United States Patent 8,067,671 (METHODS FOR GENETIC CONTROL OF PLANT PEST INFESTATION AND COMPOSITIONS THEREOF) - sequence listing, part 7

SEQ ID NO: 5304 - DNA, 4341 bp, Heterodera glycines
tttgctcgttgctatgccattagtgaatgaatgcatgcaccgacttagcagtttggtcatcgtgacagaaaggccgatcagagtgacagtgacaatgccggtaatataccgtttcctgtaaatacatttgagcatgaatgcgatggggcgggattctcgcttcacttaggatagaaatgtggaaccatagctgtgcatggggagtcagacaaggactcggaaattggtcccccgccggctatttattttgctatcgattacttttcacaaattttatccggttgggaccatttttgcttttcacctttttttgcggcgcgtttttttttaattttgaggatctggggagggggaatccggaggtgccgtttgcaaaagttttgcccataaaatgaccaaattttgtcaaaaaatttcgaatttttctgtctctagccctatcctttttatattctcgcggtgtttatattctcgcggtgcgaagaatcttgctcaaaacaaatagatcgaaatgctcaaccctttctatgctttttttctctctccttttccttgacttccgcctcgggcgatcgacgcccactgaccccatgcgatcggcgagcgacatgccacgtccactcttgcacaggagcagttcgtcccccccccctcctccgttttctccgtaattaaaaaaatttcaaacagaaattttcttcttagaaaatttatatgtatgagagattttctagaatttttgaaaaaaacttcagcgaaatgaattactgttttttccaaaaagtagctgaaaaattttcaaattcttttcttgaaaaatcttgattttggacagaggcgcaactgtcggggccgccaaagtcggacggcaaatgttgggactccccacccttgcacagctatgattggcactcgaccctacgaaatatgtcggcatgtatttgttagcaaaaggccaaaaattggcaaccagttccaataactaaaactcacagataactgatgaaatggctatgctccccaggttcgcgactttcggactcgacacccaataaatcgaagagatcaagatggtagccacagtcttggaaaattttttttttcttgaaaatttcgaggtgaaatttaaaaaaaagcaaattggtcaatgtttttgaaaattttgtacgttttttttataattgattaaaatttttcccagcggcgcctatcggcaccgcgggaccccagtgtaccattatttttttaccatttgaccccaaagtggtaaaaattgtctttttttgcgcaaaatcgctataaattcctgttttttttgtggctccagcggtgaaattttttgaaaaacaaccctggtaaaaaaatatagcccgaaaagaaaaaaaaatgccctccccgaaatttttttctggatacgtgcctggccgggccgtgtacaattttttatcggatttgagcaaaacggcccggtgatttttgtaaatacccgttgtttgactagttttggaggggtgcaccccaaaatcacaccgttagaaatttttttttaaattttcaagcttaatttttttcaaatcttaaaattttttatatgcaaatttggttaaaaaaaaattttttttggagagttttcgaaaaaagttaataatctatcataaaaaatagctgaaaatttttcaattttctttgctcttataaaaaaattataagatttttttcttgaaagaattccaagattgaaaatttttaaaaaatttctagtggtgattttgtcctgttcccttttggagagggtggacccgggaactagtttttgaaaatgccagcaccgtctggctaatttgaaattttagtgttgcttcaatattatattttcaattaccccttttcaattggtcttcccgacggttgacaatgaccgcatggatttgttggcccataaaaatgaggaggacacatgcgagaacagcaagaatcagcgtcagtggagggatccacaacgaattgccaatgaacggatgaaccaaccaaccacggccgggccaacttggctaaagacggacagtgtttttgaattaaaaaaatcatttatgcccaaaaaacaatatttgaaagttctagacatttgctagaagacatcttaaagcaaacctaaacactaaaaaaacaactcataaaattaattggttttatttggttggcaagtaaagtttggcaaaaacattggtgagctacgagcgcagcgagttgaagcaactgagacgaaatgatcacgagaaattttttccatttttaaaaaaattttccaggaaaaattaagccatttaaaagagccaaatactctttgctacaaaaaataattgggaccgactaaaaaatttttttaaattagagctatgcccctcgaaacagctccccatttttcgagaaatgcagaaaatagatcacggccataggctgaagaaataccgaacttcatttttcaacactcggaagttgcgttgaacattcaccttagttgtgttggtgcccagaaaaacgtccagcaaattcatgcacacgatagcgatcatcacttagggtagtaggaaattgaaacaaaaagtgtgataaagaaacgttttttgatcattcattaccaaatttgataaaaattctaaaacacaacgcgaatctcacccgaaaagtcactgagcacctgtcgcacgtttgacggaaagtagcagctgtttcgaacttctaagtttgggaaccaattatattataggattttctcgaattatatgcccgggtatattatttttgaacgccatcagaaagggggagataattagagacgggtagactaatggagacaggaagattgtttttcgacagttatttagtggaaaatttttgatatttatccaaaaatgtcatcgcgtcaaaaaaagcatttttattgcatttttgctaaaattttctgaattttacatgaaaaattcgaaaatgccaaaatatttacaaaaaattgataaaatcccctaataagcttaaaaataaagaaaatcatgagaattttatttccataaatttgaaatttttcgtttgataacaaagaaagtaggcactaacgaagtaaaagaaaaagttacggcctaataaactgaacgttattcattggatagcaaaagtcgattggccgtgtaaactgcagtattatctcttcatttataatgaatcatttaattcatcatgtttaacttttttcccacatgttaaatccatatgaaattatgcatatcgatagaaaaaaaaattctacgtcgataatacattttcctttttgtttatacgttagttaaagagttataaaataaaacataaaaaagtttctttttctctccttttgcgtttcgacagaaatattataaattttaggcggggacttttcgacagcaaagaatcgaaattccccaccccagtcgatggtttcttcatttttgcggtaatttgccttttcttttttccctttcctttgccaatcttccaatttgagccgaaattctcacccccgctttgatgggacaaattcgacgaacgatggggcaaagccgaagataagcgaagagaaaaagataaaggaaaggcaacaaatgattaagaggtggcaaacagtacgtttacaggaacagtcgaagttgccagaaggcaattttcaaaaattacgaagaaaaatgaatggagtggggagggggagggaaggaaatgtaaaacaaagtgatcgaaaggcagaagggaaaataaaaatgatcgaaaaacagaaggggaaggcaaaagccaaactaacagatcggaaagagggagggaatgggaaggaccaaaaaataagagtgaggcgatcagttagtttgaagaaaaataaattttataaggaaactagcggggtcagcgccttcggcgcatcccccgctaggcagtacgattgtgttatagaattatgaatgataaaatcgactggctcggccgcttcgcgccctcgcatcattttcttggcttttctccaatctctgggactcaacccaccagcaattcaatctctgggactcaattctccggcattccaaacactgggactcaacccactcaaatctccgacattccaatcactgggactaaacccaacagcatttcaatctctgggactcaaatctccggcattacaaacactgggactcaacccaccagcatttcaatcactgggactcaacccaccagcatttcaatcactgggactcaacccaccaacatttcaatcactgggactcaacccaccagcatttcaatcactgggactcaacc

SEQ ID NO: 5305 - DNA, 2328 bp, Heterodera glycines
cccccccaacaattttttgcgccaatccaccatcatttaatcactgggactcaacccaccaacattccaatcaacgggactcaaccctccagcatttcaatcaacgggactcaatctcatcaatccttcagcaacacaattaccgggactcagttctccgacatttcaatcaccggaactcaacctcagcaacggaatacagaactatttaaaaggaatccagaaattgaaatataacccataaatcaaaacactatggtgtacatttatattgcttttttatccatcaaaggatttttctttcattttttattactatcataacatgctttttattcaaaacaaatatcaaaaaccaaatcagattcttttcatattataagcaaggaaaagtacaaaaaacttttttaagtaacaaacctttttcattcaaacgaattctaatgaatttttttaatcaaacaattctccattatcgtttacataagcaaaacaaaagctttcacatcaaaatggaaatcaattaacaaaaacgaaaatttagacaaaaaataataataacagcaaaaccacaaattttttcttacacacaataacagaaccttcatataccggattttccactcaaacaaacacaaaaatgtgctcattattttattaattattttatataataaaagatgggttataaataaggaagggatgcgagacaaatttcccattatctctccctttcctttcttttactctcttttcttttccattgcaatttactctctttttttcccactccctccttctcccacacacacgcacgcgtccaacagactgctgctgcacagcagcacgcgtctgttcactgtctgcccctcccacccgccgctgcccgcatagacagacagtcagtcatacagtgcactatttcccaccatccctccctctaacctctacatcctaggaggagaaatcttttaccttctttttctgtgctatttcttttgccttcttcttcttcttaactatttattttcgtctcttttctttatattctcttctttttcaaaacaatttcttttcatctcttttcaaactcatttttaacgcaaaactcaaacaaaacgccacactaattcaaacagtgacacatacagagaatcaactttattatataagataaattataattaaatgccatccattgtccctttaggtccgtcccgttccaaatcaaatggcatcggtaagtttttatttcgtttaccgccaccacttttcctccatttgtcggccataataccataatattgaataaaattcattccagtaaaattaatcttttggattctgttccttctttctcagattcaatactttctcataaagatttcttttaaatatttttaaagatttttgttgaaaaaactgttagtttattattactagggcttctttttttaggcaaatgcctgaaattttgcgcacttgatacgcaaagataagcatgaaaacgcattttccgcttggtttgggatgtctacgatgacttttataatgcttatttttcctatttcggggtttttgtgcctaaggtgcctattttagggtttttgaaaaaatccttaacaaaaatgcaataaaacaaaaaacacacccctaagaatgaaccaaaaaaaatttcagaaaatacacccctaaaaattgaaaaaaattttcaaaaaatgatcccaaaatttattttatttaaaactaagttcttaccagtgcatttttactcccgtttttggttaaaaatttccgggagcgggatcgagagttcaaaattttccgggacgggagtcccgaacgggaatcccgtaaaaatcccgctcccgttaaaaatccagttcaccgaaaaaagcgggagtcgggagccggactcccgaaaatcccgcgggagtcccgatcccgccggtctctaatcaaaacccttaaaaattgtggtgacttttattttaattgtttactcaaattaattgttttcattgggcagaaataaatcacaaagttttttgtccgcttttattaattgccaatcgtaaaagggcatttcaaacgacaaaaaaagggtccggaaaatgccacctaattcggcaaaaggggcgggccgtaaagcctcgtaaaatcctgaaaattaatttaatcaagtaggcaaatttaatagtcgtagaattggccgaaataaaaaatgaattagcatttaacaccttttttcaaaatttggggatggggacgccgataaaccaacggaaaaatggcgaagatttggaggccgcggcaacggattttcaa

SEQ ID NO: 5306 - DNA, 1301 bp, Heterodera glycines
cgcattttcccgcttggtttgggaatttttcgaaaacttttataattcttatttttgttatctcggggttctttttcgtaaggtccctattttcgggttttgaaaaaattctcaacaaaacatcaattaacaaaaaaacacacccctaagaatgaataaaaaaaatttcagaaaatacacccctaaaaattgaaaaaaattttcaaaaaatgatcccaaaatttattttatttaaaactaagttcttaccagtgcatttttactcccgtttttggttaaaaatttccgggacgggagtcccgaacgggaatcccgtaaaaatcccgctcccgttaaaaatccagttcaccgaaaaaagcgggagtcgggagccggactcccgaaaatcccgcgggagtcccgatcccgccggtctctaatcaaaacccttaaaaattgtggtgacttttattttaattgttttcattgggcagaaataaatcacaaagttttttgtccgcttttattaattgccaatcgtaaaagggcatttcaaacgataaaaaaagggtccggaaaatgccacctaattcggcaaaaggggcgggccgtaaagcctcgtaaaatcctaaattaatttaatcaagtaggcaaatttaatagtcgtagaattggcagaaataaaaaatgaattagcatttaataacacctttttcaaaatttggggatggggacgccgataaaccaacggaaaagtgtcgaagatttggaggccgcggcaacggattttcaatggaattggcgacgaaagatgaacatgatcaatcagaaaaaccttctcaaaacattttttgtaatttatacaccgctggacacattacaaatcgtaacatttagaattataaatattttatttcctttttatctgttttagagaatatcattttatgataccagtgcatattttctataatccactagcagttattttgaattttctgtttgtttgtcagggcacagatttttatgttttaggtgggttttctatgcgcgggaggaagtttgggcaccagaaatttggacaccgggaagtttgggcactaaattaaggatttatatattttaattgtctaattgcaaccatctaatttaaaattttaactaaattaggaatcgaaagtttttgaacgaatatccgctcaattaaccatgcttattttgctatactcattacaatttattctatatcaatctcatattaactattatttgtatcattacaagattcagtttgttcaagatttaaaatttataaatttaaa

SEQ ID NO: 5307 - DNA, 5454 bp, Heterodera glycines
  misc_feature (89)..(89): n is a, c, g, or t
  misc_feature (105)..(105): n is a, c, g, or t
  misc_feature (117)..(117): n is a, c, g, or t
  misc_feature (5446)..(5446): n is a, c, g, or t
tactgataatatcctgttcaccccctttctcacacaatgttcatttcgtacaatactgaacatgcatgaagatatttgcaccttctcgntcagcagctgaaattngagcggattttnagaaggaggcgaaatttatcgatcgtcaattaggggaccactgttgggccagtcataattacgaacgacaaaacggacgacaaatttagcacattttctcagaacatgtcgttacgacaaaaacaaattatcgtttatcgtccaaatacatatacagttttgccatttgtcattcgtaattatgattggcctctgctgaacttacgactaaacatgcatttgccctccccgcaatagtcttcttctggttcgcaattctttgtgcgtggaatgggaagtcggagaagaattcgattgacttccatgctgttacttcaaaatgctcattaatcaattactgtttgactgtttgtttgggtattttttttattgaaaattgctttctcaattaaaatatgcataattccattcaaaaatgacctttcaataatccatgttttttactttgaattttggttttttttctcttttttactatttttatattgtaatcttataaaacactcaactgaaaatattgcatggttcacaaacagtatgaatggcgtaatacattttttcttcctaattatttttctaattcagagttgtgactcgaaatttttaaaaactcatttggatagtaaaaaatctttgtgcaaaaataaacaattcaaaaacttattttagtacaaaaaaactcatcgttattaaggatgatgttatgtccgaagataacaaattaaataagtttatttgccgaagaaataaataaataaaaatgcagaaataaattggagaggtcaaattggtgggcacaataacaactgaatgaggggaatgggagggtgaagatggcgaagtggcgtggggtcatacacctaatcaataattacttccttctctaacacctcccctcttaaattcgaaacccgaaggtttaagcctaaatttttcatcctggagaataaaattggcgcggctttttaactcgggttgatcggcggataaccaatggtgaattggccggctgattttgttggggcggatgaggcggttcgacaaccggcggtggctcttcgatttgaggtgcctccttttcggcttcttcttccaaaagatggcgtcgccttagctgattcgcgtgccgatgaacgagtctacgcagaacaggcacataaacacgatatgtgggcgatttgtgaagcctctcaacaacttttccttgcagccattccgtcttgttgtttcgataattgatcagaagaacatgatcatttggaaagaaattgatcagttttgatccatgcttccgatcaaaattttgagccattttgtcggtgtattttgattgtccctttttgaatgagttttgatcaaaattttcggctttttctccattcggatgaacgagcgacaatttcgtgcgcaattttctgccgaaaaataattgatcgggtgaaaagccatttaaggcaacgtggggagtggttctgtaggagaacagcatcttttcgatccaatcctttccacctttggacattttcttcatcgatcgcttgaaggtgtcaacgaatcgttccacttggccattcgattgtgggtgaaatggcggtgtgaaaatgtgcttgattccaaattctttacagaatgtggcgaattcggcggatcgaaattgggtcccgttgtcggaaacaatttcctctgggattccgagccgataaatgattgatcggagaacaaatacggtggcataagcagaaattgtattcatacgatagacttctggccactttgaaaatgagtcgatcaaaatcaaatattggtgaccgtctgagcaggggccagcaaaatcgatgtggactcgctgaaacactttgtccgtcgttggccatggcgaaagaggcgctttggtcgggtttttctggcccagttggcactcttcgcacgtgctcacaactttttcaatcgccgagtccattcctggccaatacacgtgacgtcgagcaagtgctttcatgcgcacaatgcctgggtgagcgatgtgcaatgccttaaggatgcgactgcgaagcgaagttgggacgatcacacggtcctcatacagtaggcaattgtccacttcaaaaattttgtccctttttggaaaatatggactgatttcagattcggtgactttggttggccatccgtttcttaaaaattgaagaaccatttggagtggttgatcattggccatggctgaagaaatttcggtggttgtcactgggatttgatcgattctgttttcgaaaacagaatttatgaagcaatctgtatcagcacagatgtttgctatcaggatgtcttcctctggacgcggataattagcaatgagccgggacaaaacgtcggcttggccaaatgatgtggtgttgacgtagcgaatttcaaagtcgtaattcgccaaaatcattgaccagcgttgcaggcggctcgcggcataaatcgggatgccctttttagagccaaaaatagccaataaaggtttgtggtccgtttgtaaaataaattttcggccgtacaccatgcggtgaaatttttgaacggcaaacacaatggccagtgcctctttctcaatttggctgtaattttgttgcgctgctgtcaatgtgcatgctgcgtgttctaccactttttcctttttgtcggggaatgtgtggcttaatgtggcgccgattccatctttggacgcatctgctgatacgacgattgggcgtgccgggtcgtagtgggtcagcaataaatcggatgtaatcatttcttttgctttttcaaaagcattttgctgttcagaagtccaattccaagctacgtccttttggaggagtcggtcgagcggtgcacgcaactcacgcatgcatttgacaaatctgccataataattcaaagcgcctaaaaatgatcggagggtgcttttgtcgatcggtgcgggcattttccgaattgcgtccgaacgcgatgggtcaggacgaatgccatttgctgacacaatatgcccaaggaacaaaagttcgggctgcaaaaatttgcatttgtccagttggatgcgaagaccatattcttttatgcgtccaaaaagagtgtacagtgccgtgatgtgttgatcaagcgtttttgtggcgattaatccatcgtcaagatacgcgaatacacctgggataccggcacaaatttggtccatcaaatgctgaaatattgccggtgccgatttgactccgaacggcaggcgttggcattggaaaagccctcgatgtgtgttgatcgcacacaattgcttggattcttcatccatttccatttgcaaatacgcatcgcgtaaatccaaatttgagaaaaattttgcgccattcagtgaggcgtaaatgtcgtccggccttggcaatggatggcggttcaattccagtgcgttgttgaggccagttgagaagtcgatgcagactctcgttttgccgttcttcttttttacggctaagataggcgctgcccaatgactgaaatcgattggcttaattgcgccaatttgaagaaggcgatccaattcggcattcacagcttccatggcgccatgtggaattgggcgagctcggcaaaatacaggctttgcatcagaccgcaaaatgagatgcgcctttgcctttgagcagtgtcctagtccttcttcaaaaacttccgggaaatctttttggagtgccgctttaagcgttgacacatcattgatcgatttgtttggcggcttcactgccgaaaaattttcaatcattgtcgcctgatcagccgatttgctggacggaaataaaatttggcggggaatgatctccaaagcttcgatccacggcaatcccaataaattgtgtccgacttctccgctcacataggcgatcagagtttgcggtggtttgtcggaaaattggacggtgcagatgaatttgccaagcaaggcgaatggctggtcattgcagtttttggcatcgatgtcggatggcgtcaaattcggttctcccaactctcgccatgtttgcaatgaaataattgtggcctgagcgccggtgtcgccattcatggaagtttgccttccattaatcaaaatgcataatttccaccaccgtccttgagtcgtgccgacatgcagacaatttgcgtcgactttgacagtgtgaaatgccctgtggttgttcggtgccgcctttgctttcttttgccggcaaattgttgaaatgtgtccttttttgttgcacttaaggcaaatggcgtccttgaatgtgcagtcggagcgccaatggtcggatttgccacatgatccgcatggatgcgtcggttgaccacgcgttggctttccgcttgaattggcatttggagtttgcctttgattggagccgccgctttgtctttgcgctgggtcggcccattgccgtggccttgtgcgaatggcgtttgtggcaattggtgggttgaccagcgaaagggcgctctccttgacaagctgaattgcccgaagttcctcctcaattttcttgagcgaaatgttggtgccatttttctgagcgtcctccaacattttcagtgccttttgtcgcaaatcgtgatgttcatcgttgagcgcgatgatcaaaataatgcacttgagttgttcctttgtcagactcagatcggcattttcacatgatgcgttgatctgcgcaattagtgatgaaacatcttgtccttgttgctgtcgaattttgaaacactcgtagcgacggacgaacagcgagcgggtttcagcaaaaaggcttttgaggtgtgaaatcgtttcgttccaattcacttggtcgggctgcgttgggctgatcgtgtcccgatatttgctgtactcctcctctccgagtttgccgaggagaagtcgcacttttgaagcctctggcagagtgcttccatcctcttcgatcaatttgccataccgtttgaaccagcattcaaaggtagtgccgacctcgggattgtaatggaatgacgatatgcgagcatcgatagagcttgccaaattggcattgctcaaatttgcaggtgcggcgttttgtggtgcggcattagtgaccatttgttggagcgcatttagcaattgttgaagctgttgtgcgtccatggccaaatgaagagaactgcacacggcagactttaatctcacacggagagaaaagtttttgaagatctgcgaaaattagaaatcagcacgagatttctaattttccctcttgagcaatatcaacacgagataaagctcggaattgttgttgccaggtgatgtgcagttgattgctgactgcgccanaaatttgt

SEQ ID NO: 5308 - DNA, 2188 bp, Heterodera glycines
cgttaacactaacactacttttgtcaagagttctatcctggttgacttttttttaattaatttttttttgtgattaatagggtttttaaacaaaaatacccataaaaattggtcatcattggcaaaatttaaaaacaatttttctttcgttgaaattaaaaagtttaatttttcttgactaaatcatgaaaagtaaatatttttcaaaatatttttgacaaaatataaaaaaataaataaaaatttcaaggaaattcataaattttttggtgaaaatctcttagaaaataaagtttaaatttaaaattcgcccggcgctgcctatcggcatcgccggcaccccaaaaaacctaaaaatattgctcaaaatcgaaaaaatttataatttttggacaaaatctgttagagatctatccaaattttcaaaatttttcccggcggcgtctatcggcaccgcagcaccgccggacccctttctcctaaaattctttagaaacgcgccgcaaaaaatgatttgaaaaacaaaaaacttttcgggaacaagggtccggcagtgtcagtaagcgccgccgcgaaaaatttttgaaaattagagaattagaatgcattttttaacagattttcaccaaaaataaccaattttttcgactttgagcaaatttttttaaggaaaaagaagttttgggggcccggccccggatgaaaaatttgaaattttgacaatttttacagattttcattgaaaattgttcatttaaaaatgccttatcgttttaattaattctatacaaaaatatttatgataaaaagaaataaaaaagtacataaaattattattatgaataataaaaattttaagctaagataataaaaaaaaatttgactttatggtataaggcaaaaattgaaaaaccccgaccccgagcgatttggtcgactccgaccccaaccccgacgcttccaaccccgacgcttctccccgacggtcggggacgcaaccctagtgcccattgtcgctgccggggaaatttggaccaatttttagtcaacagagtgaaacaaaagtcgggacttggtcgggtacccaaacccgttaaataactccaactctgtttatttgctaaaggagccacaaaatgtatttgttgccacagtatgactcacaaatcagtgttttaatttgaaatgtttttgttttgatcttttgattttcttttaaattatgccattaatctgttgcaaatttcttttttattctttttccattcgatgccaaattaatgaatgcattggccaacataaatttcgaatggtttctcttttttgttccttctcttctcctcttgtccatttcaaatgcttaagcagcgacgcgagagcggcgagcaaaaacgcttgtgcgaggggggcaaggacagtaggcaccgtcgtggccgggctgtccagcttggccgggctgcccgggggttcctggggccccggcgtttccgggttggccagggcttccggaaggaccgggcggtccttgtcctccggggtttccgggctgtccggggctgccgggctggcccggtgctcctgggtttccgggaggtccaggtgggccgggaattgtcgtgctgaacaaaaacattcaataatttttattggctgagttcgattctctcgccttttgattcctggttgtccgggttgaccgggctggccaggtcctcctggttgtccgggttggccaggctgtccctgaggacccggtgtggctagggggatggatttatgaaaccgatcgtggacgatttttgtttagctaaggtaatctttcgcgttattgcattttgtactaatattagggatacgccatatgaggtggagattgttttttttctacatagggatagtatgaaactttttttttctaaatttctcattaaatgatttttgcgtcaccccttgtcaatcattttgatatcgacccagcacctatgtatacatatcccgttcttaggaaataatgtacataagtagaagctaataacccattgaaggttacccgcagagccccaaacaccaaatactggtcgcatttgtggcttgatcattcgtgctaatatttcctaactcttttttagatataaatgcactttgaaagtatccgtttgtctcgaaaaatagcggctttactttcgca

SEQ ID NO: 5309 - DNA, 3478 bp, Heterodera glycines
tgatttgagtgtacagttgcgggatcaccacgagagtgcccaaatcgcggccagcgaacaaagggaagcaattccgactataattttcgcttcgtgcattttctttcctgaaatttgacttctgttgcggagggtttagcagaagaagcagtgaattatgttctgttttcaaattgctgcgctatgaatagtgagtgaatgaatgctttccaccgaatttcgtctctcttttatacgccctttctgaggcggacccatcagaaagaacgtgctttccctttttttcctttttcgtgtcgtgcaaacgtttcgggacttttcagcccctcaattattatcggagctgcgctgattgtgcgcatgagcagcgaccgaagcttcgctgttcttccctaattaggaggcaaagagaagagaagcgaattccgccagcggagtcagtcgcccttccccgcctcgtaaaaatgaggacgggttgtcaacgatgctttgtctcccaaggacattttgcagactgtttgcccacgggcaaaaactaattatttttggagaaacgacaaattggagaaggaatcatttggcggttgctgatcacattgaaaaaagaaaattcaggaaggaattgagagacgagagggattgagagagagagagagagagagaaggaggggtgattagtcattgaaacagccaaacaaccgtcagccaattaattacattctgctaatgattggctaatgatagcactcccaactgtgatgacagagtaaacctgtctttaacattcgatgcatgttttgtaaaggtatgttgggccataagctttgatcatttagtgtgatatgccttgcatgatttataattttgctcagtatttttgatagaaaaatttttattctgttgattctgaataccgaatgtgttatgtaattgaataataattaattcaataattaattgctttttcataccaattttttaaattttaaattggatccgatgcctaaagtctctctccgatccgatcgaaagcttctgtattcctggtacataggtatgtataaatagcattaaactgttcaacatttaaaaatataataatccaataactgctgaagagtgtttccctctcatggccacccgtttctttcgtttcaattttggcacttttgtggcgctgatacattccgccaaacttcgttgtctgtcacaacgaaatctgtccaaggaaatatttaagttaagatgtttctgctgctatttgtccgccactgttcgtaccggtgataataagtaacattttgcgacttgaagcatctgtgcaccgtgccgcccatcatcacgtcgtggcccaattcgatgaaaagtccgccgtcgtcgacgcatccttggccaattgcccttttaaaaacacgacctttgccgctgcccggcattactcacccaacactttcttctggccctcctccgtgcagtggtagcggatgtgcttgtccgcccatgtttggcccggcttgaactccccttcggtgccattttgcccttggcagcccaacactacgccaaacactccttttgttggccattccccaaactcacactcacttctgatcacatagcgaaccttgccgctttcagaaacttcgcagctgtgccttttcgtcccaattaaacgcgactcacccaaaagaattgcgtcgtccgttgaatttaacagaaaacacccttaggggccttttgatcgaattgctcaaaagggcatcattaccgacaacagcaactcccgtgtctttacaagtcactttgaaagagccgtttttgaaagtgtcgccttaaaagtgccaattttgggaagggaacgattcccttcacataccaacgtcataataaatgctattttcgaagcaagtcgacccttaattgttataatttgtgctataatgtgtcatttgctctgaagacaaactctgttcgtaaagtgccgtgttgccactcaccaaacatttgtgccttgtcccattccgaagaaaagtgcgcccgatttgaatgactgacatatcctcggcaatgcaagctgaccaaggcggacaacctttcggacaacaccaaaatacccaccaatgacctcggctgtgccatttttgcactcgtagtgaaagttgcccttggtgaaagtttgtccgtgctcaaaaatgccgacgccggtgatcaaacatggcaatggcggctgcagcccgtccttggctgaagtgaagtgacttatgaccaaagcgtcgacatttgttggaccaccgaccctgtgggatgaccactttgtcttgggaactgttcgggtcgtcccctcgggcaaccaaaatgatcactccctgaccatccgccgacgaattgagacgatcggcacaatggcaaacggatatgaccagaaataatggcaaaaagatggaaaacaatggaaaagagtggtgaaactggtgataagacaatgccatgggaagaaagaattgtgacggaaaaggcgctgcgtttgattaacaattggcagtggcgggggggggagggaatcgtcgtaacggccgacaaattttggggaatgagaaatggagaagaaagaatgaatgaccttcaatccaattcattccaaatgcatttctttgatgaaagcgaaaacaattcagcagcactttagcagccaaaagtgaggaaacaaatcaaagagagcgatggccgagaaaagctaattagccgttaaacagttttaatgaggtcgacaatgttcgggcgaagaaatgacggcccgtggataatttggaatggattggacagagcacaaaagcacagacattcatcaattgtccgatttaaccctctgttaaagtgaaatctgattaagattacttatgtaaatgaagtgtttttgacatcccccaccatcccattctttactcccccccccccctcacttctttagtcgcccaccctctccgtcccctctcctctccctcccctctttttcccctcgcccttccctttctttcccattacccctctccaattctcttcacaaaatccatccttcctcgctttccttggtccatccgttcactttattcattctttcatctcctttttttcatttattttataatttctctttccaaaattaaaatttatttaataatataaatgaaaatatccatttaaatttgctttttatttgtaagtttaattcaaaaaacacatggaatcggtaaaaatcaccgagtcattggcttataagggtaaaaaagagaagaaataccattttatgtgcattaggttcgattttcagtgaaagagacaagtggaaacgacacttttgtcgcttggaaggcgaagggttgcgcggtgttatgggaccaggaaatgctgcgcttggaattggacggcacggcgaaggagcggaggttgggcagaagaagcacagacaaagccaaagcgg

SEQ ID NO: 5310 - DNA, 1329 bp, Heterodera glycines
ctgagccgaagaaagggtaatggggcgccgagagatgctgtgcagccgaggaagacggacaagttcagaaaggaggtgttagtgccaaagaaatgcatcgtgcacgtaatcggaaatggtggtgagaacatccgccatttgcaggtgccgagaggcccaattcgtacagcgaaaagcattcattcaggagaaattcggggtcaaaatgcactttttgggcaacaattatttggagtacccaaacggacgcactttggccataattggggacacggaggagaaggtggaaagtgcgcgggaccacgtggacagggaattcattttgaagagatgggaggcgagtgaccgacggacggacagaccgccgaacattttgggcaattttaaggcatggaacacgggccaacacgacaatgttgaggaagaagcgacgacctacgaagaaatttaccaattgtcaccgaaattcgcactgcgcgaggacctcgaattggtgatgaagcaaattaaggtgtgcccggcaaattataagcaaataaaacgccacaaacacttgaggaccaatccggcatcgtctcctattgctaccgccaattcagcacgggccatcgtccgattattctcagagggactgaacaggcagtggcggaagcgatcaaaatactcaaaaagatggagcaggaatggccacaacagcgcacaatgggcaacagccgagcgagaagtctggacgaaatctcaatcacttcggtaaaatgggaattaattattgaaaaataaattaataacaacccaaaaatgggttgaggagaacgataaacaaatgaaaactttcagttcgtcgagtcaatttcaaagcttaaaatttcgaaaacatccgaagaagcggcgaacaatggcgaagcaaagaggaaagaagcgcaaaagggcgccaaagggacgaaaagtggcggaaaaacggcgccagggggaggaaaaggtggaaaataaaataataggacagaatggcatttggggttattaacggaatcgcatttggatttattattaattgccagaagcaatgaatggcgacagcggagaaaatggcaaagacaccgacgaagccgaaaaagaaggcaacctgaacagatcggcaagttggcagaaagagaggcgcaggaaggaaaggtgaggaggcggagaagagaaaaaaacaacgaaaataattgggaggaaacggcggggggcgggggggggggtgaagcgcacccattaattaaactttcaattaacacttaaaataaattttcattctaagcgatagcattgccaacactttgatgggaa

SEQ ID NO: 5311 - DNA, 2459 bp, Heterodera glycines
  misc_feature (82)..(82): n is a, c, g, or t
gaaaacggacggaggaatagagattgagagagattggatctttttgaatttgaccaaaaatcgggtcactttttgctgtttngagacgattcgccgccgccgcctccgtcgccgacaaaaaggacggacggacgcacacatttgggaaatgtttgtgaaaaaaaatttttttttttttttgatttaattaaattagcaaattcggggaaaacggtaggaaaatggaaaacgaaaattgggaaaaatgggggaaggggaagaaaaaacaattaaatagttaatttaaataatttgaccaaaatgatggattgattgataatcacagatttcagaggaggaaatgtatgattagaagagaagcgagtgatgtgatcttttttgggctttaggtcatttatgagcagcagggctattgttagtgtgtggaccagggggacctggattttcagactttttatgccggaaaacgggtctgagtttttgatgaaaatttcattaaatttctattcaaaaatatgcccaaaatttggtcactcacattaggcaaatggtgatcgatcgttcaataaagagcgtgccaatttggctttacttgatcagagaaaagtgatcaattctttgccaaataaaaaaatggacaggggaaggggaagattttgtcacaatttaaaaaagcttattcaaaattactagaaattttcaaagaattaccaaaaatttttgtcatttcctttgaatacatgtgccccaccaatgtattatttgactgatcagagaggatgaaatgaataaaggattttgtgatcagcagaagaaagacgaagtagaaaactgattatattatatgtaggtatgtgccaatgaggtgatatataaaaagacggatttgatcaaaaaaagctatagaattgattttggcacattgaccgatcagacagcagagagtgctttgatcttgatcgatcagtattcgtgccaatgatcatcagaaccgaattcggccctctgcttctgatccggtcatcaaaaacgcgactctttccgcgctctgccgccaccaccggcgccgtgccgcgcgcgttggtgccgctccagcgtccgcgtgccgctgaacagctcgtccagctgatggctgcgcattgccgcaccgctcgccatggtcgcggccgcggcgggacgaggcgcgggcggagcggcgatcgcagcggcagccgagtccgcgtcgctgtccagcgacgatgatgacgaggacaacgcgtacccagagcggttggccggtgcggagaggcgctaataaattaaaaaatgaattaaatatttcgaaaggccattaatttttttttttgaaagagccattttgttaaaaatttctcaaaatttcaaaaatttaaattttgaaattcttagaaaatgacgcctgagggtagtataataatttaaaaaaaccttcccttgaaaaattcgaaaatatgagctttactagttagtagtcatctaatttaaaataaaatttctttcttttccgtctcccactttgttaggcgcagctgcggcgccagcgccgttcgccaagccagcgccgtaaatggactcccgtcgacgctccagcgcctgcaatgtacgacggttgagcgtcatggacgtctaaaatttttcgaaaaaaaatgttggattgggtttggatatattggattaattagttatggatttattgggcatggatgaataggacttggatgaatttcacctgtatttgacgccgttttgcgccgcccccactgccaccgcttgtggtcgcgtgccgttgcgcggccgccgccatcatggcaccgatgccatccccggcaccatcatcgcccgccgacagcgcgaagaagcggcgccgaaatgctgcgtccagcgtgtccatgcggcgctgctccgtcccggcgcccccacctctacggccagcagcagcagccgcagacgcaacgccaacgcccgctggcggcacagacgctgctgccggcatgcccgctgcgtcgccgttcgctcgtccgctgttccgctgcggcgaagctggaggggttgtaagatagcgcggacaagcttatatacagtaaacaatacagtatgaccattaggtaaaaatagtaattaaattttgattgtattgcaagttgaccagttgccaagcacagtgaacagaaaaatggaatgcggtgagaaaatgccatccttttgaatcagcaacgatgtgacaaaccgcaacaggtgtctgaaaaaaataattagaaaaaaaaaattaaattaaaaaaaaattaattctattcaaaaaaataaaaatttaaaaattgatttccataatattaaaaccattaaataataaaaatttaaataaaattctggtgtggttattaaatattataccagttaaaaaatcttaaatttaatttaaaatgaattttaaatgaaaattt

SEQ ID NO: 5312 - DNA, 2632 bp, Heterodera glycines
actcgtccagcccaatttgcatccgttcaacctcctgtgagtccaggttaataggcctaaggtaccttgaaaattttgaatttttttttttggaatttctatgccataaaattagtagtacttgttgatcatctcgcgccagaatgatgcctcgtccgggtcaagataaacggtgtcgaactgcttgaacggctcctcctccatccaatttggcgagtccattcgctaacaaaagtaaaaatttttttaaatcgaatatttttaattagtcccacaacttagtaattttttaaggtttttgtgccaaatataaaaatcgctaaataaaatttaataaatcaaaaacttaactaggctaaattttgaaaaatttttctgttaaattaaaaaaactgagaaattaaggcccgttatttacgtcgccggagaaaaatttcaaattttacatatttattaaaaaattttaatttttcattgagggagaccatccaaagagttacatgtgcttacaattagcacaacaaagataagaccaatagtcagcgccggatttatggctccgctatgttttggcgccaaaagttcaacgcttagttgtccaattacacttgttgaacaaacgtacttgttgttgggcttgtggcgcccgttgatcaacaagaccaacgccaaccgctgcagttggttctggtactgattggtcggctcgctgctgctgggcgctggcgacagcgcccaattcactggcgccacagtctccgccgtcccggcgccgctcaagactagccaatttacgctcaatttgttgaagtccctcgtcgagccggcgcactgcggtggtggcatgggatgacgcgttggcgccgccggcgccgaacgcgtgccgcacgcagcagacgacgcggcacaaattgccgcagcccagcgacacttcgccatcctccggcgcctaattttatttttaaatttaattgagaaacaaaaaatttataagatttttaaattatctaagtaaaaatatttatttatccgaaatggaaaagaaatttatttaattaaataattgaataaaataaatatttactttaatatttgaataaaatatcaaatattaaaagcaaatttaatgcataataaataaataaataagaaattaaaaataaatattttagtgttaaatattaatcaacaaaaaatatttttaaaaatagtattcagaaaattacaaaaaagacataaagattttcaaataatataaattaatattaataaataaaaacatgttatttcatctcgaaatttaatttaaataaaatttgatccatcaaaaatttttgtgccccaaataatttaatttgttaaaaaaataaatttaataaaaaattaagaggcatctaaaacgttgtcttagccaacaatacattatgatgtgtgccgttgtggtggtgatgttcgcccgaatttgtgctgctgatcggattttcacgtgtgccccagctgacggtgttcagattgcacaacgaataaatgggcaacagcatatacctggaaaatttcggaaaattttttttgaaatttttgaaaaacactcggtcagttacatgctcgggatggccaagaagtacagtgcacctgacgggaggtgtttaatgttttgacaaaatgtaattaattgagctgctactgatgctagtcgagagtgtaaaaaaaaaaaaaatttttttgccaaagctcgaaaaacgaaaatttgaccgtgaggttcgaagccgagagcctcccccccccccctatcaaaaaaaatccatgaaatttcttgaccatgaaaaatgcttatgaccaactaactatcaatatgtcttagattttccaaaaaaatttttttagtttttgtttgtaaatttataattaatttgggtcttacaattagtattttttttttggttttagttttacaaaaatttttagttttttggaatttataatttttttcgtcttctttttatataaaaaaaaacattttttgtctgagtttttccaaaattttagtttttcgcttttaaaaatttttttgactttttaattggtttttcctggtttttttatatcaaaaatttattagtgaccatccccaaatgcgttctaaaatgaattttcaaggccaaacatggaatcacacagccaaactcgagcggatgtaacagagcggcgacaaacctatatacagtaaacaatacagtatgacattaggtaaaaatagtaattaaattttgaatttattgcaaattgaccagctgccaagcacagtgaacagaaaaatggaatgcggtgagagaatgccatccttttgaatctgcaacgatgtgccaaccgcaacagctgtctgaaaataataattagaaaaaaaaattaaattaaaaaaaaattaaatctattcaaaaatatagaaatttagaaattgatttcaataatattaaaacaattaaataataataattttaaataaaattctgttgtgtttattaaatattataccagttaaaaaatcataaattaatttagaaatgaattttaaatgaaaatttaattatatatagcaaaaaaataaaataaaatatgtatgataatctttaaa

SEQ ID NO: 5313 - DNA, 1831 bp, Heterodera glycines
taataattttaaataaaattctgttgtgtttattaaatctacctcagttaaaaaatcataaatttaatttagaaatgaattttaaatgaaaatttaattatagtttcttcaaaaaaataaaataaaatatgtatgataatctttaaaagaaaaacatttatattgttgaaaatgatcagcatttataattgaattaaaataaaatattatttttaattgcgaatgtttttttattttttcaaatgaaaaacaaacaataatttataaaaaatattctatgtgaatgttttattaacttaaaaatagcgtaaaaatagtagttttagttttataaaactaattgggcagcatctctaaaagcaaatatttatatttgtttgaaaaattatcaaccttaatatagttaataattataattaattaaacaaataataaaaaatgtattaatttttttttttggttgttatccttgcatagagaacattttttattaaacaataatttttttttaaattatctggataactaaaaatattataaaaaaataaaataaaaattattaatttcaattgtataaaattatttttggcaccattagcatggcgaagagggcgccaatgatttgtgccatcaacaattgcttgtccgttgaacaggtcaagcaacaaatgcagaagcacagcacgggcgtggtgaccacgagcagtgcaaggcgtgtgtcaatgttgaaagagatggaaatggcaccgaccacctcgaaaaagttggcaaaaattttttaaaaaatttaaaccaatcccacgaaaccctcgctattcagagtaaagatttttataatttttagaaaatcgttggaaattttaagcgaggcccgcaccattccctagtcagagtataatttttagaaatttaagtgaggcccccaaatctctcatcagagccaagatttttagaaatccttgaaaattttaatggacgcccttcaaacaacccgttttagaaatttaatgaatcaaatcctgtggaaattactacaacaatttttaaaaggaacattaaattaaaaaaaatcaaaaaaaaaaaataaataaaattgttaattaaaaggaccattaaaaagatggtgcctggcccgagcacagaagagaacaacatcaccaattgataggcaatatacctaaaataattgcattagttaattcattttatttaatatattaattggtattgattataccgtatatgctctaattatagcccatgggggattatttttcaacctcctcagaaaaggggggataattagagactgggggattatgatagagggattctttttcaaaacacctcgtagactgggggataattggagactgcgggattaatagagactgggctataattagagcatatacggtatgcatttttgtttgttctttttgaaaatttagtcatgatctcgtggattttgaaaaacatatgttgtttagcaacggttgagggtgggttgttgtaaaagaggcaagtttttggtaaaattaaaaacaaaatttcattaaaattccaattttataattcatactatcttttttcccccaattttttttgacgtaattctcatcagttaattttattttaatttctttttattttcgctataaaattggattaaataaaaatttgttggattaaataattcaaattttctaaaaaaaaaaatttaattaaaaacccaccaaattgtgacggattcgttcactttgaccacatttcggtagtcccggagcagagggatgatgttggccattgttgaaggtatccaccgccggcg

SEQ ID NO: 5314 - DNA, 1446 bp, Heterodera glycines
ggcagggtctttaattcctttttaaacagtccaaaatgtttaggcttaactttttttttcagaaacttatcagaagcgccccaaacttcgcagggataccgaaaggaaaagaattaacctgttttatcacattagcttgtcatcagtttttataaaaaattttcaaaattctcgagtctcctattattttatttttttttcaaaattttgaagggcgggggggggggcgggtgatctgaatttatgagtgagcgtatacagaagatgttgatgacatactttaaatggcattttacgcggaagtgaaaaggtaaaaatgatcgggctataatgaaactaatcagtgatcagaggaaaatcaccgaacaaaaaagtgatcaacctgcgagaaaatgtgattagcggagttttcatctgaaattaaattattagactcgtaattacaaaaaattcagagatcgcttccggatttcatatttttatccggcaaattttatagtaaatttatttctctttttaaataaagcagaatacatacgttttgtttccatttataaaaaaatatcaaggctcagagatgaaaagaatgatactttgatgggggttaacagctgtgctttatctctaggatttcaacaaaaatccttaaaaattccaaattttgaaccgcttttacggttcatccaaaatcccattgttttttttggctaataaaatttccaataaaaaattctcaggtggccaaatgggttggaagtgtccaaatttcggcacgaaatggccacaatgggctggtcactgcaaatcaaccaactcgacgtggacgagtggcgttatcggagcagagaaaagtggacatgagaatggaattgagggatggatgaatgggacaatggaataagagcgatttgcttaacctttttttctcacattttaacactttttgttgcaaaatctttgcttttcatttttattaataaaaataaattaatattgaatgttttttagcttttggaaatgtatttgtgctgatttgtttttttcgaagttcagataaaatgattaattttaatgagtcgttcaaattttctatgcttactagttctgctcgagactgaaaatttcccgagacttaatgcttacgccataatcattactgtagtggcaataagaaatttgcaaaatgggacggtccccggatttctgtgttccctctccgtggacctatgaaaattgctcaatttttggcccattcccatcccattcatctgcaatttgttgtaaatgcaaaatctgaaaatttggattgattgccatcatacaattcaagcggggggggggggtcgaaaaatttttcggactttttaatgaatttgttaagaaaaattccaaaatttgcgaccccccccccccgcttgaattgtatgatggcaatcaatccaaatt

SEQ ID NO: 5315 - DNA, 3791 bp, Heterodera glycines
  misc_feature (18)..(19): n is a, c, g, or t
  misc_feature (33)..(33): n is a, c, g, or t
  misc_feature (38)..(38): n is a, c, g, or t
  misc_feature (59)..(59): n is a, c, g, or t
  misc_feature (82)..(82): n is a, c, g, or t
  misc_feature (87)..(87): n is a, c, g, or t
  misc_feature (93)..(93): n is a, c, g, or t
  misc_feature (3619)..(3619): n is a, c, g, or t
  misc_feature (3694)..(3694): n is a, c, g, or t
  misc_feature (3729)..(3729): n is a, c, g, or t
  misc_feature (3739)..(3739): n is a, c, g, or t
ctttcataattttttgcnntgggttcaattccncactnggatagaatattcctcacatnttctttaccattattttaattanaattntaattntaaaaaatattccaacttttttctttcatgttaagcatcctaaaaacccaaaacttaatcaattggtcttttttttacaaattctgttaacaaatcgcattaaaaattacaaaatttttcccggcggcgcctatcggcaccgccggccctccttgtcccccaaaagtcttgagaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctatatctgaattttagtgttctttatcctgaatttgaaaaaaaaacttggtcaacctgaatatacatatacttctgaacaattctaatgctaaaaaacaggtactcgcgcgaaaactgaataaaaattttgtatttggaaaattttgtccaaaatttgaattgacgaacgaacggaccaacgaagtgctaactttggagaaaaaagacgacaattttaattgtgtgttgaagcgatgcccaattggaaagacaattcaatgggaggacaaaaagacggacaaattgagcaatatcaactttaggttttatagtcgcacgaattgcattgggtgagttgcaacagcttttgctataataatcaattttaattgcccttaatttatttagtccattgtctccaccaaatgcgggtcaaatgaacgcaaaaaattgtctgaaaataaatcctgggctcagcggagagcagaagaaaaagtgaaagaattattggaaaatgacaattgattgatcataggaatggaaattgatcggataatgctcctcttatttaattgttgcttctttcatttaaatgaatttaatttgttttgatttttgtgaattttatagcggaaatgaaaggtttaaaaaaatgaaatatggtttattctaatgtttaaattttcattcttcctaagacggaattgcgtagcgaaattgccggaggtgacaaataaaatgtaaaccattgatttttgaaaaaataaagtttatgcttttgttcaaatggtgtccattcttgaaaaaaatattcaatcccatctcggcaaggcttggtttttatatttagggatgacaattttatttaaatttacatgaaaaaatttaaaaagaattattattttagctgatcaaattgttcaatcagatttttgatggctcgatcattttccaaatatttggtgcggggtacttcagctactggacgtgtctggtcaatttcatgtggtctcattttatttctttggtattcctcttcagcgcaaatgtagaggcgcaaatgtgtaggcgcaaatgtggaggcgcaaatgtggaggcgcaaatgtggaggcgcaaatgtggaggcgcaaatgtggaggcgcaaatgtggaggcgcaaatgtgtaggcgcaaatgtggaggcgcaaatgtggaggcgcaaatgtggaggcgcaaatgtagaggcgcaaatgtgtaggcgcaaatgtggaggcgcaaatgtagaggcgcaaatgtagtaggcgcaaatgtggaggcgcaaatgtgtaggcgcaaatgtagaggcgcaaatgtgtaggcgcaaatgtgaaggcgcaaatgtagaggcgcaaatgtagtaggcgcaagtgtggaggcgcaaatgtgtaggcgcaaatgtagaggcgcaaatgtgtaggcgcaaatgtgaaggcgcaaatgtagaggcgcaaatgtagtaggcgcaaatgtggaggcgcaaatgtgtaggcgcaaatgtagaggcgcaaatgtgtaggcgcaaatgtgaaggcgcaaatgtagaggcgcaaatgtagtaggcgcaagtgtggcacaacctataagttttatataacgtaatccaaattttagatgatttggatttaattattcgaaacaaagaacgcatacgtaaatacgcattccttgttatttgattaaatggtcggaaaattgtaatttgttatcaatgtttactcctaaatccctaattgtatccccaacttttttacttgaggataaagaatcattttacaccgtcattccatttttggtaaaatgatgagtagggctcggaattatatgcaccaaaaattgcaaaatatgcacataaatttttccaaattgagggtgtaatttctcaaaatttcttccaattcgttaaatttaagttaaaaatttcgaaaagagctaaatatggtataaaaatcatttttgaagaaaaaatacaaaataaagcatttatttaataattttggcgaaaattgagtaaaaatcgaaaattttcaatgtttcgacaaaattttgctaaaaaaatgtctttttcggaaattttttcggtctttgtggtcaaaacggccaacttagcagatgggggccgttctaatagaggttttttgggaaaatgtcaaaatatgcacaaaatgcctaaatatgcacaaatatgcaaaatatgcatatggaaagtcatcctagaagcttccaaccgagctaaaaacatgtttttcgtgcgttccatgcctcccacagtccaggaaaaaaatatgcatgtgcatataattccgagccctaatgatgaggtttctttgccaaatattttttagtaaaaaatattttataaataattagaagatggtaaaaaattaaattatttaagttatatttaatgatataaatattttattgtagaaaatataatttagttaattaattaatttgtccaattggacatcgcttcagcaaccaattaggataatctcgtccttcctccaatgtcagtttttctcgagtttgttcattgaccaattcaaatggcacaatttgccctgatgggggtaaacgaaataacaaaatgtgactggcagaagtggtggcacggaaaaatgcctaaacaatgggaaacgcaaattaaaatgtgcagacgaagggtgccggtggcttggacattgcggatgagtgagtgatgagtagggatgggatttttaggggcgaaaaagtccaaaataggggcctaaataggggtaaaaaattcgcgaaataggggcaaaaaaatcatttaaatgaatgattttctattttttcttggaaaatttcccggttcccggacaaaaaccgaggtcccggttttggcaaaaattcccggtcccgtgacactctagattatacattaaaaaattttacaaaccaatagggtccccccctttttgtttttactttttgataaaattcaaaagaccccttctttaaactagcgccgcagcctgtttttgtctttagcccttttatcaacgatactcacaatgaattttacataaaaaacaatggaaatggacacattttcgaacaagcaaaggtcaagaggtacataaaacaatattgaactggcatagtgccaacagcatttcggtcacataatcgcatcaatcaaccaataaattcattcattcatttctactgctgctgctgaccactcggnccgggagaagcggcatcaaaaagactgaaaaatgatgattcattcatgtttttattgcactttattccatttcantgttatttagccaatggcattttatgattcaaatncaatgccttnggctttttgtaccatatttatgccattcaaaacaaaccaaacacttttggaa

SEQ ID NO: 5316 - DNA, 1293 bp, Heterodera glycines
ctaagcatttgttgattggactcataaaacaacaaaaatattaattttaaattgttcaccgttcgtcgaattcgccatctttgatcacaatgtcaattgggttctgtcgatcatccattaattcattcaatacatttgcccaattttgctcctcccatccaattggacaacggctgattgcaaaataattccgctcatgttgttccagtgtcaattgctccccagtcacttcgtttgtccattcaaatggctcaatatgaacaatccgcttttttcgtgtaattgtgaagtttacgtaaagacggaaagtcattggtgaagaagcattggaaaatgcctaaaaatgggaaacacacatacaaaaagacaaattaagaggggaaaagtcaccgctctgagctgttcctccatcgctgaccaccttttgtcaccacctagcgcacgcattgtacatttgagcatcttcggtacaccatccggacgaggcgtgagcagccattcggtcaccgcttggccatccgacgcattggcactatcatcatcaggcagaaaaattattgggactttgttctccatttcaaagtaacgaagtgatggacaatcggtgagcagtgacggttccaattgaagcaaacggggaaaagcgatgtcgtttaaattcattacacgaatagaatcgcgtagcattggaaaaatgttgagcaaaacgaactccgaaatgcgaacatttgcagtgaaaatttccaattctgttgtacatgcagagaaaaaacggtgaaaacggcggagaaattcgatgacattgtggtcgatgtaactgaaaagcaggaaaagtgatggccacaaatcaatttgaatctaatcaagtttttacttgatctgaatgcgtctgaatccgacgacattgttcggcaacggaatttgcgggattggcaatgaatttccttcggaattgacaattcgcatttgcttggtgccattctctccaattcggtggcaaattcgcattgcgcccaatgtccatctgcgcgtttcgaaatgttcatcgacgaggccgtcaaagcggcggttaatcagtgcaatttcgaggccaagttgaaaaggcgcaagtaaatcgaacaccggcagccaactgaaaaatgttttgatatccaagtgtgaattttggtcaaaaattgagaaaatgaaatgcaaaaaatctaataaacgtacggaatttcagaagacatttgcagcaacaaaatgaccggaaaatatagggagaatgaatgaagagaatggaatgaggaggag

SEQ ID NO: 5317 - DNA, 2232 bp, Heterodera glycines
attttgtaggaaaaaacctttttatggtaaaatggaacattttaatctaaaaatatttttaaattaattagttttcgctctctctctctctctcttctctgtttctcatgctctgatattattggccagtgttatcatgtcatcccatgggggcggtatcttttctttcaccgatcaagactctttctgtgttcttctgcctcttcactctctctcagttgtgccagatactcccgcccatcgatcggtctctttgtcctcgagaccgattcggattggggatcaccttttgtactttgaccattggattccaaataaagagtgatattttgaacattgggccaatacgcattggcaatattatgtacgttctttgggctcccccccccccccccgcgcgtaccgactgaaatagggggacgagactcggcgagactaattgtaaataactgcacatataaaatgaaaattttattaaataagttaaacaaataaagtttaaaattattattaaaaggaattaaaggaaaattgtcatatcgaagaatggatgaaaagaccgaaatggtaaggaaaacgaacagatagtaaaaagctatagtctatcgataaaccaaaacaaaaatggccctaagagcatgggcgaaaaatgagagtcgaatgagtaattaattgtaatattatttttgggtggattttaatagtgaaattttacattaaactgcgaacacaggtggctcgacgaacaacggatcgaaacgagcagaaggagagcgaaaacgagaacggcacaaatggctgccgaagcagtaatgtcagcctaggaaaacaatgagtcaacaaaatttgctaaatatgtactgttttttggtgaaggcgaccggtaagcatttataaaggcctaccaaaatggccccaaaaatgccgaaacacaatccacggacgaaagcagcaagtaaaagccaaaggaacgaaatggcaagcagcgaaatgtaattttcggaagtatgagcattagccccgtgtggaagacaggtgttcggattagtacaaaacaccagtttccaacaaacgagcaaaaggcatggcacggcaccgtttgccattgtttcccacacagtctcggccataggatcaagaatttcttttggtaaaaatgcaaaaataaaaaaatattaaagtaacggaacaggacgacgaaaaactgagaaaacatcaattaaatcaaagtctccgtccactttcactttttgaacacttcatttgcattttttgccttcttccccccccctccccgactttccccttcaatttcataagaattagcccaatctccgacgacatctgctaattctattcttttattccgatcacaaaaaaagagagcaaaggccgaaaaagcgactgacggcaaaagctaaaggcgcatattgttggccgaaggggctgattggacgactaaatggccaatgtgttggtaaagagataaatgcagggcaattaagaaaatagatcgcctttcgtattctgaacattggaccccaaatctttcacaagctctatattagcctaaaataataatgtggaactgtaaaaaaaaatatagataaaaaactacgaaaattctgccttttttgcgattttaaagcgacaattttttgtaagctgcttaatcacttagaaataacttagatatatcttttaaacagttaaggctttcgaatgatcccatgtttgtcaagtttgatcaacaaagaaaaaatataacggagttggccagacggagttgacccctaccgccccccccccctccccgccccagttaaattcattaatttgtgatatgaaattaacaaatttataaatcgttcgggtatttatttctctggtgaattatttcactggattgtatgccttacaaaatgaattcaaataaaactattaaataataagcacataaattatattatttacaattacgacacaaaggctatattttgtcaacagaatcatctcaaatgcatttgtatcaccggacgaatgccaatttgcgagcttccggcgttgttttgtaaggtgaagggttaaattatacacacgacgaaatgactgagatgatgtgtacaaatttgcacaccgaaattgcactttcgatgtctctgatcagagatgatcgatcattaattgatcgtcctccgattagtaattagtcatgggtcgtcaagatcgacg

SEQ ID NO: 5318 - DNA, 5950 bp, Heterodera glycines
  misc_feature (63)..(63): n is a, c, g, or t
  misc_feature (92)..(92): n is a, c, g, or t
  misc_feature (107)..(107): n is a, c, g, or t
  misc_feature (120)..(120): n is a, c, g, or t
  misc_feature (210)..(210): n is a, c, g, or t
  misc_feature (2801)..(2801): n is a, c, g, or t
tgtccatgctgacaatgctagggctgttcgttgtcggagtttgtggcaattctgaatcgaacnaagaattgttggcttgttttaacttcatnttatgaaattgttgngacctccagccanttgaagtcggcgccggactgacgccccggaggcattgacacctttcggatgtgccgtgccaactcctccagttgaagtgatcaccgaccncgaccagcgtctcaccgcccgtgttcgactccgcttccgagtcatccgacgcgttttcgtcgtcgctgccggacgaacttccgctggaggagtggcgcggactgcccaaacttttggtgtgtttgcgctgcggacagcgcaatgaattcgctgcaaagcgttgagggccgccagttgacgaggcggaaacggaagagggagaagaacattgcaaagagtgcaagtgatcattgggatgactgaacggggcaaataaaaggtaaaacaaaacgaaatggacacataattatgcagttcactgaattcaattccaactgctcacatgatctgttccgcaagttcaagcagttcttcccgtatttcctccatgctttcgatggtgcatccgtctttgtctttgtgctggctcagtcgcccgccctttttgctgccatttgcccttttcagctgtttcggggccgcttcatgcgccaaaaggcggtccacaatcactccaaatgaaaccttaggcaaacaaaacattaaacgatcgggctaattaattcgcaagagcatgtaccattttgagaacggacaggttaaagcgttcagcaagcagcagcattttctttacaaatgccaaatcggcgaattcctaaaaagctcaaattaacacaataatttgatcattggttctttgaattcaaatttcactttataattaatatttaaacgtttttaaattaattttaaaacaaaattttgaatttaccgccatcacttcggtgcaaatgaatcgttcgcattctcgccgaagagcggggaattggacatgccttgaggcgtccagcgcctccaaaaaatcttcaaaacattcggcctcccggacaataaccgtgttgaaataataatgtgcaaaaacctaaatttattaaaataaaagtgtaaaaattacaaattaattattctacattttgtatctttcccagcaattccttttcatccaatccatcgccaaaacttttgagattcttcaaaaaacggtcaaaaacttctgaacacccaaattggaaaacgtgtcggtagagagtgtatttgtcagtctgattgtgagttttaaattagaaaaatcattataatcaaagtatggaagtatggtttagtactttgaagtcgaaatgttcaacgtctgggactttaagtttattttggcgaaatttcgtcgagaacaacggcacagagtgccgagagtttgtcactttgcggcgactcaatgctgggcaaatattgcagcggttggaacaacgaagcgggcattctgaaaaaggaagggaatactgtaagtaaataaataaatacacagtacactaattacatcactaaaaatgataaataatcataatttgtcatgcaatacagttccgtttcttcctcacttcatctgcacccgtacggtgatctgcttgccgacgtggtcgtggatgaactcgctgaacttgcgctgctcgtccctctgccgtccccccagcccttcgtcgcttatcggcgaccatccgccgccctttgtgtactccaagttgcgcaatggcatattgtcgaagagaatgccctccgagtttcgaatggaaatgcttaacattttaaatttcaataatttattggcatttgggcgtgccaatttgcttattttttgaataatttccatttttcggcttactttcccccgctcagcttaacgtcgcgtgccggcccctccttgtagtagagggtgatgttcactttcctttgctgctgttgttgctgcaccatctccaattcgtcgtcatcgccgcccgatgcgaaatacgacgagtccatcgaaatgtcgccctcactttggtcgctaatgtccgcaggcaatatttcctcctcgcaaatgcgcaaaagccaagtgaattggacacctaaggcattttaaatttattatttggagaacaaacaacaaaaaaatgacccaccattgaaggcagtgcaaaatgccgggctgacattcaaaatggcagattcaccggcaccgatcagtctgaacagtgtggacaacaataaatcaattggattggtgtaactgttttaaaaagctatttgtcacgccaattattgtgtttaaaaactttataataaagtgaccaccgttccgttattcgcactggccaagtgtaacggaaggtgacaaattcctgctgctgctgctgctgttttgtccgttgtagatgttgtggttgtcctactttgctatcgccactaactgctgccactgctttgctttgcttctccgcaattttgatcctcaaagaatggctaccgtaggcgctctgtttctgttgttgctcagcagggtactgtacccgggagacaaaaaaacgctttgaactgccgcacgaattctggcgttgaattagcatggatttgtccgctgtagtaagcggcggttgaggtgaagttatttggtagtcgtctgaggcggctaatgaggtaattatatttgttgaggagggactgttgaggtggtgccggtggatagaattttctggcgatgtttgacttgccattgaaagtgatttcatttggtctanaatattttattggctttattatcgcatttaaaaccataaaattcaaaataattacttaatgaatcttaaatgagtaatctcttatttatgatgcacaatttgccatgaaacttttgttgtgatttgtgaatgaaatttttcgattgtccacgcccacgcgatttttaaactcgtgaaaatgagaaaaccgacaaaaaaagaaaagagtaataaaagccccgcggtccatttgctgcttttgttgccaacaatggcagaagcgaacggcaaaacaccggacggagggaagggacgaaaataacgccgaagggaaagaaaaacgcagaaaagggaaaattggcacggcactgaagggaaagaaagtgtcaaaaaaaccaatgtcaaaaaaggtaaatggagaaagaaaaaaaaggaaagttaataaaaagtattgaaatttaaatttataaaattaaatattaaaaaaaaaatatttataaaataataaagggaattaattggtaaaagacattttcatatatgtatataagtaataatctctgattctcaaaattaattaattatgagtgcttctccatctccattttcgattttaatccccccccccccatttaccgtgggcttacaaaatttatttatggaaaatccgactttttttatctttcgcgctctcccaaaatggtaaaaaattgtcgagaattaatgattgtgggaaattaaatgccaaggcaaattctggcaaaataaattatgccgtaactccaatagagtaaaaattatattttgtctaaatttctcagattcaatggataaaagaaagaaaaggaattaatgaatttccaattggttggtttgtccggtgccaaacaattacataattacgaattgtgaaaatgcattcgttcgttcgtcccctgctaaaattgcggggtggaaaaacgaacaaaacgaacaatttgcgccctccccgccgccgcggggaacattcccccgcttccccgcacgcttttaagaacggggaaatgcccgcggggaattcccagcgcattccccgtcccacgggcagcagcagaaaaacggaaaaagaaaggagaataaataaacattttaagcggaaggaataatgagcagcggcagaagcaacggaaggaaggaggaaaaggaaattaaaatgtgggacaattcaaaataattataaaatgacataatgcgtaaacagcgggatttgagatgattcccacttttaaagtgaattgatccgatcgaaaaacgggaattttgtcctcgccccccccactccctcccgcacaaatgtttgccatttcattccattcaacaccctcttgccctcctctcttcccctcccctcccctcccccccccatccatctccatgggagacgatgatcgtgatgatcatcactcttcccccgcccggccagtaatgactgttttcagcggctattatttgagcagatgtgtgatgaagtgactgaaatgaaatgaaatgaattgggcgggggcaacggatgcgaagggattcgaagggatgacacatcaaacgacggggggggggagggacatggagggatttttgccatttcaattgccaattattttggcgggtcccttttgagtgaacaataaaaaaaatttcacagaatgttgtgagtaatgcgcaagaaccgtgtatttatgtgtgcagtttctttcatgtaaaacagtgaaaaatgggaaatttaattagtcaattagcgagggcgtaaaatgaaaaatatttagagagagagagagaaaggttgagatagagtggagaatgagacaacgaatgggtggagcgattaattaatcggtgattgagccaacatatgtttgggtgagctgatcagaaagtgatttgtaaaaggattatctgaagccaaggatcaaatggtcagaatttgatcagtatggcgtggattttagttagttaacttattttttctctacagccttattatgatgagacatgcacaaaaaacatatttttagcccgaaaattcttcatttaacatcattatttgttactaggaataattgttttggattttcataactaaaacagttaggtcactatttttgattttttgaaaacccccttaagaattaaacttttggaaattcaaaatttgaccccaaaaattctaaaaatttggacgttttgttgtgttttttatggcaaaaattctacaaccttcttgatttgaataagtgacataacaaagaaaaaaatcgtttataaaattaacttttcactgcaataaattatattttttcgttatttcaaaaagaattgaattcattttcaatcagtgtttaaaatcttttttgttcaattttcattgaaaaaatgtttaagtttaaatattattgaaaaaaaaaaaattctggtcagtgttttcatcgcttttatgtcatttatttcattattctgtagttaactattttgggatttttagtaactaaaatccgcgccttattgatcagtgaatgtccaaagttcaaatgatagaaactgatcggtgaatgataatctctttgccctaaataaatttcataatgtgaaccaattttgtgatcatactttgatgaaagagaatgtgttctcatttgaaaagtatcttcataaatttaaattcgatgaaaattgaaaccagtttttataattcaaaaattggtcaaatttggtcaatttatgaccaaaatgaaaatttaatttttctactttcttcttctgaccaatttcacgttcaaagcttaaaatatgttgccaaaagcaatgaaccgaagcatttcccattgatatcaatcaaaactgtcacttccgatggcttcaaaatagaaaattcttatgccatatgatccgtagtttttccccattttcgcttttggcgaatcggatcacatttgttgcatgtttaaaaaaaagattggaatggactgctgatcaaaaagtggcagaagaaagttaaatggtgaaatttgtggaggaaaagttagtgagctaattaataaatgaaggatatatagcggcaaaacaactgggaaataattgtgtgagtgtcggatggcacgtgctctcggcgagagggagaaaaaagggggaaaagg

SEQ ID NO: 5319 - DNA, 1759 bp, Heterodera glycines
caaaggcaacccgtcgccagcagcagagcagccacaacattcattcatttatttagctgtgtgttggtgtgtgaaaagggcttccattctcgacattctcaattacaccattgtggtgggggcacaagcagacataattcatggtgggattttgaattaagatccatgaacgaaattatggtaaattatgggttattttaaaattatttaattagttttggcattttaaatttttcggaatgtttcaaagaatggatgagcggttttcactgagagagtgtcaaaatgataataaaaatttggagacaatcaattgcccaaagggaaatgttaatatggagaaaaggaggacgacaaatgacaatgaaaaaaagggggacaatggaaaatgtgacgaaaaatgacattttaaagggactcgtaaggaacagcttaatacaaaggaaagaaaggacaaagccgacaattaagccgatttaaaatgggaaaacgaaaggccaatgaacggagaacaaacgacgaaaagcggcggaaatggagaagaaacgaccgaccgaccccaaacagcgaaagattccgcaaattttattggatcgttctgacaaaatgagcggcgttaattcgcattgtttcttattaactaatgaaattgctgcccattaaaaaaagagagtccaatgaaaaacaatcggtgacagtgtgacgcgaaatcgcgagcgaaaatggtttcgcgtgttacgacgaaagtcgccacaaattctttcgtcagcataaaaagacgcgtggaagaaatcccaaacatttctgtcaaaaaacgattttagacagttgggaaggaaaccgtcggcggaattttagaaaataaaatttgaaatgccaaaatgaatgtttcaatgcattaaaataattggtgcgttaattttgggctaaaaaatgcaaatgtttgacgggggaattcttttggcttttctggaacagcagggaaatgaatgcattcgtatggaaaaactcgttctgctgacgtgggaaaggcggtggataaagcgaatgataaaagaccaatggaattgacgagggacgaacgactcaaaaggggggagagaaaagcgagagacgacacatgcccggggggggcaacacaacacaatcccgcggcgttaaataaaacaattcgccgccgtcaaatggccgtccaacggaccaactccccgcttctcccccccccccaacatctgtgcttcatctcccctttgcttctgcttcttctgctggtgggtgtgatcattaggcaatttggagggaggagaagaggacattcagctgaacaaatgcataaaaaggctgggaaaataaaataggctaatgggcaaaacaaaaacatatcgcccattggcagaggaacaaaaagcaattggaggggggggaaggagtgcattatgagaaaagaaagatagaaaactgtttgttgttatggccaaacaaaaatggcaatttgccaaagggaaacacaattttaattcgacaaaatggcaattgaatataaaaaaaaccattccattttttggtagggggggggggaatgcttctcaattgtcagcccatcattttcattcgcttcccctttctctcccgtggcagcacgtcgtcaattttcatagaattccgagaaatgtgcacccaaatgcataagtgaagtgagtcatgtgacagaaggcaatggaattataagctcagcccatcccccgaaaaataaattcct

SEQ ID NO: 5320 - DNA, 4030 bp, Heterodera glycines
gagaaaataaattgtcaatccccaatatttgttttaggcaaaaatgtccactgaaagtgaccaactcggccagcagcagcaggaaagggaacagtcggccgatttggggggactgaacagcgacagtggcagcgaaaagaggcgactgcgcgtggccaaaacgtttgttctgccgcttcttcattcacttcttcgggtcctggcacttcagcatacactgacgaaaacgaacaaaaattgaagtcaattaatcccctgattttgtattccgctatgataccgtatcgttttcccgtctctaccaattctcttttataattgtttgtattcatttgacggtaaatacccctcctcttccctccttcgctcacttctgttcactttgtcatttttctcctttttcctctgtgaccccacttccaatcaatatttaatttattgttcgccctgtccctttttatttgtttgaataaacttttggtttattcactgcggacttagcggcgtttcccaattgcgtggttttctcaaaaatctgaattttagattctaagttagttttagttgaaaattcttagaaacttttttggtacaagttgccctttgtacgaattgccaattgtacgagttgcctttgtatgttgccttttgtacgagttgccatgacacctcgggggggggggggaactaaagtgaagttaagtatttgagtgccgaaaactcaactaattaaaaaagatcaatgccctaaactttcaggcatttccttctttaagatttcaatcactcaaatgaccgcttttctctcccttctttcttcaattaaagtcgctacttttggttcattttattttttatgattaaaatgaataaatcgatttacaacaatcgtactcggaaagatattacaatgtcaaaggagagaatgtaaaagttttcccttcctcaaaaacggcatattttcctgaagaaggcattcgccacccttctctccctaattgtgcgccttctttcagcttttgtccgttgttttgttagtaggacttttttctcggcataagttttgacagaatgccggagaatgatcgtttgtgctctgaacaaacaaacacaaattggttgctaaatattaattaataaatttggcaaatatctcttttctcactttgtttccgactcgtgcccattgcttcttccatttcctctccctgcttttcctctccttccctccgcttttcttcctcctccccctcctcctcatctttgtgccgttcgtctctttcttccgtcgctttttcctcctctttcctattgctttgctcgcgtctcaaccgtcgcgcagtcaaattgtccacaatgacgcggttccacagttttgtcggctcttgccgcgatgcttctcccattttgccgtcaattaaacggcgaccatctgctgacgatggaagttgttcattttgaatatcatttattttgataattattctttaattgcgtctgcttctcgccctcggctcattcattcatttattcattcacctgtgtaagtaatctgtggcttcttctgtttgcggttgttgaacagctcatcatccggttgctgatggctacgaaattggggagccgacgaggagggcggcgatgcgtagaactcgtaattctgtgggaattattaattagccctaattaggagtgcgttggttttcttacctccgtttgacagttcatcatccccaacattttcaaggttttttatttcgccgaaatgcacttttgaatgagaacggtcttttctttctgtgatttgtggctagtcacactaagcatttaaataccaaacaaatgtctgagggggggacaaaacaaaatttcgaaatttcgtaaaaaattcattgtaaaattagaaaggcattgactgtttgtaactaaatttagtacaaaacgaaaagaaagtgagagaaattggatcaaatgaatgaacggacgaagaaagaatgaacgaatgagtgattaggtaagtgattggcagaaagacaaaagcgaaaaggcaaagtgatgacgacgaaaatcgcatctgacagtcacacaaatgagcagactttggcgaacgcagcagcgaaacgaaacgaaggcacaacgacgccggagagacgaacgaacccatcaattaattaacattaattgccacccccgctcaaaagactgacaaataaaacaatgggccaaaacattgggggggggggaggagaagagggaggggagggcacccgatgaaacggacggcggatgggcgacgaaaggcggcaaaatcaaaggcagtgattcattcagtcatttgctgcgcgtgacttttgaaatgtttgcgctgacgtcactgatgcactttaacaaatgttttaccttccgtcgagagtgatcagtgattacaggcaaaaatcgtaaataatgatgacaattttgacaaaagttttcaaacaaaataaacgaatcttttaaaattaaacataaaaaatgaaatattttattgttttaatttaattgttgtttattgttttttacataaattaaatttcttcataaaagtctagaacggtagaattcattatatagctcttaaatacgatcaaaaaatgtttgaatttgttgattttcatctccgattattcggctgcatcaattggaacttttcacacgaaaaaatgggctgaaattcaaaataaaaatgatagctttttaagcattcccaacttttaatgagtcatttccgtcggcaattttattgccggaaagaggcaaacaaccgaccctgtccttttcgcttgttgcagttttgcttttctccagtaatttgttgcggaaatggccgcaattcgctcactgtgagcagaatttttttctaaaattttcaaagaatttaaaaaattaagaattaaatattttgaaaaaaattcaatgatacgttaatctttcttctctttggctgaaatggccaaccaaataaatgcgtattcagtttaacccttcgtatttaagtttttctgggctggtgattcccccccccccaactctgttccatttgccggtgattcccccccccccccccacccctccatcttttgtgccatttgccggtgattccccccccccccacccctccatcttttgtgccatttgccggtgattcccccccccccccctcccctccttcttttgtgccatttattccccgtgcctttcgccctttctccgcttcggttgtgccgttagttcgctttggctaagccgtcggatggttccaatgaaaacggtcaatgcgctgttctttttgttggctgtcatttcggatggtgctcctccggcggcggagagaatcgccgcgttgctggcggtggttcggtcctatgatagaaaagcatcaaatttcgttaccgtattattagcttttggaattttatttttacgatttctcacttttcccctggcgcccagccaagcgaagagaattgggttccaacaaacggcggacatcgccaccaaatgggcgaccagcggacacaaatagggctgactgaacaagaagtgcggttccatgcctaagggggcgaatgcgaagcgaacaaaggccaaatgcaaaaccgaagtctttggccaaatttacggccgtcagagggccgttgcagccgacgaacgcgacgaccatgccgagcaaagtgcaattgacgcgcctctttctgagagtgccattccattccatttgacaacaatcgaatgaatgcttttcctcgccatttgcccacctgttaatcgcatccattcgctgcaaattggtcaaagtcttgcgaaactgcacattctgtacgatcatgtccttttgcactttgcgcagaattcgcaaatggcaaaaagtgatgacactcaacggcacaacaaactgaggaaggagcggtgaatgttttgcattagcaccaatgagaatgcctaacttgaaaaagagcacaaaggcaccatataattgccgacgcgattcgct

SEQ ID NO: 5321 - DNA, 3738 bp, Heterodera glycines
tcagcagaaagaaattccgcgtagatcgaattctgacaatcgtaagaattattcttacttataaaacaattaaatgtttattaccgatttgtccgtccaaaggccattaaaacgcttccattggaaaacaaaccgaacaaaaacaaaagggcataagcgaaaatgatggcaattttgatgaggggatagctgcaaagcagttaattgtggtacaatccattcattgcttgtttttgggttgccttgtccaatcgtcgatgccgtgggcggcgatcacttcggagagatggacacattccaacaagtgccattgggcattcatttgaagttcaagaggctaaattaatgtcacgataaaagtaattagctgtttgctttaattttcacttcgctttcattgttttttaaaaattggccaattttttgtcgtacagaaattgatgaattcatttgctgaatgatgatgctaatttattagttaaaattgtcttttgaaacagaagaaatgctacggaaaaatattgtcaatttataaatatattttattttattatttatttttaacggattattttgcttttgaattttttatgaattaagataaagttataaaaattgtatttttatttatgtatttggtcgtaacttaaattgcattggaaaaggaaatgattaaattgagtgagacgttgaggaaaaaattgcgatgagacgcccttaaaaggggggggggggcaaagcaattgaaaaccgaaatttgaaagcatttgctaacgtcgagggaagagagtctgttttcccgcttacttagtgattaaaattgagtttcaaatggaaaaatagtttaaaaagaattttgtttttcttaatcgatgcaattatataaaaaataaatcggcaaattttgcatttgtttaattacccaaaacatttaacaatgaggaagaagtgaatgaaaggagcagcaaatgtttacggaaagagaacaaaacttttaaattcgaccataaaattaccatagaattcgctctcttaaattgttgtgccaaaggcaattggaaattgtccgtccctcggccaattttccgttggggcgattgaatgggcgcacaattttaagcggaaaagtgtttttgtttcgaagcagcgacagacggacaattagcagaaaaaagggtaaatttgaatgagtaattacgcacagattgttttattttatgcatgaaaatgttgagagcgaagcgaaaaagttattttgaggtgaaaaaaaatttagaaaaggtgccaatgtcggattttgaggatggaaaatgccaaagttggcaaaaatacgaaagcaacaattaccgtagcaggatcagctgatgcatacggtaaaaactgaccgaaaaagggcgaaactaattacccaagcagaatgaaaacaattttttccttggaaaatttcttaaggctattaaaagaaattccgaaattcccccgtggaaacataaacaaatgaaaagtttagggactctttgagttcccaggaacttttttatttgcttttttgatcagtcataattcgtttcatttccaaccaattaaatcaaaattttaaatttgtaatttgtattttttttaagtgaatgctgctaatttgtgagcgatctgacgcactcgagaaaaattatgataacttaagtcccaggctaccgtttaattaaaatgttaaataattatttaagggagcggacccacagtgacaacgctttgttagacataacttgagacttagaccgctgagaaaaaaattatttttctatcgatcgaaaaatcaaaatgattttgtattatattatcctaattattagaattaataaatttttagttgatcataatgtttatcttaagtattatagaaaatatcttttaaaatttccgtaaaatttgcgttttcttttttgaaattcataagattctctgctgataaaataattgaatgatttattttaataataaaaaatcactcacaattacaaccaattgttttgattatcaattcgttcttaaatcatagcccttctgctgatcactgatcaccctatctttttcctctcttctcaatgattattccgtttggcttctgttaaatggtcaaaatttcggttgaataattactttgaatttaattttgatcagcaaacattgcaaacaaataacagctctaaaactcccacaaaacccaacttctgcttttttcccatgctttgttttataaattaatttttaatgcttttatttatttatttttattatttttaaaaatatatattttcggcaccgaatgcaatttgctatttcattttttgttgttgttgttaatgcctttttcatttcatttccgtcacatcgtccttttacaaattaaatttccaccgacgaaattacgaaaaaacgcaacaattttttcgtctctggcaaaaaaaaaacacaggcaaacatgaagaaaaagaagaagcacttgaaaatgaggacgacgacggcattcattttcataataataatgaaaatgccaaaaaacggtgggggaaaggcatttgttgcaattaatcaaaaaaatgtacatacaattgatgaatcgtagtaatgtaacatttcactttcaaccaaagtaacgtcaaaacaaccgtaatattgtttgctgcctcgaaatggcaatgtggccacgccaatccatcgaccaattagcctaatggatttgatttataataacttaactgggtcattaacactaattgacattaattaattaaaaaacgcatttttgccagttcattcatcgaaattaatctttattccttccacgtgtcatctgaacattgtgcttttaagttgctttctttcgcttctcttctctttttcgctttccaaagtgaatgtcatttctttattcgatctgtcaatcgtcggattttgtgcgattaattttattaattaaggttttgtcattctttaatttccaccgcttactcatcgcaaattgcaatggcacttttggctgcccatattcattccgtccaaaaaataatccctttcttcggcactctgaattaataaacattaattagcttctgtttgattttggcattcgctggtcttcaattatcaaatattagcgttttagttgcttgaaaggatttagagtggaattctgctgctgctttccgtgaccaatttacaaaatgaggaaggcaataaattgtaacggaaggctaataataaatcataaaggagcaaagtgaaatttaaaagatatttaatatttattatccatccaatgctttctttcgttcattctttgcctccgttttttgtttgctttaaaaggtaaataaatttccttctttttttaaatgaacattttcaattaaaaattatgcattttaatttcctcttaattccttctcatgaatttttgttggagcttattcttctgtgtttggaattggcacaaattctcaattccaataaactttgtgccaaaacccttctaagatatttaaacgaattttcgaaaatcaaacaatttatctttccgttcatttgtcgcatttaaaattgaaaatatcgctcgcactttttggccttttgtccccttttctcgcttattcccctttctttctcttttctcctctctttttcgtttcttcttttaattcaccatggcaaatgaaaagccatgaaaagagggggggg

SEQ ID NO: 5322 - DNA, 929 bp, Heterodera glycines
cggcggcaaggggattatccccaggaagaaagaatacggcacgtaaatcccctgtaaattggcacgccatcccatcacgaagtgggaaaaggcgcccatgcccaatccgcaaaaagtgttgtcccccgcactcttctcggcatattgccccaggcatcgtccggcgttacaatccccggggtttttttatacggcggttttttaaaaccgcgtcatttgaaaattccatgttaaaaatagacaacactttctccatttccgttttacaagtgaatgttacaagaaatttttagaatcaaaatcaaaattgctaattcaaaaattctaaaatagatgctaaaatttattctgttttttcttcaaatgataattagcaacacattagtttgctaattaattataaattattttaatttatctgctttaaattaatttttcttttcttgataataaaaaacggaagaaaaaaaagaaatttccatgctcataaaagttcgcagaaaaattctataaaataagtcaatgttaaaatatttgcaattcaatgaattggataaataagtgctaattgcttttgttcatttaggaaaaatttttcccgcgaatataaaatcatttctcaataaaaagcattacgcgcatttgaaggcgtccattagtcgtaattggttgtttaaaacagagatgaaaagtgccatttttgtcaactcattgtcaacagatcattcattcaatgttcgagcaaaactaaggccaaccatcgaaggaatggcaaaaataaattggccattcgtgtcggatgacatcactcttcgccccatccgcacattcatccgccaaattcggcggattgtgcgcttatctgtgctccatttcgtcttatctcacttatcccacccacccattaatccgtggcccattcgtcctcc

SEQ ID NO: 5323 - DNA, 6346 bp, Heterodera glycines
tcagtggcgaaaccgcggacacaagagggcgatggtcggcaactcctcgttggcgcgggcgagcacgacaacaattcgggaacgaatggaatgggcaagacaggggattcggaacggatggataattttgatacttaccgatgaaaatagtttagaaagaaattatatttgacatattttaaatattaattgtaaactcaattaaattttgttgcattttaacattcaacaaaaaaataaaaataaataaataaaatgcaacaaaataattagtaaattgtcggggacaattttctctcaggaggggaatggtatctctataattaattgtacattagatatttcttattttctgactgtctgattttgttagtgcctctgatcactctgatcaactttaactccgccccttctcgtaatgtggcccatttcctagcgatcacctcaattcattcttataaccgggatcacatttaccccgatcccctccccttccgtcctgtacggatcggggtccctttcccctttttactcattacattagcatattgtatttcttggatccgccttcggaataaaggacattattccatgtgtatactattattgtacggggaaattagggcccacaattagaacggacattacatagaaatcaatactaattaaatttttactattttgtttggtttctttttttgtgttttccttattaattaaggtctaattagttctgtccccaaaattagtttcttttatttatgcataaattgtggctttcaaattcgctttgctacctgagcttgtactgctccaaccccatgcatgaatctggagctgtacaagctcagtgagaattcagagttcaaatctaggtccatatttgggctgaccgtggctagtttactcagaattatgtattgtaaattcagtattttcaggtcgtattacaaaaacttttgcgtggtggttaagaaaaatgttatttttggagactgctttcaaacttgactttccagtaattcaattaatattaaataaattttatttagtttgagttctaggcctgtgggggttgatctcctgtccaaaaatggcaactcattatcgataataataataatggtaagggattttgaattatggctaaattttattcattagaaaaaataaaattttcgaaaattttcggggaacaaaacttatgctacaccatattaaattgtcttccacttaattgttcatcatatttcgctaattaccacctgaaaagttgggtgcgcaggcgaaggcggcggtgccttataaaaagattcgtctgaaagttgctcaatcattggttcgtcctcgtccatctctttggcaatttgcccaatttgaccattttcgtccccaatgccattttcctgcacaaaattggtccaaaatcccgggctaaaatttaaatataaattttttaaattttatataaaaactaacggattttggtcattcaattcggattggtttggcttcacctcgaaaatttcaaaaaagaaacaaatcaaaaggaaaaaaagcccgaatttcattgcttctaaaatttgttactttacagtaaaaatagaaaatgaagttatattataaaaatgaataaaaagctaaaaaaagccaacgagtgaaactcttgatcaaatgggaatcaaaaaaaaaatgaagaaaagggcaaatgccaagaaaatcaaacacatgggcatggacaattgttggattctgttaagctatttctgaagaaagtcttcaatttagcaagcataaaattatcaatataaataatagtgaatattattttaatatttctattctcgaaaattagaagaaatatttggatattattttttattttctcattattgaagaaaatgttattttgtcccccgaggtgagaagggaccggtgacagaatatcaaataattaataaataaactatcgaatacttatgtcggagttaaaatacagtatcaaacaaaattagcgacaaaacaaataaaaatctaatgattaaaattttatcaaaatcttgaaaaaatttgaaaaggaaggaaagaatgagacagaataaaaattcgggaatcgaacccaaacaattgtaattcccgatggacttcaaactctcaagctgcgagaaagccataaaataaggtgcgttgacgctattttgcgcaaaacaaaaagaaattgttacaattccgggttctggatttggtcgaaatgggtgtctgattcgtgttcaatgctcccgaaaacccacaagttttgggctcgaatttataacatgagaccggatttttaggcacgaacatttttcaaatagttaccgaaaataggcacgaaaaaggtgaaaaaaggcataaaaatgtacaaaaacgacaaaaaaaggcacaaaaaggaaaaaggcagcaaaatttacacttttggacaaaaaaattttcttaatattaccacaaaattcacaatttttctttcgcactgtcaaaacaaatggatatcatgtttttctggagtaaaaaaatgaatttttgatcaagtttgaaaaaaagttatgaatatgtatagattataggacgacacccaactcgttggcaattttgtaaatgcgttgactatacatttcagtctgtagtaattataaactgcggttagcacttaaattcccattttccagtcaaaaaaacgagttggggtaataaaaacgagttgggtctttttacgagattatatgggttttatatatttttttctgcgcatattctatgaagaaagttgctaaaaaatagcatttctacgataaatttttatgatttgagcttttagtccatataaatccatatttagggttatcgggaataaatccatatttcgctattttttcgtttttgtccatatcttagccaaattttcgcaagaaaaaaaggcaccaaaaagtccaagctagaagattcaaaccaagccaattaaaaactcgtaattcatgtatataagtcatagcagattagcaaaaaaaaaaaaacatatgcctcaaaatccggtccctatttataacagtattacgcacaaactacctccctttttcattttaaaggctaatagaggacacttatttgttagggctattgattgtacaaagatggttggatttggttggcaaagaaaaaagttatagccaaaaacttgggctcgcacgaaaacggcctggtccgctgtaataccgtacttcctaaaatagagcccccgggggctctatttttcaccccaccccctcaaaaggtggggggctttatttgaaagggggcactaatttagggggcggctttattttaggaaatacggtatgttgtattacgcagaaattaggtacctctctttttcctattgttcactgttcttcactataaaagtcctggcttttctctttgcctctttcactctttcactcactttttcttttccttttgccgccgcaatgtcttcaaaaaagattctgtatgtttttctttttctctttccttctctctttctttttatccctcttttctttctctcattccgtcttttcagtttgttcggtgtgcctttgttggtcggctgttgcgccattctttggatgtgttgggactacgccaaaaaacgacacgtcaaaaaaggacgacgacggcgacccattgacgacaaaaaagaaaagtagcaaaaattaataattaattaagtttataattgtttttcagctgcttcatcccccgtggcgattggcggctggcggtctttgcttttcttgcgccttctcagcttggcctcgaaattgcactgctcagccaccgatttgactgtcttgtcgatgaacactttaaaacgagaaaatgggcattcgattcaatggacatttggcgcaaaatcggagagaatggcaccaaagaagtactaattgtcaattcgcatgggaaggcactgccaattccgcaaaagccgatgccaaagaaaatcatcggattcaaatgcattacaatcgagtgaattggacatttatgaaaaattggctaacatttctcgttttttttttcagatacttccaccaaaatgtcgtctcctttctccaccgttttcgctctcttttcggctcttctgggattaatttgtccattggatttggctcactcactgatcgcactgctgagtaccttatgtgcaagctttggccattgctccggggcaaagtctgcggcatggaattttggccagcggagttccgatgtttgcgacagttcgccccatacattctgcgcgactgtccgtccctgcgaaccgtctgtcttccctactgtagtcatttcgacgagtcggatggccaagcggtgtccaaatggcttttgtcgcctcggccggacggtcttccaaaagtgttccgttgcgaattcgatttggctgagatgcgatgggtgtcactgatcagagaattcaaagcggtgatttatttgttgatcattattttacacaacttgctattacttttcattctgtccatgtttcagtcatttgcaaatgcttctcgccatgtcaatttcatcattgtcattcgcttttcctgtgccgatgactccgccgttgcgacgttcgatctgatcaacaatttcactggggagcgatcgacactgaaaaggcttaacaaagacaacagcgacgacaataacaatgatcgttttctgctgattcgctgtccgatttcgcgagatgagtgtaaatggagcaaatgggaaaaggaagcgattggatgggaattcgacaatcagtggaacagaatcatcttctcaattaaggactatggaatcgaccattggtcggctatttgaaaatttttaactgttttttcatttttcatttttttagttgctatcccggtccgagtggtcatcagaataagagcaaatgaattgatgggacaatgtgaccgattcgctgaattttgtgtccttttaatttgaattgtttgtttctaaattgaaataaataataaaattccttgtctatattatttgccatctgtgctaggaagccattgaaaaaacaaaaatgtggcgccgggggacccaaaatgggggcaaaattttttgaaatgaggcaaaaagggaacgcataaaattttcaaatttatttttcatttcaataaaaaaattgaaacaatttggacaaatttattagagcgactttttagcaactattttaaattattttagcttttgaaattaaaaaaaaattattttttcaactatttttgcttatgaacaaaaaaattgcctgagaatcagggctgggcgtaattacggattacggaaattacggcctttttggaccccgtcatgacggattacggatttttgggatttttccgtaaagtcttattaaggctacaccctaatttgagttttggcctacaaaatagggcgttttttgtcgctttgcgttaagccaaatcagtattgggacacatattttttaaactttaaagtttaaactccttgtcaagaaataaatgaatttttgagaaaatttttaatttattaggtgtgtgtttttttaaatttttgggtcgatttttaggggcgtatttcttttttattgtatttttgctaataaattttcaaaaaaatgttaaaataagttttttcaaaattacttttttgactaaaattaattttttatcctattttgaagcaaaatcttttacaaatgcactaaaatcttcaaaattttcctctgcgttcatgccaaatcttattaatatgcttttaaattgcttataaaattattgaattttttaaaataaaacttgaaaattatttcaaaaaaattaaaattttgaaaatttacggattacggattacggaaaattacggggttttttggtccccgtcatgacggattacggatttccgtaattgaaaatccagttacgcccagccctgctgagaatcgacctaaattttttttcaaagaatacaccccataggaatcaacttttcaaaaagcaaaaatcctggctatgatttagcggacaataaaaaaaattttacgcctgaaaatcttaaaatatgtttgatttatatttattcaaacgaaatggataaagaatagtcagttttggaaaattcacacattttttatttcaaaaatttaaaatttaacgaaaataacaattcataactagcgttgtaaattatatggattaacatattttttctgcgcatatgttacagtcatggtcaaaggcaagggcgtagccagacccttggctttggggggggggggggatgt

SEQ ID NO: 5324 - DNA, 2229 bp, Heterodera glycines
  misc_feature (125)..(126): n is a, c, g, or t
  misc_feature (173)..(173): n is a, c, g, or t
ttacgaccacttacatttttataataaattcactgatacaaggattagattatgatatttgctgaaaatgtatttatattttttatacattttttttatggctttcgaatggtatcattcattanncgttataatgcttgtcacatggttactaaaagaaatgaattatatcncattttggggtggtcatatgtttacgaccataaacttaattcataaaaaatcaatattcacgtgatttgatcacagcctcaatacggcgaggcatagagtttatcaaattgataattgggtcaagcggaattgagttccaggcctccaaatgccaagttggggctttgactgaaagtgccttccggcgattttccgcttgacaaagtgccaaagattttcgattggtgacaaatcagggctcaatggaggggtacgaaggaggggaacattgttcaggctgaaccagcccggcaagcgcagacgccgaccgccaggaagtcgccgatccatattttgtgggttttcgggaataaatccatatttcgccatttttgcctttttagtccatatttcggccatttttggcaaaatttcacaagaaaaatgcaaaaaaaagcgaaaaatacacccctaaagatcgactttttggaaatttttacaaatacacccccaatgagtttttgttgtcattttggcatttttaattaatattttcaccatttttttgcgaacttctctttttttaaaaacttggaggtgttttttatacaacggacgacaataaaaattttgcatttttaaattttaaatccattttttttggttgtctattgtatttcttaagtttacttaagcaaatattgaatataaaatcaatgagaatttttttgtttgaaatgtgatttgaggatttttgtggctttttgagaaattttgaggatttttgaggcttttgggaaaaatcgtcagaatcttttaaattttgataaattgacataatgtttgacaattatttaattttttgggttttaatagagtatcaaacggaaatctcacccaaatttagccagaaaattacaattttttcgaaatccacaaaattatgaatttttttaaatgaaaatctgctaaaaatatggtcaaaattctcaatttttcccccaccggcggcgcctatcggcaccgcccgcccctcaatctccaagtttttttggaaaaagcgccgcaaaaaaatcaacttcgatttttcatgctcagaatctcacaagatgcttatttcgaacaaaaaaattgctcaaattgtcatggaccatcgaagatataacatttgatcattttaaacgtgttttgaataaattttgtaaaaatgaggctttttgacccaaaatgaggtttatttgcatgccaaatgagttccctctattacaaaacaaacaaaaaaaatagaaaatggcagaaagaaaatttattaacaaataataatgtttatgaaattaatggattgaaaaaaaaacagagagagaaagagagacagagaagagagagagagaagaggagagagagagggagagaaaagaggagaagaaggacagagagaaaagataagaggagagaagaagagagagaaaagagatcgagactgggagagagagagagaaacgaagaaagagagaaaattgaggagagagaaaaaagagaagagagagagaaagggggaaagagtgaatgagagagagagtgaaagtagagagagtgaagagaagagagagagagagagaaggaatgagagaaagagagagaaaaaagagcgagaaagagggacgtactgggaatgacaatttaattatttaaaacgatgacttttcgcgtttatttttgtgtttaaatttcatttttgttttgttttttgttcatcagttgttcttgagatttctccgatttttgtccttttttctctcttcatgttttaaaaataaattattctccaatcgccttaatttgccctgatcgacagtgtttatcagcagacgacttttgaccacgaagtgccgccaatttgtaagacaacaattctcttcaccctctctccgcttcacatcaacttcgttaaatcttgactaagcattcatttttgtccccgtaattgtgtttctgagttttaattatttgaccactcccatttccctcaccaatcgaccgaaagacaatcggtctgaccatcccttttcccatccc

SEQ ID NO: 5325 - DNA, 854 bp, Heterodera glycines
tagagttgagcggtaatcggtaattgcaaaaaaaccggtaccggtactgaccggtactgcaaaaaccggtaccggtaccggtaccaactttttcaaccggtaccggtaccggtaccggtaaaaaccggtaattttagaacataaaaatttttggacaaaattttccaaatacaaaatttttattcagttttcgcgcgagtgcctgttttttagcattagaattgttcagaagtatatgtatattcaggttgaccaagttttttttttcaaattcaggacatagaacactaaaattcagatatagacctcaaaattcagattattgcaaaacaaggggtcagcagccaattttccaattttgcgaaggggtctccggccatgtaaattaatgtaaatcagggcgcgtatctttcctgatttatcagatttgtcctgatttgaagggtccaaatctgataaaattaaaatgtcctgatttgtcagatttgtcctgatttggagggagtgacccaactttgtcctgatttcttaaataaacttacaattttgaaattttatggcataatgtcactattttatcaataaaatataagatttatgacaaaatttggttatttttttaataaaaatctgttaacaaatcagaacgaaattacaaaaaattttccggcggcgcctatcggcaccgccggaccccctgtccatcctccaaaattttttgaaaaaatgcgacgcaaaaaaagcgtttttaaagcaaaaaagtcgtcgcttgacttttaatttaattacaaaattggcattttttggtgaaaatcttttaacaaatcagaacgaaattacaaaaaattttccgg

SEQ ID NO: 5326 - DNA, 1845 bp, Heterodera glycines
  misc_feature (1836)..(1836): n is a, c, g, or t
gtttctaatcgaatctgacgcttgtacaagaactcgtacgaaaatgtccccggtacgaaaacgaccctgaccgtcttcccatcacactctctctctctctctctctctgtctgtctctcacctgctgctgttctctcttcttgtcctcgtccctcttcgtcctccgctttggccgcgttgtctcatcacctcgtcgtttcttcccgagcatttccagcggaagttcgctgaccatcgtcgacactgagtccgatccttcgtcgttctgcaccactgctgtgtacgtccctgcaacaccaccacccaaagtgacactccttttctgtgtttgccttttcctcaccggaatgttctgacggacagaagcggagaatctccagcataaactcagtgacttcgaggtcgtcgttgaatttgttgttgaacagtgtgaagtcgtcgcccgtcgctggcacaaatgcttttccgtttttcagccaattaaacgatggcattgggttgccggcgtacgaaccggccaaacaaacgcgagaaccactgatcgcttcctgaaaggcgcattgacttgttcacttttgatcttcccctttttacaatgctttgttttggctttttgacaaattccggtgctttacgcttttcctcccttttttgaattttgcttgtccccggcttttcctcctcagtttctttgcttcctttgacttccgttgcttttcttggctcattcttctgaatttaaaggacaattatttatcacataaaacaaatgaaaactaagggtaccccaaagacgataagattggcttctgtagatggttttacggtagtcttagtcaactccaactccaatttgtaccgacctgtgaatgtgttcaattttcaaaaaccgtagtttctcctctcttctcccctttttctctcgctctttccccttttcactttttctcttctccccctcctttctccaattttccctcctctctctccctttttctcttttccctctccactctttatcttctctcttgtcccttccccctctcttttcccccttttgctcttccacctgcgtctcctttctccactttgttcacaataagttttgcttctccgcgcggcatctccaaaagtgccttgtattttaatgatgttcgtgtgttcagtaatttcccatctttgtaccttcaaatgattaatatcgaaatgattggttaattttgtaatggtttggcctaattcccaccattttgccctcattagcgcctcttttgcgtttttgtccagttttgcgcccaattccactcgtatttggccttcagtcgcctctttgtcctccaaagcattgtcaaatccgtccgtctttttctcttcttccattgctttctttttctcctcttcattactcttcgtcttctcctcctccgcttgctctttctttttgtcttctgtcgctttcctttttctctcttcttcttcttcctttttctcttctttgtgctttttcttttcctcttcctcctttcttttccgctctttttcttcttccttcttcttctcttcatcttgctttttcttttcttcttccgctcgtttcttttccattcttttcctgctctcttcctccagtcgcttcttctcttcctcctcctttttctgtgtctcttcctcctttcttactttctcttgttcaatccgtttcctctccgcttcttccatcattttttcctcttgctccttcctctccttttcttctttctctctcgatttcttctgcttctcctcctcctcccttttctctccctcctttcgcttctcttcctcttccttttgttncatttcctc

SEQ ID NO: 5327 - DNA, 1619 bp, Heterodera glycines
ttcgattttgcgcctgccggcgattccatcaatgtccgatagtcgtcgtcgtcttggatgcctagaaataacccatcaaattgctcggcatcaccagcagactgaccagagtcgagctgactgcctgaaaatgccgtcgatgactccgaatcgctcccttccgccaatgccagcgcttttttcggcccctccggcgttgttgtatcccccctcagcgtcactactccatccgcctcccttttgctcgatgcttccgccctttgtcccccgttttcttcgtccgccgacggtcgtcttttatttgccattacaaaaatttcgtcgctttgttcgctcgcttcgctgatcaaaacaccttcaaaatggaaagaacaaatgatcaattacgacttttaaaaacaaatttaataatgtgaaaagcaaattcaaacgcttgcccggcaatttggcgatgattttgtacacctaaaaaagcagtgattagcgctcattaacaatcagtggattatttgttcaataataaaactcacatatcgtcccgtctccaacacggaacggtcaacgaatcttaacgaaaaaagcgaaatatgaaagaaaaatggccaacaaagaaaggcccacttgttcctctcagagttgcttatttccagccaaaattccttctcggacgccaaaacggacacttttctgcgatgaattcctacaaaaaaacaaatacagaaaacaatcgaagttgagggaaagtgcgcataccgtacaccatggccctgtccacttttggccagctcagcgtgcatttcgtctgcgacgggtccacagcaatttcaggtttgctgaagggatgcgcagatggttatggcacatcggaatttgccattttatcgtactttggtctagagagaggcgggattggctccgaattggataagatgagcgaagtgtccgcagtcgcctcttcctcgtccggcattaccacctccaccgactcgctgggcaccgattcgccaatttcgtttacagccaaaattctaaaagccatccaatgtcggtgaaatgatacgtttatcggttaattgcctgaaggcataacattcgttggggtataagccgacgatgcgcgtgaagaagccgccacggtcggtgcgaattctgaacaattcaatttgggattttaagggtcgggaaaaggcccaaaaacaaaacggacaactgttttgttgaaagcgataaaaccacagaaactgaccgatcggctgtctttcgttggatttgtcgccatcggattctaaaacaaatcaaaaggaaatgggaaatcattatcaattttagctcaccgttctgccgtcttccgttccacaatgaaactttctaccgaattttcctcctccaattcgccgtcatcgcccaactcccaataaaggtccacacaggacgaggaaaagagttcggcacgtactctgtttttatgcatttagaagaaagatggaaaacgaatggcaaaagtgccaactttgtcggtgggacgggcacatccaacacacaaagatcgaagaaggtggagtcttggcccaactcgttggaagcatgtagccaaatctgtgcagcaatacgaagtgaca

SEQ ID NO: 5328 - DNA, 1352 bp, Heterodera glycines
gtgtccgagaagtgtgccgtacacagaaaactcttccccgcaaattttgaccagcttttcgtccgtgtagcggcggagcttcaaaagttcaaaggttttgtatatttgggccaaagcattgtgcccccccccccacctgtattttaggcgcaacttcgaacttgagcttggccggtgcactgcgttctccgctgtcctgaaaagtttttcccattttttcagtcgcatttttcgccatttgcggctgaccaatgtgacgtggtagtcgccgacatcgttctcgtcaaagttgtatatctccaggttagcgcgcagttcgtcaacataggcaaagcacttcttcgacatgagtcccactccgttgcggaaccaattggcccgctccgtcgtccgggacagttccgcgaacaggcacacgcgttcgccgtagtcgtgcactgttcggccctgcggggagaacataatgcgcgcgtcgggaggtcgcacggcaagttcagtctgcacacgatcttggccgccctccgtttcgcaagtgtacgtgcccgagtcctccttcatcgccccgtaaagcgtaaggtgacgcactttgcccacagagtctagcgcgacgcggttggttgcctcgttaattgtacgtttgttgcgggaccagcggacgttggcgtccggatgcgacacttcgcactcgagcgttatgtccttgccctcgaccaagtccatgcgttccgcgaatgccttggtgaagtgtgcttggatggcacccagcaaaagctcggcacggctttcgatggtgccgtgactgttgctgacttggcacgtgtacaccccctcgtctccgtcggccattcgatgaatggtcagtttgctcagataaccttcattgcttatcgacacgttgtcgttttctggcgttggcacaatttcctcgccgtttttaaaccaaagataggttggcgccggctcgccgacggcacaaacttcaagtcgaatttcgttgtttttcggaaccaaagcatcgcgcaaagtcttcgtcaagatgggcaggttcgagccagaaagcttcacagtgcgactttccgctgattttccaatttcctctccgtcggccgacttcataagaacgcgaattcggtacggcacgccctccttcaactcatcctcaatcacagccggtgatttactgtactgctccaacacctcgttccacacggaactgccctcggaacggtattgaataactgcgtgcgccccttgcgggatttgctgctgcaccgtttccgcggttgtccatcgaacgctcactgagtttccgctcagaatttcgacctccaggtgctgccatgtgcacatcg

SEQ ID NO: 5329 - DNA, 1606 bp, Heterodera glycines
  misc_feature (20)..(21): n is a, c, g, or t
  misc_feature (43)..(43): n is a, c, g, or t
cgtcgactcgtgagttgcgnnccaatcgccaccttccatctgncagaaaacatcgtagccgacagcgggacttccgccagtgtcccagcactcgtcccactcgaggcgaacgctgcgctcgtagacatgagacacccgtggcgcggaatgtaccacgggagcggagaacggcatgccggtagtaattgaggccacttttgagaattcgccgaccccaaatcggttgacagccgccacgcggaacacgtagggatggtcgtagtccaattcctccacgaaggtttcgttggtgaactgtgacagttggccaactcgttgccacacccttcgctgtgcccctttcttctccaccacataacccgtgatgcgttcggaatcgtcgaaaagatcagtgccgggcggagggttccactgaaatgaggaaatctttcaaaagtttgccctcaagggaccgactttcaagaaacagtagtcgtgccccacatcggtcaccatcagcccggagggcgggtccggcacgtcgcgcacgtacacttcgtattcgacagcgtcctcgccgtactcgttgaacagcaccacccgataggtgcccctgtcctccttggtcagctctttgcgcgtcagcaggagcgcctcctcgagaacagtgaccgaagtgcgcagttcaggcgtgagcagttcgccgttcaggtacagatccacttccggttcgggcagtgatttgagacggatgttcagggaaaggttttcatttgagtccaaaacaatgcgttcgcctttctgctggtcgagactcggctttccatgaactgaaaaaggacagtaaggtcgaaatccctcccccaatcaatgaccctccaaaacggtggatgactccattctgtccactttcagcgtgtaacgaccgcccattcggtaggatattttgcgaatttccaaactaccttaaatgattttcgcatttatcaagcgtaaatgatgactgatcaccactaattagacctataattggtcaataatccaactgctaaactgtatttttgccttttgtttttataaaaaacacaatgccaaccgtaagcaaaacaaatgccgggttttcgtcgccatttgtacggatttcaacttacaaaggcatccctccttggagatgacgtgctccgtgcccaattcggtcagttctctgccgttatggtaccaagaaatctataaatgaatttcataaatggcttttcctgactaggaatgcaaattcactttttgcgcagcgtcgtgactgagtgtcgccgcgagggtaattgtctcgtcgcaatgggcaattgctgaaaatgaacgaacttatgtaagacagccatttgtaatgtcatcatccgttctacttttgcggggcaatttctcagcaaattccaccggcgtttcctccactgtcaaaacactttcgatcgtttggtcgtccaatgtgatctgaaaaacgcatttgatcacataagagccgccacaaaatttaacctgaactttcatgatgaagtccaacggcacaatctgtgagaattgcaaatacataattaattgttcacgacaattataatgaatccgagcgatcaga

SEQ ID NO: 5330 - DNA, 1456 bp, Heterodera glycines
  misc_feature (13)..(14): n is a, c, g, or t
  misc_feature (33)..(33): n is a, c, g, or t
  misc_feature (35)..(35): n is a, c, g, or t
  misc_feature (47)..(47): n is a, c, g, or t
  misc_feature (65)..(65): n is a, c, g, or t
  misc_feature (72)..(72): n is a, c, g, or t
  misc_feature (81)..(81): n is a, c, g, or t
  misc_feature (93)..(93): n is a, c, g, or t
  misc_feature (95)..(96): n is a, c, g, or t
  misc_feature (98)..(98): n is a, c, g, or t
  misc_feature (118)..(118): n is a, c, g, or t
  misc_feature (123)..(123): n is a, c, g, or t
  misc_feature (133)..(133): n is a, c, g, or t
  misc_feature (135)..(135): n is a, c, g, or t
  misc_feature (137)..(137): n is a, c, g, or t
  misc_feature (139)..(139): n is a, c, g, or t
  misc_feature (153)..(153): n is a, c, g, or t
  misc_feature (181)..(182): n is a, c, g, or t
  misc_feature (192)..(192): n is a, c, g, or t
  misc_feature (198)..(198): n is a, c, g, or t
  misc_feature (207)..(208): n is a, c, g, or t
  misc_feature (215)..(215): n is a, c, g, or t
  misc_feature (249)..(249): n is a, c, g, or t
catcaattcttgnnttttattatttctttattntnaataaaaaactnaaatatcacaattaaaanccatatnaaaaatttnaaacccaaaatntnncnattccctccaaaactaattnttcancaaaatactnantnantttatacaaccatncataacatatacatctacttatataatnnaatacaacantttatnaacatatanntaatctnatatatcatatatcatccatcaatcacattattntttctgttcgggtggtcaaccccgagagatgaaagttcacaattgcatttattttcccttggcatttgtctctttcttttcctcttattttccccactctctaattgttgtgtcttcctttattaatgtaagacactattgatttatttggtccaatgcatgtccattcccctcattcattcggttgctttttatgcacttatttctcttcgcctaaatttttgttctcctccaatttatttattccgcctccgacttcgcccatttttatttaaaattgtttaatttatttgttcatcaaataaacattttattgtgtcggcttgaagaccgaacaattggcgacgcccgtcttaaataaagactcaacgacggatattttggcaatttcggacagattccgaattgctattcaactttcttcaaaaaagcaatagacccaataagggtgagcttccgccaggtgcggtttattcatcgaaaaaaaaccaagatacccaggtggttgcggtttccgccaggtgcggtttactcaacaaagacaaggaaattccccaaaagttgatcaacaaaaatggcgttaaatccgacaattgaccagctcgtgaaaatgctggcggatcaacagaaaatggtgcaggaccaatcacagcaaattgctcaactgattgcgatcggacaaaacgcaccaaatgcggcggcacagcccaatcaaggagcaaattcagtgccaatattgccggacatttcaccattcgagccaacggacgacaagagccgaatttcggaatggattgagcgcttcaaattcgcgttggattgcacagcaccaacggcggacgacgaagtcaaggtcaaatgtttgatgaataagctgagcgaatcggctttcagcgaatacagcagatcagttctgccgtcgtcggtcacagatttcagttttaaagtgacgacagaaaagcttgaaaagctgtttgccaaggctcagtccatattcatcgaccgctacgagtgtttaaaagcggtgagaggagaaggcgaacaattcaggcagttcattaatcggcacagaaaattgctgaccgattttaaattcgatgagctgacaaaagagcaatttaattggctcatgttattgatgggactcaaagcgccccacgaagctgcattgcgacagcgaatctgacaaattgtcagcagatggcgc

SEQ ID NO: 5331 - DNA, 5509 bp, Heterodera glycines
gggatccacagctgcgttgtccgcccgctcggcgggagggagtccgcagctgcgttgggagggggtccgtcgttgttgaaggtgcctgctctctcggcgggagggggtccgtcgttgttggaggtgcctgccctctcggcgggaggcagtccgcagctgcgttgggagggggggtccgtcgaatgtttttgtttggagggaggaggtccgtcgttgttggaggtgcttgccatctcggcgggaggggtccgtcgttgttggaggtgcccgtccgcacggcgtgagagagggtccgcccgaatgagggggtccgcagctgcgtttggaggggagtcgtcgaaggttttcgctcggcgggaaagggcctgtcgaagagggcggtacgcacctggccccattacattaagaaggcgtacgcatcggtacatttgggtggcggacgcgttgattgggatggcgtacgcgtggtaatactgtggcgtgcgcgtgctaatacggtaccattgggtgacgcgtatcgtttggcgtacgcgtggtaatacggtggcgtgcgcgtgctggtacggtaccattgggtgacgcgtacgtcgtttgacgtaggcgtggtaatacggtggcgtgcgcgtgctgatttttcgtacgatgcatctgccgtaggcatcgtacgcatgtatgataccgtaatgggattctgcgtaagaagcatttgccgtaggcattgtaggcatgtatgataccgtaaatgagattctgcgtaagatgcatctgccgaagacatcgtacgcatgtatgataccgtaatgcgctttgcgtacgatcaataaactcaatttattaattggcaaaggtccacttggcaattgtccaacccctccccaacatttggcaactgcccaatagcccccttggtaattttgtattttcaaatgccgacactaccatgccccccccatctttcgggaaaatcgataactaaattggcaaatgtccaatggttcgccccattttgcgcacgcgggcttctgcgtacgatgcatctgccgtggcaccattcgtatgtgagataccgtagtgggattctgcgtaagattcatctgccgtaggcatcgtacgcatgtatgataccgtaaatgggattctgcgtacaatacatctgccgtaggcatcgtacgcatgtatgataccatagttgttcataagattctgcgtaggatgcatctgtcttaggcatcgtacgcatatatgataccgtaatcaacgtatgcatcaagaacacgtatgtgttgatggacgtatgcacttctggagcgttgaatatcatgagtatgtggatgcgtacgcacgcatctaccgtataacattaatctaccatagtcatgtagacaacgtaggcatcaagaacacgtatgtgttgatggacgtacgcatttctggagcgttgaatatcgtgagtatgtggatgcgtacgcacgcatctaccgtatgtaactaaaagtattatactgtacgcattatggatttctgcgtaagcaattagaacctttctcatatagaatccggaagagacggcctgcaaaaagttttgttttgtaatcgattagtcattttttgttgccgcaggaaggtgtacaaggctatatcgattggttgattgtttataagaaggagggagttctcatttcttctcattcgttaattttttaatactaaatttcgtctcgctgtcctctatcaatattttaattaaaaaatattaagcattaaaaagcattaaatcaatgtcaactcaaccatctagctttttcaacgtcgccatgccgccccttggacatgtcgaacaacttgttcaacccatgtttatcaatgcggcacatcagcaaatgccggtatttttttattttttttttcataaaacaaattctgttttagtcaccattttgtgctgatggcacgcacaccattcaatttttgaatgggagcgtctctattgtgggccgcccgctgccgtctgttatttaaacagttttttctattcaattgattattcaggccgatttgtctcaccgtagtagcagtagatcaccgcccgcaccaacaaacaccagctggccctctccctgtgaccaatgttgtgctgcgcaacggcgacggtcaacgtgttgaagcttcgggttggcagcaccaggccagtgttctggcgtctttggacatcgggagtgcctactggttcaccaactgcactgcgcgggcccgataccagcaactggactgttggtatcgcattggcgtcgatggcaaaaatgccattgtcgtccctcacaccgccgctccacaggtaagtttttcaaacttttcttataacagaatattgtgttaagccgacggctccgcaaagtggtggactccaccattcaattgcctccattttgggagcacaggtgggcttaaatttattcaaaaattttttttaaatatggaataatttaaggcgccacatgttcagacgggtggaggccgtacgttcaatgaggcgcgtgcccctcccgaagcgagcccaattgaggaggacgcgaataacaatgtgagaaaatgatttttttttttgggttgtgtattttttttttgaataaaatttgctcagacaaatgatcatcgttttgggatcccggtgcttcatcaaagacgggcacctcaattggttggttattatgatttgctttttcttgaataattataccatggataaatttaaggtgactcgatcaattgaggactgtttcgtcattgaacgaacgacgccaatgcgcaacaccctccgcaacaccaggggcgaactttgcgagatccgcttcctgcctttggaggacgccgagcggcccgatctcgtgctggagacgctcattcagcatctgctcgaccgtgtgctggaaggtcacccgcctccgatgctcgttggacttcagcttcatccgcccggattcgatcgaccgtacgtcatccgactccgcccaccggagcaaaataatgcggcagcattgtcggcgcctattgagcgcctcaacgagcagtctgctgccggaatcgatctgctcgctgggactaccgtaaccaaagtgcttgctgtgtggcccctggagcctattcgtgctaatgctcagcgtggaggttgtgctattgtacctttaaatattgatttttctaatgaatttaggtggttgcgactttgacgctgaacaccatgtgtccaacaccgtgcggtcccttgtgcgcgtcgtcaacccaaacgaccgccattgtctggcgcgttccgtcctcctggggctctgtgaccgtgagacgcgacagccgaacggcggtggacgggacacatttgcagcgtacgctggacgacaagaccaacacggggcgcaggcggtggaccttttgaggaacgctggacttcccgtcgacaaacaaatgtacacgctggaggacgttgaacagcttcagcggtggatcatcaacgagcacggtgttggacaaattcggcttgtcgtgttcgagaaggagcaagagtatcggattgtcttcaaaggagaggggtgagtattttgtaatttttaattaatgtctaaaatattcttttaagtgtggctgcgcatttcaatttgtgcctcttgctggagcgtggtcactttaactacattggaagaattgaacaactgttcaaaatcgagaactactgtttcgactgtgaacgcagagcaacgactcgctatcatctggccggctgtaaagttgtgtgtcgtttgtgtcttcggtttggcgcagggtttccatgtcaaccggaacaggtaataattaaaaaataaataaataaaatgaaatatgcttttttttttagttgccaaatggtgggagcagttctcgtcgctgcaatgaatgtggctttgtatttccgaacgacggctgctacgactatcatcttgccaacatggctcccgctccgattgatggccgaggccaacgccaacggcagccaatttgtcaatggcgtcgtttctgtcgagcctgtggtcgtgtcgcttattttggcgtccatcaatgtgcaccactccgtcggcccgctggaccaattgactgtcgccgttgtcatgggcggcacacactggatgagccgtgcttcatccaaccgctccttgacaggcctgctcatcagaacaacaacaacaacaacgatgatgacgacgacgacgatgacgacgctgatgtcctcgacgatgatgaagcggatgacgaactcccacttcgtctttgcttcttcgacgctgaaacgtcccaggagcggcccctgcaattgaacaaccaaattgctcagaagcacgtaccgcttctcatcgttgctgaagtcatctgcgagccatgtcttcgagcgggaatcaacgtcaacgatggattcggaagaagagctcctgattgtgtttgtttgtgtcggatggtgcgaggtcaacaactgaggcagtggtcttctcccccgtttgtcaatggagcaggcgacaacactccgcccccagagggcgctccggcattcaatcagcgccgcttctactttcactcttttgacaacgaggccaacgatccgattgagcaatttttgctctttctgatgaagcacggctccaagaaggcacacacagtctgcatcgcgcataacggtggaaagtacgattttcatctcgtacttgaggcactccatcgccgcagcattccaccgaagcgactctgcacgacggggctaaaaatatattcaatgaagctgcgcggattaaatcaacgacgaattacattcaaggactccatcaactactttttctgtgaattggatgccttggttaagagctttgatctgccacaacatctggcaacggtgaagcccttcttcccgtacttgtacatacagcgacaacatctgctacaccgtctcaacggtcttccggcaatagaacactattcgcccgacacgatgaaggtcgaaaaacggaccaagttttcttcgatggcacggttacaacaacaacaacgccaactttcaactgcgtgatcaactcatcatgtactgtgtcaacgatgtggcaattcttcgtgaatctgtccttcgatttcgtcaactcatcggtgaacacacccaaggccttgaccccttcctctgcgcttcgacggccgccggcctagcgctcgccacgctccgccgctgcttcctccccgtcaaccgtttggtgcactctccagaaggcgggtacctccgtggacgacgagcttctgccgaatctcgtcgctacatccgcttctttgagttggaaaacgatggagcacaagtgcagtgcgctgactggtcagtgggggaggcgcacatcgaggattctgggtaccgtgtggacggcctttggcgccgtgacccgccccttcgtccaatggccatcgagtggatgggatgcttctatcacggtattttccaatcaataaagattta

SEQ ID NO: 5332 - DNA, 1465 bp, Heterodera glycines
cagtgatcagataaaagagctgtcaatgggaagggtacttaaatattttttaattttataaaatttacgaggcttcccgggtttgacgtgttcattaaatgtgtgagaaaaatggccagtgcagccgggtggcacttcagttcttgcaggttcgaaaatgggcccaccgggtcctggcaaagcattgtttaaatattagcattaagataatttatgttttaattcgatgatttaaaaattacaaaaatataaaggcctttaaaagaatgaatttagggaattaaaaataattattttaagcaagaaaagacattaattaattcaattctatcgggtttttttgcaaaaaagaatcaatttaaaaaatatatacataaattcaacagctttttcaaatattttcgccccttttaaatatttacaatttattccaattttttaaaactgttttaaattgcccattttcacttcgttcgatgccatttcgttgtgttctgctgccccctcctcgtccttctccccctccccttttcccttctgttccaattcgtcgtcgcccatcagcaaaaggtcattggccgcttgttgctggtgaatatactgcattccgcctgtttccacctcaaaatcaatttttattttttgtgcttcttcaaaatagcaaattttaaattttagtttggtatataaatttcccctttccccgaaattcctcccccgccccccacccattttatacgtacccaacttcgaattggctcaacttttgccgcaacaattgccgactttggcggtgcaactcgcattgagctgggcggaaaagttttgttgctctgaaaggaaaattaaaatattttttgaaaattaaaaaaggaatttcaaagaatcgaacaatttatttataatttaaatatttattttttaaacgcatttaaactcgaaaatgcattactattttggatggcttcatatcccttttggcaccgtattgacattcaaaatttcaacgaagaagcaaaaatatcccaaaaatttcgatggccaatttgggggcgaaaacagcggcagtcccgcagattttctgacgggattttgggctgttggtggcaccgctttttcatccgtcccccggggggatggacgacgacgacgccacaccccgccaaaaccaacttttttgcttttgctttgtgctgtctattctcagagagaagcgattaatggcacgaaatgtttccccctcgggcgcatcgccaatttcttccttttcggcggcaacaaattaagtcaaaaaagctgtgccggggtggccacaaaaaaaggggggatgtaacgggatcggatgagcggggagagggtcgagaggggggggggggggagggggatgtttcccataaacttttagggaacaaggttccggcgaagccgataggcgcggccgggaaaatttttgaaatttataaaa

SEQ ID NO: 5333 - DNA, 2874 bp, Heterodera glycines
ttattttaatttatttgaattttaaaatgcttgctcttcttcttgtcccccgaggtttaaatgttcattaaataataatcaaatttcttgcacattttttgtttttggcaaaatgtctgcgcagtgtgctaatagcataatttgcgcctcttaagtacctaattatggtcatcacatttacggcccctttttgtgttctttcaacacccgcaaggcataaaaaataaattatgttatgtatgaatgagtgagtgacagaggctatgttttttcgaatgccaaaacacaatgccaatggggtggaagaaacggacgagggacggaatggcacacggatgacacaaatccacccaccaccacaaatcctatttgggccaaccaaatctgcaccagtagaaagaaactcagtcagtcccccggggtttgtttggtttattggcaaatttaatgagaccaaattttacaaattttggccatccaaaaattaaaataatgcaaaaggaattaacttcaaaattaaaaaaattgtattaaaagtaaaggcaatctttagaaacatagaaattttttaaacaaaaaataaaagaaattttcgcttaatattattttccagtccaaaatttttaatcattttatatttttatttttatttgaccacctgctgttccgtgccgctctccgccgccgcgctgcacagtgacgcgcgcttctccgttacggcacattttgcggctgtgccgcgtcttcgcctgttgctgcgcgtctgttgctgctgctgatgatacacgttgaatttgtcgttggttccattaaccgcgtgcccaagtcgtgctgtgttttaattaaaatttatttttttattttttaaaattagactcgaaaactcagtccctaataaaaacaatgtccttttgttttctgcctttgttggttcacccatttccttttttaatttcttttaaattgcgctgtttctttgccttggccattgttttccgccgtgccattgtccatggcattgccatcacttagcagcggactcaatgtgttcagccggcactccaactgactaatccgactcagtgcccgttccaatttgatgccaccaccgccaccagtgatgatgtgctgcggttgcttgtcagtacagtgcatgtttgcttgaagacactgaaaaggggccatcgattgatcaacttctttttgattggccatgtgaaatgattagtgatttaattatatcgtaaatttcattttgcaatttgtctttgattttatttttaattgcataattatggcaataattaattaaaaatttaatccaaatgagtttaaaagaccgaactttgttttgccaaaaaaaaagtttgtttatatgggctaagaaatttggcattcaatggtaaacgtaaattccatagggaactgaattcaacccctttttacgtcatggactaaagaaatttaggcttattcccaaaggcttctcttaaaaagaaaaatcaattcaaattcatttaaactgaacaaaaaaattgtatcaattttttgaattgataaaaattcgaatttttcttaaaactttgaaattcaatatgtattaattgatttacacctccaaattggcacgttcccgctgcaatgcgtggaataattcgttggcacattgttggcgccaattttgatcattcaatatctatttaagtatatttaattttactttttatttttgtaaaaaaaacaaataaattattttaaaattaaaaaaataaaatgtttaatcattttactgacaatatatgtacataaaacaaaacccaacctaattataattataagaaagacaattatttaaataaacggcaataaaaaataatttatttattttaaatgtttttatatttaattcccatagttttttaatttattaatttaaattaaattattttttctcttataattcgttgccacctcccaattgtgtccatttttgtcctcctccgttatcattgtttttgttctttttgtcgctgtcaatggcggcggagatttctggcacagtgccgtagccggcgatgggtggtgttgtacggggaaaagtttgtcaaagtcgtcccaactgtttgttgccacagaggcggggccgagcagagtcagtgccaaattgtaacctcctaattagagtcaattagtgtacacaattgttaattgctaatttcttaaattaaatttgaataatttatttaaatttatttttaaataaaaatactgaccagaaatcattttgatcacttcctggaaattttgcgctgtcactggcattccattgactttcaaaattcggtcgccctcccttaattttggaaatgaaatggaagcgagcggatacggtacatataaagtgataaaggctattactgtaaagtgataaaaaatacaattaaattaaactgttgctatacgcatataaaaatgatgaatataattgcacattaaattcgctcttttgtctaaaaatgatgcttaagcctaattaattagtctgtcctcatgggaaagcaattgcctttttttacttcatttttgttttaccttacgccggctatttgagcggccccgttgtgctttaccactaaaaagttgccaaattaattaaatgtgtgtttggttgtcaaataaaaaacaacacctgcaactttcactgggtattctccgttcactgtcagtccgaatccgtccgattgtctgaaacatttgtcgaatttcacattttgattcggggcgttttgacatttcgaccttgccacaagcacacatcgttccgtcatcttctgttgccattgcttttgcacacatcgggcgattgttcttttt

SEQ ID NO: 5334 - DNA, 1872 bp, Heterodera glycines
  misc_feature (51)..(51): n is a, c, g, or t
tcgttgcttaattaaggcatttcgctgctaattaggctcattacccaaccnccatttcgactagaataatactattaggtttatataaaaaattaaaaatgaatatttatttttatccaatgactattattagaaaactttgctgttcagcttcatttgctaacccggtgaaattttggtgttttcgcgctgcgttccatccgccgttgtcgtctgtggtccgccctttttggtcaattcggtgccggcggcggaagtcggcggggaaaagcgccggcactgcggagaaagttctaaaaaataaatcaatttaaatatttataataaaaaagacatatattaattaatttcattttttaaaagtaaaataaatggaatatttaaattgatatattaaaaataaataaaatattttatttttttacttagttttgaaaaaaataaaaatttatttacaaataaaataattgatttagtgagatgtacgaataccactctttacagtattctctccaccggtttaccgtacccgggatggacggtgggtaatctgtagttgtactgcttgaatttgatgagttttcttcagaaataactgaccaacgggaggacatttttatgcattttcagcggaattggatttcctttttgggataagaatttggaaaatatgcaaagtttgaggaatagagacaggtaaaaatgaaaaagtaatgcatatttaaagagcatatgaattcatcggagggattaaaggaaataacgtggcattttcaacttttattttgttaaataaaatatttattcaataaacaaatattctatgaaaattcaaataaataaatttgcgaagttttcacaaattttatttcttagtgtgtatatagaaaaaaaaacttccgtttttattcttgtaaaatgtgtaaaatgaatttactggtgccccgagagcacacatcaaatgcccccggggatggatgggttaagccggccaaatttgacgggaaaaaatttgggttgaggagggataacttataaataagggcacagcagcagacggacgatgaaccgaccacttgggaatttgagaaagaggcgaaagttgagagattagaaattggggggggggagaaagtgccaaagaaaaacatagagaaatgggagatttgaattttaagatttttttggacgaccgatcacatagaatcggtatcaaatcctaaaaaaagctccgggcaaataattttggcggatttataaaaaaaaagtaaatgttttggtatagagaataaatattctcgacattcattttgagaggaagccgaatttataatgaaataaacgaacagataaagcaaaaagcagcagagaatgtttgttgttcgccgcttttcattttaatgccggaagaaattgcgtgagtttgtgcaaatgagaaacaaagcggaagaattggaaattggatcattttaaacaattaaaacttgaaaaaaactgaaaaatttatttgttaattaagtaaaaaaagaacgtaaataaaaatgagagaatttaatagttatttttagaataagcaaataatcaaatgatcatcgaaataaaaggagcaaatcaatgtgatcaaattaaaaagtgatcgatcggtagtcatgcaaattgtgttaatgactgatcataaatgcggagaatcagcagtgattaattaaaagaacactggtcgaacccccaacttccatctgttgctgttgcgcctctcacaaaaagtggcccccgcccgaccgaccgatgacctccccccgccccccctgaaaatcacagggttctcgagggagaagatgaaatgatgaatgaatgtgttgaagacacacataa

SEQ ID NO: 5335 - DNA, 814 bp, Heterodera glycines
gaatccggttttagaaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaatattcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttctcctccccccccccctgccggcggggcgaaactcgtcggataattgttccggaaattggcgcaaaaaaataaataaattttggggcagtgctaaaaaatatcaaacaacaggcgcaagaagaagaaggggaagaggaggaacaagttgttgttgttctattcttcaaaaaacgcatccgctgaagatggcacaaacggacggacaaatgggcgaaattacaataaataaaacgcat

SEQ ID NO: 5336 - DNA, 6178 bp, Heterodera glycines
  misc_feature (22)..(22): n is a, c, g, or t
  misc_feature (50)..(50): n is a, c, g, or t
  misc_feature (55)..(55): n is a, c, g, or t
gggtgttttcggtccgagggtntaaggaagacaatcaataaataaaagtntatgnacgaacaataaataaaaaaacgaagacaatttggtcggaggcaaataacaaaataaaatgaatgaggggacaagacaaggagggaggaaaagatcgtctatttatgggtcagtgacaacaacaaaaatggcgtggaatttgaatggacagatcgccataataattcaaataggctcatccgaacacctccccctttgagcggctcatggcgagtaccgtattggggcacgtctgttccgttgcgggtatcggcgtggttgaatttgctgatcatcttcttcggccactgattcgtcgttgtcggactgatttagatcattctcgagtccctgctcttggacagtttggttgtgctcagctcgagcttccaaatcattggcaatttggcgatcggcgggttttccgatgtcaaatgtgtcgagaaagatttgcaattggtcggcttcgtcgggagtgtgtcgaggacggagttggttggcatggaatcttcctgacgacccgtcacggaagtccacgtcataaatgactcctctctttttggacacttcaccgaatttccaattttgtgaaattcggtgtttggcgaagactttgttgccgacggcgaactctcgaattttggtgccataacgtcggttgaaccttttttccatctcctcatttcgctcttttggcagagtgggagttggtttcaacaaatccaacgttgttcgtggtttccttccaagaaacatttccgctggggatttgctgtcttcgagcgaatcattgggggttgtccggtagctgacgaggaaagtctcgactatgcttttactcggagccccctccccttttaattttcggaaagttcttttgaatgtgtccacaaatcgttctgcttggccgttggacatcggattgtatggtgccgagaacaggtgtttgatgccattgacgtttgtgaattttgcaaattcatggctggtgaactgtgttccgttgtccgagaccagagtttcgggaagtccgtgccgactgaagaggtatcgaagtttttcgatagtggcacttgtcgattttgttggcatttcgaaaacctccgggtatttcgaatatgcgtcgacaatgatcaggtactctttcccgaaaaatggtccggcgtaatcaatgtgcactctctgccacggtccatttgtctttggccaagattgcaaattcgttttggttggcgcctttgcctcattttggcatggttgacaattttcaacaaattgttcaatttcctggtccattttcggccagtatgcttattcacgagccaactgcttcatccttttcattccaggatgtcctttgtggagcagttgcagaattttggctcggtgttgcgttggaatcacaactctttcagcatacatcaaacaatctttggtgatgctgagttgttccttcctttggtggaaaattctgatttccacattttcgttgccaatattttgtggccagccatttctaataaatttcatgacctttttgatgttctgatcactttttgacgactggacaatgtcatcgaatttgatgggaagcttctcgacggttccaatgaaaatcgattctacatccgaatcgaccgaagtatttgcgatgacgcggtcttccgcatcttttcctttggcaattagccgtgaaagtgcatcagcttggccgaagtcgttggtattgacatattcaatgttaaagtcgtatgccaagagaatgagtgaccatcggattggaactgcattgccgcactccttttttgttgccgaagatggcgagaagaggcttatgatcagttaggagcgtaaatttacgtccatagatcattttgtgaaatttctgcactgcaaaaattattgctagtgcttccttctcaatttgtgagtagttcttctcggcaggagttaaagcggaagatacatgcgcaatggctttcatcgttccgtccgggaatttgtgcgaaatcactgctccaattccctgatcagaagcatctgctgctactacgatctctttttgagggtcatagtgcgtgagcagcaatttggatgacaaaatttctttgattttgtcaaatgcctttttgcatttgtcgctccaattccattcggtgtcctttttagcaaatcatcaagcggctttctgacgaagcgcatgtttttaatgaattgttggtaatggtttaccattcccaaatatgaccgaagtgaagagacatccgtcggttctggcatctcattgatggcggtgattttgctggggtcgggtctgcgtccgtttttgtcgattatttgtccgagatatttaatttcatcttggaaaaacgaacatttttcccgtttgacgcgaattccccattcttgaaatcgcgagaacatctttttcaaatgttcagaatgttttttttggtccttgctgacgatgatgatgtcgtctaggtaggctgtcgcgaagtcaaaatctgccaacatttggtccattatcgattggaaaatgccaggagctgtttttatgccaaatggaagtcttttgacttcataatttcctctatgggtggcaatgacacacagcttttttgatgcttcgtccagctccacttgaagatacgcatcccggagatcaatttgtgaaaaatactggcctccatttaaggtggcaaatatgtcttccggtaatggtaacgggtgctggtggtcttttagcgcattgttgagtccggttgaatagtcgatgcacagtcgagcgctaccatcggcctttttgacgaccaaaatcggtgctgcccattctgtgtgctcaactttgccgatgactcccattttctcccaacgatccaattctctgtcaactgcttctttggcgttgtacgggaccggacgggcctttctgtatattggccgtgcgtcggcgttcaattctaagtgcgctttgacctttttgcagagtcccaattcagttttaaaaacattggtgtactcctgctttagctgattgatttctttctcggcgtccttgtttcgtttgccggcaactttgttggatttgattggggcatgtgttttgcctctcaattcttcccttgcgctgcaaagatttatcggagagttgattttggctttgatgccatccaacaatccaaatgcatccattgtttggatgctcaacagattcatcgagcctttttcggcaacataaaaattttctttaacttttacgccttggaattcgaaatgtccttatccctttccgataaaagatttttctgtcccatcgaacattctgcctctttcggcacattcccaaatttttggctgtccgatcagtcgataagtttcctcatcgatgacattgatctgtgccccggagtcgagaataaacttcacgatccttccgttcagcaggacttttatctttataagagaagcactgttgattgatttgagtgccattccaatgctaagcgttccaactttcttcactttgaagtttttgcggcgccactcttgcactttttcgcattggttctccaaatggccggtgtagtgacatttgggacacttagccgatttgtgcgagcattctctgtgggtgtggttcgttttcccacatctccaacattgaagctgagttggagttgcgtttggttggccttgcttggattgtggctttggtctttcccttctttggtttggcttcactgcattcactgtccttgatgacacggaagttgcttcgatcaattttgcctcatggattgtagacaaaaaattgatgcaatcctcaatcatttcatcgtatttgacggcgtcgccatcctttgtaagtttggcgagaatacgttaccgaagaactgcgtcctttgaatacttcagcgcagttaggagcattagccctttgaattgttcctcattcaatttgtcaaactgaaaatctttcaaaagtcgtttgtgcctgttaacaaattgttgaaattcttcgccatcgtctttggtggcgatcagacatgcaaatcggtccacaaatattgattgtggtttggcaaacagcttctccaatttcgaaattgtttcatcaaagtcgaaatccgtcaccttggccgggagaacaaatttgctgtactcgctgaacgcggtttcagacaatttgttaatcagtgccttgacttttatgtcatcggccgcgttcggtgcgcacgagtcaatggcaaaagtgaatcgctcaatccattcggtgatgcgaggcttgtcgtcacacaaaaagataaaaattcagtataggcggttaaggtcagcaaagaatgattcttggataggtaagcaagttcatcgaatcaggcatcacaaagtgaaacaaaaaaacaaaaacaaaaactgaagcttccccacggtggacatctttacacattcgataaaatgagtaaagatgaaacgacaaaattttggaggtgcgaattcaaggatagcgtcaacaaatgtaaaggccgcatttggacggacctaaacaataacttcattcgtcttgcaacgccacacacttgtcccgcaaattcttcgaatgttgaagctcaacgagttaaaactacaatcaaactccgtgccatcgccaccttggaaccgccatctatcattcgttcagaagcattgcagaacgtgccatcaccagccgcacttttggtgacaaaaaggctcgcgaatgacgcacgagaattttttaacaaatgaaaactaacaaacaacttatttagttaatcaaaagggcgcgccacgaaatcaatgcaccaccagcagtcccgaccaatttgaattttgagatcggccaagcatacaggacctacacatcgacgggtggcgctgaggagctgtttctttctattgggcgactccggggtgtattttgaaaatggaaacgaaaacctgcaacggtaatttgtgaaaaaatgcaaaaatttttttcgcagagttttattgtttgggcgcgaatcatttggacgctttgcggacagaatgactgagtgtttcggtgacggaactttctcgctcgcgccagcccaattttatcaaatttatacgatcctggcaaagtctgtttgtcttaaatcggttttcaaatttgtaaattaaaatatttagacgtgaaaaatggattttcccagtgtgccatgccctaatgacttccaaatcgcaaacatcgtacgaaagaatgtttacacttttgcgtgctgcgtggccaaattttgctcccatttctttttccgtggattttgaaatggacatgtcaaatgccgttacgacaatctttcccggatgccagatccggttttgcttttttaattttgtacggaacttacaaaaggaagtgaagcagcaaggcttatggcaggtaattttctcccctttatttaaaaattttttttttcaaaatttaagcgttattgttctgatccggtgtttgctttgaatgttcggatgctcacatcagtcgcattcgttccgctttgtgatgtcaggaatgcagtgacagcacttgacatggaatttggaaatttggcggcttttcgacctctcattgattggtcagaaaataaaattttcaattttagaataagtttttaggcttttggacaattatgttgggcgtcctcgtcccaatggcacatggtcacaaccattgttccgtccggagcagtggaacgtctaccaacgaacattggatggaaatgcgaggacgaacaataacgcagaagcggaacaccaccgtttgcagggcgcgttcaattgtcgtcatccatcgttgtggaatttcattgatgttcttcgacgtgaacagaaaattgccgaccacaaatacaattctgcgatcgctggattgtcacctgataaaaagcgaggcaaatatttggcagctgatagaagaattctgaatatggttcgcaattacattccattgaatgcagtgaatgatcatgattatcttccacccattccccagcccaatcaatttcacactattttggaatttcttcgaggtatttcacaccattatcaaatgaacccttgaaattgttgtttttttgttacctatttattttttgttttttat

SEQ ID NO: 5337 - DNA, 1025 bp, Heterodera glycines
tggaaagaggggaaagacgccctattgttatttctcagtactcgacgatgacatgacccacacaaaaattgaggttgcaaatgtaactttgttcttttttacttttctcttttagggaagtcttttggaaggaatgtattggaaacggcggatggaggctgtctgtgcccaatacaaacgatggaggacatacaatcggaacagagcgcgcaaaaaatgttgtcggaaaagggtgagggaatgtacgggcagaatgctaatgatagaccaaacaaaacggggtgcaccccaaaatcacgccgctagaaatttttaaaaaaattttttaaattaaaataaatcttggaaaatttttttacgaagaaactaatgaaaaatttttttttttttggaaaattttcgaaaaacaataatttatcataaaatttcaaaagaaaaatcgcaaaaatatttgcaattttttctcttttaattttcttataataatttttctagcaataaaattttttcttgaaaaaattctgtttgaaaattttcttacggcgtcccggcatggttttgtcatgttcccttaaaacgatatggcaaaggtggaatagaaactgatcattgggttaaattggctttgggtcagcacaatcggtgggcatgggttgtgctgtgttggttcagtgcagctcttcctcaccctcaaaggagaacagctgcggatgtgacaaaggcgccgttggcaaaattgggccggtcattgccaatccgtcccagccgaatggacagcagcggagcatgacgcccgagaacatgtcgacggggaacaacggtctgatgggtgcggaatcaaaaactaaacaggactgccacgactctctcatgtagtaccaaaactaaccacattactaacatttgttaacaatgctgcataaattgtcaaaaatcccaggcgacgcctaacagcgcgtcggactttcatttcaaatgtttggtttgtttccgacgaaaaatcaccaccggagcgcccccccccc

SEQ ID NO: 5338 - DNA, 4424 bp, Heterodera glycines
aaggaatagaaactccgcataattcattgttcgatgccattggcattgaaaccaaccattcttttctgcaagacaaatgcacgtgagtttctaatgagttcattcaatagttaaaaataaatggaaaaatttaatttattttgctgttattttctgccaggattcgattgcgccgcagcaattcgctgagcttgtctctgctccctcaaaaacatcgcaattcccgtcatcgaccaaccgctgggcctcccaaaatcgccgtcatccatcggcggattccttccgcttttcttcgccttctcttcagttaccccaacagcagaaatctctttctgtcacttcaccaccaattgacaaattcgcgaaggaagggacagaatgcaattggcgatttccttcaacatgcgccacatgaacttaccgatggcatgctccaattgagcggagaatcgtcagaaatgctgatggcaacgactctgttgggactgagcgaacagatcaaagaggaggagggcgatgggacaatgttagaagaaaagatactgaccgacgacaaacacacttttggtgagcagtgcaaaagcattcaacatttcgaaatgctgaattatccgttgtgccatttccccaattactcttgtgctttagccactttgggtcacaaaagacggcaccaccacggccagcagtcctccgttggtgccgcttgctcttccacccaatcctccgccccttcttcaagtcaatcggaacaggctgattcaacactccatccggaagagcggaaacgcattttgcatttgcatgcggaaaagaatcgccgttttgcgctgaaggaaggcttcgagtcgcttgtgaatgccattccggtagttgagcagacgggcgttaaatgcaccaatgcggtggtgctgaacagggcggcacagcacatcaaacaattgaagagcgaacaggatcagcagcagatgaagttgagggtgttgcgggagaagattaccaacatgaacgaacgaatcgcgtgagttaggagtggaagagggggggatgaaccgatgcaccccaaaactccgccgccgaaactccgcctggcaaaaaatttcacttacaaattttcaagaaaaaatcttaggaaaattttttcttaaattcggagataaaaatattttctaaaaattttccagcgattttttttggaaaacagtttttcatcatcaagttttgaaaaaatcgctagaaatttttttaaaattacttttttcttcgaattttctaagaaaaatttttcgaatatatcgaagtttgaaaaaaaattaaaatttttttggcgaagtttcggccggcggagttttgtcctgctccgtggatgaacgtggtggaccgagcaacaaacactcccatcgttttagcctaatccagtccaatttgccttcctcatcaaccggtggttcacggccttgtgaagctcagactcccagcatgcgcattcaagtggaacaattcttcgaacattacaaaaaggaacgttcccgtgaagattaccgcttttggctggtgagtcgtgattaaaaaagggggcggggagtcggagacaaaaaaaacacgaaggggtaacgatttttttgctcttcattgttaagttttttggccaaattttgtccaacaaaagcgagtgaattccttcagatgggtgaggtgctcaagcctattgtgcattcgtttgccgaacaaattcacccggacgcgtctgaccatgaccgtgttttgcattcgttgaagaaatggctggacacccattggaatgcggcggtgcttcgtcccatcgcttccgatgtgttggtccgattggcgaccgcaagcgcagcattcactgacgaagcggcgctgagcaattatataatgaatgaagtgcgcaacgcatcctccgctcagtgacacgatgccgcttttgaatgaatgtcagcactttgggatgcccggttctttttgaggttgcccttctccttctctggcgatgtgccctccccatccattttgttgcgactattcctattttttttcattattttgtacattctctgctcccccacttttccatcccttctctcccttgataacatatctttcgtttcttttccttgtcacctcattgcccttcgttgaattgctggtcaattctctgcaaccttttttctacacatatttcttattattttttgctcaatcagaataggccatcacagaaatgtgtcaaatatatatttttaattaatcagagaaatatttgtcagagttttaccatatttttaataaatggctaagatttttatataaaaaaatcccaaaattgcaacgtataaaattttttgaaatatccatgtgtgaaaactattcaaagaattttctttcccccttttaaatgccttcgttacttaaaagtcttagccataataataaatcaaaatatttttttgttctaaaacacaaataaatgatgtacaaataatctattataatttatttgtcgttcaaaagtgaatgattccatgaaagtgaataaaattcatactttgtttgttaattgacatactaaagatatgtacgcttttttacccgcagcggaggggggggggcattttacccgggtaaaattgcccgtctttttggcatgacttcgctggtgactttacggaatttttggcagagtggtgggagggggggggggggtgacccgtcaattagcgaatgggtgttctcatttgttgaaggcatttgctgctccgcgttcggtgtgcttttctttcgtgccgtcgtccgctcactcgtccacttccaatcggtgccaatgttcgaatgttttgcctgggttttccatcacttgttgccattgtcggcccctttcgtcgggtgcggcggtggacagaacaattccacctgaaaggaggaggcgggcgggggaatgtcttcgcaattcgtcccttcccttctcgtttaccgatgtaatcgtcgtgccgtccaacgtcgtagtcgtacactccgatgactaatgttttgcgcggcaagtctttgaacggcacaatgaattggagggtctgaaagggaccgccgttctccgtccgtccgtcggctttcttccctcacctcgttgaattcagggttcaatgttcgctttttgatcgtcgttctctgacgatgggcttttgttgaaagcggggtcagtgaaactttgcagtacgggtcggagaagctgaaaatggcttttccgacagtcttttcgacggcattccgcaggcggaagggcgtggccaaccgcgcttttccctggccacgcccttggggacgtacccggtcgagtccatgccaagcagttccgcacaccgtctgatgctcacaaacagcgacccctgctgaatgttgtattgcaccgccagcaaaagttttcctcgttcgtccgccgtcgctttattgggcccgaccattcccttttcaggcgcgggcattggcatcgcatgttccaggtacaggttgaacctctttgtctggcccagcggcagcttgcgcagtgcgacgcgcgtctccccgagaaagtcagagccgatgcggtcgcggtcgagaacggtgacgcgcagcgacttgcgctggcgttcctcctgagaaagacatcactcgtcacattaaggcatcagtcagcgacttctgttatgccgtagtaaatcatctcctcgttccattcggggttcagcgtcttctcaatcgttctcgaggttaattttgtcgcttttacgttgccgggcaaaagatggaacttcacgtagggatcagagaagccgtttttgtccatcgccttcagattctgaaaggagcagcgaaaactgagtgagttaatttggcatttcgcggtgaccgatgacgtcaccttagctcgaatcagatgaatgatcagctgcttatcctccaccaaataggtgagattgaattggatggagcccaaagtacctaaagggaggaagaatgacacttacaatcgccgggagaaatgccaaagtgagaagaaaaaggtggaaagggaaaagagtagtggggagaaagaagagtgagtgagggaaaaggagagaaaagaaaaagagagatggacgaaacagtagagagacagaggtggagaaggacaaaaaagagagagtgcttaaaggggagagaaaaagaatggagagaaaagggagtggggaaacgaattaaatttgattaatatgcgtcaaagttgtgctaatgtgcgtggaaaggtcctctttactcgtcgagtgagtgctttgagctgaccgctgttttcatcaatggtcggcaaagagttcgccgagtgcggccttttgggcgtcaagcctagtaaagagactaattggagtgataaaactccgttccgaagtcat

SEQ ID NO: 5339 - DNA, 948 bp, Heterodera glycines
  misc_feature (870)..(870): n is a, c, g, or t
  misc_feature (897)..(897): n is a, c, g, or t
gaaagaaaagagaacgcaaactgactggaatcgtcctcgggagagctcatgaatgtgggtgagttgtggttgttgttctgcagttcctgctccagcttctccaccgtctcctccaattgtgccctttcctctttcgttggcggcgccgtcgattgggtcgagcgtctgctaccgccgaacacatcgggcgccaaactcgtcgaacttgtggcagccgttatcgaactatgttctccgtacgaaacttctgcgcatttagggtcaatgtcaaaatcatttgctattaatgaggggaccctgcggcactcctccgacgtaagcgatcgcgcggttcgcttctcccccaactttggccggaatgctttcgtgtgatgatccgctgttatttccgccgctggaccctctcagtttgatcagtgcagcggatggagtcgttgcagcagaagcgggcctccgcgagggaacgttcggaggatagggaaagtgcgagtgggagaggggagctgtgtttggcagcgcggatttcagcggggaggaagcgatgttggcatttcggggagggatcggcggagggacgggcgatggcatttggaagggaaggcgctgaacacttcccgcgttaacggaaaagctaagggaacacctgctgggacagtgactgctcctgcggagggggcagcgaattgagctgtgagcgcgcgtacgcggccaatccgtcggcggcggcggcctgcggctgagcgacggaatgatcactttggacgacttaagggaaagggcggtaaaaggcaaagggaggacaacccaaaagagcggggcaaagaaagggcattcactcgtaaattgtggcttttgcttttcctttcgtgngtccgccattttccatttcctccaccnaaccacggaatcgacgctgcgcgagtcgctcagcgtctgctcgccgcccgc

SEQ ID NO: 5340 - DNA, 2258 bp, Heterodera glycines
ctaaacgtaacacgaaaatatttgccaattcattcaccacgatttgcacattttgtgcgatttgaaattgagcaatacaattaagataaatgggaaagacttctgaaactgtttccgatttctttatagtaaaagaaaagtcctcaattgtcccttcccaaaatggcgttttgtccccaaattcaaatgcccaaatgtccgttcgtctctttctctcttcattctctctctctctctatatatatctccctctcactctctttttctctctttctctctctatcacctgtgtccgacattcgtccgactcttcccagtgcaactctctgcatcttttggatgccctgctgatgtcccaaagcctccgtggcgttgcctttgctcttcggcttcgctttgtttgtccttaatccactcgcaaatccgccggcgtttgccccgaggggatgagcagccgcgtgctgttttaccgaaagcgcacgctctttagccgcgaccaacgacttgcggaactgtgcgggttccaaagacgaggaagtggacgaggaagccgactcgccgtccgagtcgtcgtccacactgacgctggactgctgaaggccttcgtggacccaagaagggatgatgcgcggtcgcggggtcgtcttcagcctgccattgccattggtcccttcgcttctcccccccccggctttttcgacctttgctgatgttccgctgggattggcactggtgccctgttgctgttcctcttctgctgcgggtgctgttccgtcctgccctccgtcctttgctgattgccctctccagcggaatgcattcgaatgttttctgctccgctgcaggggtcgttcccggccccaaattcgaagtgcctccgttgcattggtccggtttggctgcccaagggggggttggaccgtgcggatgggctgagcggcagataggaggactgcccgccgttggccatcattgcgatggacccggccatggcggaggagggccgtgaggagccgaggggcagcggaacctcgcggtagaaccaggcacccgacttcttccacatctgagcaaaatgaacgaacaaacgatcagacgaagaacagaggcgaaaagagacaagcgaaaggcacttacaacctcccggtactctgagcagattttgcacagaaaaatgggctcacgacgcttctgatcgaatgtttcaacgccgcaattcctttggcatacgtactgaacgggtcggattgagtttaagcggcttttcccattggcacctttcggcagtccgagcacatcgcagcgtaactttttgccgccaacagtccgaattcggtttggcacaaaaggcattgcgtgacgccgttgcccgtagcgcgtgccctcagccgttccaaccgttcgatcattttgctggagggactcagttgggaatgccttttgaattggcccaccatatgcgctgctgttcgttctggcgcccggcctccgccctttcgagcaccttctgaatgtgcgcctgctccgcctcggatatgcccccgttgatcagcgtctgttttgaggtcgtcggcgagcgggcgttcgcagtgcgtacgctccaaccgcttttcagcctggccaaacgaaggacatttggaaggcatttggggttcgagagagagcaaacaggccaaagactccccccgcccaatcccgaaaaaaacattgggctcgaaaggcactcactgtgctcgaagttggaggtgccgatcacttggacatacccacggattgggagtgccaccgatctcccaatcgttcattaaatcttaaattccgcattaattgggcaattttttttttattttattcgctatttgtcaaactgtgaaagaataatcccattaattcaccaatcgccgcttcttttaaatttattgccttttgacaagcgccaaaaaaagagagaatggcggggaatatgcgaagaaaatgaaacgaaaagagagagagagagagagagagtgagagagtagagtagagagagaggatgataaagagtgagagggagggagggggagagagagtagagagagagagagcgagagagagagagtgagagagtagagtagagagagagagagagagagaaagagagagtgagaggatgataaagagagagatggagggagggggagagagagagtagagagagagagagagtgagagagagagagaaagagagtagagtagagagagagagagagagaaagaga

SEQ ID NO: 5341 - DNA, 3547 bp, Heterodera glycines
attcagccaatgcatcagtcggaaatccgcatcccttaaacgaaagatgatttactgtataaatgtggcaagaactgaaagggaattagtttaatttgtccatacctttccatgacggagtcaacgccaagccgttccatcaccgaagtgctactaagccgaagaacacgggtagtcgcactcaaagcatggtaaagttcacaggtaaaagcaaccaagggaatgtccatggaagcggggaaaacggcaattgtgtgaaggttctaacgggaaaaatatgaaattactgatcaataagacgaaaaactctttgggtcagtgggtcagacgatgggtgactgatcagcgggaaatgactccgaccagcgtaatattggccaagcaagcgaacgagacggaaaccgacttgtgggtactgtaaatagaaggataagagattatgtgtcgagaaactgcaccgacctgcatcttcacaaagttcaaaagtccctcggggatgcgggcaagttgcgaaaaccgaacagccaacactacgccaaacactcagtttgcgagagtttcaatgatttccatgcgacttacccgtcgttgctcttggattatgttgcaacacatcaacgagccccaacacgtcaccttttccgaactcttcaattgcaactttgtgggacacggaacgaagtcgtccgctgagaaccataaaaaaggattcagagaagtcgccctgcctaaaagagaatggaacggatcaatcgattgcaaatgaacacaaaaatagaagaggacctataaactgcttcaccagaatccaacaataaccagccgagcgcaaaatcaacagcacgaacaaagggggaaagtcggagcaaaactgagtaagcaattggaaggacggaggaaggcctttgctcaatcagacggtcgacatcacttttctcgagcaaagcaaccacacaatgacaagcacccttcacagtgtagaaagccggttcatccgtcagtatctatgttcaattcgaaaatgtttaattgaactccaaaacaatcagtgaatgagccccaacctgaaggcctccgacaagttctttgggatggatgaaagcagtccatatttcctggccgctgtcttcaaatgtcgagaagcggggctgttgagtgagcttcagaacgcccgacacgataatggccaatgcgggctgattttcagaactgccctcctcgaacaacgactgattctcttccaaatgaattattttgagaaaaggtcgaatcaaatcattggcatcgctttctgaaagacgcaatgcttcgctgaaatagctaacagcgagtgccattttctgctctgcctttggctgctcaacttccgtcgacattcgttttagcttgggttttgtcaacgagttcagcgctcgcaaagactgcccgcgatgtttctctttgcttcgttctgttggcggatttaagcgctgaaaatggcgacaaacccaactaattattgcaactgtccaactttgttaataagttcctccccaaggcccatctgctgatgaagcgtggtcagcacaacgtgcaaaagtcgagtggcgattatctgaaccggacgaacccacgcagacacattcggctcatttatataaaagttgtagaaattgagcagcgaatacttggccaaacgtgtccgaacgtccgcgcgtaaagtcactgttttcaaggtagaaggattaccctaaaggaaaaagtgaagggacggaggggggagaggacaaaccatgaaaatgtcaataagagaaagcgaactgaagaagaagtcaccgggctcaatccgtcgcacatgaattggcttatcgttggcatcaggtggcttaaaattgaaaaaataaataaacatctgatacaattcatacaacaatgcaaatagtccatggggaaaaaccaacaaaaaatgccgtttaattaccgtgatgaaaacggacagacaaccttccaaagtgacaaaaattgcatcatctaaacatttgaaacaatcaaagttaaaaaaaactccgactcacaataagttaagtattggagaaatatgtattagcgagtctttttgtttattggtacttcttaaaaaggtaacataatctggtacaaaaaaccaacccggatcccccggcttcacaataacttcgttcggttcgattatgaacacttggatgtccttctggttgatatcacagtttgaagggaatccgagaattctaaaaaatgaacgaataaaatgaaataatagtaaattaaatgtattattgaaaaggtcatggcttaattttccctgcctaccggagattttgacggagaaaagtgagaggtttaaaacggtcatccttaagtgctttagagattcacatatgtaaatgaacaaaaaccgggatttctggcataggaatcggttcaaaaaattcgttcggtggcttgggaagtgcttctcgatttcctccaacagatttttgacgtcgatacattgcactgttgcgaaaaaggcttaaagaaatggatcatttattgacagtgtttgaaattagatttctcggtcatttaaataaagcgattttaatgagaatgtaccattttattctcttatattagcccaattttgacgaattgattagggttttcactttgacttcacaaagttatggccccgttaagtggccaaaatcttactaaacccacttaaatttcatgaggcattacacagcctaaatatttttaaacaaatctgaatgtgctataagataaccaaaaatagccctacaattatgcataattggtattttatttggctgattgtgagtctcttaattaaaacaatcaaaaaatttcgaaaaaattgaatttttggaagttgactttaaaataaaattgtaataaagacgaattgaatcaaaaaacccgaggaaatgaagtcaccttttagccacattggcaacttgtgatgggatgtgcgaatcgtccaccgtcgaatggcgtcgctgcagcatttgcggaatgtcagccaaacttgtggactttcccctaacgaaagacgaataaatgctctgaaaataaggccagtggtcattagataattgaagattcattcagcgaaagtaccttaaaaacattatctttggatttgttactgtcaagcgaattctgtgcatcatcaacagactccgtttcggggggagttgaagaaacacctgaaaacaaacatgaacagttaataaataaccatgagcttttccttgatataaccaaaccaaaagttactttttatgtaaaaatataatcatgttttttcttaataatttgttcattaattaccttgtccatttcgtgggtagaatatatagacaagcacagcagaagcgaaaacgatagtcgtaattaaccataacataggaactaaattgaagttgaatatgcgtctttaagctcctataaaaaataaacgatcaaatatttaactgatgccacacgaatcgggttttgccaccctgaaccactccccctaaac

SEQ ID NO: 5342 - DNA, 1734 bp, Heterodera glycines
cgggaaaatttttgtaatttttaatgtgatttgttaaagaatttgtccacaaaaatggccaaattttgtgattttgagccaatttttaagaaaataaaggacttttaggggctggcggtgccgataggcgccgccagtggaaaaattgagaattgtacatatttttagcagattttcattgaaaatattcttaatttttggtttttttttggaaaaaattggttctattttccgtccccggtgatatcgtcagtggttgatttcgtcagtgattgatttcgtcagtagttgatttcgtcagtgagaaataatttttaaaaaaaatttacctatcaaatattaaaaatgaattcaaaaatgcaagtgatatgaacatgctcgtaaatactctaacggatcacgattatcgaaattttccacaagagccatcaaattttgccctcccagggcaatagggaggacgccgagggcatttccagtaactccagccgtcttcagttcgggaatcggccttagaaaactattaattttttccatttaaaagatttcacttcgtaaagatactcatagccgccatgagtgatcagctcacggccacgattggatttgcatacagaaaaacggattaaggccattgaagacaaaaaaaagatcaattaatggggagaaattcggaaacgaagtctcgaggtcaatggaaatgaccactggcgagtctcgaaaaacgaacaactaagagacaaaaccgcaaaagcgacccattatcactgataagagtgaccaataggcaatgaaagggcaaacaaataattttttctcgaaagacgaacacacaagatacaaaacggcagaggcaaccctcaaaaagaattcttttctctgataagagtgaccaatagagagtgaagaggcaaataaagtttcgtattttaatgtatgaatatattttcattatttattgcatacaaatgtattatagttcatatgaaattataattagttcatatcacttgcgtttttgaatttattttaatttttgataggtaaattttttttaaaaattatttctcactgacgaaatcacttctgacgaaatcacatggcaccaactttttcgaccccaaccaaataagaaattattttccatataatttaagcgaatttttatgctctttctaataatcaccatcccctggaagcaacgaaggggagaaaacgaatatcagcgaaacaagtcaacccgtttgaactggattcaacaagtatcgaactgaaaatagaaaaaaactgaaaattgttagatcgagtaaaaaattatttgtttgctacgaaatgatggaaaaagaagtatgagcattattaggaaatctcagacttcttctctctacagtatcaactagagaccggaaaagagggtcacggtttcggttaaaacccgaaaaaaaccgaaaccgaaaaaaaccgaaaaactcaaaaaattctcggtcgaacggtttcggttaaaaaccgaaaaaaaccgaaatcgaaaaaaccgaagaaaatttttcggtttatttcgacttttcggtttttttttgaatttgtttatttttttttcaaaaaagtaataaactattctattaatagaaaaagcaaaaattcctctgaataaaattgtagagctattgaaattctattgaatggtgtactaaaggtagggaaatgatagaaaaggcagccaaaaaacatggtttg

SEQ ID NO: 5343 - DNA, 1882 bp, Heterodera glycines
  misc_feature (1785)..(1785): n is a, c, g, or t
ctccgcaattaatactccaatgacggacccagcggtattttaagattatttagttacgactacactcatagaatttagaatttgttggacgagcgtcaacagcaagcccagcaaactttggcaggtcttcgtcgcgattatgaagaattggatcacacctttgtcgtatatgaaaaggaatttgaaactagggtaaattatttgattcttaagcatgcttcgcttcccaaaaataattgtaacaaatttagataaatcgcaccaaaactgcttgggaagacgcagttcgttctcgctctaatgaaaatggtgagtgaatgttagagttaataatggacaagtagatccatttgagcctttaattcatttttttacagacaaacgtcagttgctcgagtcaattagggaccgtcttcaaaatgttttcgaaggtcaacaatatttattaaaaacaaaaatccagattatttaagaaaccctgaaacacaaggctgttattgagaaattagaggagcgcgacaaacggatgggcaatatgttggaaagcgtagacaatattgaaaatctcaggaagtgaaccgacatagaatgtatgtagtattcccccacttcttatcccgatatcaccattattgcctcgttcactcctgatctctctacagtcaataaagcataaaacttatccgtaataaatgtatattacgtgaataattattggtaaaattatacttatccctctacaataaaacgcggaaatatttggtgttatcttgtgagcccaacattcatcaatgatttttgtagagtttgttcagaagtacatccgatgttccctaaaaaagatcagttaaatgaagcctaaaaagtaaaaatacttggtattcaagacattcaacccaggagagcaacgaccgagtgagggcctggtaatttgaaaggtcaactctcgaggtgaaagagtcgaagcaggtgtcgagaaagtgttgaagcttaatgtttgaaagaataacattttcggtttgactaaaattgttacaatctgaagttgcaaagccgagcagggctgtgaattcaacgaaaaattttcgtattgctgcaaaatcatttccaatgccgaatattgcgtttgtaactttgccaattcttcagcgttttgctccatggatgtttcaagagcctttacataatcggcagctctgagagggaaaatgggaaggggaatttacctattttatgaaaaggattaatacctaaagaggatggcagcgttggtggttttgccttggaatattcaaatacaaagaatgaagggatttagaaggaacctacacccaatgaaagaggcagaagctggcaaaaggtcctttagttcgttgtaaccgctctaaaattaaaatttaaagaaagtcttgaatatctcacacattaattgcttctctcctctgtctgaaaccaaaagtattaacattaacaaacttgaaattttgttcgtattcacctttcacagcgcaaatgcgtttgctttttcctatcattttggttcattgtacaattttatagaatttgatgtgtattatgttgtattagaatgtattagatgctggctggtgttaaataaatagaaaaattaaatttaaaaaaaagaaaagaaggggaaaggtgaaagagaatgagttcaatttatttttccctccaaagtttttaactcgcactaaatttctagcaaaaaaatcagtggggtaagaaagcggagaaatagaccattgaaactgaattttgcaaaangcattgattttatgataagtgttcaattacttaattcttcaaaaatttgtaaatttaaaagaatattggttttaaaagtcactaatcggctgataaa

SEQ ID NO: 5344 - DNA, 5159 bp, Heterodera glycines
  misc_feature (5045)..(5045): n is a, c, g, or t
gagcaacttctattatatagggtacaaatattttatttcttttccaatataatttttaattatgcatttatttttactcccaaaatttttcgatgagaaaagtggtgaaaattttcaagaccgctttctctttcaattgggaaataaatattaaatcgaaagaaaattatgtatatttgtttggtaccatctctttccgaggcattcgttaaattttagccttaatataatattaatttaaattcattttttttatcaatcgattcgcctctaaatgagttaagcacgaaaaatatgtatccagttgcggaaatggatttaattgaaccggtttaaaactcgaaaacgcagagaatttggtacttccaatttttaaaacgatcgaactcaaacttctaaatttggtataatgcgaaagctattaacaaatttccattcatttattgtcttttcctgtatttttggtatagaaaaaattcaaaaatgtcgtgctttaacaatccattttaataaatatttttttttcattttcatttttttagccctttgtccatccgtcgttggcatttggaaattgtaaaatggcaaaaactggaaaaataaaaaaattggcaagcgttttggggtggggaaagtgactattggtagcgcaaatttacggaacgtgccgaaaaaattaccaaagaccaatggcacggcctgatcatttccaagcacgaagacggaataatcagttacgaaccgaggcaagttggaagagaataattcaaatgaatttaaaaaactaatccacgaatttgacggctcccggtaaattggacaccagaaaattggacaccaatggaaaaatggacaccagaaaattggacactgttgtaaataaaaatgaaaataaacaaaataaattactaaacaaaaattttggtttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtgcattttttggcccattgatcaatcgtcacccatttttggtgcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggtgcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggtgcattttgtggcacattgatcaatcatccctcatttaacccatttattccactcaaatttattttcacctaattcttgattttttttaaaaaggaaatcttagtgtccaattttctggtgttcaattttccggtgtccaatttaccggtcccttttgaaaagggatataagaagtcagtacattgaaatatatttctataatccgaagcaaccatttcaatgaaggaaataattaaaatcaaagtaaaatattaaattatttcacaaattgtcttttctctgatttaatgttactatgttttttgaagcattttttttattaatttatttttaattaatatttgcccatttgttattcttttgagtcattcccgcaaattataccaatttatttgattcatatttttctgtaatgttattctattaaaaaaataaaagaaattattattttattcattttttcctaatgttattataatttaaaaaaataaataatttttataagaaatgattgaaaattaatacatacatattcattgatttttcgtgaattttattaatttcatcgttcctgtctctttaaattcattttttttttcataaatttacaattatgctaaaaattagaaaaaattttattgtaaatttttatgctttatattttttcagattaattaattccatcaatgcaaaagaaggtattaaatccgattaacttttaaatatgaatccgtttttaagctttattatgtgaatcaatcagcgacacttttgccttgtctttcatcaaaaattttcataaattaccaatagttgaggctaacgctgatcaaattcaaggaaagaatataatggattttgtaaaaagttatttaaataattatttgacgaaatctatcgaaaaagacgaaactggagaaaaccctatgaattcaaatagtgatttaattaagatgaagcttaatgcgttggttgataaagcaggagagcaatgccaaaaagttcgcaagaatcaatcaaaaaattttctgggaaaatttagtgcaaaaattggcaaaacatttcaaaaaagagagttaaaaaattcgaaaacaataaaaaatgaatttgatggtaattttattctgtgcatttaccattttttgtacacattttgccttgaacttatcaaaaatattgcaaatgatcagagcaacaaaatgaacagcgacgaattaagccaaattaagcaaatttatttaaatttatatggcaaatcatcaaaaaaggttataaaatattttaaaatgaattttgaagccggaaatgattttaaaaattcaattggaatttactcattaccaaaagaaaaggagatgaaaacggaaaattttggtaaatttaaatatttttaataaaaaatttaaaacttttagaggaaaatttatcagcgaatagtccatttgaaatgatttcaaaattatcagataaaactggtaaatacccgaaaaatattacgtcaaaagaaattacaaaggagagaaataaaatcacaaaatttgtaaagaaaagcattgccaatttaaattttggggaaataaaaaagattttgacactaaaatggtttgccaaaatatttgctaattttaaaaaggccaattttattatatttaccgatttaacaaagctgaaggacattttactaattgcattgagaaatgacaaatcaccagaagagagccaaaaaaaggttcatgatttttaaatttcattttcgatttaatcactttaaaagaaaaaagaacaattaaattatttaagattattaatttggccgacaatattttgttggcaatttcatccaatcacaaatgtcaaaaacgaataaatcaagcattaaatgaacgaaaatatggcaaaaatgacgacaaaatgattaaaaacgagccatttatctatatgaataaaatgatagaaattagaaaatgtaagttcttcttagtaaaaaaagtttgattaactagcaagtttttatataaactgaaaccgtcaaagaatttaaacctgaattctaaaaatttttacttttctaaaataatttaatagtttgggagaaaaaaggaccattctgaaaagccgataaaaagtggtaattatctaaaaaataaattaaagagtaattttttatcatttaaattcttgtgaattcaaaaagtttcgttcctttttagcttatcgccaaattggaccacgtgtaaaacgccaaattggcacagatattgttgcgctgatcggatactgtaacttttattttggcttggccgttctgttcattggcgcaccaattgtggctgccgtttttctgtccccggctctgttggcattgttttttatcaccggatgggttggcgttccggcggcaaaagtcttttttgaaaattgcattttgaacatttgataagattttttttattattgaattcatatttttggacgaaaaaatgtcaaattaccaaatgagcagaaatattaatgccaaaatgctatttatatcaaacaaactttattttttgctataaaaatatacatgaaaaatctgtgcttttaaaagctcacgaattgtaagctaaatcgttatttaagaatgataattttctcttgtcgttactaatccttaaagcgggggtctgtatggatttccatatttttttgcatatttattcggcctacttctcgcatgcattgggttgaaaacaattttggacatcacctcagaaaattttaatattttcactattttttaaagtaagcttaatctaattgattgattttaaaataacccaaaaatggatacgcaaatctacggattttagcccttgataatcggcatgctggcaaaaaaatctgtaatgaatagatttgtttttttatgtatttcaaaattttatatatttgttgtcctaaaatgccgagatggacttgcggaaagacggggccaaagaatttcccccccggggatgggcaaaatctcatcggcacatcctttataataaaagcatcttttgacctctcacttctgctgttgaagcgaagcaccccttcttgcttcatcgaccatctcctctctcnaaacaaaaattggataggacatttgggctgcaccattctcatcccccccccccccggggggggggggggtgacaaaaacaaaacttattttcaaaatggggaaaaaaaggggcc

SEQ ID NO: 5345 - DNA, 1622 bp, Heterodera glycines
  misc_feature (1596)..(1596): n is a, c, g, or t
tttatcattctttattacttatattaacttcattatctgcaaatttcgttttgaaacattttaaaatttggaatttcctctccctccccccattgtccatcattacgctcaatttgttgtcctcctcccctcttcaaaatgccgtgccattgttcatcccttcaccctcctcaaaaatctccaaatatatatatatgtatgctttcatcatttgcagcccatcattcattcgtaatgttgtgaaatttcgtgcaaatttaccatacttttccttcaacaaattaattatttatatttttgtacatattccaaaaagtgcggaaaatcctaaatttttatttttttttaatttgtccaatttaaaaatcattttttgaaattaaatcacataatattgcagaattatttatcctttccttatgacaaatataacaatttaaaatttagaatttagaattttataaagttcgacctggacctggatcaagtccttgatttatgctggatccatgtcctggaatttcttgcaacctccaggtccagttccaggctttggactatttaaacactttttcactcatttatttttgcttttagcgttcatattttttacgtcaaaaaaatttgttttccatggtctaaaataaagtattttaattcatttatccaattcgttcttctccttaggcattttttgttatactaaaacggactttatctctttaattgtatgagcaacagactttttctgattttgtttttttttgattaagaataattttttttttaatttacttgtacaacttttttctcgccaatattaataattcgacgttctaatttaaatttatttttaaaatttaaattagcgtccaatttcctttgcccgtccaatttttgccatttcaacttttgctcggctcttttcaaatttgagcttgccatagtgttgtcaagcagcagacggctcagcaagcagcagaaagcacaaagctcaaacaacacattttgcgatgtctcagcccaaattttagcctcgggggactaattaatcgtcgtcgcccctccattttgtgttgggatgacaagccgagaacacccggggcgagaacagtgtgccgccgcttcctgctccatgccaaaactgtggcataaagcccgcggccctaggccggcattttcttggatttaaactttcattgatcccccattagttggtttacggctataattttgaaaaaaaatatagagaacatggacttaaattttcgtaatacattttaattaatattacctattcctttttgcgcaaaattatttttttttaaaagcatatgtatcttattcaaaaattgaaaattccattatgaagaggatttaaattggaagcatgttttttcatcaccatgatgccatttagtaaaaaaaaatatttgtttgtttgtaaagaactcatagcctaatttaaaagtaaaattagcgatttataattaggtttttgaaaaaatattcagatcaatgaaaatctgtattccttatatggtaaaaatagtgttaatatataactcataaaattttccctataatcacccatancaccaaatgctaagaattaatgcact

SEQ ID NO: 5346 - DNA, 3294 bp, Heterodera glycines
atcaaatttttgtctgtgcttttagctagaatttttaaaacttcaattgatataaagaataggatttagcaaataagaaaaaaaatttatggcttaagaaactgaggatgccaattaattggacgcttaaagtgcacgagaacccaaaatgatgcattaacagaatttggacccggcggtgccgagagggatccgccgggaaatttgttgatccctagggctcccacccaaaaaccaactctgttcgtttgtccttccttgttcattgttctaaaatagggttacacaggtccgggtactcgatcgggtcccagactcggatacaaacattacatttgtcaaattagtatgtgatcgtgtcttttttaaggtcctgtaatttccgagtcgtatccgtacagaattttggacaaaaaatttcagttttgtgccattacagttgagcccacacctaaaaagttattcgactcataacctaaaacttttatgctgaacaaaaatttcatttactctcatttttaattggatttgcttttgcgattgaaccttttgcaaatatttctttaaatttatatttttgtttttaacatatgtaaaagtaggctatgtacataaaatggcacttcgtttaaagatcatttacattaacaatagggcggcaaatcgaatgaagaaagataaaatcgcgaattgttggcataaattagcatattaaaaataacttttccaaactgagggcaaaaatttcgttaaattcctctatgtttaaatacggtattaaatttgttttacaaaaaaaaaattaaaaataaacttaaaaatgttattttttagtgcaaaacgaccgaaaaaaactaaatttgctacttttttgcttccttttgacataatttaccatttaaataaaattctcgaaaaattttcggatcattagggggtaaaaaaaggccatttagctcaatttggatttccataaaattttccgccctaataaatttgaattttctttcttcgtttgtccatttcattttctggtaattacacccgaatttggcattaatcttcattgactcaaatgttccttctgctgctgttcgtcggctcctccaagtcgaattcatcgcagaaattggcgagagggaaatcgccaaaattggcacggatatctctgcgggaaaatgccatcaaatattttattttttgtcggaaaatctttttacgaaaatatcgccaaattacttgctcagcttaagcatttggcttctcagcgacgccccttccaccatttgtcctcctccgttggccatttgtccctcttcgcttttcccttccctttcattggcttcgtcgccgccgtcctccgaatcgattggcataaatttggcgaattggccaacactttgtttttgttgtgcccccgccaaaggggcggcaattgcggacggagaaggaattgcgagaagttcgccgtctccgtcgtcgtcttcgtcggcgcccgtctcaacactcatcccagtgaaggaggaacaggacgagaccggtgcagatgcaatttcatactctgaccagacggggggggagtaatagaacgatttgttttccttgatttttttgggtttcggtctcgactcttcatttcaactctcgagcagcactaatgctcaccatacttcaacagcgaagcgtcaaatataaaaaatgacagcagcatccctactgtagtgatgggggtgtacgataccgttatcgtagccaatggagtgggccgactggcgccagcgaagcgtggaatcgccgagcagcggcagttgagaagcattttgatggtgggaggctgacaaaatgtggtgttgaccaaagccattctgttgcttaaaataggggattgtcatgtgaaaaaaccaatggcaaataaaacgtggacaaaagaccaactcggaccaacgaaatgatcttgtcggccttttgtccgattttcccatttgtttacgttttgccccaatttagccccccccctcgctcctttagcgctcccttaccgaagatgccattgacgaacaactacagctaatgtcagcttcgtcgccccctccgcccgtcatggcgccctgccgctggtccgcttcgcaccctcccgccgtgtcacgccttccaccgcccgtcgtcccagaggtgccgtgccgcttgttcatagccatcagtttccgtctgactatctccagccgactctcccaactcgaatgccaaagaccggtagtgccgtcgtctccgctgtcccttctcctcccccgttgtccctgctgcttttcctcctccgtcgtccatcctccaacatccatctcagtaccgtaattgttgttgttgttatcgtattccgacagtatgccaccgctttcctcgcgacatcgcagccccaattttggctccttctgttcctctccatttatttcggcggtttctggcggttgtccatcactggcgccgccgcctccgttaggaagcggaaacggtacgcattcggctgcgctgacactcaccgcttctgccgactgtccatcgttcatcccggccaattcctttaatggaatttgtgagtctcgaacctatgaatctagcaagccggtaaatcatggtaccgatccaagaaaaaccaattaatagacagcactttttaaaatgcgaaagggtccaatcgcttccgctggtttctgtgtgccgcccgaattcgtccgtgccacccccccccctttacccttagcattcggtcaactcttcgtgccgccgagttgagtttgtccagtgcactcgcttcttgctccagtgaaatccttgaccccgccgtcgatgtgttggcactgctccgccaatccttcggcaacaatggcccatttcgaagcggaacagcacgaattttcctaaatttgcttaactaactcacaaatgaatagtgattagatgctctctttttacagattctgtctatttattaattgacttagttgaaaccgcttccgttttaccgactgattttttctttttatttacccactaatcaattctctcttttttatgattgatccttctcacgctctttctcttacttttctctctctctctctctctaatctggtttccctgttcgtgactggacaatccgacagcggacaatccgacagcggacaatccgacagcggacaatccgacagcggacaatctgacagcggataatccgacagtgaggacaatccgacagaggtggacgatcggacagtggacaatcggacagcaaaatac

SEQ ID NO: 5347 - DNA, 2363 bp, Heterodera glycines
  misc_feature (27)..(27): n is a, c, g, or t
  misc_feature (36)..(36): n is a, c, g, or t
catgaaattctgtattatgtgatacgncatgccctnggatcgaaataaaaattctcgtgccgattgtcctgcccattggcgccggctgcgatcatttcgggcgtcacccattccaactcggagtccgtctcggcacttatcaggtcgacggagaacaactcggaggagagggaagagtgcatggagttgaacaattcggccatttctgccaatggattggcccgaatgtggcgaagcagcgggtaggcaccgccagcagtagtgccaacgacgccatcggcatcaccccctaaggcgggaaggaataagccgagattgaagaaaaagatctgaaattctcgagccctttggataagagctctcgggataatagccatttcagtatccaccgagtgccaaatttcgttttcaaatgagagacatggaaaaaaatcaaaatgaaaaatgccaatggcaccgaaaataaaagcaccacctgtccaattttggggcaaaagcaaagcgccagaggaagagcacggactcagatcagtcatcagatcagtgccgaaattgggctgattgagttgtggcgaagagaacggaggctgtcgcatttcgacactgtaaatggcacagtatttcaggaatttaccataaactttaagcccactctcgagcatttctttgtgtcgagcaatgattaccatctctcatcggttcgccattggttggctccttcgccgctgttttcgtttttgttccgatcactttcaccgccgcttctccgatggggcggcggcggcggtgccaacaccggtggcaccaaatgttgaggcagttgatcagccgaattaggctgcgactggtgcgggcggagaagcgaataggcgacaagccccggggcaacgctgaaaagcgccatcggttaagaacattcgattgatcagaaaatgctaacaagcatggattgaatgatagaaaagccttcggggcttattttgatcagcgtcactgactgatcaaaatggtaaaaataaagaaaatgctgaaagaacgggcctcattagtgtggtggaactgggtcaaatttccgaaagcatcctaatgagtcccacctgtcaaattttcatttaaaaaatgaagagatctttgagtcttaagcttgggtttggcccgtcctttgacgcccaatttgacctcagtgcgctctgttcatcgaagctgaactgtgcgcgtggtctcagtgccgagtacacttcctccgaaagcagcacacagtcgccgcccagcgcagaggccgcctccatcaatttctgaacactttggcaaaatgtcagtaattcccatttcaatttacgatccatccgttttttggttgcgctttttgtctgatcattttcatatttcaggcttttcctaaactctgtctgtccttcgcttaagccacctttgcccgcgtgttgggctgtccccacagctcatagcgcggcccgtcccatccgaccaccacagaaagtgccgtgccacagtccaatccgatggcaatgtctaacccctcggaatcggccatcttctgcaaaaaattaaaatgccaaagttgctgatcaaccgatccgatgggtgctgtagcaacggttatgtcaatgccaatgataaatgtatgacaagcattttacgggctaaggaatttcgaatttcgtaagtcggaacttttgaaattaattcaaattaataaaaattaatcattttttaaatatttatgaatcaagatttaggtctggcaatttatattggggtaattttttgaaaaaccaatgaggcctgaaaaaacaggcctagagacaaggcgtagcccataagatttcgtgagcaaaaaaatttgagaagctctaccggacaaattgtacctcaatttcctgtgcaaattcggccagaacagcgagctgttcaccaatggtgcacggagtgtcgtggacctggtcaaaaaaagatggatatgagcaggaccattaattggggacaaatgtcgcctcacatttcgggccaattccggcaaaattccgcatgccacctgaacagcaaaaaggaaaagcattggacgaaaattataataagccaatttcgaaaatccaaatccaactcaattaatttttctctttgtccgcctaaatggcataattttgttattagtccaaagcagcgacaaaatccaatggatttagtttccgaaattctggtcccagcttccaaatctcgacttcattcccgactcccggccaattaatccccggctttttcgtcacattcttgaataccgaccatgacttttatcattaggcatgtcttaccgcgtatacggagtgcagacttcgaactttctc

SEQ ID NO: 5348 - DNA, 3816 bp, Heterodera glycines
gcaacaggagcacagagggaaagcgaggaaacacggcggaactgagagaatgggagagagacagagacatggcgatataagaaagaaagcgaaacaaactggagcatccagagagtgaaagacagcgaaggaaagtgcacagggaggcagacggaagcggagtgagaggaagaaacggcgagagatgaagggcaggagaactggaagagagaaaaaagcaatgtgatcggaaagagggaaagacgggctgccattttgatcactgatcagaccagagggcattttgtaaaactgaccaacttctaatcagagtgcaaaactcagtggcactgaccgaattggcgattccgcagatggaaagtagggagagcacgagcagtacagtgacggaacggccgacggatgttcgggtgacgaattggcaaaagctctaaactagggaaagggacgagaaaacaggtcgagaataccgaacgatcaaaatcttggtccgggaaaatttacaaatttccgtattatctccgttattatcaaaccccccccccacaaaaaatgatacctcacaacagctgacgtaaagcccaagcagtagcagaaacatcagtgccaacgcaagtgccaacgtggccagcgtggtcaacagccgcggcatggccaacgcctggaacagtccggacagggccaagaacagcacggagagggcaaggccgggaatgaacctgatgatcagcatagatgatcaaatgatagattaatcctgctcgagagtctccaattgatcagtttatgaaaatgatcggtcaaccagtgtatttaatgagaaatcaatcaaacgtaccaccgatcgatttgtgcgtggaacagctgctcaatttgatggtcggcaaagcgaagggacaaagtcatcagcggagagtgtcccagcagaggcgatggcagcgaactgtggcactgatcggacggcagacgaacacggcgccgaaacaggctgaccttttgcgccggttggaactgcttccgcttggtgaacggcgtcggcaacggaattccgtcggtggtggcggcgacggcggtggggggacggaccgattggttgagcagacggttgatcgcctgaaggggttttgatcagtgattatggttgcttgataactgattaatgggaataaaaagtggctgtttaaaaaaggacttttcagtctggacaaaaacgatcgaaagactgatcaatctgctggaatgaatataattgatcaaatttgtaatactttgatacattgcttagagattaaattgaccaaaattttgatctaatgagactttctttggaatgaacattgcgcactttaggcagaataaaatctcaataattcattggccaaaatattgatcggtattgattgattaatgccattgcctgcggtgtcgtgagcagtgaaaagcgacgcgacgcggtcaggaaaagcaaaggcctaagtgccgggttgttggtcggttgtgccgtgcccgttgggctcaaccgccagcaacctctgtccacccgatcggcggctaatctcgcgccgatcagtcgccgcgtgtcgtccgaaattagtacggtgtctggcgcacaattggcttctaaatgcattgccgcgtccaccgccatgccaatcacctcccagtgccatcgacgggcgccgacaatgccgccggacaacgaacccgaaccgatgccaatgcgaatatcaatatcgacggatgccgactcgttgaaactcctgtggcaagacagagaaaaaagataagcgggttagagacggccaaataaaagtcaaataatttggtggacaaaaaaagagatttgatcagaaattatctgatcttttgtttttgatcagcaatgagttgatcggtgtgatagtgtgaagaccattagtgatcatttgaagatgactcattcaatattagtgtgactcggattgatcactttgtcaatgccaaaaggtctaatgcaaagcggcaggcgacgagcgcgtgatcagcgcgcgcttccggcaccccggaaattgccaacacggcgtcggattggaccagcaaaaggccgtgcagtttggccaaccgcccaatgcgcaagtccaactcgttgagcagacgtgccgagtcgggcacttgcagttgtgccaacactgaggccaagccgtggaatcgggcaaagatgacactgaaatggtataagtgattaattaggcattggctaatcagtgggacggagaaacgctggaaattgccgggtttgcggcaatttgagtcacctggcatgggcaaagtgttcaacaaacactcgcggcagttcgggcccgtcaagttggagcagtacagacgaaatgacatgagggggcagcgaagcggacagaagctgggcctaaaagccaaaaagggattgtaaaaaggtgttatcagcaacttaagccccaataattctagggaaaacgaatttaggagtttccgatcagaaattatggcaaatcatttaatttttttttaccattcgttctctctcccttttccactccgtttcactttccaccgaattgcgcgcactcagaaaaacggcacgagaaatttttctaccgtttgccattgagtaaaagccgaccaaatgagtccacaaatgtgccaacaaagcagcgattagctgaaaattgattttgttttaaaaataaaattattgttgccgtaatattgcaaaaaatgtgagtgtgctgaatgtgatcaagtcaaccaactctgatcaatagcccagagaacagctttactcaatgtcttatcaaataaaacctatgcatggttataatggagtttcctgatcagagataaaattcgatttaataattaaaagctggattcaaatttaaggtctgttggttgccatgacgtactgatcactgtgaatgcccaccttttccgtgctcggcttggcctcgtcagaaaacccaaatgcgccaagatgtgccaatgaaatggcaaaggaagtgccgaaaatgaccaatggccggaagggaaagaaggcgaagaggacgaaaatggtgatcagagaagggatcagtgaatgggaagcatcggaagggatgaggaggaggaggaggaagttgaggaacagccaaagggcacacgcggggacggaagcgtgatggaaacgggcggaagagagtggcgagaggaacacacagagcactggaaaagcgaggggaagggaaggatgataaagagaaagagggaaggtggagaggagagatagcgagagagagagagaagaaagagtggaaaatgaattataaagaggaggatacaattgataaggataatgaaggaagatgaagaatgatgaggaaaaagtaggaggaagagagagggagggaggaagacaagaggaagagaagagtgtgtggtgccattgatgatagagggtagagaaagaagcagagggaacaccgagtgaaatggcggcggaaacggtcagcagcacaagtgccgggtcaggcgatggcacacgacaaagggcaagtacaagttggacagggatcagcatggaaaagagacggagcagctcagcttaaatgggggggggcacaattagggtacaagtatataattaaggcaattatgacaattggccaagggcccaccggctgctctgtgcaattgctgatggttaaagagggcctccaactgcgcgtcgccaaagggccgactcagcgcggaaaatgacacgggtaaagaatggaaaggcattgacacgaccaaacgacggacaccctcagatcagatcattct

SEQ ID NO: 5349 - DNA, 5617 bp, Heterodera glycines
gggggggggggggcgattcgggcggaaaaattgattttgtttagagccaaatattttggtggtggcgttgcgcatttcgttcattcactatttactcccctggggggcctttaaaaatggggggggggggaattcttcaaacaaaaagtgcgttttccccaactgtatgatgggcacatgttctgcacaggcaaaccctcggcggttggccccctcggcgcgacaaataaacccataaattttgaatgcgtcggtcgctgaatgcacgccgcttctgatacagcgcttcaagagtctcgattcgcggattcgtgaaaaaatttccggtttttttatatcgtcgcgcagaaaacaaaaataaaagtaaaatgaatgcatgaatttggattaaaaattattggccaaaaagcacagaagcgactttttgaaggtagacattttatccgcgtttaaatgaatgtgaaaattatgtccgcttacagacattttgtccccgtttaagatgagttaaaacattttgtccgcatttaaatgaaaatagacattttgtccgcatttaaatgaaaatagacattttgtccgcatttaaatgaaaatagacattttgtccgcatttaaatgaaaatagacattttgtccgcatttagatgaaggtaggcattttgtccgcatttagatgaaggtaggcattttgtccgctttactaaacatgaattgtttgccgccaaaaaatatagacattttgtcagcgtttaattgaaagtcaacaatttgtccgctttattaaatatggattttttgaggcccaaaaaaaatattttcccaattttggtagtcggtataatgaacacattatttttgtttttggcccctctctgctgctgctgctgcgggtgatggaccgtccgtcgctgtcattaggccaccaaaaggttggacgaactttggggggccacccccgcggcggcccaatttgtccaattaattagtgcccatttatttgctaatcgatttgaattggacgcactgcgcgagacgcatcgcatccaaaacaacgaaattggacgaacaaacgaagaccaaacaaaaattgaatggagcctccttctgccccctttaaatgatggtgtccttgtacgtaacaaaaaaaggaaagaaaattaatgggaaaaaatttaagaaaatttatccgggcaaggtcaaaacgctgaaaaaccactcaaattttcgggaaattcggctatataattatttttcatggcttattgaaagtgattaaaaatcattcatttccctctttaataaatttgattttctttttcttttttgtttattaaattgttttactctaaaaaattactgtacaaatacaaatacaatataatcattaaatttaaacgaatttgtatcaaatactatttttgaactaaaataataaaaattattccgtaaaaataaaaaatggattaaaaaattattttttttcttttttttttctgtccgtcgttttgcctttagccacaaagtgagcacgatttgcgacagttttgcatcatccacggcctcgtgctggccaattggcacaaattgttggtggcccaaacgccgcagtaaacgttggcatccgcgcaacctttgtattaaaaaacatgacataatttgtgggaaaagtgccacaaaaatgaaggaatgcgccaaaaataggaaaaatatgccaacaataggttttgacaatgacaaattcagcaaaatgtgccaaaatggttattaaagggccaaataagtcaaaaggtttgtatttcggtattcccaatccattaaaaggtgtcaaaatgattcataaaattttaaaaatgacattgaattgtcaaaatggcacataaaaatacaaaaattctggcaattatcctcaacaatcaaattgcttaaatgtcaaaaaaaatttttgaaggaatttggcggaatttgttgtcatatttcggcacacccgtcgcccaacgctaattggtcataattagtgccaaatttgtacccggcatgcagtacattcgcctcagttcctcaacatccgttgcactcagccctctccgttggcccatctgcgcatcgttggcaccggggttggtcggaaaatggtataaattgaaatcatcatgattggttttggttacggtgttttgaataaaaaacggtcattatatgggttagatatttatggggatggcagaaggaagcggagtgagggagaaagtgggataaaggacatgggattgatcagtcgattaaaaagcattccacgctatggaaaaaccgtgggtactagtccaccgggccagttatcttttatgtactaaggatttattaattgatggacaaaggatatgtccgagggaagagattcgagaaactaagactcttgaataatgacgggattattgattgccacgcagctcagtcggttaaaaagaattccacggtatggaaaggccgtgagttcgagtcacaccgggagaattaactcttaagacaaaggatgtgctcgagaggagagattagagaattgaaatgagctctattgattggtggactgatgccgaaaatagggaaaataggccgagactctcgactatctctctaattgatttgatttgatacctttgccgtcatcgttttcagtccagctgatttggacgcaatgttgctggcgtaatgcatgatggaactgaggaattgattgatcagagaggaatattgcaattatttaattgtaatttaaattaaagttccttcccgactcgaaccggtgaaattagaaaattttatttttttcgactttttatcaaaatttctcaaccacgaggggagtatttattgcttcccgacatttttttgaattgtccagccttcttcccatacgacaaattttgtcggggaatttcttctccgatttttttcctaagaatcaacgcttaaccctaattaattactgttcacccgtagtcatatcggacgccatagctagtgtatttgaccagctccgagcgcgcaaatgtgtcatagttttgcggatttatattcgcccaattgatgttgatgaacagatcacggtctgatgatggaaatgaaaaatgaattaaaaaataaaaatggcattttaagggaggaaaatcggaaaatagcagaaaaaacatagaaaagtttgggcacaaaaaaggcataaagaagcaaccaatttgtacagaatgaaaactacaggatttcttgtaattcagccccccccctgaattagagccaccactgaaacaaagcccatgccgcccgaatttttttttctacctacatatgtaaatggtggcacaatagaaatttaatccagaaatttagaaatttgaaaaaaattttaaataaaattatgccaaattttgtgccattgccaacccaccgactcggagctgttcatgctgcaggcccagcgcgtgcattgtctcatggatggcaatgccaacggcgttgccgcattgaagctcaaataaactggatttgccggagaaattcggcccacataactgagcccacaactgaaagatgccaaataattaaaacaaatagtcaataatataaataaaaattattgcaaattagcaatttaattaattatttacaatcaaacaaaaattaattaataattagaaataagcatgaaattaattaattagcaatcattaattttttataagtcatcaattaagtaattaattaaacgatcattaattaattaggaaatcgtaattaattaattagttagcaatgaattaaacagctataaaaaactaaaaaatcaattcatttattcgttttttgcgagttgaaactcaattttaattattaaaaaattgagttttataaatttattaggtaattgaaatggagtgaattttaattataaataatttttttaattaatttcttattttttaattaatttcttacaattgtggattgttgatcttcacatagtacagatggtttcctgccggttttctggacgcttcttggaagctcagacaacttttggattggatttcctggcaataaatttataaattcaaaattaaattaaatcagacaaaaaatgtataaaatgttaaagagataatttattaatatttaatcccttatccaattttcataaaaatatttttaattgtcatccaagaaatcacctgaaccgccgcgcgaacagaacctttgtcactttccgcttaagttaggcagcaaattattgtttttaaattaattatttatttaatttgctttatttcctaaataaataattttggagtgtcatggattcgtacaatggaagttcgtacaattcctataaatttttgttgtttaatttaaaattaagtaaaagctttaattttttctcaaaaaatcagaatgatttttttatagaaaaacttttaaaaaattcttaaatttatttttcaaaaaatttgaactaaactcaaataaattagcagaaaattttttgttaagtttttctagagaaaaatttatttattttttgtgtaagattctaggttctaaatgaaattttaaaaatgtttacacgaactgccattgtcccaattttgggcctttttcattcttttgatcaaaaaagttacagtatttaaaaaatttctggagaattaaatgccatttgacaaggtgttgaaagccgctgagatggaaatattttagaaaaaaaaataataatttttattattttttaaataattaattttctttttaaacccacgaacggactgatcgaacatgtacagaattggttgtccgactggccatttttgggtgggagaagcttcaaagaacagcgaattgccggcgcgagtgaaacgacggcgattgaaattgtgccgacgactgaaacggcggttgtcagaaggcggcacggcaccaacgccaaccgaaaacaaatgggaaaatgaaaaatggaagattaggataatttaaataatttattaaatggcaaaaaataatatttttaataaattaaaatatttacaattaagaaactctgaaaattattagtgaaaaaagtaaaataattattaaaccattaaatatttctaaattaaatatttaaaaacttaaaaatttacaataaaatattaaataatttgtttaaaaaatattataaattaaacaatttacaatatacaaatagtattttcaattttatataaaattgcaaaataaattgatttaattaaatgaaatatttatggttaatcttttaattcaatttaaaataaatatttatttaaggaagaatattttattaaatgtgttttgcctcattctgattgatctccgtaattagcacattcgcctgctgttccgttagcagcaaatcttgctggaaaacgccattgttcgccggctcaacgcgtccctaacaaaaaataattgtttaaaaatatttaaaataatttaaaaattaaaaaaatatatatttgcctccaggccagctttgcgaatccacgccttcttcacttggaatgttcgcgaaagtctgatctccacgtcacgaccaatttgactgtcc

SEQ ID NO: 5350 - DNA, 4219 bp, Heterodera glycines
aaaattatgttcaaaagtagagcccgacattttgatcttttcctgaacatggatttttttaatatttgacctggagctggatttcctggaaaaatccaggcctagatccaggtccaggtcgaaaatggctttttgacacagaaccgtttgatggataggagggagtttgatttaatttttgggtttctggggaccctgcgaaatttagttgccacctttctcccgctttttaaaaaatgcctaatttgtcatccccccgccccgaaatattttttctttaccgccccgatgaaaatgccgtggcggttgatcattgctttgcgccgtgttcggctgctgttgacccatctggccgaaaatgccgcccaaattgacgcccgcttggctcgtaaattggttgacgttgccgagcagtccacccaagtcaaattggcccattgccgacgacggcacggccaacagaaaaagcagccggattggcaacattggcacaatcactttttaaaattgctgttggtataaagaccaaagattatttagtaattggattttttcgagactgtgcaaagagaatcgggtccctagaaattcgagaacgggaaccctcaaaacccgagaattctctcgattcgagaatgtgaagaaactgacgagagtttctttcccacaataagagaagggttggctttgtttggttcgggcggaccagaacgttatcattaattaggttcgggaaaaaaaacaatttccgacccaaattcaaacgattaacgggagaaaatgacgcgcaaaaccctcgcgcaccgcttagagggagaaacaaaaattgaaaattgatcaatcactcggttgctcgagactgccctctgtttggtgaacaaatcgtctcacttcccgtcccaaatttcatcgtccccaatttgattaccgcaaattgccccccccccccccaggggccaaattttgttttgtcttccgtttgtttaatttaagagagaaaccacacgacccatccgtctcctcctcccaaatggagaaggaaggcccgtccccaaaaacttgttttttattctaattagctttgcattaaaaatagtggcgtcatgtcaatttggcggcgagtgatcaaaacgctttgtgaagagagaaagcgctcaccgacaaatgagtacacgcatttattctaaatttctttttttcttgcgagaacaataacaacaacatcaaaaaaacaaaaacaaaacaaaaatgatgatgagtgggcgctgaagaaatttcaaaaagttttcaaattttcaaaaatggaatttttcatgggtgcgaaaaacaatgaatgggcaggcaaaagagcgagagattggcgacaaaaaaaacggtgctgatcaaggacacttttgaacgatcaaaacaaacagaataaaataaataaatgtaaggaatgatataaaaatataaacggcacacatttcaaaaggctcaaaatcgcggtttcaaaatttattttgcatcaatccaaatattttcaaaattaaggaatggattgatataacaataagcgttttttaaaagagtctgggatataatttggacgctattttagcggtaatttttttttaattggtacaaatgcacaaatttgaaaccgatttgtgggggacacaaaaaagtacgaaaatgggatcaccaacagaaaagaccgacaaatgaaaatatggatcaaaaatttgcaaaaaatgatgcattatcccctcatcctcctccttcctgagttattgttggcacgtctttacgcaaattccgcctgactccgcccactgttcgggtcgcatttttggcaccgccccgtcggcacgtcgccctggtagagggggaacgcagcggaacagacggtgcagcgacggacctcgtaaatgttgcagcgcgtgcagtgtttgttgttcggaatgcctgacaatgagcaaaaatgaaatcattggccatatttttttatttacaaaatatggctccgggagggggacattttctacgtcgttaaattaattagttttttcttgaaaattaattaattgccttctttgcgcgatgagcccttgccaatggtgcccatttcgttgaattcttccgcctcgaacaaagagaagggctccgtgtagtacacctcgacaagcgtgtccaatctgattttgtgagaattaattaattttggtttttcaagtaacatttttttgacagtaataacgaatctgccacacataaaattaatatttaatttatcaaaaaaagaggggaagaatggaataattaatactaatctaaatgaaaatctaatgaatggacgggtaaaatacggccagaaaagaaaaccattggagaatcagaaattaaattcaagtgtgtgaagttgacgaattttttttttgtggcctacttgtactggttgaactgtcggcaaacagccaaatattggggcgtcgcggtgggcgagccggccctcaaatggaccttgaggaacgggttgtcgaaccagtccatgctgatcatcttcttcattttgcagaatctgtgtgccaatgccatgttttttatttgtttgtaaattaaaatttcttttataatattagtagtaatttttaattgggttaaaaatttcgtacatttattattaataaaataaatcataatcacttgtccgtgtccgagttgtgcttgcacaccaccaccgtgacgtagtggagcacggaggactgagttggctcgtccacgcttgccgcgtgcaaataaaagtcggcaaagtacaaattgcatgtgtcaaaatcgagcagtttgcgcgccgaaacgaccatttgcacgtcgctataataaatttttttaattaaatttttttttaatgagtatatactgacccaaatggcgaatccttaggcagatttttgccgcgcaacagtgtggagaagaaaagacctaaaggatagggggatacaaagccgagaattttctttgatttaattcaaaaaaaattcaatagaaaaacaatcgtaagtaaatgtaggtaagtaaaatattgcactttcaaaaaaatgagtgaccaattttttatgtttgttagaaaaaatattgctgctgttttctcggttttaccgtcaatggacccgttgatgggacagcccgggtgtccgttctcgtccttggtgtacggtcgcatgatacgcagtccgcctgcaaaaaatgccgttacacatcagagatgggaacatcaaatctcggacattgtaggggacgcgatattccgttcccaaactaaggggcctaggaaaccaagtgcctatgcccgtttttagggggaggaggcctcagaatcacgaatttcgatttttttttttgtgcgatgaattccaggcctgtcacacaagggtgcaaatgattagcgggcaatcccgccaattcacctggtgagtcgtaaatgtcgtcccaatacgctttcggtttgctccgatgcaacatatcgaaaacaaacaaaaatttaaaaaaaaaaactttttttcctcacctaatggatacatttgctcgccacaatattttctcgccttttcaaacagtgtctgcatttccgaacgtgaaaaagctgtaaaaaatggtaattttcaattaaaatagaccaataataaatgacaaatttaatttttcgaatttttcacgagatgcctaattttgaaatacccaattcaaaagcctcgaaaatcctaaatttctaggaccgtcgcttaaaaagtattcgaaaaatgccaattatcgaatcgccactcactggctctgaactggccggagccgtgtgtcactttaattcccggcacatcaaagccctccagtgtgacggcgtatgtgcggccggcacacacctcgaacacgtgctcagtgcgacggcccaactccacaacacggggcggctgaaggtgttccttgtgctgttgctgctgctgtggcggaagacatgcgatggtcagcgattggttgtccacttggaacggtgctgcaaaatttggacgttatttttttagaaaatcagtttttgacatccattttgactaatagtgggaaaccatacatgtgcaaggggtgtcttagcccaaggcccacacgacggacgattggaacaggggggtgtctcaggaccgatttttcatacgcaggtccacttttttctccgccgacgacctttttt

SEQ ID NO: 5351 - DNA, 4732 bp, Heterodera glycines
aaaaaaaagacacacgcaagagagagggacagagaaagagagagggagagagaaagagagagggacagagaaagagagggacagagaaagagagagggagagagaaagagagagggagagagaaagagagagggacagagaaagagagagggacagagaaagagagagggacagagaaagagagagggacagagaaagagagggacagagaaagagagagggacagagaaagagagggacagagaaagagagagggagagagaaagagagagggacagagaaagagagagggagagagaaagagagagggacagagaaagagagagggagagagaaagagagagggacagagaaagagagagggagagagaaagagagagggacagagaaagagagagggacagagaaagatagagggagagagaaagagagagggacagagaaagagagagggacagagaaagagagagggacagagagggtggggggggggggggggggggaaaagagagagagagagactcataaagtcggcacagcatttgacgcgttcggcttacgtccttttttggaaatttttttgcggcataatggacaagtgttgtgctgattgaacctggacgaaaatgaattctctgtctaataaattttcattttttattattttaccatgcttcgatgcattttgtgtggaattcatgctgaataaaacgaaagttaattgcttgaatacacgaacgattagcgtaattggcacaacaattagcgtaattgacgtcaattatcggaattggcatccctttcccgcccaaattgccttacttttatcatgaattaattgatgcataattgaggtcaattaagataattggcattaattacctaattggcacccctttcccgcccaaattgccttacttttacttttcccttggcacatggcagcgtaataacactttccccctgctcataattgcccaaacaaatggcgcaactttcagctgattgttcaccctcttggacaattcgttgtggcaaatggtttattttcacttgaataaaaaataaataaatttttgaatattatttaatatatttgttatttctttttatttaattcgttggaaatcgatttaaaacggttcaaagaaatgagaaaatgcaaattaggcgagtgcttgtgccattttaaggattagaaatgccgggacggcgcctaccggcaccgctggaacccccattttaccatattctttaaaaaaatggagacaaaggtggcaaaaatagttattttttggcgattcctgcaaaatcacacccccccccccctcccccaatttggaatttctaaaaaatacaccctaaaatcgaatttttgaattcagcccctaccaccgaagccaatggatatattttgatttatttatatcaaaagccgtgccaaatagtctccgttttaaaccaattccgaccgttttgagcaattttacccggtttgtgctgcattgaattttcggaattttcaaaagccaacggtctgttgaagggtgctatgtcattacttaaaaaccatcataatgggcgttacttaaaaaaccatcataattaaaatttttgcttataactttgctctaaaaagaccaaatttttaatccttgctatcattcgatagaactaagtgttctttaagagcctgtaaaatttcaaaaaaatttataactttaaaaaaaagttatggccaaaaatgtccgaaaatcacgtttttttgagttccccgagctataacttttttgaaacttaacgaaattttttgaaattttgcagactgatagagaacacttagtgctatcaaatgatatcaagaattaaaaatttggttgctttcgagcaaaattataaataatttttcgacaaaatttttcataatgatggtttttaaagtaacgcccattatgatggtttttaagtaacgacccagcacctgttgaagagcaacagtctgttcaagacggattccgccacggaaatggccaaaagtaaagggattaccagcacaatggcaacgaccatgacaattattttaagtatcgatagaattaatattaaaacgaattcaaagaagtcaaagaagccgcgctttgttcgccttttctgcgtgttgacgaagccaactaaaagtgccaaaaaataagacatttttttggcatttaagtgaccgtttaatggaaatttggaaggaaaaagaacagtaaaatgtcggtaagctaccgtagtccgataaaggacgattttcggaaagccgattatatggcattcccatgtttcccaattgtcctacggcatatttcattgcgcattaaaatatgaattagctaaccgtcgatttggtcaacggctgttcccaaaagctgcagcattcgctgcagattcgcctttgttttgtccgcgactttttcggcattttgtccttttttgtcgacactttgtctcatttttgcttcctttctatttgccttcttttcttgaataaataattttaccaattcaataaatattcgctttttgctcatttttttcagtggcacaattttttcggtcgaaattcggagacgcaatgccaaaatttgaattacaaattgcaaatatcccttaaaggcattttgcgaaaattgtcctgtaattatttatttatttgattatttaatgaataataattattgtatgacctgtttttatttcttttttgaatgaccgtaattcttcgattatttggctcattaccgtatccttctcttttattgcttttattatacggtatttttcttcaaaatccttccctttctttccacctaacatttccgaattcatttgattgcttctgttttcattctgaattttatgaatttatttccttaaatttttattttaaaaataactcctaaaacctttaataattaactaagtataattaagaaaatggaaaaaataataattttagactgttcaaagctggcaatttcgtgaaattaattcgcgctttccttggaaaagttatttgagttccattcattttccgtcccttgtctcgaaaatggagcccaagaccaccaaaaaagccgagagtttcctcgagccaaaagtcgagagtgaatctcgaccagcattattggtcattatttgcctgcttggcttcgtcctcgaacactttttctatcagtcgctcgttttcccccatttcctccacaaattgatcaaattcttcctccccaatgccttcctctctgatcagttccgccagcgtcgttcccttttcctttcatgtgccgttttcgtcggcgattaaatcggccaaagttttgcgggggtctttttcgaaaagatcggccaacgatgttctgctgctggtggatgatgccgaactttccgtgccgtactttgtgccgtcgtcgcccacggcattgaccaaaacggaagacgaaaagcacagcaaagaaagtacaaaaagagacttccggccctttaatgtcagcatttgggcaaaccaatcgaaaaagtttaaattttataaaatctccataagttttcaatgaaattttgaaaaaattcctaaaaattgtgacacctattttatagtgatgctcgagaccgagacccaagaaatccgaaacttttctcgagtcagaatttgagattgttgagcatcaatattattttagcggtagctcacaaaggcctctttaacagagggggggggggggcgttgtaataaaggacctttttttgaaaaatggccaaatatacacataaatcgggaaatatgcatatggaaatacgtcaagaagcttgaatattaattgctagtgaataatatggcaagaaaataggataactttgagaaaaatggaatgaaatgctaaaatgcaaatgtttgagcaagaaaaggcaattggctctaaaaccaatgaatcatgtgccttttccctcgagtttggcgttggcaaatttatttaaacattgttttatattgggaaaatttgtgattggaaaaaattgttttttacagaacaattcgacaattttttaaaatggttttattatttatttatttggcataattgttgtcaattatgctaattgacgtcatttacgttaattgttgtcaatcatgctaattacgtcaattgctaattagtgtaactaacggcaccgccggaccccgccccccctgtccccaaaaagttttttaaaaaatgcgtcgcaaaaaaatctttgaaaaatagttttttatttttagtaaaaattttgaaaacaaatattttcaactatggcagtgaacgaaggaagagccgagcggtgccaaatcgtccgacgaaggacagggccgttcgtcagtgcaactcccaccagtcggagtgtccgccgcagtaaacgggagtcgaaactcgtgttcgtcaagtcaaaggggtccgacaagcccttctccaaaccttgtcggtggtgccgttaagcaagcagcaaatcgctgcacaacattcacagcgccagtccaactttgtcgcccctccccccctcccattctcgtccccctttggcgccgatcggatcggtcagcaaagtcagacctatcagagcaaacggcgaaaagagtgcgcattcctttacgacaagcgaacggagtgacgagagaagaaagggacgagagcggtgaagaagagcgggacccaatcccgcc

SEQ ID NO: 5352 - DNA, 2339 bp, Heterodera glycines
  misc_feature (67)..(68): n is a, c, g, or t
  misc_feature (72)..(72): n is a, c, g, or t
  misc_feature (74)..(74): n is a, c, g, or t
  misc_feature (94)..(95): n is a, c, g, or t
  misc_feature (97)..(97): n is a, c, g, or t
  misc_feature (101)..(101): n is a, c, g, or t
  misc_feature (103)..(103): n is a, c, g, or t
  misc_feature (105)..(105): n is a, c, g, or t
  misc_feature (115)..(116): n is a, c, g, or t
  misc_feature (119)..(120): n is a, c, g, or t
  misc_feature (122)..(123): n is a, c, g, or t
  misc_feature (125)..(125): n is a, c, g, or t
  misc_feature (129)..(129): n is a, c, g, or t
  misc_feature (140)..(140): n is a, c, g, or t
  misc_feature (145)..(145): n is a, c, g, or t
  misc_feature (148)..(148): n is a, c, g, or t
  misc_feature (153)..(153): n is a, c, g, or t
  misc_feature (160)..(160): n is a, c, g, or t
  misc_feature (165)..(165): n is a, c, g, or t
  misc_feature (174)..(175): n is a, c, g, or t
ctagtttcgtttttttggttcaaaaccggcttaaatgttcgttaacaactaaaaaaccataaagganngggngngatgagacttttcgaaaggnngngccngnangccaccgaannaanngnngngaangggaaacggcncacgnggncgcgnaaaaggncacgnaaaacacgnnatggctaaaaataaacgtcatattcgtgatcacgctaaaaattatcctagaaaaataattattaaaaaaatatttcaggggggggggtggcaaaacccataagtaccaaactttgtttttaaatcaaaggcaaacgattttatattaatttttgcatttaaaaatatatttttttaaatcttgtaaaaattccaggtttagactatgtttaattaataattaccattttattcagaaaaaaagaaacaccgcgtacaaaaacagaaaaccggcaaaaaataagaaattatatctgttaatgctcacacgacgatgaaagtgccaattaaagattaataccaccaaataattttaattaaaattaattggtgacattttacaacaaaattaaaaagtgaaattgaaatcggaaaagtgtgttcattcttctccctcatgcatttttaggcgccgtatttcaaccgtttgtaaagggcgttcatttgttccttaaagaaagaaaaaacggtggattttttttataaaactgtaaattttgacggaaaaaaagattttccgaaatcgagacccggaaatgagctcgagagtcgatattaagaaacaaactctccaaactcttccgagactctcgaacagccagcccttttagtcaaaaatgattagaaatagcaccagaaggatgaatgtgagcacagtgtgcgggcccagccgcatgtaatagggcaaaaagcccttccaaagggcgaaaatgccctcgttggccaacacgcggcggacgacgtccacgacgccggagaattcaggacgaccgtcaacaacgctcatgttttggattctgttaaatgaatttatgcaaatgattcaaacaagaggtgtcattagcggtgccaaaataaatttatcgacttccaaattgcttttgataaatatgcaacgctttatttttttgaaaaaaaaataaattaaattttcaaaatcccgattttcaaatgttgtttctcgcttttatccctgtttctgatcaagcgttttccactttttgccaattttgtggccctctacaattttttttgcgcttttcacttgtttacagttgattaattgtccgtttacctaattgcttttgagacatattaacgcattttttgaaaaaaaataaattaaattttcaaatattcccgattttcaaatgttttttctcactttcaccctttgtttctggtcaagatttttccacttttgccaatttaaaatttccaatttgatcctttcgtcaacaatcaacaaaatttgatagtgttccttcaaaagtttcggccctcaataaaaagtgatttttcttgcgcattttccccgtttagggtaattaattaattgtccgtcatttaattgctaatttgtgcctcgtcttcacaatgtccacgggcattgaggcgatggtggtggccaatccggaaatcattgaagcgcaaaaatggagcggaattccgtcacggaaatggccggaggcgagcagctgctgcttggcctgcgaataggtggccaattgggccgcgttgaccaccatggcacggatcactgtcggagtacagcccttttgggggggggggggattcagaggtggcattttaaatgaaatttgaattgaaaaataaagaaaaaaggaatcaattccgtctcgctgcgcccgaaatcttgccgagataaaatctcgccgccgaaattaaaaaaaaattttcaaacttagaattttcaggaaaaaatcttcgaaaatttttaataagaaattttaagaaaaattgaaacgtttcagcgttttttgatcattttttgaaaaaactcagtaatgcatcgtaaaatatcaaaaaaaaaaaaaaatcagaaaaaattgaactcttcgaattttacgaaaaatcgaggaatccatccagaaatcatgactagaaataatgaataaactatttaaaattaaaatatttaaaatcaaaatattttcggcccacccgccatagtgtgaggacgccctcctcgcgcgtgacgcgcaccaacgcgttcagcacgctgctgtaatttcggcgctgggcgggcggcagccgaccgtcggcggtcatccgaaccaacgccaaatcccatcgatttcttcatccaaaaatacaaaaattaa

SEQ ID NO: 5353 - DNA, 1904 bp, Heterodera glycines
catccgattcttgaccaggtccaacggctgcacgaacagagtggcacccattctgagcacatggaaaacaccgtgaagcggcaaaaaaaccggcacttttaaatgaaaggcataaaaaaagttggcacgatgaattaggagtcccccaactggcaaaaatgggttgccaaaatccaaaactgatcaagggcatagccagggagaggctccaaaggcaaccaccacctactccctgcaaccagcagaaaattaatagaaatttgtatccaattttgcggatagggaaataaaacgggaagacgttggggagaagtgcaagaagtatttgccattatcaccccgcaattccgccgaacataaatttgactgagttcggaatcgtttgtgccgcagcgacggatttgctgttggctttggagtcgcccattgttggaccggcacaattagcaattaaaattacctgaaaaacacattgagggggaaaattgccaaaatttaaatttaattaaaaaaatataattagggatttgagcgtttcccttatgaaattgcaattaggtaaattaccaatttctcttttatttatttctttggtttttttgtgaaaagatcataattttcatgatgtgtattaaaaatcgcgcctaaatatttgggaagaaatgcgacaattaaaaataaaacgaaatgaaaggaaatcggaaatcggtgggatcaatcgaaagagagacataaaacagacacatttgtatcaacttgtatttatattttaaatatcgtctgatcatcatcctcgagccgttttttgtcattcattttgatgatcatcagctgcggaatggtcgccgcccgccggcgccgtcgtcgccgacgaattcgaagtgttcgccgcagcgcctaccgccctttcctcgtcgtcgtcccgccgttcgtccaatgacaaaagcatttcgtggaactgaaacatttttaaaaatatttgaaaaatttaaaatgtttgaaacctttacaaaatttaaaattttcttttaaaaaatttaatgttttaaaaatattagaaaattcattttaaacctttcacaaaaatttaaaaatcttttttttttttgtaaaattcaacagattgtgggcatttcctccttcaccacactcataccgtatgcttttgaatgtttttttgtgtgtggtatactgtaccttgtgaaattcctccgcgatgctccgtctctccgcccattcgtccgttaccgtccgctgcggtgccgcgccggcggcgccactttcgccaactgtggtggcaaaatcgggcgaaaagcaccggatgttgcgacgacagcacggcttctcgtacacctccttcgcttcggacggagaataatcggcaattttcctgcaaattttttggcatttgttttaatttttgaaaaagtaaaaaaaaacgcactcctccttcagcccgtacagtcgtaacagatacagcttcaaatgcagcaacagaaagcacgcctgactgttccgcttcagctccaaaatttgagcgcggttcgatggcaaatgctctgaaacaattttaaaaaattatttcattggaaaaaccggtcaattgctgaaaaaataaacaaaattatttaaaaatttgtttaaactttctttttaaaacatagatgttctcaaaaattttttgaatttatagaaagaacaaaaaattctttgacagattttttgtttccttaaattttcttataatttttttcaagttaggctaagtaactaaaaaatgtttgcttttttccttgtgtttttatagaaattttttttttttttttgcatttttttatttaatgaatttggcatggtttttaagagttttgcccttgtattttaatcagtttccccaaccattt

SEQ ID NO: 5354 - DNA, 1413 bp, Heterodera glycines
cggctctactgcagtttacgcgtccactctacttttacgcgtccaatcgacttttacgcgtccaatcaaaatttaacatccttttcacggtgggggtcgattgggcgacgccgtttgggcgccgccgattgggcgacgccgtttgggcgccgccgattgggcgacgccgtttgggcgccgccgattgggcgacgccgtttgggcgccgccgattgggcgcgggtacgattgggcgccgccgattgggcgccgccgtttgggcaccatgcggcagccaaatttttcgttttcatattatccaaaaacgtaaaaaactgaaattactacaaaaatttctagccattcaactgaattacgagaaacagcactcaaaaaacgtaatgtttatgggttaaaatctatttgagtcacaaaattccttcatgactccttcttttttaatggcatgggtcctcgaaattatgccctgtaacttaaaatttgaagtgtccttgaatttaatgtccttgaaaaagaattcgagaaaaacaattattttatataatgtttttaatcatctacattcttttgaatagattttgggacaacaaaggttgatttgatgaaaaataaattttcgtcttttattcgaattcgggtccgggattcgaaattggtcaaaagggatgtcagatttgtgatcaacgacctgaaaaccccctagaaatgttttaaaaaatattttttttatggtttgtaaagtgcatacataagtaccctgaaatctttcaaaaaaattttcctgctgatcggcaaccgccggaaccaatgttcccaaaaagttttttgaaaaaagcataccgcaaaaaagtgcacatgcggtgaaatgaggaaactgatgaacagaaacaaaataataatgaaaaaatactacaatcatttttcattgcatattataatttttttgtatcctatccttgaatttaatgaaactttcacgttacgtcctcgtaaattattatacccgtccttggaaagtccttaaccctaagttgaggcaaggttaatgaatttaaatttccccatggcgcccaatcggcggcgcccaatcgtaccggcgcccaaacggcggcgcccaaacggcggcgcccaatcggcggcgcccaaccgacccggtccgtaattttacaccctaataatgacattattggcgctagcgaaatcagatgattaaagtgaaaaaagaagatttaagagcatttaaaaagaaaaaatggttttttttgggttaaaataaaatttggtcattcgccgatcggggtgcccgaccctcgacaattgagctcctccccgccccgacccccgacatgtcgccccccgaggtccccggcccccgacattttgcccaccgaggggtcttggagcaacactact

SEQ ID NO: 5355 - DNA, 1857 bp, Heterodera glycines
ttgacatgcaattcagtgcatacccttttgacgtagtcaaggataatgtcctgctctgctcggttagagtacgagtgcccgtccatttccctctcttcaggttcattggcgtgatgccaaagaatgggaaaaccctgaaatttcccactctctaattatataaattagaaaatgtgattatgttttgttaaggatttggctctacggcattgtacgcgtagaatcgacttttacgcgtccaatcacagtttgcgcgtccaatcgacttttacgcgtccaatcgacttttacgcgtccaatcaaaagtttacgcgtccaatcaaaattttcctaaatcgaacatccttttcacataaggtaccaaccattgcaaaaagaaataataatttaaatattaaaaacgtaactccaagagaaagaaaaaattactaattaatttttaataaaatttaaatccgtcattgatcacttattatcaaagtatcgataggtatatacgcattcaatcaattgttataaaatttaataatagagagactaatatgtgcgtgcttattttggtttcgataacctctgatatcaaaacacacaaacttttgattggacacataaacttttgattggacgcgtaaaagtcgattggacgcgtaaactgcagtagagccggtttggctgcagataaagccatttgagattaaataaaaactatttttaaagtcctgtaaatggtaaaatgcgattagaaaagatgcttctttcttttttacaataatttaagcccagttttcgtgccttattaaacgtcggacggcggttggtgctatgtcattatttaaaaaccattattatgtgcgttatttaaaaaaccatcaaaataaaatttttttgcttataactttgctctaaaaagaccaaatttttaatccttgatatcattcgatagatctaaatgttctttacgagcctgcaaaattttaaaaaatttcattaagtttaaaaaaagttatggccaaaaatgttcaaaaatcttttcgacaaaaattttcataaagaaggttttttaaataacggcttcgccccggacggtttagtctccgtcgaaatggagctttagtatccgattttttttattatgaaaaatggcaagtgcgtcctaatttgtattgggaaatgcaaaatcccttagggtcattaagtcgaatattaaataccaaatactagcctaatccgttaccgaaatgccataattatgctttattccgtttcaatatattttcttctaatttctttatttattagtattgcttatcggcttattagcattttccaattttcattacccgttctgtttcagtgatatgtcaacaataatcggcggtgcagtaataaatatttaacataattaatctaaaaaattttccgggtgtcatcattaccttggcaattatgacattcatctaacactttattaactcaaataatttaataaagccggtttaaaatttagagtgcgctaatttgtaagtgcacagtccaaagtcacacgtcacactgaaaaaaatattataatataaagttaatttaaaataatgaaataaaagcaaaacagagttacctatgttgtgctctgatggcattgtcaaattgcgcaacatttgcaccagggatggcacggaattccgatttccgacgtttttggggccggaattccgatttccgaaaaattttggtcgtcggaattccgacttccgatttccgaaatttttgatgaaagtcggaaattttcggaaattttttaaatttttttttcaaaaaaaaaaattttggtataatttctgttaataaattgaactgaaa

SEQ ID NO: 5356 - DNA, 869 bp, Heterodera glycines
cccccccgcccccgacactatttcgggggatgggggactccgagcgtttaaaaatttaaaagctaattcatccacgaaggcgggaaatattgaaaattgttgagattttgaacaaattttcttaataaaattcattaaaaattatgaaaataaggttcaaaaaaattatggcctacttttttggtcccaaaccaagatcattagatttggttgacaaagaaaaaagttatagtcaaaaaacatgtgctcgtacaaaaacagcctggcccggccgataggtgccgccgtaaaaaaaaaaaaaaattgaaaattgggagtttttggtagcattttttacataaaaatggccatttcaaagcttttttttctcaaaaccagcgaaataaaacattaatcagaaaaaaattaaaatgtttaggtgaagcctgaaaataagaaaaatcttagaaataaggacattttcagtttctaagatctggcccctccaagtaatgacaaatcttagaactaaggaataaggacacttacgaaccctgcttaatgacattatgtcataaaatttcaaaattataaatatatttaagaaatctgaacaattttcgtcgttaccccaaaatcagaacattcttataaataagaacaaatggaagccctggtttaaaggcccgcttggactcattcatactggcgctaacgaaatcggctacccgacttttggggatttgcaacttggggacccgacattagggaacccgacatttagggacccgacatttggggattttaataaaacaaaaaaaatattaaaaaagcccttgacggatttctgttctcgttggcccttggggaaggcactttaaataaaaatt

SEQ ID NO: 5357 - DNA, 286 bp, Heterodera glycines
aaagcaacacattataaaatacagataaaaaagaaaaaaaaaaatcagaatttcccccccccccccccctggatacgcccttggccccctttttggaaaatttttttttgtaaaaagtcgtgaaaagatgtttattggggttttctgggtcgggaaccaaatccaacattcatttcgactaatttcgaatcccggacctgaactcgaacaaaaaagccgaaaattcaaaattttaaaaattcacttttatgttcgtacctgtaaagaatgatagttttatgatgtt

SEQ ID NO: 5358 - DNA, 1454 bp, Heterodera glycines
aaaaaatttgcataaatttctcttattttcccatcaaaaataatttattttttataagaaaaatttgtatacctaatctaaattcattttgaacaatttctatcccggatccgaattaaaacaaaaattcttaaattgaaatagaagtaagggcacactctgagtttcagtttatctctaaatttgggcggctaacatacgaattccaaacgaaatgtgtgacctgatagagtaggagggaccaattttatgtctaaaactcatgtaaaaaactcaccataattttgacctggatttacaaagattaagcagaccgagttcaacgcgagctaaccatccgaccaaacagacgcgaaattttaccaccctccgcccccctccctacaaaaccatttcaattgaagcacagatgagcatttattaagcacaacaacaatacaattacataggcaacaattaaatatacattcatttgaagttatgatcacagaaatttacataaacatacaacaatttaaatgacgggggacaaaatgacaattttgggacggtgggatgggatcctatcatgtccatgttgtggtgacgaagcatccttccatcagaagttgtactcgattgacaagttcttgcggcgcaccatccgtctccctggaaccactcgggcttgaacacggtggcgtctgggtgcggcgtgtttgtccactccacggtcgccctcggtgccggggtcgaaggcgtcgcaggagatgcccacgttgacgaacttctttgggccgatcgtcccgtcccgttcggcgggttgatgttgatgcgctgcgccttggtggtcttgacggcgtcgccgaggcgccgcggtttggtggttttgaaggcgtagccgatgcgctccgtcccagggttgatcacctaaattttaaaacgggggttaaccgcatgccacgtgcaccatgcccaaacgcacccgcacccaggcggtccccccgttgtcgaacggcgcgttgaagacgaccttctgcgtgtgcattgttgcgatgtcttccggtggaagttgcgcattgatgtttttgtcgctgttgtcgggctggctttgtgggtgcttgatgtgtgatcgttgagaacgttgcttgaagtgttgctgctgatgagtgtggcgaaatatttaaaaatttaaagattacctactttcaaaatttttgagaaaattaaattttcaacaaacttaatgaacaacgaaaaattctcaaagaaaattgaattttcctaagaaatatttctaaaataaaaaatgtaacatataaaatttaattttccggaaaaaatcttttttggagcagctgctgacggaaaaatcgaagtgggtcgaaatgcgtattatattcgttatcactgatcagcgacttcagaaacctctaaaaaacttctttttgatgagtttaaatatttttgaattt

SEQ ID NO: 5359 - DNA, 3343 bp, Heterodera glycines
  misc_feature (61)..(61): n is a, c, g, or t
aaaaagaattgatgaaatcatttaataatttttcaaagcaaaataggtattcaaatatgtnaaaccaaaacatttttgaaatcacctttacttggttagaattttaaaattttgcctattaaaatatttttaaaaaatcttggttttgtatgtgacacagacaaaagtcggtacgattcaaagcagcaggtcacccaatccgatttttaagcatacgggtagaacagatatgcaattgacatatgaaatatacaattgaatacaacagtttatgacgaaataggttaactaatttatcttatatgtaagtatatcatgcatccatcacatcgtcgtttcatcgtattgattatgtttattggcatcgttctactcgtctctgcttaagttcattcgatggcacttccgttcttcttctggtgctgatgaaagatcatattggcacattccgtgtcgacatcattcagcacgaatttgtgaagaataatctcgaagacggacgaacacaacaagacaatgctgagcacctttaaaagtgtttaaaattttgaaaaatgtaggaatcaaatggtaaatgtgacaacaaaacaaactcaccaaagtgatcaacggcacatttgtgtgatccgcttggaagttgacgcaagtccaaaagtccgtccaatggagcagcaatctgaaggagtacacaacagagcaaccccagcagaagatagaagcgaaggcatacgaatagatgccgatcttgaaaagaaacaaattaagcgacgcagacaaaacatattttgacaactcgtgaacacagaacctcaacactacaaaacttaaatctcaatttgatccaaaaaatcaatcggatttcaactgaaaagcaattttggtcacgattttgtcgggttgaattgatgtgggccacgtgttgcgctcgctcactttatattcttcgatagagcgcagcatttccatgatgccatagaacagaagagcaagcgagaccaatgcgctccaaaaaagttgggaaaaacgaagcagtgacattgttgaggggtttctgtgcagcatgtcaatccagcaaaaggcgtaatctgaaaaaccaaatgaaaattaattcatcgttattattggctttgcttacgggccgttatcggaatgcaatggcgtccagcgggaggcaatctcgcgaccaagaagtgaaagaattggcgtttctgttctttggttggttgtccattggtgatgttcataaagaatgaatgggttgtgccggtcgatcacatcgccgaattcgccgttttttgagtcctttccaatgagcgtatagcgttcgcaaagacgaccacagaggaaggcctgaaaatcacatcactttgatcatttgtgaaattctaatgcaattgacttttgggtcggtaaaagtgccgcagaactggtggagtgaaaggagttgccaaatgatggtcaaagtgagcacaattgcaacagtttggagcagggatggcacggaattccgatttccgacatttttggagtcggaattccgatttccgaaaaattttggacccccggaattccgctttccgaaatttttgataaaaagtcggaaattttcggaaattttttttgaattttttttcaaaaaattaacaattttttacaaattttattaataaattgcactgaaattttcaaaaatttcccggcggcgcctatcggcaccgccggaccctaaaatcttatttttcttgagaaatttttgccttaaatctttttttaattcattttagcaaatggttaaagtttcaaggtattctattaatgattccaacaatctgccgttcatcgcttttccaacattggacgatataaatttgagatggcttttttcccaaaactctgaagagattttacaatttttggcacacagcggacttgtccaaaataaatgtttatgccataattgttggaactatgtatatggctctgacaaaacgtagccaaataaaggatggatttcaagtaatttgaaaaaaaaaatcttttttaagtccttttttaagtggcactgtcaacactgtcatctatacaaatctgtgcgcgaaaaaagtttttttcacaatagtgctttgagtctcacacaaatgttcaccatcatctacatgtggattgaagactaccgaaacaaaaacgctgtcaaagaattgggcgtgtcaaatccttctatagtcaatttcttcaactattgtcgttaacaatgttcaaaacaggctaaaattggaggaaaaaacaaagtggtcgaaattgatgagtagggcttccaattatatcgaaatccatatttttttcctggactgtgggaggcctgaaacgcacgaaaagcatgtgtttgcttggtttgaagcttctaggatgactttccatatcaatattttccatatttttccatatttcgcgatttatgtccatatttccatattttggcatttttatccatattttatgtccatattctgggatttttctaaaaaacctattagaacggcccccatcagctaaattgggattttgaccccaaatcggaaaatttttgcgaaaaagacattttttatcaaaattttgtcgaaaattttgattaatgtatcgtgtttttttcttcaaaaatgatttttaatacatatctagccattcttaaaagttttactttgcatttagcgaatttgatgaaattttgagaaattatagcctatatttggaaaaatttatgtccatattttgcaattttatgtccatgttttgatattttggcaattttatgtccatattttgcgatttgttgtccatattttatggccatatttcgcgattttatatccatatttttggacgccctattgatgagacatgttggacgaaaatgaagcatcatcgaggaaaacccaaaaaggggagccaaatttggatgtttggcgccattgaacgtggtgaaggtacaaaaaactaccataaataaattaaaaaaaatttcccccctcgcgcggcgcctatcggcaccgccgaactctcttccctcacccatacccaaaaatttttcgaaaaatgcgccgaaaaaattgttaaaaatctgttttttttattctaaatgcactgaaatttagcttatgttcgacaaaattgttaaaatcttataattgattttcggaaatgtataaattttcatttctaagccgaaattgctcagaaaatagttggcggttagtaatgcttgattttgttgaataaaaagcgataaaagttttggaagcggttttaaaaatgtccctatttttgccctaaaatttatttttga

SEQ ID NO: 5360 - DNA, 1908 bp, Heterodera glycines
ttctacactgaatctcctcaaaatgcgagaccttggtctaccaagggactaataattaattgtttccatttttgaggtgtccacaaatttggtcctacatccattccgaaccttgggcctaatacgaaaaattaaacttataaaatttcgcatttttggttccaaaaccggcttagagttgaatttgtgttcgggtggtcaaccccgagagatgaaagttcacaattgcatttattttccctttgcatttgtctctttcttttcctcttattttccccactctctaattgttgtgtcttcctttattaatgtaagacactattgatttattttgtccaatgcatgtccattcccctcattcattcagttgctttttattagagaccggaccgggccgggcccggtaccggtttttaccgggcccggaaaccggaaccggtgatttttggaaaaatccggtttgaccggttttccggtttgaccggtttttgagagaccgggcccggaaaccggtcgttttttaaaatgcaacccggcccggaaaccggccttttggaccggttttgaccggttttataatcaagccaaaaatgtttctttttgttcatttttctttgaaaatgtctttttggcataatgtttttaattttttttttgtcaatgttcaagttgaattttttaattctaatgtttgcttctttataattattaaataatgtcttttttgtttagattttatgcaaatgagtcttatttggcaaattggcctatttaaaaaaacgtccaagactacagcaatttgtctcgagtgccaatcaaatgaaaagccgaaatatgaattcaagctcaccaaaggaacggtcaaaagcttgcacaccaatcttcactgctttcacgaaaactccgaattctcttaaaagctgaatgctcttgaatcgaaagctgaaaaggagaaacaaaaacagaagccaatctcagactttcagtcgtcctgcggaccgactttttcggactgtaattcagccaaattttttttaaattatttaatttttgtttcagcacaactctcctcgtttgataagaaaattcttcattttttggtgacaaaaaacatttccttcggcgcggtggatcaccaaacttttcattctttatttccccatcaaaaagtgaaaagtgaaagtttctataggtgatgagttacattaaaagttatgagaaaattacatttttgaaattttcagaaaaactgccttgccaattgtttaccaacgtgtcagacataaaatcaaagatgaattaaaagaatcagcatttattacactgacaactgattgttggagcggaagcacttgcaaccttctgtggtacattattactttgtttattaatcatcatgggttttactgcagcctaaccgcgcactcaatttctaaatggaagtctatgtcacgtgttttggcaattacggaattttctgaatcgcgctcaaaattgaggatttattgctcaaatggggtattcctaaggaacgtgtgcattcaattatctcggattcagcagccaatatgaaaagagtgataatctaattaattttctttacacttgctcttatttgcaggcatttgttgagagggatgaaaatgaaaatcgaattttgccgatgccaaacggaccttgcgctgctcatttattgaatttggctgtacaggaggcgttgaagagagatgaatcaatcagcagtttattggccaaaactcgtcatattgttggccgtttcaagcacagtaacactgccttcagcgaattgaaaaaaattcaaaaattactcgatgccccttctcatactctttgcaaggttaaatgttaattagaattcacttaattttatttatttctaatgtcatt

SEQ ID NO: 5361 - DNA, 998 bp, Heterodera glycines
tttttttagatttaacttagaaaatttttcgaaaaaacttttgacaaaaattttttataagaaaatttcaaaatgaaaaaaaatctcagctttttttgggaaaattttgaaaaaagataacctatcgtaaaaagttttcaaaaattgctaaaaaatgaattctcaaaaaaaaattctaaattttcatcaatcattgaaattgctggatatagggacggacatacattggtagaattgaagaatggcattgaaccacccacttgtccactgggaaagttggtttctgattaaaaatattaggagcaccgggcgagagtcgaacccacgcctcgggatgggtgggcaaccaattctccactgaactacgctaatttttgattttttgtaagccactaaattttaattttagacggcggtgcaaaagtttgccaatggcacagtgttggcgaacagcgactggcgcaaggggacggagagtgagccggcgggctactaattaggacacgcatacactaattaatttatgccaattatttatgtcgttttctttttagctaatacttatgttgtttcatacttttgagagaatttcaattttttagatttttcatacatataaaagaattttactttttaaatttgttgttttgttactcacgcccgttcccttcccctaattgccctcataatttgtattgattgctgcaataaaattgaataagggtcaagtcaaagtgagtgtgtgtgagactcccgttttaaatatttgtcgaacatttaatccttttggtcaattgttttatattagagtgccacgggaccgggaatttttgccaaaaccgggacttgccgggacctgagaagccgggaccgggacctcgatttttcttcgggaccgcgaaccgggaccaaccgggaaattttaaaaattcaaaaaaatttaaaaaaaatttaattttaatttatttcaattgaaaataatacaaaattaaattaat

SEQ ID NO: 5362 - DNA, 950 bp, Heterodera glycines
tgagcgagaaggcgcgacgttacgacgacatggtggaggccatgaaaaaggtggcctcgaaaatttctaaaaaaattttttgaaacccccctaatgttttttttccattttagctgatcaagttggacccaaatctgaccctggaggagcgcatttcgttgtcaacggcttacaaaggtgcgatggcttctcgtcgtacgtcctggcgtgctttggtctccatcgaggaacggaccggcgcgagtttgagcgatgcacaacaacaggtggcatcatttggccacaaattctgatcaaaattggcccaataatttcccccaaacaattttcaggtgttggagaactatcgtgagaaggtgcagaatgaactggtgaacacttgccaagaacttttggtgagtttctccgttttccaccgattttttccaaatttttaatttccccaatttccaatttagacatgcatcaacgaagtgctgtttccgaaggcgtccgacgtggagcagaaggtgttctatctgaagatgaaagccgactactaccgttacatttccgaagtcgcgacggacgaagaccgatccggtgggatttgagaggatttgtgcccgattttcaggcattttgtgatttgtgtgattcctcaatcaactaaccatcctctgttttttacaggtgttgtcgaactcgccaaagttgcctaccaggaagcgattgacatggccggcgacaaaatcccagcgaccaatccgactcggcttggccttgcgctcaacttcgccgtgttcaactacgagatcttaaattcggtgaccgaggcacgcaaagtgatccaaactgtgagtttcctatttgaattttcatgtttccttttcatggccaaatcccccggcttttcacaggctctcgacttggccaatgcgcatatcgccacacttacgcagccgctgtct

SEQ ID NO: 5363 - DNA, 3567 bp, Heterodera glycines
aggatccagttttatccactttttatgccatatacaataggtaatcagtttcacaaatgtcacgttcatttggagccaattccgagccttgattgagtgaaacctccattttaaatattttccggatatttgaattacatttttcccactcattttggctaaactttgaatttgtgattggacccgccgactaaacaaatgtgatctttgtcccacttggccgccgtccactttaaatttcttttggccaagagcgattaatccattcgttttgtgtcaaatgctcagttggccaattctctttgaattttcagttgaatttgtccttaaattcgtcaccatttgccaatcaactcgaggccaaatgttccgccattcattgagttttgctcagaatttccccccccccccctccccttagtttaagcacaaataatttgaaaattggacttggccaaatgcccattaattcatccatcctttaaaaattccgtgtttccttcctctaatagagcctccggcagcttcggttttttaagcaaacacatcgaacggggcttctaatagagggctggaggggcttttattagagggcttgtggtccctcaaattaatcgtttccacacggttaatcaagctttgagtgttctacttcatcttcctcgtagggggggggggggctttattcgggggcgggggttataatagagggaaatacagctaaaaattacatctttattgactgatatgtaattatgatgattgagttgaattgttggtgatcagtcctcgacaacgttccccgatcggcgcggagggcgaccgtttgtttacttttctttttggccctcccgcgcccaatccgtccatttccctcaacaacttccaacaattcccgtcgtgttcctcatccttctctcttcttctgctgcaaaaaagaattgatcacccctcaaacaacatcaaattggatggcgccacttttgctaatataatagcccaaaataattaattaattaggggaacaaagacaattaattagtgagtgccctctgttctgagaagagaatttcgaactcaagacccaacccgagcaacgattctcgctttttgggtctcggatattctggctttttgtggtctcgactttagagaaaagcccggaattttttttttgtggtttctgtctttggctcgatccgcaaaatttttaattcaaatctcgactcaaaaatggctaaaaattatgtgttatacaaaatattatttatttatagtggcgaagaaaaaaaagagaaatttaaatttaatttcttcggcaaatttttgtcggttcgattggacagcaaaagtgccgaaaaatgattaagcgacgcatcaaaaggcgaacaccgacagtggtgatcatcacttgtacagtcagagtggtcagtgcctgaggggattgagttggggcacaattagggagggatatagaagcgattctcgacctcgaatttgtcgatttttgggaatctctggggtcacattggtctcgataaaaagtgttggcgatgagaaccaataaatctctctaatccccctcccccatttttattggataacaaaaaatggaagccgaaatttaaaaaatgtaaaaatgcaattttaaaataaaagtgaaattccgccgcccaatttttgtgctaaaatttggcatggatcagctcaattttgtgcgagttggccttttctttttgaatgtaaaaatgggataagaaataaaagaatttttgggattttaatttttttttggggatcaaatgacaacaaatttttgaatggatttcgagggggcggagaaaggctttttgtgttacttttggtgcacttttttgatcggaaatgggagaagggatggatcaaaatgggatttgggaagggattttgctgcttttcaatgggtcgggggccgaggttcaatttcaattttaaaacaaatcccgccaaaaaaaaaaacagatttcggtgccgtgtgccgccggtggtgcgcaaaagtcaacaaaagtggcggcggtggcggcaaaatgcgccgacgcccgggtggcggaaaatgaggcggcaacggcagatgaaaagcggcggcggctgcttcaaatgatggcggtgacgaatgtgaagacggaaaaaatgcgggaaaaattggcgccgcaaaaattgggagcaattagcaacggaaagtacagtatgacgacggacgacaagggcggcggcaactacaatacaccaccgtacagtagtactctcaagaacaacagtaacaacagtgacagtaataattgtcgtaaagacaacggtggtggtgcctcaggattgaaaaaccagcagaatcccggcatcggttggatctgattttgtcgcgcattcattaacaagaaaatgccaaactgagtcccgcgtttctcgggactcgagagtgggaccaaaaactcgcgacccaaaaagcccgagactcatttcgatcaaaatccttggcctcattaagcgcaaaatgtgcgccttacgctggacaaaatgcgccaaaaagaggcgcaagcgctgcgcgagcgctccaccgatgtgtacgccaaggattatgtgccaaaaaaatatgcaaagaattcggcggagtacggtcgaccggtcggcggttaccgtaaaacaagaatttatgattgttttttagccgccagggtcgctgacggaaatgagggcgaacaaagcgtgtaagttttgtggtgatcactgatcaagtatttgtgtgcctacatccttaaaaatttcggcaagcggaaaggcattccgacgacccaaaaattcggaaatcgaaccgtaattacgaaaaatgtcgggaactcgtaaatcggcattccgaccgcccaaaaaaatgtcggaaaacggcattccgacattttcatggtggtgatgtgctaatgggaaaacgccactttttcgaggctgcaaattgagattccaacgggacttcagggagctttaaaaaattacaaaaatcgggaattttccatttcagcgatactcgagaccaggtcctccaaaaattcgagatttttctcgactcttagaccccgatattctcgtgccaaatggcactcttaaaaaatcggcaatttgttttggtgccattgttcagcgcggcacgttgcgcgcgagatgctccaactgtgcgaggtcattgaggagcatggacatcgccggagggcacggaccaacaacagcagcaacaatgagccaaatcgtgtggtcatttcgtttggcgccctgttcaacatctaccagttcatctcggacaaagtgagacatttggtgccacggaaggggcgggggacattttgtccccggacaattggtcccttagccacggaaggtgggacgaatagtccgagggagacaaaaatgaaacacaagcaaaaatatatgccaaaactctgaaattatgtttttatgtgccaaaaaccatcgaaagtaacggcgatgccaaatttcgcggtcaagtaaagattgaaatctcgagcatggaataattaggag

SEQ ID NO: 5364 - DNA, 4500 bp, Heterodera glycines
cagcgcggcacgttgcgcgcgagatgctccactgtgcgaggtcattgaggagcatggacatcgccggagggcacggaccaacaacagcaacaatagtgagccgagccgcgtggtcatttcgtttggcaccctgttcaacatctaccagttcatctcggacaaagtgagacatttggtgccacggaaggggcgggggacattttgtccccggacaattggtcccttagccacggaaggtgggacgaatagtccgagggagacaaaaatgaaacacaagcaaaaatatatgccaaaactctgaaattatgtttttatgtgccaaaaaccatcgaaagtctcggcgatgccaaatttcgcggtctcgtaaagattgaaatctcgagcattggaattaattaggagattttcttattaaatatttacccattttaacatcacaccccctcgcatccctataaaatttgttttttttctcccctaaatttacatgcctttttttgtgctaaaaaaaatccacaaaagatgtgctaaaacccctccaaaaaatgccaaaagtgctgaaaactggacgaaaaatgccacaaattcttcaaacaatgccactttccaccaaaaaattcataaattgtacttcaaaattgttctcctgcttacaataaatccacacacataaaaagagttttcttttttttgccaaaaaattttccggtgtcaaaatatcgaaacatttcggtgccattctttcaaagatgccaatttttttgacaggtggttggcatgctgttacgtgcccgaaagcatgggatggtcgactttgaaggcgaaatgcttttccagcggagggacgaagcaaaattgatcactttgctgatcagccacgaacaaattcagcaagcattgagcgaaattgagaaatgatacaattaaaaatttttatggcgcaataaaatggcggaaaaatcgagaaaataattttttgtgccttttctgcaatgccattttcatgtattttttaacttttttcatgcctaaaaaaattcgtgccaaaagtccgcacttaaaaaaaacaatgttcaagattttagtcatttttcgtcttttaaatttaaaatatttcaacaaaataaaaaaaacaaaaaaaattatttttttattttttcaaagccttcaattttttgtgctccgattcttggacttccaaacactgcataattcgtttcgtcttctcgtccctctcccgtcgcactttgcgctgtcgctcggcgtacgcactaaaatttacaaaaaaaaatttttttttttgcatttggctcagtggtctgtgcgcttggcgccatcaaaaatgtgttaaaagttcaatccccagtgcacgcagaaatgtttttttttatttttttcaaattgaattgttgcaagttctcttaattcaatcaagttttgttgtcgaaaaagcgatttttattttctaaatttattcatgtgttttaaaaaaaaactaaagttttatacaaaaaaattttccaggtaaattgatcattttctcatgaaaaaattagtattttaaaattcaacaaatttttttgcggggaataaaaaatcaaaattaatttttttttatttcgaaaattaaaaaattatcacccatttcttatgaatgccgcccctttttcccccactcacttggccattcccttggcgccttttcgcaattctttgagtgccccgcgccgttcatttttggcacgctttgcccaactcttttctcgcgccttcatgccgttgctgtcgttgtttttgttgtttcgcctttccgggtcaaaccgttcgtcaaagcgcggctccaacattttaatggcactaaatttggaagggaagaaaattttagtgggagagaaaggggcgcactttttgaaaaatgaagaaattgaaaaagtttttttttttaatttccgttggaattttttctgtcgttctcaaaaagtttattttaaaaaaaattaaaaggaaaatgaccgaatccatggaatttcgtagcgattttcaacggatggtattcttaaaaaattaaaataaataatttttgccaattttttaggcaaaattttgtgtaaaatttcgaatgtcgaaataatcggggcacatccgaaaaatttatgcttatttaacggattttgctattgaataaagccaaattttcaaaaaatttacaaggaaattacgtcaaagctttaaaaaatttaataaaaaattagccccaattttcaaacaaattttggaggagttaaaaaatgccatcccctcggggcaatggacttggaaacccctacccttacccacctgttggttgttgttgttgtgccccttttgctgatgcgtttcatttgcatgactcgcccattctgtgccatcagtttggccaacagttgggtgagtcgtgccgcttcgtccgccaattgggccgggtaattggccacgggcaaatggagacaaatgcgatggaacggactgaaaattgggggtggaaatcgtacatgaagaaattattgtaaactcgcttcgatattgaatttttatttgatggggtatggctgtcaaaaaaaacggtggttccaatgatttttttaaaaagacacaaatttttggaattttgctgaaaagtacaaaaaaaaaaataaggcaatcggtccatcaaattccgaaaatttcattaatttttaaacgttggattgaattaaacaaatacagttttcacgagaaatgaaaaaatggttaacaataagcatattaaagtctaaaaaaatgggacataatgtccaaaaacaaattgtccattttttcctcaaaattctacggattggaggcattagggaagcaggaattttcataaaaaattaaataaatttcaaaaaatcagcaattaggatggatccgacgacccaaatcctaaaaagaacgtacccaaaacaggcattgaacgcgggacacattgtgccgccgtcgtttgtcggttggtccccggcggcggcgacactttcgtcggcggcggtggtggtgccgtatttgcgcgcgtattggccaattgtggcgaacagtgcgcgaacggtggccaatcggagacggcatttgtcctcgtctgtgctggtggcaccaccaccattctcttcctcatccaaaatgccaccattttccgtctccaaatcgccaatgtttgggtggaaaatttgtccaagtgacaaattaccaaaagtgccggttgttgatgttgttgttgactccttaataaaattgatggaccgtgaaaaggaaataaatttaatttttttttaaaaacttttttgtgtcaaaggcaaaaaaaattttttttttttttttttgctaaaaccttgaatttcaataggttgacatcgaaaatagctattacgagtcgttccaggtaaaaatttattttttcaaaaaaatgccatgatgaaattggaacagcatcagtcaatttgttggcataaatatggaaccaaatcgctgtgcccataaaataaccaacctttggcgcgacaaaaagcatttggcgatggggcagcgaaattgggaaattcatcgacggaaatggcacttctttcgcctcatttttgctctcacagcacagctgaagagcgcccaacaaaaaggccaacacttcggggaagaaacgaggcctaaatttttagaaaattgggaaattttgaaaaaaaaatgacgaaaacggcggcagcgacagaccgacgacaaaaccaatcgcacatttgggcacacagaaaaatcagacgagcgcattggtcaaccgagcaaatgcgagtgctgaaaatgagaaaatttgaagggggggggggaataatggacccaaaaaaggcaattgttgaagaaaaaattcagtggatggattttatttcgcaataaataatctttcgagaaatttgtcgtgaaaaaataaaatttttccaaaaaatgaaaaattcaaacccctgaattttttaaaatattgatgaaaaaacgcactttccgaccagttcagaagcaaatgcaattgtgggcgtaagaattggatggaaacgcgcttctgacgggaaaagtttggcaaccaattgcaaaaaagtgacctaaaaagagcaaaatattgcaaataaaagtgcaaaaaacattgaatgacctgcacaaaggacggagacgaagccaatcgggcactttttgagtgcaaaaaatcggcacgaaactcgctcaatttgtccaaaatgtgccgaggcccactgaccgaacatttctgaacagaatttggcacaaatattgtaaaaatttagtccaaattcaaatccaacgacccggaatggactaatagtgacgaaaaattcaaaaaaaaaaaaaaaaaatttttttgaaaaattttgagagtaaatcgttacaaaaacagttccactcccataatttaagggaaaatcttaaaaataataagcccccaacaaacctcca

SEQ ID NO: 5365 - DNA, 5428 bp, Heterodera glycines
  misc_feature (8)..(8): n is a, c, g, or t
  misc_feature (34)..(34): n is a, c, g, or t
  misc_feature (78)..(78): n is a, c, g, or t
tagaattntaaatttcctaatttaaaatttgtgnaatttataattaactccaaacacaacaaaaagtcaacaaacatntaatagttttgaaaaacacaatatcatagcattggctcaccacacgactacgatatagaaatacagtatcacatattcttcacttttatgtccctacttcttcctcttcttctctaatcattcccatattttcaatcgcttcatatgctttaatgcttatcatccgatcatttctgagtgattgcatttgttttaaaaggtcgctaatgtaattgatcacttcttgaatatcataatcaaccttttcgccattaaaaagtttgctgattaattgatctaaaacgtttttacggagttgatcaatcgtcgtttggctaattccttcccgaatattttgttcagtgagaaattcgtccagatcaatgccaatgatgtttaattgatcaaacaaaactcttatttcaccaacactttcatgtaaatttacgagatattgatcaattacttctttagcttgattggaattaaattcatttgcatgctttttgttgttaataatttgtaaaagtattccaattgggtctatgtacaaatttgggccaaaatttgacggcccactgaacattgggttaaaagttgatgactgaaaaagaatacaaattaattttgaatcttaagaaaataattattatttaataaaatgaaaaatataatttttttagcaaaagtatgagaaaatttgatttgatgcacaaaatattgtgatcaattctcaattctataactattaagattaatctgctaaaatcacatccaaatttcttaccagcactaaatttgcttccatcatacagagaggacagcaaatcttgttttgtgcaaacctaaaagtaatttaaaaaaataaaaattaaaaaaaaaataaattttaaccaatttttgatgcattcattgtggaatttatgctaaattaaaagtaattaaagtaattaattaacgacaaaacaaccgttattttgccctttccgtcattatgaatttctgtaatttgttcatttttatattccattgcttctaaacatattgaacaaatttcttcttcacgcttcttctttatctctcttttattcgttttatttgcaaaaatattctaaaagttaaatttatgaatgaattcaaaaatttaatttaaaattttgggttttaacctcgaattgataaatttttaattcaacattctcaataagttccgtctcttccataatgcttttatagaacagactatgtttgattggaaatgacaattgatattcgttaaactgaaatttaaaatgaattgcaaaattaaaatcattattttaatgaagccctcatttatttttcgaaaccaaaaacccagaattgtcttctttttgccatgagggtttttgatctcgtgtgccgggcttttggctttttgcccatgcattttggttggaacaccaatattgggatgggaaatttcgggacatggtttatcgtagggttaagccctgaccccgagctgcccgactcagctccaccgacatttttgggctttctgcccgagcccaggtctccggcctgcccttcccctcgctcctcgagaatttcttccccgagcggcggggcttaaccataattttcggagcaagaattgggacggggttgaccatcggccgggggtttttcaatttttgccttatgccaaacaatgaaaaaaaatttccgataattactagggatgcgatttttaattttttttaactattttttttttttgctcaattttttgtgaagaaaggagcgcaaaaaactcatttctgcgttgaaaattttcgattctgatgacactatcagtcactagaaatcattattagggcgctttgtccttaaaatagttaaagttcattattttggcgttttgccactattttttaactatttggatatttttgggaaattactttacaaaaatgcaatgaaaccaaaaaatgcacccctaaaaataaaaacaaaaaaatttcaaaaaatacccctaagaaacggcctaaaaattttttaaaaatacacccctaagaattgaaaaattttctctaaattcctctgcctaatcttttttgacgaaattatcaatttaaataatgtaaataattgctaagaaaatattagaaatgaaatgtacctaatttgcaactgcaattagttaataaaaattatttttgctcaattttttgctaaaaatatatcactcttgacttttagccattattttgtcactattttggactctgtcaattttttcgtcactaaagtcgcattcctaataattacttataaatttaacctcattcagttttaggtctatcgctggttcattttggtcataaactttctccaattttgcgtatcccaaaagcattttctcctcggagttctcagttcgaccgattttgatcgtattggcatacaaaagggcatggtaagtcccgtgatcatttttctgatcaaccatcagtttccgattccaataaaggccgggcggatcaatgcgacccaaattgatcacatatctttttgatgggtttggccaaatcactgccatggtcaaatagcgtcgtaacagccatccttccggtgccatttttactcgcgcatggccaatgagtggaacttcatcacggccaaatggctttatgaaaatgtaaaattgcagatcaaccttttcaatgccttcttccttggcattgtgttgctgatcaatttcgagttcaatgttttgtccattttttatggttttcgctccttcaaattttttgcttttgtaaaaatattccaagtcaaaaattctttcgcgtttttccttcatcgtctcgtaaataacgcgaatttttaatttttctgaacatgtttctttcgtcaaatataaaattaatggaagaaagacacaaaatttgttcaaaaataacataagtaataataaataatcagcgttttaattaagggacataaattacaaaaaaaaagtaaaaaaaaatcctaaaaagaaaataaatatttaagaaaactaatcgctattatattcactttctttttctggagaaacacaaaggaaattcaattatattgattaaaacatatctgattttatatttctattaattctatgtaaaatttattacaaaaaatttaaaattttattactaataaaataaagtaatgcaatttaaataaaagtaggcggcatttcacatattttctagtattcaaatctataataagctctatattgtttactataaagcatctaatttttgtctcatgtgttctctattgaaggtctatagtctcgctgtcaagtctcgactcgacaaaatgctcgtctatcttggtctcgatccctagtgtctttatcttatattttattttaatattatttggcaggtctctctccaattttccagatttccgtttatctttcggtgaaaaaaatttaaatttaataattcgaaaaaacccattaaattctgaaaaaaatttccccccacgacatccggccacgccttctttgtgcaacctttataatctcgaatgatttggcccaaaatattgaccagttcttccaatgcagagattttctcggcaaatgacaattttttgttaaatttttgcaaataattccgaattcttgcacaattttctttgtcttcaattgattctaaaatttgtcggaaaattttgaattcattcgaattcgaaatgcgccgttgcccttttgtttgaatttggccttttgtaacggtgtccaattgggaatgaacgatttgttgcaatgcttcaccaaattggatcactgcttaacagttggaaaacggttgtaatcaattaatggaataaataagagagaactgaaaatttgattgattctttgtgaattttcggatttattttaaaatattcggaaaatttgtgacttaatgaatttgtgagtgtttgcttaattatacttagaccaaagaaatccattgtattttaaattttttacgggtttttaaaaaagcacaatgaaatttaggctcgaaacttatgtcaaactctagataatattttaagtctttcccaaatttcatttaaaagcatatttcgttaaaagaatcacacatttctcttctgatggaggagactaagcaaattggtaatttcataataattattatgtaaggccgggaccggaaatggcctttacccttcccccccccattttatctctccgatagggctcctcccatcccgaggggcgcttaaaaggcaacggataaccagccaaaggggacaatcggagttcagtcggaagtcattcagtggaatggctaatcgatccccgcctgggaggcgcccccaggtatccatcaacatcccttcccttccaagccctgcggggcctaattacggacgcgtaagagggctcccctggactatttccctcataagcactgggtatgggacttcacggctttactggtagcaccggatggttccctccctatgcttacagggcttgggccatgggaagagggggatcagagtggcagaccgacttttcaggggatgtctttgtgttgcgcaagtcgccaatcaattttagagtcctgatcaggccccagcaaccccctgggaatcaaaaaaattttttcaaaaattatcccacgcgtggttcgataatgatttacagagaaacaaaaaaaaatactcaatcatggtttgaattatctgcagcagcagtcaaaaaaaaaaaaaatcaaaaattccatgcatggtttcagaaaagtctaagttgaaaaaaaatcaaaattccatgcaaatgatttcggaaatttacactcaaaaaaaaaagtcatcccacacgtggtccaaaaatttatctgagtgagtcaaaaaggacccttaaaaaagagggggagagagacactgtgaataataaacacataaattagtcattttctcaacgccttaaaaggggaaatttaattaatcccggtaaaataaagaagaaaaaaaaataaggttacggatgcattaattagacattttaaagcgccttaaaaataaaggaaaatttaatgaaccccgcggggtctggaaagaatgtgtcctactcttctcaccgcaaatcaaatcttctcaattttagtcggaaagtccattaaccctgaggggatcaattaatttgaaatacgataattataaataaataatagcaattaaattgaaaagctataaaatcaaagacaaataaaattaattgaaaagagggaaaggggaattgaaaatgcaaatcatgtgcatccagcacacatatttagttatgtaaatttgcgtctcataaaataag

SEQ ID NO: 5366 - DNA, 3314 bp, Heterodera glycines
ccatataagagcccataatatggtttgtgattaggaatataactacctctcaacaattttatattaattttcattaaagtaaatttatgatttaaactaattttaacaaaaatctttttaattgtaacacttttatcaaattgagggaggtccataattcatttttttgcatgaatttattttcattgaaaagtttgtgcagaagaaaccgacgttatcatttttttcttcaaaaatatttttttcttcactttatcaatgttttcgtttttatggggacattaaagttctgcacattttcaatagcacttttgtattaagtacatacttaaattgttgtgaataagatggaaaaaatcatcattaagaaactaaaatttttttatatttaaaaaaaattcaattttatttgttgaatttatttttgaagaaaattgtaccgcacttttcatttcaaattagcacataatggagaagtctcggctgctttatgttgtgctgtttcacaccgttttcgcatcttttggcgaaattgaagctaatttgctcaattacttaactgtgccggtgcgacagttttttgccgactcacttttgcaacggtacggtattgtcccgtacagtagccagtttgagtttgtctactccatggtggccagcattttcttcatcggtgctatttttggcggcgcaattatgggcccatgcatggagcactttggacgcagagcaaccgcagtttacctacggtaatatgaggcatcacccaaagcctataaaatactgtaagccacaaaactctattgaaccaaataaccgaataccaaaaccaataaaaaatatattattaagctttcaataatttaaaaatgaattatagctcatttttgggcgctctttctgccatttgtatgctgttgtccaaatggcttacaattgttgagctgtttgccattggtcattttattgccgggataattgcggcatggaaaattgccatgatcatctacttggctgagtgtgctccggaccattcgcggggtatttatttagtgaaaatttatcaaagaattttttgaaatattaggataattaatgaaaaattatttaactttaccttggcaatttaaattatatttaattttaaattaattttggttttttattttgcagaataaagtatgcaaaatatttttaatattatatattttttcaatttaatttttcaacattatttctatttagtttttttcattttatttttgaagttttttatgcgtttttttgctgttattttaacttttacatattctgcaggttggtcgacaagcctcattggctctggctcaacattggcacttttgttcatggcttcgctgtgtttgccttccgtctttggcactgcccaactgtggtggcttttgccggcatttgcattgcttttgtccacctttcatttgtgcttcgctgcacattttcctgaatcgccaaagcatttgttctgcggtgatcgtcgaaataaaacaggcggaaattgccatgagcgtgccaaattatcaattaaggtaattaaatatgaaattattagtctaaattaattttaatgtttttctacttagttttatcacggatcggcaacagatgtttttaaagtgatgaaccaatttgagcaggaacagcagttgttggccagccgggagcactttagatggagtgatttttggaaaattcccgagctaaggtatttgggaatttaaaaaaacctttggaccagatttagcagaaaatggtaatttttaggaatttttgggattatgaaaaattgtcatttcttaaatccatcactatgtgcatcatcgacaaaaaaactttgacaactttaccaaaaagccccaaattttttgtaaattggatttcgaccccaaagtttcggaaatctcaaataagaaataggaaatgggtatttcgttaagtcccaaatatgtacgcatttgaaactctattaaaaaattcattttttctcttttttgattcagacattcattgttcatcacattgctcacctcttgggtatttgctttttcgctgagtaacctaaagagccaatatttggaatcaatgctaatgcgctatggcttgactcaaacgggtgcaatgatttcaactatggtaaaaaaggaaaaaatcaaacgaatattttttatattttactaaaatttgatttatttttattacaattatactcattaattaaaattaagatactttggcgctaaatcttattaatataattattaaaatataaccccgttaataattaaataaatcaaaattttatttaaaaaaccagtaaaaggatttatccaaaaactcccaaaatatgtgctaaaaactcaaaaagagaaaatctctgccaaaaattgcaataaaaaactcaataaattcgagattttctcaaaaaaaatctcattaattatctatttagtttgctagcacgcaaatcaaattcattccagtgcatttaggtgtaaagcttcagggaactttgaaatccaatgtcaaattaaagattttggtcacttttgccaatgatttaaatggtaaaaagcaatggaaaaaaaaatcatttttttcagaaatttccaaaatatgtgccaaaacaacccaaaaatgtttttgtgagccaaaagtcccaaaaatatgttgttttttatgtgtgctcaaaactagctataattaaaagaaaatttgagcttttcatgtaaaaaatatatattcgcaaaaaaattatataagaacacagaaatcactgattataatttaatttcaggcgatgattgcagtgacagctccatgctgttttctgtcaccggtgttgatcgaacggtggggacgccgcccactatttttgctggtcacatcgttctccgtcgctgagttggcactgatcactggtgctcagtttgccagcgaccaaacggcgtctggtggcagcgctgcgacagcggcactggcactgatcggcttcacattgggccaatccagcgccaaccttggcattttgtatatgacgccaattctggtcggcgaattgattccgcacgctgctcggtcagcaacgattcaggtgcatcttatggctgagtaaagttaaatctcgaccccgagcttcccgctccgcgtcagtgatgccgcgggttgagaaaaatttcggggtcgggtttcgggttgaaagaaacctcgggtttcgggttcgggttggcatcacccctgggagagaaaaaatcagatttttaccaatatattttacggcg

SEQ ID NO: 5367 - DNA, 1356 bp, Heterodera glycines
tgtgatttgttaacagatttatccacaaaaatggctaaaattttattgatgaaacagtcaaaataataaacacaaaaatatttacccaaaaaaaaactccgaccatcagattaaaagtaatagcataatttttagcctaaaatgatcccaaaattcaagtatttgagctaatgaaataagagtccaaatcttttattccaataatctctttttattttcaaataaattttaaaatttgttatttaaaattgccttaatcaggtcaatttgctgtttgcttcgcctctgttcattttcattgtgatcgcttatccgccactgatcggcacttggggtgcccttttctttatgccaatggcactgatcagtgccgtacttttgtttttgctttatcggtggatgcccgagacaaaaggcttatcagtgaacacaattttcctgagaatggccaagttgggactgttaaacagcagcagtgagggaagcactacaagcataaatggtgatgatgaggatgaagaaactgaagcattaattttaaaaaattaaaattaatttgtttaattttgaacaaaaagttgtattaaaactcatttgtattttaattcatatttaataaagaaacaattatgcaaatattaatttggattaaaaatgaaaaagttttcttcccctcttattttggataaaagagtttccaattttttataatagtaaaagcaaaataaaacaaaaaaaaatggtgctagatcgtttcataaatccgccaaggggtaggaaaacaaaaaatgtaagacatataaattataacttggctcaaaattcgaccaaattaaatatatcatgtaattattgaatagcttaagtgatctcaatcagaatattaatttaaaatttttttttacaaaattataaaaaagttatggtcataaaatagcaataagttttgtgtcagaattttttgtccattaaattttaatctttaatagattatacagaggagttgaaattctaatataaatggaaaattggtaatttttagcgattgtgaatgataaattcaaattttcggtcagtgatcaacggcttatttgttagttgaaaaacgaatttgaaacatagttattgaatttttcaagtctgatctgtgattttcattaaaaaaattgaaattcattttttatgcttttttggcatttatgtgaatgataattagggctgggaattatatggaaatccatatttttccccggactgtggagggcctgaaacgcacgaaaaacaatgtttttaacttggtttgaagcttctaggatgaatttctatatccctatttcccatatttttccatatttc

SEQ ID NO: 5368 - DNA, 2121 bp, Heterodera glycines
cttttcaattaattaaatatgggtttattttatgatttatgttttgtttcagtgtcccaaaaatgagcagcccggccaattgagttgcaacagatgtgagccgagttgtgaccatcggaacccgaagtattgcacaatgaaattttgttattgctcatgcgattgtggggagggattgttgcgcgacaaaacgacgaataaatgcgtgccaaaagaaaagtgtccactcaaaaagaatcgaaagtggcaaatgatggagaactgatgggacttcaattttccaagtaaaagttcaacttttaagtttttgatgggctcatttatcgagatcacataatttttcattcattttataatagcattctttgatattcattttgataaaaaaaaaattgggtttttgttttgcatttaaaaatatataacattcaaaattaattacgaatgaaaatttaatgtttaattgatttaaatttgcaaaagaagtaataaataattgatattaatttgtatgggtcttagttaataatctttccttaattattttcttgaaaagcgtgctatcagaatattaatattaaaaatttggttctgttcggttttatgcgtcccatgaatgactatcttctgtttcttaggacataacttttttcttacttggtcaatgcctatattcttggtatcaaacaatagtttaagtctacagcagcttttgattataagctttcataaacatacattaaaaatataaatttagtaaatcccattaaattttaaataaaacccgcatcattgattttctttgccagctaattaaatcactcacattaaattggaaattattattccaaagcaaaagattagcaaatctgcgtgttcaatttccaattattaaaaaatgattttgtccaattttgacattaatatgaaaatgaatcattaaaattggcattttagccaaaaattattagtttattaataatcacattttacaaaaggtcttttttgtccaaatgacaacacaatttcattaataaaatgaaccttttttgtctgtgtgggcggcttccacaaaaatttgtgtgacttttgaacttcaatgaatgaattctttataaattgtaagtgaagcatggaccgtatgacacttatattctaagaattttttttatttaataaaaaaaaaatttaactgacttttttgcatcaaaaatcatatttatattagatttaaattttgtcaacatgcttttatatttatttttatatttatgtctacattattccgtttttggagacgggtaagaaaactaatcaaaaactttgtcctacgaacgcatttttgacaaatgaaaatataaaatttgtttaagtaattttccaaaaatggaaaatatttattaatttttaattaaaaattttggaataatgagaaagttttaaccctccgtgagaaccttatttctaacaagccagaagggcatgaggtatttttttgcattttattaaaggtttttttttagcctatgtttaaaaaaagtttggggttttggtcttttaattctttttttaaaaaaataaaaaaataataataattagaaaaaaaaattaaatttaaaaaaaattaaaaaattccaactgattcaaagaaaaaatctataatatttaaaagaccctgggatagggtgatttgccgaaaaaatgcaaaatgtaaaacataattccagtccgccgccgcacattttcccggcaccatcgaaatgtgaaagtgggactttgtttgcgccatcgttttgttcatcgcatttcttctatttgtgctcaaatggacaaccgatcagaatgaaatgtccggcagaccttgtgtttgaccaactgatttctgtgtgcaactacaaaaatgcatgcggcaaaaggcaacaaccgtatgcttcttgtggaagaattacgatattttgaaaaattattaaacaaatttcagttctgattcacctataccattaccggctccgcatccaccgccgcctccaccaccaccgccacagtctcagccactaccacctccgcctccaccgcccccgccacagtatcagccaccgcctcagccaccaccgcctccgc

SEQ ID NO: 5369 - DNA, 1917 bp, Heterodera glycines
cttcttctgcacatacagcatgatcgtttctaccgtttcctggtcagattgaaaacgggcctctcccttcccatgcttttccatgaatttcgcgtgcgcacgaccgtattccgtggcccagcgacaccatgcggcccatgcaccgtatttaacttttgctttctcagattgtggggcgggcacagctttgacaatgccagtgaacggtggcggcaatttgtactgggtggtgcccatcagcttgtgcaggtacaccttggcaaggacgggggcacttttttatgaactctttttaggtagcaaaacacgaaattttaaagtttttcaaccaaaaatttttcaaaaatatattaaattttgggaaaatttttcaattaggggtgtattttcaatttgttttttttgttaaggattttttcgaaagccctgaatccatgcttatcagtgcgtatcaagtgcgcagaaatttttggcatttgcctaaaaatggagtccctatttattattgatttacatgttttcttgagccataatacctgccaaaaaaattacaaaacttttttcactctcagttcctgtcccagcagggtccttagtcgactgcctatttttttttgtttgctgaaacacaaaaaccgtttgcatttggatactgtacctctttacggatattgggcagcacttctttgttgagataatattcaacttttttccaatcatagtttttaatgatctgttttcccgctttttgccaccgttttttcggcgtttggttactgtgtccactactgtcagtgtggctttcataattttctgtgtcagtaaatgaagctgttgaggagctgtcttcgctgtccagcaatgggaaattttgctcatcatcagatgctttaaatggaaaattttttttaaaatattacaaaaaaaagagaaaacatttggaaattttcatattttttatttgtaataccgagacttgacccttagactcaagacaaagactcccaaaagatccgtgatttttctcgggccgagacttgacctttgatactcgagaccaaaacagcaacgagaccatgactaggcaccatcgagagcaaaactcgactcgagaccgagactaggccccgagatttgatttcctaaagtcgagaccaagacccaaaagacccgtaatttttcttgagccgagacccgacttttgaccgagacttgacccatagagtctagaccaatactccaaagaaccagtaaatttttttcaagccgtgactctcgagtctgagggaattaagcatcactaatatttaccataatctccggcggcgtgggcattgtggggaaaagagacagtgtggagtaaaatgcacaaggcaattgggagaaaaatgggcgtcatgcctggaaagaaaaattattcattaaaaatatggtggtcacaataaaattctataataaataaaaatgaaaatacatatttttttattggcttttaaacagaaatttttggggggggggggcgtgcaaatttcgaggatgatcagaattggcaaggacgaactaccaaaagcaaacgataatggaccagaacagaaaatgtctttactaatcgatggcaatgtatcgattggtggcaattttgtggattttccgttgtctgctcgtcaaaatcaaggacaattaaatcaattagtcgtcgtttaatgaaaatatggctgatcagtgatcacctctcggaaattgttgagccattcgagatttcgtggacccacataagcacggaaacgcaatcgcttttggttgtccatctttgctcggcgtgtgcaaccatttggacagaatttgatcatcaatcgtgccagagcacataagagcgaaatcgatcgaatgcaattgatcaagatcgttgagaattgt

SEQ ID NO: 5370 - DNA, 920 bp, Heterodera glycines
aagcttgaataatttttttttttttatccatttttaacaaataattaaatttttcttgaccaacattttttgttttttttataaattggtccaccatcgcgtttttctactgttgctgatgtccttgttcctgttgatgaccaccaacaacagctccgattaatgatacgactccacggcgcctctgggcacaaattgcccaaaccgagcacatcatcagaagtgcctgttttggcaaatcccattttaaatgaatctcagtttttatttttctagtacatgatgggacaatctttgaaaatcttttagatatttaattttcaaccatttgaacatttttaggatttcaaagataaagcgagtttgctgagatcattcatcataagcgatgccggtggaatttttttgaaaatcgttattcattttattacagattttcaacccgtaaattttgtaaaataaaaatagtaataagctaccttttttagaattttttgcataaagctgttgcatttttagcctgtggcacattgttcctcattaatgtgagttgaaatatgtaagaattggcatgaaactgttgcgcgccgctgaagctgaccaatatacatgggaagagcctaaaattggcataaacgtggaaattttggcatgaccgtgggcatggacaaattggcattatggggaattcattccattattttatatagaacatgaaaaaaggctgtatcaaaaaatttcaaattttttcatatcattgaaaatagatttttcaaatttacggaatttatttttcagattttgcccaacggcgcccggaaaatgcgtcagtggaaaatacggcagtggaaaatgcgtcagtagaaaatgcgtcactctggaggtatgtcataaaaacaagttccttgcgttttcggggg

SEQ ID NO: 5371 - DNA, 4943 bp, Heterodera glycines
gtaccaagaatgtaaaatttgattgcctttaagcaaagttatgccatgttttgtcgaaaaatcgcaaaaaaatagcggattttacgaaatgccctaacacttttttaacgctttctatttcttaatttgaattaaatttttatgtttttttttgtttaaattaaataattttttaaattaattgtgcttccaatttttaattttttaaccattttcattataaaaattgttttaaaaaaatgtgatgaattagtgattagtaatttgtgtcatttgattattgcatttgttggaggcaaaaatgaacaaggttttttttgttgtaattttcggtcattaaacctttggaaattgaatgaatgaatgaataataatggttgatcagagtcattttagcatttcattattactaaaatgttttagtaaacttggaacgattttgaatgtcgaaaaaaccgatcgaaccccgtccatctcaactatatgtttgttggcattttctttgttaaatttcttttttttagtttcaatccaatgttgtctgttgtgatcctttacatatttcttcaattattaacattttccgtcataaatgcctataattatgaccaaagaggatacggttatcaagcggcttatgctcaaaattgtctgaataaacgaggtctgaaaaatttcgtttttccaatgcttaattcgaattgtttctctgggttaatgacatgagtaccgtagtattgttatggtatttattgcgtctttatttaataaatacaagtttttatttttattattttattttttcttcagtgatccaggcccgcgtattcatgtttagggcaaatgataatccgagcataaaaccattggaaccggtaaaaataaaataattttttaatatttttaataacaaatttttatttacaaatttaaataaataataattcagtttcattttacaattaacttaataaattaaatttaaaatctcacttgttactcaaaaattaatataaaattaatatatttaaaattatttcaaaaatctcatttacatttgcaaaaatagttaaaataggttaaaatccaatttaattttcatgagttaaggaaattttccgatttttaatttttaattttgattagattggagtgattgacattgcagagaatttctatggcgtcactattgtaagttttacaataaaatttacgataaaatatgtaattttgttgaaaaatttagttaaaaggtaccatcagacttgaaccgggcaaccatggcttacattttcatcaatttggcgacatttcaaaagcgtatggttattaatattttgggaaatatattatattttaatatggattctggtggtttaaaaaaaaaataaattttataattttctaaaaaatctcatcaatttttggaccaggaaattgaagtgaataaatgaatttttaattttttttagataattacagaaattttggtgccgaaaaaaaataaattttaaaggaaatattttgcggaaatttccggtttttatttttttttgttaattcgccgattacttttggttatatttttttagttgcatggcggcaggtgcccattttaatccgtacaatgtaagccatggagcaccagacgcacgcgtacggcacgtgggcgacttgggcaatttggctgtcaatgtgaattaattatggaattaattaagtatagtaattgaccaattgtatgccaattatactaataatcagtgatttgtagtagtacacttatacaattggcctaaatacgaatttaatttggatgaataattgactactaaaatcagacaagctttattgaaataagaatttgacaagacatgatgataaatcaatatcattaattagacattgttttgttaattgctcatgcctttatggcatgtgatcaatcaatcaatgcgtgttaaaattaaagcgccaattgtcccaaaatgaatttttgctcccattgatttcgttttctgatcatccaaactactaaagctctattagctaatataaatacctaatcacatatcctgtgctcgtattggcagtacaattttaaaaatgctttcatttggtcacgatttcgggaatttaaattttgaaaaacaggcatttttaggctgaaggcgttgccgtggtgaatattcaagaccgattgttgaagctgaacggattgcacagtgtggtcggacgagcattggttgtgcatgagaagcgggacgacctgggcttgggcggcaacgcggaaagcctaaaaacgggcaactcgggcaaacgggtgggctgcggcgtggttggcatcaccaaggagctgtaatcaaagtgccatgatcagcccagcatcggctgatcagtcgaaaaaaaagaaaaaacatttgaattaagtgaccggtgatcgggttttattttgtatccaaattgatcagtcaaggaataacaacaaattagtgattgaaaatgtcggaaaaagggcaattgtctagaattgtggtcccaacaaaaaataaatttaacatttttaatttatttttccctgggatggaaaaatatgccgagggtgtttaagaaatgacaacaaacaagagtcaatcaaaatgctatgaatgttgtgttgtgcaataaaaaatgccgtgcgaggccgcaaagcggccgagccatagtcgattttatggttcccggtgatttcgtcagtgagtgatttcgtcagtaagtgatttcgtcagtgagtgatttcgtcagtgaaaattaattattaaaaaagagtacacctagctaaaaaaattcaaaaattcgagccataagaacaggcccgtaaatatttaaacgattcacgatttgcaaagacctctataaaatttctcacatttttggaatggctaatccatttttatttgagtttttcacgatgtcaccattttcgcattttctggactacccaattatcaattactcttaacacacttcaaaaggtaattgtcgttaccttacttaatcataatagttctctctttttgttatttcccattggccattatcaattcaatcacatttatccttttcacacgttttttccttttctcattgtaatgtttctccgcccattctcttcgcatttctttttccccagtgatcagtcagtcagttagttgtggaacagacttcaattatttattccttttctcgcttcgtgtaaatccaacaacgagtgaataaatatatcgacagtcaatgagtcgttgggattttggggcttagtcactggccatggctttccccattccctcccatgttccatccgggatagacggtgcggttggtctggggggcacagtgcgcatccctcacttatcgaatgaattttaattttatgaaaaattaaatgtttttttcataaaaaatgattattatcactgacgaaatcccttactgacgaaatcactgctgacgaaatcactcactgacgaaatcacttctgacgaaatcacatgttaccgattttatcattcataattctacattacaaccgtactgcctagcggttgcgatgcgccgaaggcgcattcaaccgctagttttttaacaagcaacaaaaaaatgattgttttttgacgcgatcacattttttggcgacatatttaaaaaaatttcaaaaatctctaaaaaatcagtcgaaaatgcgtttcccccgtctccatttatccccccgtatctaataatcccccccccctttctgaggagttgaacaataatccccccggggtgacaattagagataatacggtacgggaccgggccgggaattcccggtcatccgaggtcccggctcccggtcccgggttttgaaaagctcatcgtcccggtcccggtaggtgaaccggtacggggaaaaacaagcactggataagaatggggtctgagtgaaaaattagtgaagaaaattggagtcaaagggaaaaataaaaaataataattaatatattctttaaaagtaacactgcccaagtgtgcaaatggcctaatggctagtctccttgactttccttcttttttcccctggttcaatccctctacagaaattagattattttcaatttttttttttttgtatactcgtgggtttcctataaagaaaatatgattcctcatagttttttttaaattgatacatattttatcattttttaaatgaaaatcctaccaattgagcttaataatcgcaaaaaccaacctttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaatttgaagaaaatttgtttgaaaattttcattaatttaatttattaaataaaaaaccaaataattttgtattattttcacttgatataaattaaaatttgaatttttttttaaatttttaaaaatttttaaaatttcccggttggtcccggtttttcttgcggtcccgtcccggtcccgaaaaaaaatcgaggtcccggtcccggcttctcaggtcccggcaagtcccggtcccggttttggcaaaaattcccggtcccgtggcactctagcttataccccttgaaaacagcaaaatgctgataaatcagcagagttgagagccctttgaccataatgaattaagtcgcaaaaaaataaatttcagaaataagcacatttggaagttaaaattaaagatgagaagctaaactaatcttttatttcagagaagagattcctttcaaatctcacaatcaaggcaattaagattt

SEQ ID NO: 5372 - DNA, 3774 bp, Heterodera glycines
  misc_feature (3659)..(3659): n is a, c, g, or t
  misc_feature (3679)..(3679): n is a, c, g, or t
atactgttcggcaaaacattttcaaaccccctttaattaaagttaatcaggcccaaaaattattttttccaaatttatgttgaatattacagtatgcgacattccggattttggtcatattcggaagtctttaagtttaataaaatattgaaaataaaaaataatagtcttaagtagtaattaaattaatttttttttttattaggtgttgggtttgacagtatggaaagtgatctggacaaaaacaatgtgtgccaattccaaacaacatttccattacatgattatctcaacaaaattaatcgggatttggaagttgagcaaaaatgtaagatttgtgaaaattaaaaaaaatatttatgacgaaatttatataagtgtatttatatttctataaaaaatggttatttattctgtttttgtttgacctaacgtaaatccatttttaattgattatttaaatacctcctaactcaattatttatatacacaattttcggcaattaaattcgattaatttccaaatttattgaaaactgaaatgaaaatcttaataataaaattataattatctttatctttgcacaaagcaaacagtttttaataaactctttcttttaaaaacaattttattaaattaaataaatatcaaaaaaaataattaaataaattcatatgtaataataataataataattatttttttttagttaaatcagagcgccagcttaaacgttttattaactttgccaaaacaaggagttctccaccaataaattctgatgtgcatccaatttccaaaatttcaatttcgatgaaaaattttccaattggcccgtatgaattattcgattttcagaacaagtcggaaagtgtaatgattgaaggtaaaacatataatgtttcgtgtcccgacatttgcgcctttgtccaaaatcgggttcaaaataaagttttttttcaatccctgatcgcgtaagcagctttaaataagctattgaaagtgattgtatccgatcatttgatcttcaaaaattaaaaaaaaataataaaatttttcaaacaacaaattattgaacataatgaaccaaaagaccgtgttttcttaattttattgctaattaggcgctatcagagtttgaaaaaattcaaactttgagtccgattttggacataggcgcaaatgtcggggctcctaatgtttagatgaaaaaatgtttttattctcatttgcaaaaatggaaaaaaaattctccgagatttttgaaaaagagccttggataaaaaagaatatatgctgtttctccattattatctgcatgaaaacgccgcccataaataatttcaacatttttatttaaatcgaattcaaaaaattaatataaaaaataaataaaataaatatattttcagctgtgaaacaagacgcaaatgaaactgatcaatcatccggcattgcaaatatgattgagataattgatcctttgaaatgcagcgagctttgtggggttgccgatgaactttttattgaaaaagatgaacatcaaagctttcgtgtaagtaacaaatgtcacattggcgcgggtacttttggcgacttaaaatttaaagtgtcattaccaattgattagggtaattaaatttcatttaattatttgttcgatttgatggaataagtgttttctttcgcctggaaaatttaaaaagtttaattaagaaatttaaaaaacttcattttagcgggggagtacgaaaaagaattaaatgaaagtaaaattaattcgaaatttaatattaaaattagctatatataattaaaactcattttgcacgataaaaaataatgataaaatgctttaaaatttaaaaataaaaaaacattaaaatttattaatttttaaaaatttaaataaaaaatataaaaaattggaattaatttgtccaactatattaatttatttttaatttattaaacaattatatttgcgattattctattaataacttcttggaattaattgtttaagcaaagtttttcatgtttttaaaataacggatttctgacaaaatatatcaaagtctttctttagcaaactaattggtggacaaaacaacaaattgtctttttactagagaccggcataattaatcgtttaattagtctttttcgattgtttgttgttgtttttttgatttgaatatcaaaaaatcgatccaacaacacttcccctatcaattttttacaatacttttgaaccaaaaaaaaaactatagttactcaatttttaaattctcgtttttttatttgtaatttttttttaaaacagacagttggcggcgaagtcatcaccgacaactattatccatgggttgtttttgtccgagtccacgtgcattgtgcatattcggccccaatctacattcactgtaccggagtgcttatatcgtttaagcatgtcatgacggctgctcattgcatgcatttaaatacaaccatgttaaatgagtgcattggctggatgaaattttttccagctgggtgtgttaattaatgttgatttgtttttacaaggtgtgctcggggtgctgagacattatatagtagggtgggggaccccggaaacggtgcgggaattccgggttttcccaggtcccggagtttttaaacagccaggtgcccatgtagggccggaaaaataagcattgataagtagggttgtaaatttatatggactaaaaaacgcgaaatatggactaaaaaagtacgaaatatggaataaaaaaccaaatatggaccaaaaaatggactaaaaactgccaaaatatatgttttaaacactcaaacattcctaaaaaggtttttatatatatatatttgcttaaataaacttaagaaatacaataaacaaccaaaaaaaatggatttaaaacttaaaaatgcgaactttttattgtcgtccgttgtataaaaatacctccaagttcattttaaaaaaagaaaagttcgcaaaaaaatagtgcaaatatttattaaaatgccaaaatgacaacgaaaaaacaaattttttaaaatttttatttgcagtcgatctttaggggtgtatttttcgctgttttgcatttttcttgtgaaaaattgccaaaaatggccaaaatatggaccaaaaatgctatttttgagcccctttcttcatagcatatgcgcagaaaaaatatgttaatccatataatttacaaccctattgataagaatggtaatttgagttgaaaatttttttgatggaaataaatggaatgcaaaattttttgaaaaatgcctaacataaagatgcataattggccttagaatgtcgttttaggtaaaaaaaaaagggtgttttttctttgtcgttacggtaacggtatgataaaaaagttcacctcaattttttaaattgattgaaactttttagtttaataaattttgcatatttaaagccaaaaaatcgacttttctataaggaagactcttttttttgtatattattcaaaaaaatgaattaaaatttcgcaattttttgccactatttaaggcccctaagttgtaatgtttctcgcttaaaaacccgaatactaattattatatttgaaaaagaagtaattttgtttaaccctattantaaattttttgattcgtaanaattgtctgttgaaaacccaggtcttaatataaattctaaccaaaattcgaatcaaattttattaaaaaataaataagttaaaaatttttaaaaa

SEQ ID NO: 5373 - DNA, 1806 bp, Heterodera glycines
  misc_feature (1689)..(1689): n is a, c, g, or t
aaaaaaaaactatagttactcaatttttaaattctcgtttttttatttgtaatttttttttaaaacagacagttggcggcgaagtcatcaccgacaactattatccatgggttgtttttgtccgagtccacgtgcattgtgcatattcggccccaatctacattcactgtaccggagtgcttatatcgtttaagcatgtcatgacggctgctcattgcatgcatttaaatacaaccatgttaaatgagtgcattggctggatgaaatttgttccagctgggtgtgttaattaatgttgatttgtttttacaaggtgtgcccggggtgctgagacattatatagtagggtgggggaccccggaaacggtccgggaattccggattttcccaggtcccggagtttttaaacagccaggtgcccatgtagggccggaaaaataagcattgataaaagatgtgaatttgagttgaaaatttttgaaggaacttagtggaatgaaatttttttaaaaaaatacacattttgcctaacataaagatgcataataattagctttatactgccgtttatgtaaaaaaaaatttggatatgttttttcgtagttgatacggtaacagtatgataaaaaagctcacctcaattttttaaattgattgaaatttttaagtttaataaattgtgcatatttgatgccaaaaaatctacttttctataagaaagattcttttttttgtatattttcaaaaaaatgaattaaatttcgcgtttttttcgccactatttaaggcccctaagttgtaatgtttctcgcttaaaaacccgaatactaattattatatttgaaaaagaagtaattttatttaaccctattataaaatttttgattcgtaaaattgtctgttgaaaaccaggtcttaatataattctaacaaaattcgaatcaaattttattagaaattaataagttaaaaatttttaaaaattagatggaagaaaaccgagttgcacgacgtttacattcattttagttcatctactatgagtgaaacaaaaattgaaaaagttcggagaatttcaattgtcaaagattttgacatgtcacatgacaatttattacggcccgacgatcttgccattctcgaggtaaattttttctttataagattgaaaaataaaattttttgaaggcttttctcattttatacagcgacacactaatagtaatgtggggtagaagaggtaacttgccggtgggacttgaacccacggtccatttatagcgtggaatgccataactgactgacaaatgagctacggctgttacaaaaaaaaatttaacctgcttttgttcgagtttttaatgttaatcgcagtaaattagaggatttggcgaatttttatttatttaaagaatttaaaaaattagaaaaagaacactgagtttttctaaagatagaacgaattttttttttcttaaatttttgcttttgtgtacaaaattcacggttacagaacatgttggttctgtttttgtagctcaattcattattatcccaacgaccaaacattttataggttagcataggagctattttcatggaatttctgaatttttaaattggttaaattttttaaaaagaatccgcctattcttatggacaatttataaaagcattaattttttttanattttctttcattcagctaagccgaacattagaccgaaaagcggacaatgttgttccgatttgcttgtataaaaatttgttgtataatgagcatatgggcgagatggcaatcgtcgc

SEQ ID NO: 5374 - DNA, 2673 bp, Heterodera glycines
aaaaaattttatttgatagcaaattcactttttacaattacaaattttgcatttaccaaatatttttaaaagattatgaaaaatataccatttttaatacatgtttatttacaaatttaataattttttttttaatttagcgtcaaactacttaaacaaaagccagacagcaactttagtgccaatacggtccgcaatttattgcaacaaaatttacaacaacattttgccttggaaatacaatccaagcaaatttgtatgcgcaagtagcagaaataagggcattacaagcgtaagtaaatttatttgtttgaacaacagttagtcatataatcctctggacatttaatgtcgaaaagtgtccgagttttttaggtttccaaatgtataggtgtgattttttaaattttattttataacattcattttctcattgttttcttgaaactaaggttgccaaaatataagtgatttttcttcattttgtgatttttctcgcgtttacatttggcattgtttgactactaatgccttttttgcttttaaaatttctgtcaattttgattcaaaaaaatgtgtgaattttaataatattatgcgtaataattatttagggcgattgtggcggccctttgatgattgaacgaaacggattgtattatttaattggcattgtaattgcagcgtatcacccaaaagcaggattctacaggaaatacgttcctggtgatatttgtttatttttttatttttgaacaattaaatgaaaattcttggtaggcaaggtaagaataaaaatttatgactaactgaaaatttttttcttacaatttaaaagattttaatttaatcgaaatgtacctaatggtcaggtttatgataccattccagcacgaatcagcaaaacaattaatgattgcatatactagtttttctatttaataaaattttggcttggaaattttggctatgtttttgcagataaattcttggcgcatggtcatatttataaaattgaaaatgacaaaaaattactgataaacttgctgaaaaatagcaaatttatattcttgatatcattcgataactctaagagagttcatgattagcttgtaaaatttcaaaaatttcgttaactttcaaaggggttatggccaaaggaaatcacaaaacaggtttttcgcatatttttagtcataactttttgatcgtttgaattttttaattttttcaaaatttttattttcatttttctaagtttttttaattcatttcaattttttgaataatttttttaagttaatttcttttttccaaatgtatttcataatttttttaaaattatttttaatacattcatttattttatcaatgttttcctcaaaacccgtttcattaattttttcgatttaaagatgtttatactcgtgtgaactcctttgatagttgcggttttgtggaactggtcacaaacaatgaagctacatgttttcaagaatttttaaagtctgaccgacttgaaacagtttgtgcaacacaacacgcgcagattttggaaaagaccttaagaaaaagttgcgaatatgtttccgtggatcaaatgtgttacattggcatgatgctattttcccacccttaaaacatttaagcactcccagcaatttccccccccccaaaagcaattaaggaatcaaaactaattcaatcaaaaattgtattattagtaataattcacaatccatttaaaacattttgaatttattaattttgattgataaatttgtttttgcattcgtttggagttaatttaatttttattttttaactagcataaaatagggcccgctgggccctgtgaaagtgccgtggccgccgctttcaacactggcgccagcaaggaatacgaagcagcacccaaatttattttcaaacaatttcacacaacttttcatcattcctacacaacttaatttaacaaccttgcatacaacattccgtacaattttcaaaaaagtttaaatttttgaaaaattatgaaagaaattttaaaatagatatttcgattaataatattttgaaaaaaattataaaattttctatgtagaggcaaaaattttcggttttcagtgcttaagtttttttgctaaaaaaatgtgaaatttttaaaagaatttttctttattttttacagtcacagttgccttatgtacactcatttcctcctcactagaaaatttttaagaatttaatttaactaaattatagattttcaaaagaaagatgtttttttctaagaaattttctgtataatgctataaattaaaaaatgttggaaaaccttttgataattaagcattaaaaccactttttaatggttaataattacacatcaatttaaacaatcacttattaatatggtaatgaaacaaactttcgacattttaattacaatttatttttgacctgttgcagagctttaaaatgatgatgtaaagataaaaattttaaatgtatgctttttggacattgtcttctaaacaaattctccaaatatctcatcaaatgacttttgtttcaactttttcttttcagttgaatcaacgactaattttaacgattaaaaaaataattattatgaataataaaataaataatttcatcttctttcaaaat

SEQ ID NO: 5375 - DNA, 1498 bp, Heterodera glycines
gaacaaattatcaaagattcttttcatacgaaacaaaaaaaaatttacattaatttacactaacaaaaaatcaactttttgtgattttcaataagttttacattcaaaccaaaataaattttaaaattaaagattttatagagattaaagcattttaattttctttgtaatgaaaccaatgacaaagtttttaattggttttatttatttaaaaaataattacgaggtcaaatagaatgatacgataaaagatttgaatgcatcagttttccaaatgtcgttttttaaaatttttcgtttttcaaccctcatgcttttcgtccccaaaattgtttctttttccatttgtagcatttatgtatttgttttggagatcaaattgtttaatccatttataaatataattatcatttgtgcccaattttttcgctattttctcttccaattttactcctttcttttgttgaatattttgttcctttttgctttattttttcttttataatattttccagttatttctcttttttcttctcctttttcttcccatttttccccaaatatttcgccaaatgacttttgctgaacttttttattttctgctccaatttgactaattttggcgattaaaaatataaatattatgaataataaaataaataatttcattttctttcaaaatgattttgtataaaattactatttgtctttttcatcaggaatgattttaaaattatttaatgtgaaaaatgaaggcaataatttaatatgagaatttattcgttttggctggataacataaatcagaacaaatgaaatatcagtacaattatccacgaataaatatttttacattaatttacaataacaaaaattatgttttcgagatttccaataaggacattttcatgcattttaaatcagataacttttaaaaattaatggcctttttatagaggttaaaaacaaagtttttaatggattttattttacttaaaaaaaaaaaataataataatacaagatcaaatcgaatgatttgataaaattttattatttttttgatcagtagagtagaaaaattaaattatcatttatttaattttcatttattttgaataaatttgatcagtaggaagaatatctttttttaataaattttttccagggatcagtagagagttgtgatttttcatttgaataaaaggctcttaatgggctaaaatgaataatttgaatttttaatcaagaaaaaaaaattatataaattcatatttgagaatataatcacgaaaaaatgaaattattattgttattattctgtttaatttcaattataattgccctaattagtacaattaaaacagaagagaaaaaactacaacaaaaatcatttggcgaaatatttggagaaaaatgggaagaaaataaacaaaaaagagaaataattggaaaatattataaaatggaagaaaaaataaagcaaaaaggaacaaaata

SEQ ID NO: 5376 - DNA, 6756 bp, Heterodera glycines
gccgatttaaatttccaaaaaaaatctctctttcatcaaaaatcattcaaatctctcgatccattcgggaatcgggttttctcggataataaaaattcacacgatttcttctaaataaataaggggatttcggatacttctctctaacgacgagcaatcataatttttcgaataatcgcgtcattatttaataaaatatacaaattataaaataaataatgtattttggaaatttctacataaagataaaacttattattcgtagccaaaacatccgccaaaatcggcccgtttttaagcaagttgaattggatatttttgattttgaaaatttaaacaaataataaaacaacgttttattctttctctttaatttcttttataattatttcgccatcattttttaattccattttcaaaagcaatttcatcagtgagttaattgctaagggtaattaatttttctaattatttttaattagggagacgacaaaatgctaattgcatttatgaaaggtcaccaagaaacgcaaagtaatgaatattcaaagcataaatatgaggcacaccttggcattttgtattatgaaaaagaattggcaatgtgacaaaagtttcttttttaacgccaccaaaagttttgttaaaagtcaagtgggtagtgtgttctgctttcttctttcttttgctggttcgattccgcttggctccacttcaaattttaattagtaataattgcccaattacgacggccaatgatgacaaattaattgctgaagacaaataatttgttgacacaattaaacattctcatagatacttctgaggcagtgcgtagtaattttttttcaaacaattttcgagaaaaacaaaaattttataaaaattctaatgaaaatcgtaaaataaatttggataaataaaataaggcaaaataaagaggaatattttcaaataaattttgcagaaaacctgataaattttaaagaaaaaacagtgaaattttttcaaaaaaagagaatttaaaaaattgcacaaaacaagtatttcaaaaagtcgaattttattccaccaccaccgccagcatttgtataaataaaaaaagcaccaaaaaaagagtccacaaaaataaatataataatgacaaattttgaaaaatcaagcgaataaaatgtggcgccaaatgccattcgtcttgcgcgacttttattggcactaattgctgcacacttttggcactcagtggcgccgctgcgcgctgttgtgggtttgcagtttatatcttctgctggtgggcatggctgtgatggcattggcattttggtggctggtggagcagctaaaaattaaatttttttttaattttctgagtaagagcaggttggtaccgtcaaaattggaattaggcttggggttggtgtaccgtgacaaaaaaaaacaagtaccgtattacttcaacctatatgtcgtcctgattaccctatttagtgttcctaaaataaagcaccgtaagtccctaatttttttttaaaatatttattaatattaattcccatacttgagggagattaaaaataaaggccttaaattactaaattcaccggcgaatttttaaggtatcatgtatgcgttttttgaaatgccatgtatattttttggaaaatacggtaatatattttgaaaattctcacgttttccggttttggccgcttcaatggccgagcggaggacaattgagcgcttcttacgtccgccaccgccgccgcaaccgcagcagcaacagcctaaaacttttttggttaaaaaattaaaaactttttggattttacatggcctgcaacagcaacagccacagcatttgcaacagcaggggcaagtcctgaaaattcgggaaaaattaggaaacaatttctaaaacatcgattgcctagaccttggcaatttgatcagcagtggtgggttacaacattggcacggcccgacacaggtacagccacaacagcaaggcttactgtaataattaaaaaatataaaaaaatttcagagaatttaaaaaatttcctcttaccaacagcagcaacaactggcatcagcaaaatgttggttctggtcaatgtttgcaaacagaatgaccaacagaattgggaatgtgaagagcaattgcattttattttttaaattttgtttttttaattttctaaatttaaaattatttaaaatatatttttatttattattatttttgaggggggggggtaaataaatatatttaaatttatttaatattccaaatttttgtgggtttgtggttctgttctatcgtcacatttcgtcccaatttataccgatcgggacacactcccaattttttgtccagtgacgtccacctaattatggccaattaatttgttattgttcgtccatggaaagtgtgtggttcgctggtagagtaactgatggaggacggacagtgagtggacacaatgaaaaattcgtcggccaatcagacggatgaagaacaaatttttaattgtgtccgatcagagtcgcaggaattgtctcatttttccgatcagaaaaacgagtccccgcgcgggcggagtgggaacaacgaaagtgtggcgttgtgatgacgcaaaaaaaaatgcaaaaataaatatacaaaataacaaaatgtgtgcgtcgaagggaaaataacggaaaatcggcgctactaaaaatggaatttgtgatgtcatcatgggcgatagaagatttgatcgcaacatattgtaatgctaaagatagtatttttcaaaatgagagatatacggtagtgtgataatttgattgtttaggcttaaacggtagttactgaaatttagtgttcccgatacagcatatttaaattttccgtagaatctgtttttttaaatacagtaccactaatcatttttgtaaattttgtggatattaaattttttttttaaactacgaccatttttgggtccgatttttttgtcagttcagtttttcgattttctagcattttttagcaattaaattatattaatttgcatttttattttatttatgtattttattctattgaccatatcatgtttttctaattgtattcattcctgtgttttccgctataagtgcaatatgttgccttgcagtttgctcaaataaaaaaaaataaataaatagatttaatttacatttaaaataataaaatcaattaaaaagcatttaaatttttatttaagataaaataaattaacgcatacaataaaataaaaagaaattaaaaatctgtccaattaatgatcaaagtgcggcaaatggctcttcacctcccaacggcaatttgctggccctctgttgcataatttcacgaaatctcatatttccttccgcttctctgtccgcaatgggtgaggtcctgaattttttttaaggcctcaaaaaatttttttaaggccttcaacacaaagtataggaaatttgtgattttattagtattttagggtcggggtcatttttgcgcagacaagtttaaagattcataacttttttttaattcgaccaaataaaataatgttgatattaatcaataggtctaaatgttctttattagcctgcaaatttcaaaaaattatattaggttttaaaaaagatatagcgcgctgcaccaaaatggccagaaaaatgcaattttttgaggttttttggccataacttttttgtttctcagctaaattttttgaaactttgcaggttaataggcactatcaagccacttaaaatcataccaagattatttagtttggtggtaaataaaaatgacatgattcgttctgcgccaaaatggccagaaaaatgcaattttttgaggttttttggccataacttttttgtgtctcagctaaattattttaaacttttcaggttaataggcactatcaagccatttaaaatcataccaagactatttaatttggttggtaaataaaaatgatatgattcgttctgcgccaaaatggccggcgcctaagtgggcggttcccagtattttaagagaaaaaactgaaaatacgatgataaaacagtgcttcgaaaattttaattaaatttttatgaaataaaattttttttttattttgaaaaaggtatggaattttttggaaaaaaaattggttaaaaatcattaaaatagggaatattttacgaattacgatgataaaacaatattatgaaaaaaaaattaattcaattttatgaatatttaatttaaatttttttttagaaaaatggaattttttgaaaaaaaattgttgacagaatttgagaaaaaataaattttcaaaaataaaatttaaatagtcttttttcttactttttatccacacccgcagatgcatctggtgggttcatgtgcagtgaatgtgaaaatttcaagtcatgaaattgtcgctcttcggcattgaaattttttgcttggctcctcagcccagtgattgacgttttggcatcggccataaccttcatcatttaatgatttattaaaaaataaagcaaatttaagttattttttttaacaaagacgaatgcgtaaaaaaagcaaaaatttgtaatattagtatgtataaaaatttgttaaaaaaatgaaaattcgaaattcaaaataaaaatctaaaattatggcttaagaaaaagcataaagttttctcttctgaatgaaatatgaaaattggattatttgtttgattgatttttaaaaaaatcccaaacaaatcaatccccgtctatgacagatattattatgtcaattttagaaaaaaaaacgaaacttttattggataaatgaaatttttgtttacgaacagcttaaggaaaatttcttgaaaatttatttaaaataaataattatggacaaaagctaccattgcggtcgagttatattggcctgaaattaaaaattttttaaataatttttatgaaccaaaaatcgttttacccaaattgaatggttcaatatcgccgtgcaagcattggtgcaaaaattcctcaatgaatccggccattgccaatgtgttgtgcggttttctgggaccatggcctagaatttttttttggaaaatttattcctacaataattttcatgattcttgaaacgaatataaagcgttattttatgttttgaaattattatttaagcaaaaggtccaaaaaaaaatttttgaaaaaatattaaatgaaaaaaccaaaaaattccaagaaatttaaataaaaattgaaaaactaatcgtcaaattttttccaaaatatcaaagtttaaaaaatattcatatttttctttctttttcaccacaccttcgtcgggaaacagaatgtatgtcactgggatgtggttccgctttagtgcagcaacaaattggtcttaaaattataatttaaaatttttttgaaatttcttgaaacattttacacctgactcggcctgcttaacccgtgggtcgtttgccccgtggacgatcagcagtggattcttgacccgatttgcaaagtacagtggtgatcggcttttcaaaaaacgacggcctaattttaaagtaatttttaatgttatgaataatttgagttttattaaatttttagaggattttttagtgggttttaaatttttttaaattgttactcccaccccccaaaaaatttccttgaaatcagcaaaattaatgcataattttaggattagctaaacctaaagtcaattagtagcttttaaatttggtgtgatttgacaatttttataaaaattatgagggaataaaattttaaaaatgatataaatttaaatgaattttatataaaagaataaatttttagttaaagataaaaatataaaactatgcaccttcttccgtgtttttatcagctccaagcattgtgatcatgtcgttgtagaagccgagccaatacggaggaattgtgtccaataaagtgatcagatttgaaggtccaacaatgtccacccctaatcaattaattaatcatttattttaattgcattggtttctattattgtttaaattagaagaattaattaaataattcattctatttgagttattcattcgcgaattaattttaattgacaattatttattttaattggtttatttttcttctttgatttattaccgcacgcaaaaatgtcgggtgtgaaggtcattccgaccaatgtagcataacctccatagctgccacctaattttaaaaaataataaatataaaaaatataaattattttattgataaaaatggacccaattatttattaaattatgaaaaaaatatgaaattatttgtgaagcgagtgtaagtttgcgaatttaaaaaaacaaaatcaaagtttttctatgccgttaatttcggcacttttgtctgagccaagtttagatcatcatagcctttttctttgctgaacaaagccaacaaagttggtattattcgaaagctcttaacaagctcctgagtgaggcttttcaaaatgcacaaagaaatacggacatataaaaaagtaaaaataaaaatatacaaaaattctgagttcccccggattagaatctaattaatttaatattaattattaaattgattgcctcacccattatggccacttggcgtcggtccgcaatgttgttgctcaccaagaagtcaacaccgtccaacaaatcttggtgcattttacggccccattcactgttg

SEQ ID NO: 5377 - DNA, 1687 bp, Heterodera glycines
ctcagcgatattctcagcatatgggtaatttttttttgtagtttctaacaacaacctgggtttttcctgggcctggatttttgtccaggacaatccaggtccgggttcaggctttttcaaaataccgagctctagtcctaggtctttaagacgctaattttaactaatttatagaaacggaacacaataaattcattaggaattctttttcctttaaattggcattccgaattagttttttttttaattgcctggagcacagcgtatcctcggctggtcagccacgcgttgatggcggcgaagccgaagaaatcgcgcgattttgggcccccgtggacgagcacaatcaatttttggggccgtcgtggcaacatgccctggcgtgccaactccagcttgtccccacgcacttgtgccggcgacaacaacggggtctgagctcatgggaaatctttgcacttgaaccttttgaactcaacaaactttttgtccttatttccaaggacagtccttattttctaaaagtacaactcgtttgtaaaagatgattttgttcaaccataatgtaagggttcgaacaacagggtttcattaaatggaagaatttcagcatttaggtttatagtccttgtttataaggactgtcattatttgcttacaaaattttgtttataaatatctttacataaatattttagagaaatcattggttatttcgtgaaaacaaatgctctgtgattcctggtgacaaaaaaaaagctctcccgcgaatgagacagaaagatggctcccgtaaattaattcagcattcttttttgtccttattcataatgacggtccttatttaatttaatgtatccttataaaaactagtattttttaaaatttctctttttaaagattttttattttctaattttaataaagaaaatgaattgccgtgttgtatgaaattatttaattttttcatttaaatactgtacttatttttgaaacattttcaatgaaaatctctagatgaattagaaaattttgttgttgaaaatttcaaatttctggcattttatttcatatttggtaaaaatagataaattaatatttagggtaatttgtttgtttacctgtggtggtaagcttaaatatgcttgaatgcgtaagccatcccgtgccgaataatcaaacccaatcattttgcttaggggtcgtccagccaactcaggacgagtggtgaacagctgcaattttcacaaaaaaataatatataaaaatacttaataataattaaaaatatatttaaatgaatatatttaaaaaatgatttttttttttttaaacgaacgtaatcagcacgttttttgcttcttttgtagagaaaatatctaaatgagtttttatgtacacaataaatttaaatcaaaaaattttcctaattttttcgaaacgttttcattttaaaatttatttaaatcaaaatgttactcaaacggttgatcgtcagagatgaagctgaccagccatgtttcgaagtccatgcttaaaataataataaataaaaattgcaatataatttagtgtgtatttttaaaaaaattattttttgtcaattttcttaataaatttcattaattttctggttatgggcctaaagacctcatgctttcaatgactggtgttcctgatggtcgca

SEQ ID NO: 5378 - DNA, 1019 bp, Heterodera glycines
caatgttgacgtctcggcagtggcagtgaacggagccattgtcgtgatctggggcgcatttttggcacgccccaattgagagttgacactgatcgaagccccgggcctgctgctcgtccgtgcagtggaggtccgaggggatggtcttccccattgccacagcccgcccatcggtgacgaaaaatgatgacaagactggcaatggagggagggaagaggggacgaccgccagagtcatattcccccattgctcgggaatcccgggatggatgacgaccctttgagactccacttgcccgctgttcgtttccagttccacccaagcactgagctgtaggtcccactccaaacaactgaactcctcgaaaagcgtggacgttgtcggcgttgcggcccagcggtagaagaggcaagcagcggaaggaagaccacacgaattgtgccaaaagcttgtgctttggatgcaggctgagtggccgggtcgactgttcagttccacgagctcggggacctgtgccccgtttcgaacacgagcgcaatagtctccatggcacgagcccgccgctgggcatcttttaatcgcaaccgtcgagacagtgtaggagcggagccatttctccgttttgggcacgcagaccatagtgattgacgtgagccgtaggcgaacagccccgagcaattcgtcctgagccgatctgatcaaaaatgagttgacctgatcggatggcagcagagtcaggattgtcgccgcggatccgatcccgaacatttgagtcccgatggcgtcctcgcgcaatcctccgatcggagcattaccgatatgggctttgacgaagaagaaatggcgacgagacacaacagcggaagcagtgccgtagcggccccgggcatgaatgcccgccctcgctcaggattcctccaggctctagcgaccgcgcgagcgcgcctggccaattgcagtcgttcatggacttttatgatttcggccctcgcctttcttgcgccctttctccctcgag

SEQ ID NO: 5379 - DNA, 5606 bp, Heterodera glycines
ataaatgccatcgggacctgctcaaaattccatgcgcctcgggcatatcggtccggttccggtcgtgattccgttcggcgttccggctcgcgcattgccgccagagccgattcagccgcacgcatgcacctgacttgagcacccaccgccctccgaaattcccgaactgaccatttcgttccactcgtgctttcccggatccgcagttccatcaggatccgcaccggcaatttggactcgagcagtggcccgaaggaagcgtcttccacatttgccccgagctgctccaattgacacactccgcgctcgaactcgtccacgacggttgtcaggctttggacattttctctggccggtggaaggtggagaagctgggcccggattgcccgctgtagatcatccgtgtccccaaatcgttccctcagcagttgaatgaccacgggataattcccgtccgacggggtgtagacctcgacagccctcctggctggggatccttcctttaagcagcgaaggagaagaagctgcttttcgaagcccgggatgggcttgtcgtccactgcccgcttgaaatacgaccaaaatgtcgtccaatcctccggttttcccgaaaatgtcggcggctggaggctcgaccgggagttcgtagtgagtctcgggattcttgggcgaagttgcccaacacccatccgcgcagcaaatttcgagtttgtccaccgattcgtcgctgtacacggtcactccacgcgccgcgcagctcatctcgcatggattcttgaggtcattcgagtcgcgcagcgccgtcagtctcgagtttcggggggcgggttggcacccgacgacggtcccggtccacattagcacggcaaaaagcgtcagtcctatgcgggattgtccaaacttccgcttttgcggttttctcggcattgaccactccgggtcacgaatttctcggattttccggtcccgctgtgaccgtcgaagggccacgggattgttttcccgttcgatttgcgctccttccttgtcctgcccgctctgaccgacgacttcggtcgtttcttcggcgctggccggcacggactccccgattgtgcccgcctcctgctgcgttggttcggcgttgtcctcatcctggggttccgtctgttgcatgattgggcccgggggaatgaggtcccccctgatgtcgccgctctcgcacgtttctgctgtcccgtcccgttccgattccggtgattcctcgagggggcatatcttatttaccgggcgcccccaaattcggccatttggcattcggattagcacactcctgatctgatccggtggtcccctgagttcgatgattcggcccatctgccacacattgcggggctgcattttgtcctccaccagcacgacgtcgccgacttttggtgtcccgccggcgaccacccgtctgttccgatgctgccagccggctttctcccgtaactgcagcaggtactcggagtgccaccgcctccaaaaatgttctgtccgttgctgcgccgccttccatcgcttctcgagctgaacatgcggggggtccttccgatcgggtgggagctctgaggctgggttcaggggaccaatccccaatcggccgttctcctggatgaagtcgatcggtctgatcggtagcggatcgccggctccgtcactgacgtaagtgagcggtctcaaattgaccgctgcttccacctctgccagaagcgtgatcagctcgtcataactgatcacccagcttccgagtgtcttctgcagtgcccgttcgaacactcctcccgcccagggggtgtggctgggagtgaatcgccacttgattccgcgagaatcagtgaatgccacggggtcgttacccgtaactccgaatgatgaaagagttcggcctaccaaagtgaatgaaggcgcattgtcactgaggatccgtgaaggcgcccctcgcctggcgatgaatcggcgtagaagcgtgatcaggctgtcagctgagaggtctcgagtggcgtcgacataaattgcccgagttgtcaagcacgtgatcagcagcacccaggctttgcgccgctgccccgactcatccaacgccgccgtagggcccaagaagtccagccccaccgattcgaatggcagccgacgtctgacccgatcagctggcagcggtggcattggaggaagagcgtaaggcgccgcttccattcggcggcacttccggcatgatttgatcacctttctcgcttgttgacgggctccaggggtccagtaccccttcaagaactgggagagagtcgcatttataccagaatggcgcagtccctcatgagtgtccgcgatcagcagaatgccgatccttgaatgcttcggcaggacgattggtctgctgagttccgtttcagcgcaattctccactcggctgtgcaggcgtctcgtaccgttctcgtccacctcggtttgaatcccttgcggcattttgccctcgttttgggctgatcggatgatggtctcttgcgctgcgtttaactcctcagtgcacaggggatcacgtttcccctctctctccattcggacttcatttgtcccccccctttcttgcctttctgccgaatcgcagcgaccaagcgatgatacggaccgctcgcttccactggccgcactttctgaggaaagctgtcgggaacgaatcgtcttgcgcggaggcgaggagcattgtgctaggagtgtcctggtccagggggaagtctgtcccctccttgtacaccttgaactccaactcttttggccatttgtcggtgggtgagacaatccaccagggcccattccaccacaattgactgccgtgaagttcagcgggaggcatcccgcgcgttgcaatgtcggcggagttatcctccgaccgaacatggtggaaggtgattccgttgccgtccgtatctcgagcagtcgattggctacgaactgcggttggggtgtgtggttccttacccagtgcaaagcaatcatggagtcgctccataaatgctgttcagcgaccggacggtggagttgggcacggacgaaagccgccaaccgcacgccgagcaggatgcccatcaactccatccttggtatagtgaaagtgtccgccgctttctttggcttgaggcgcgacttggccatgagcagacgggaaaagatcccgtcgggtccttcggaacgaatgtacactgcggcggcgtaggcgaactccgacgcatccgtgaaaatgtgaagggataatgacagtccggttccacttatcactttccggggaatcagggttacttccccgtcccaacttgcggtgattcgttcccattctcgctgatcagctgggctgagtggagagtcccaatcgtgagtcgcgtcccacaagcgttggaagaaacgcttggctgcgagagtggcaggggccaaggtccccaaaggatcgaagagactggcgatcattttgagtacggacctgcgagagttggttgtggcgcaatccggggggatccccgggtaattcatccgaatttcgtcccgctcggaatcccattcaaggccgagcatttttgttgtcgtcttcccgaggtagtcgtccgtcgggaattcccgattgagattctggtcattgctgaggaactctctcagattcatccgagcatcagtgaacattcgcttcgccaagctggccttttcggccgcttcctctcgtgtgtccgcggggatgagcacattgtcgacataggtgtcgcggatcagctgctccgcgaagtccgaaccgaatttccggagatgatgacgaactacagcggcgaggcagaacgggcttggcgtcagcccgaaagcgaggcgccggaatctcagcggcaaaagattgtccgtcgtcactggcctcgtgggatcccgaacccacagaaatttgcatacctcgcgatccgtctcttcgatctcaaccatcagaaaggccttctcgacgtcggcaatcacgggcacttggcaagcccgaaatctcaacagcattccagccaaatcaggcagccacacgggtccccgtagcaggcagtcattcaaggacggagctcctttggcatgagcactggcgtcgtagacaatccgcagcttcttgggcgtgatcacggcttgatgcgggatgaaatgttcccgctggttggccccgatcgcggctttttcgatgatgccggtactgaattgctcttcgatcactgcccggtaccgctccaacacgtcgggcattcgctgtaatcggccgatcaggctggtgaggcgcctgtaggctacagcgaagttgctgggcaacgcgggaatggggtcccgccacggcagccgaattgaataacggccgtcttcattttgtcgaactgatttctcgaattgaatgatcgcctcggtgtcggcgtctccggtcgggtcgtcccgaattccgatcgtctcgagtgaccagaactgctcaactgccgacggggccggcatgcgactccatccgctgtcttcatcggttatggccatgaggatgtggttatggggcgctggttgccccaagtgagctccgaaatgctctccacaaagcacagtcccgaagactgtatcaattaggaaggccccctcggccgattttttgaaaccaatcacaaagtcccaaaacttgcgtattccgatcacgatttggggctgaagtgtcgcgcccaccggttcgagcagtccgggagttcccggcccaaccagcttggtttgaatgggcgtgcaaacattgggcacggatgacacctccagcggctcccaccctccgtccaatcgtttgagcttcagccggtgcctggacgacgggactctcttctttgatccgccgaacacttgcacgacaagcggggctgaccccgcagttggtagttcgagttgctctgtcaggattgtctggacccaatccacctgactccctggatccaagagcagagcggtaggacgctgacgcgtgatgtcgtcattggccgctaccacggggcataccatcaggtaagccggcaggctctcgcccatcgctgtgaatgcccgttgatcagtgccaagggatcgttcccctcgtttctccgattgaatggccgggtcgttcgtccgtcgcttcggctttcgcttggttttggtacgagcctcgggcgggcgggaattgccctccgagttcagtccggtctgcaccagcatggcatttgccaccggtttgggtttgtcctgcccgcgggcctccactcccgccggtggttcgcgggttgcgagctgtgtccccgacccgatccaacagaccaaggaatgatggtcgtctcgctggcaccatcgacaggttcttgggcgtggacagcagctggcaatgtgatcagaagagaggcagcgaagacagcgccgttgctcgacgagccgctgtcgacgtgtttgggccgtggggtaggccgaacaactgctcgggcgatggcccggtttttggcaaagagaacaggcattgtcagccgggacctccccccgagagtggggaggtcgatgattcctggtccaattctgatctttcaccttctgat

SEQ ID NO: 5380 - DNA, 2134 bp, Heterodera glycines
  misc_feature (90)..(90): n is a, c, g, or t
  misc_feature (103)..(103): n is a, c, g, or t
  misc_feature (196)..(196): n is a, c, g, or t
tggttttgctgaatatgaatgttttccaaatgaaatgaatgggtttgattcgcaaatttgtgaaattgtttctccgtcaaatgtgccaancgctgagggtgancgatggcatcgcaaattggacgatttgttgccatttgaggccacagtaccactgcaaaagcatcagcaaatacagtaggtcacattgtctctntggttcaaaatcaaaaggggaccgattgtgccacataataatccgcaggacggcattcgttggcaaaaatagaaaaagcacttgtaaaaatgtgaaattttacgaaattggaaaaaaacccaaaattttgcgccaaaaacttaaatttttacgaaatcgaattcgttttcctatttcaccggaccgccacccatccaccgacagtgccaattttgagggcatttctggcaaggaaccgttgctgatcagcaaagtggtgcagaaggcgttcattgatgtgcggtgattgcccatgattagggcccggatttacatggattggatttccatataattgggcttaaatactcaaaattatcattttaagcatgaattgtctattgaatttgatttaggtcaatgaggagggcactgtcgccgcggcagccacaaacgtccgaattgctcatcaatcgagcaaagaacgacgacaaaacttgcgttttgtcgctgaccatccgttctgtgcctttctgattcgcgatgactctgtgcttttcagtgcgattttccgcaaatgattcaatttattatttaatgtgtatttgtgttagatttggtaattatttttgttgtaattggatccattttataaatcttcttttttgtgtgtgtttgtttactatttttgcatttgattccaatttttaatattcttttatttgccgatgatgaagagtgattggatttacacataaggaaaatcgcatatataatacataaatatgtaaaatcaaatatgaaatacagtacaccggaaaaatgcgaaaatgttaaaatgtttatctccaaaaaagtgtgcgcactaagcaatatgtgcgggaaaaaattctgtgttatctctaattatcccccgggggattatttctcaacctcatcagaaaaggggggaggggataattagatacgatgggataaatggagacgggggataattagagataataccgtatgcgcctgaagaaggaaaatttgaacctcaaatttaagagcacagaaaaacctcaaatattaaagtttatctaacttttgatgctgatttaaaactttttagcttttcaatcttctgatgatgattgacatttaagacgacaaaaaagcgaacaattattgaaaaccaattttatttttattttattttaattttcatattcaccattttgccgataaatttgtgaatgaacatattttgggaatgccagacaaatttttgattagcaaaaacagtaacatgatcaaattaaagaagtaccgtatcagtcgcctttcattgaggataagccgagattgtctatatttaaattatataatattttaggaaataatttaaaccaaataaatttagttggcttttacgagccaaaaattttatggcaaattttaatgaagagctttcgctaagtgaagaagcatcaaaacacgaactgctgtcggtccgctttcatcagctattccatgcccaataatttgcaatttgacggaataaattagccaaagcattactttttagtaattcattaaaatgacataaaaccaaagattggattttcagctgggggatggatggcattacgacttgattctcgagttttcaatgccaaaggggtgacaaaagtgacagtgaaaaaaccataaaaaatcaaaaagttgatgctttcgaatgcttctcctccccattatcaaatttcaccgaatgtttgttctctctgcttcttttctgttttctctgctcgtgtcttttcatttttaagcgcctgcttttgtcagtggccaaacgaatcaataaaagtgccactgctcttccaagcatttggcacaaatgaccaccaccggccactgctgggccaagccattggctaacgagtggccacccactaatgccgctctcttccaataaaa

SEQ ID NO: 5381 - DNA, 3013 bp, Heterodera glycines
cgggaaatgcgcatttccggtaataagtttaaaaagcctccttattccggaaattcagttacaattttaaatactatcccataatgcgcatttccggtaataagtttaaaaatgcgcattttccggaaattctgttacaattgtaatataccggcaagtgcgcatttccggtaataaatttacaaagcgctttccgtaaattcagttacaattgtaaatactatcggaaagtgctcatttccggtaataaatttacaaatgcgctttccgtaaattcagttacaattgtaaatactatcggaaagtgctcatttccggtaataaatttacaaatgcgcattttccggaaataagtttcaatgcgcattttccggaaattcagttacaattgtaaatactatcgggaaatgcgcatttccggtaataagtttaaaaaggcgcattttccggaaattcagttacaattttaaatactatcggaaaatgcgcatttccggtaataagtgtaaaaatgcgcatttccggaaattctggtacaattgtaaatataccggcaagtgcgcatttccggaaataaatttacaaatgcgcattttccggaaattctgttacaattgtaaatataccggcattgcagatccgcttgctgaccggtggaaattccttctcgatggtgacgaacttatcggccaacaaatttgtataataacgttcactggtgcgtttgatggagcaatgccatgcgaatgcgatttgctctggctttatgactttcgcgaagagctctattgccagattgtgccattgagcagtgagtgttggcgggggacggcagaaaggtgaactttcggggcccttgagttcccaaatcgtactgcccctgtcggaacaccagaaaacgtccgctccatcacggttcgttcccaagtctctttttgctgatttgatcgtgccggaaggtgtcgttgcgtcagtttgttggcttcttgctttcgtgacgtatagtattcgggttcgtcttgtcgtccaagttgatgcgctgtttgacatcattggagtccatctttgcttggtggtcgtcatcgatgcccatgttgtcgttgtccatggatttgtcttcgtggtggtcatcatttcagttcgagttattgtgctgtaccacgacgaagttactggtcggagtgcggtgctcaaagtgattgttaattcagatggcggtgcagttgtgagtgtgctgtaatgcgcggataccatttggaggaatctttgtgcattttggcttaatgaggctcgatgaatgcgtaacggtgccgctgctgttggctgaaggaacatcagcgcgaacatgctgatgaccatcagcgtgtttattgagtttctggacataagtccactgctgcttgcggctgatgttgaaggtgtcggatcaacttccatgatttcgtcttcttctcgcgccaagatcatgtcggttaattgtcttgcttcaccggttcgccggtggtagacgaaaaagcctgccttggccgccttagccaactggtagcattcattcttgtttttgagccaggatttgtcgtccgtttttgctaacactattgttagttgaatgtccgtctttgcgagttctcggatgtacggggtgatgccttttgttaagtcgctttcattggccaagtagcagaaaatgatgtgctgtacatcgggcccaggggatagatgaagtctgtccgaggcgtagtgcgtgaaccattgagtcctcgatgcgttcgccaattcttctgccgccagatcgccaacgcaaataatttcgtggttactgtagtgctggtttgctatggctgcctttgttcgagaagcgacatttgcggtgaatttgttgaggttttcgagccaattctcgaattctgatgtttctttcccttcgattgagattggcctgagctttattggctcaaattggttcagctgcattaatgctccaaagtgatcacacgaagtgctccattgcttcaacaaatccatgagcgatgcttgcttaacgagttgccgatttttggtgacgaattgttctttccaaaatttttcagccaactgcttcggtgtcaagatggacggcattacgtattcttcgtggaggacgactgtttcgctgcgaagatttaaaagtcgctggaccaagtcgaaaagcattgcgttcatcagagaatttgctttgcaatcttcgaatccgttcaattgttttttgcgtgttgaagcaatttgccgatacgtacatttggcacaactttcgtgacgttcaccagaacattcggttaaaatgttataaccgacgtattgttctccttttggccagctttgttggtaacattcaatgcgcaattcttccggttctggaatgtgcggtgctgatgggggagtgtgtcccgctctctggactcgtcgctcgttttcctcttgaagctctgaggacgatacttcctccgtgacgatgatttccggttcaggttcgctctcactaaccggtgggccatggaagaccatttcttccgtgtcagattggtgtagtggccttctttgaatcggacgttcacggatggtcgagtaccaccgaggaattcggatggttcgaccatttttcctttttggtcatgaagtttccatccttgcgtttcgagctgatgaagctccctggaagtgcgtccatttttccagagaaactgccaattatcattgccgtaaatccgttgacagtacgtgagtaggacttcgttgttttttggcatgtcctcactacaatgtacgagtactttgattatcgatttttttcaatccatattttcggacccccccccgccccatacctattggatgatctttgatccctttcaccgaaacctattggatggacttgtgcgcgagaattaattaatttaaataatttaaattaaattatttatttaaatgagcgagagctgcgcgactttttccgataaattgtggaaaatcaaaa

SEQ ID NO: 5382 - DNA, 1748 bp, Heterodera glycines
ttacttatgtgcatctgaaaagtcattttttttgtccagcagtgagctccatctgtatatatgaataaacctacattagagagacctgtcaataccttttttagaatccgtttatttcccagtatcttattggctttttttttgcctttttcatcacctcgtccaccctttgttccatttctcgatggcttacttgacgtgctccgagttgttcaacaacaatctatataaattatccataaaaaatggcataatttaaacttctcttgcgagtgcccgcgctgaagctgtgtcgtggtctacccctaatgcattgccaaaaagctggatttcgtacaaacgagggcaaatcttcattgttatcattgccattttttgggcctgggtgtaggttctatgtttcgaaaagacggtcacaccagcatagcggacaccttccggactagtgccggggataatagacatctgcaacattaggcaatttttctcatagtattttaactctttaaaatcttcataattaattttaaaggaataaatatcattctttatttttatatggacagtagagaccggaattttaaagtaccgggaccgggcttagacatttgaaagggaccggggagctcgttcaaaaaagcccgttttacgggcgcccagggcccggtccaaaatttgaacgggcacccgacgggacagggctttttaaaatttttggaattttgattatttcaataaaataaaaattttaatcttttatttgaatttagaaaaatgggacgggaccgggccgcccggtaaaagcccgcctggtcaccgtgccaatccggtctcaaatagacagtataatcattttgttatattttatgatataattacatattctaaatctccgatgaaatctgagttttcccaaccgcaaaagccatgggcgacttcgtgccaggaagtcctgccaggcgtgttgataaggggattttgtatggcgtagtctatggcagcgttgtattgattgtaaagccgttctttttcggcacgagctctttcaacgattcgctgatcattgattagcgatcggaatggaaattccgacactacttatccatttatatttgtgaagaagaattaaaaattaaatttaaaattatctgttacttatgtgcatctgaaaatgtcaatttttttgtccagcaggtgagctcccatctgtaatatatgaaataaaaccttacattagagagacctgtcaataccttttttagaatccgtttattttccagtatcttattggcttttttgcctttttcatcacctcgtccaccctttgttccatttctcgatggcttacttgacgtgctccgagttgttcaacaacaatctatataaattatccataaaaaatggcataatttaaacttctcttgcgagtgcccgcgctgaagctgtgtcgtggtctacccctaatgcattgccaaaaagctggatttcgtacaaacgagggcaaatcttcattgttatcattgccattttttgggcctgggtgtaggttctatgtttcgaaaagacggtcacaccagcatagcggacaccttccggactagtgccggggataatagacatctgcaacattaggcaatttttctcatagtattttaactctttaatatcttcataattaattttataggaataaatatcattctttatttttatatggacagtagagaccggaatttttaagtaccggg

SEQ ID NO: 5383 - DNA, 3032 bp, Heterodera glycines
gtttttttggaaaatgtgccaaataaattattaaaaaattctatttatcccccctggcacataaatggagactggtagattatttttcaacctcctcagaaaggggtacataattggagaccggtagtttagtgaagactggcacataaaaagagcaaatacggcaattggaaacagcattgagaaaaaagaacttttttatttatttaagaagagaattatcgaaaaataatcatcaaaacgaaattcaaataaagacaaattattgttgctaaaaaattcttttgcttatttggccatcgctgttggttctgtcccgaaaacgggcatttttaatgggccgatccattagattggggggaggaggaccgaaaaaggagcgaaaaaatgagtgggcgggggggggggagagaaaggaatagagaggggagcgcggggaggggggaaagtggcgatgccaaaaaatgcaaatcaaatggggcaacacggggaagcggcggataaaagggaaagaaaggagaattaaggggggggggcaatagataagggatagggaaaatgggtaggagagatgggattggaaaagcgagaaaaggaggggcgacaaaagatatggaaaatatgcgagggttattggagggcgggggggggggataaagaaagaaacgaggggaaagatttgagcctttctaggatgatgcaataagtttttattttcattttccggaaaaaaaaatttttttggaaattttattttaatgggaaaaagttttaaaatattttcacatattttgataattgagatagagcaaatttgaatttttattttgtgtatatatataattttattggtttagaaaatgatcgttcacttttcgttcaaaaaatttaattagtttaagatttgctaaaaaggtggaaaagcaaagaaaatatgagactcctaaagaaatcatttaacatcgggaagcaaagaggtgaagaatagagttgtacgggaccgggacctggtacagaaaaacacgtacaactgagtacctaagtcccggttttgactgtgaaaagtcacggtttttcaacccaaaaagtcccgatttgcccaaaattcccggaattagtttaagatttgctaaattggaaaaggccccaaaatgggggacacccctttgcatcacgggtgggcccgtgtcaaagaggtggggggggggggggtcgtagcgaaggggaaaagagggaaatttctgaaaaattggtcatttcttaaagaaaattcattaaaaatttctaaaatttttccgccgacccccccccaaaaaacctctttttttcttcaaaaattagctcaaaattgcaaatgataatatttttttttattcagaaaaaatgtaatgaataaaaaaatgtcgtctttggtctgaacattttaaatttttttaattgttcggtctctgaaaaatggttgtgtttttttatgttaggtaattagaaaagtgataaatttcttcgccagaagtacccagctggtttttatgcacagtttgttgttccatttgggccagacaaaaattgtggtgcgtcaatgtattggcatttctaaataacacttaaaaacggttttaaatattttataaaacacttttgcgtccattcgttcgccgtaaaccgacaaatacatgacaaatgctttaaaaatcatttgtttgtaattggtcttctctctcctcggtgtgatgcttctgctcctcgacattcgtctttcttcatcgcaaacgctttcgatccgttgtttaaatcgccgcttttttggccgatcagaactttaaaaagctttttacttttttctcatatttttttcttaattaaactaattaccttttcctttttgtgtttcctttttgttgggaggagaaaattaattaacttttttttaaatttaaaattcaccttgtttattcgctttagaaaattcgcccataatttctttgaattttttaaccttctcctcaaactctgaatttgcttcttttttttctctgattgtctcggaacccgtcaattgggccccacacgtttgggccactgcatgtttcggatataactttttcttagtcatccaaatccaacattcttggtattattcgaaagttcttcatctagctctattagccttacaaaaaacaaaaagattttgtagcatataaaaaaattttaagaaaaatttcaaaagttttgactttttgcaattttctagttataactttttagcaattgtccaatcgcgaagcgatatattataataccttctaaacatgtagccttcgaatgataccaacaatcttggctttggataactaagaaaaaaattataaccgaaacatgctggggcccaaacgtgagggttaactgacgtgaccggatagtttgatattgataaatagggatgccaatcatatggatatccatatttttttcctggactgttgagggcctgaaacgcacgaaaaacatgtttttagcttggtttgaagcttctaggatgggtttccatatccatattttccatatttcgggatttatatccatatttccatattttggcatttttatgcatattttatgtccatattttggcatttttcaaaaaaacctctattagaacggcccccagcagctaaattagcctttttgagcccaaaaaccgaaaaatttttcaaaaaatcattttttcgccaaaatttctcgagaatattgaataaatttaaattttcttaaaaattaataaatttatgtcaaaaataagcaaaaaagcgaaaatttcgcttttgtggttgattttgcgctaaaaaaattaataaattttagcttttatgtttttttcttttaaaatgattgcacgtaattgccgaaaaaattcgagaccaattccgaatgttgaccgactaattgcgtctttgtcaaagcgccttaccgagccaaaaaatttggaaatgtatctcatatgcaatttcaacccaataaatttgaagaaattt

SEQ ID NO: 5384 - DNA, 3248 bp, Heterodera glycines
  misc_feature (93)..(93): n is a, c, g, or t
aatagaggctggacagttgggaaattttgcgcaatttttggcaaatattaaaactacagttaattttaaacgtgagctattaaaaaaaatctntaaaagaagtcattggcctaggaaaaatggagcagcacaagtttttatcagattttattcagaattgccatttttttaaattaaaatctttataagttcaaggaaaatcatgataacattcaaaattttaggactattttaattttgcgaagttcaaaaaccttttacgttttttttggctcacctaaattaattttttaattaacaataaatcattttttgagatttttaaggacccgtaacttttgtcaatttcttttttatccaaaaattctttcgaattctttattagcagaccgtgcggaatcgatttatatgaattttgtcgcaattccatgcgtttaagggtttggacggttcagtcccaaagccattttgtcatttcagtcccgggtctgtaactcttcagcgattggttaccgccaaaaaattctttcggattctttcattagagaccgagcggagtcgattggtatataatttatatacattttccatcccgtcagtatccttcacttttaccttttatagtcatgaaaagggagggattgatgaagtttgttgtatctttttgttcatgtgttataaatagggctatgtttttaggtttttacatattttttcctgagctccgcgtggcctgaaacgcacgaaaaacatattttttttggctgttgttaagctacttttcgagttattagggcctattttctaggtttttattttgaaggaatagaccccaaaaaccggtcggggtcgttttcgcgtggccattttcgcgtgagtacctgtttaggactgaaattggtcggatttgtgcaaaacatccatgtttcgaatcccgaacccgaattcggacaaatttcttaactttttaattttttatttcttacggctagtatcttctacaataatttgtcagtttggtcggatgtgcgtcaaacggaaaaaataattaaaattggttctagtcggttttacgcgtcccatgacactttacgcgtcccatgacattttacgcgtcccataacattttacgcgtcccatgacattttacgcgtcccataacattttacgcgtcccatgacactttacgcgtcccatgacattttacgcgtcccatgacactttacgcgtcccatgacattttacgcgtcccataacattttacgcgtccgatgacattttacgcgtcccataacattttacgcgtcccataacattttacgcgtcccatgacattttacgcgtcccataacattttacgcgtcccatgacattttacgcgtcccatgacattttacgcgtcccaacaacactttacgcgtcccatgacattttacgcgtcccatgacattttgtgtccatggcagggatggcattccgaggccccaaaaattttcggaaatcgaaattccgtgccatccctggtctcatggtattatagttgtcctaataactaagagaaaaacttttttttgttaggtattcaataaagtttttaactataaatttcgttgttaaacctaaggttatcatgacaactcatacacaggcaactcgaacaatggcttattgttagactaggcctaagtttaggcttttgtaaatttttttttcttatattagttgaatttctgttgacatcaataagtgtgcttagagttgcttttgcacttctcttttatatgcaaccacgcgaaaacgtcctggcccgccaaaaacttacagaaaaatattttttcgtaaatatttctggcttttttatcaaaatatttgtcccagccctagtgattagtagggcttccaaaaatatggatataaaatttcggaatatggcaataaaacctaggaaaaatcgcgaaatatgaacataaaatagcaaaaatatggacataaattttccgaattgaggggtaaattttcaaaaatattcttcaaattcattaaattcaattaaaatacatctaaaatggctaacaaaatatggacataatcgcgaaatatggaaaaatatggatatagaaatccatcctagaagcttcaaaccaagctaaaaacatgtttttcttgcgtgtccaggaaaaaaatatggatttccatataattggaagccctagtgatcagtgatcccggaaatccctgcctgaaaagtcaatttttgttgattattttgtgcaaatctcaaaatttttgtgtttcgtacatatattttttgccatttttatatgtccgatttatttaccgaaattgagaggttttcatcataaattgcatttgatcactgatgaattatgatcggttggccattcttaaataattcatttcttcttccactaatcaccattgtttcgttcttttgtccgtcactcattcatcgtcagcagaagacgccacttttgtgatgctttgtcccgtttcttctgccggtggcggagacaatggccttaattaagcgcaatttgaattatttaaacaaaattaaatgccttttttatttgctcacccaatgcaattagtgtcactatcaagccaaatgaacacattgttacaattgttgccccaatttccgtctttccaattgaccgccgctgtctccccaataattttgcatcgtttcattatccaaatgtcgtcccattcattttcgtttgccttggccaatgtcagcttttccttcgtccattcgttcaccaattcaaatggcaccatttgtattgacggcacatgaacagaaaaatgaatttcgtaactgacggaagaaatggcattggcacgaagaaaatgctaaacaatttgaaaacaaaaatcagtgatttttcgagattatggccacacctccttgaaattgttgatccaatcagtgttcgtttgttcgttgtgatcttcgcaatgcaatcgcttgggttggccatcttttctcggaatgtgcaaccatttggacaatgcttggccagaagaaattgttgaaattggcccatcaaaatcatcaccaaacgcagcgggcgacagaccaaatgaatggattgaaaccaattggttgagatcagtgagaattgtcggcgaaatgcgacgaagcaaattgtccaaatgatcaccattgtaaaagcccaaatgacgaatgtttgccgaaaaaaagggccaaatttcgcgaa

SEQ ID NO: 5385 - DNA, 2942 bp, Heterodera glycines
caacgcaatcgcttgggttggccatcttttctcggagagtgcaaccatttggacaacgcttggccagccgaagttgttgaatttggcccatcaaaaccatcaccaatcgcagcgggcaacagatcaaatgatttgattgaattcaattggttgagatcgatgagaattgtcggcgaagtgcgacgaagcaaattgtccaaatgctcagcatttgaaatggtcaaatgaccaatgtttggcgcaaaaatgggccaaatttcacgaacaaaaatgtcccaaattggttggccattcgtggcgtttgaataaggaatccacaaatgtaaatcgatgcctcttttgtcaaaaatttggtgattggaacgaagaaaagcgatgacgaagtgatcaatgtaactgcaaaaagggaatgaatgcttttattgtcatagctctctgatttttaattactaaatctcaaggctcttaaaacggattttgctgggcaacggacggtcgttgggcattggaaatggcacaaatttataatccatcagcacagatagtttcggttctggtcctttgtccttgctaatttggatcgttctccaaattgtcaattcgcttttgccatcgaaatgtttgtccaccaacgcattgaaacgtggcgaaagaagtgccaatttgaggccgagttgagcatggtcaaaggatgggaaaatgtccatccaaacgtcgttgcaaatccaactgaaattatggaaaaacagtttagtcaaataaatgactaatttgtttgacttttaaaatattttaccgtcggttcatttttgaggcaattagcacaatttggccgagctacgaatgatgtcacacaatatatagcagaagaattaattgagttgggtaaagcttggatttttagggttttcctatttcttgacggatattatcagggaacggatttatatgtttttatatatttttttatctatcgcatgaaaatctcaaaaatagcatttttacctgttttcctttcaatcagagcgagtttttagcacatatttattttgggctttttgggaataaaaacatattttggggtttcggcagtttttgtcacatattttggcgattttttggaaaaattaggtttttttttacaaaaatgtcttttttggcactcaaattcgtggtcaaataaatgcccaataatttttcaaaattttctttttttttgtatttttttgacccttttcatgactttttcacttttaaggcaaaatttgatttttagcgaagaaattccgaaaaatgagtaaatctttgagagcgaaaaaaaatttacgccaaaaagcattacattaagctagcgaaattgataaaaaatgagacttttttgagaaattaacttattttttgagcagtttttttcaatttttggcacatattttggccttttttttgggttttagcacatattttgggggttttttggcacataacacaaattgcagagaattaattgcgttggaaactttatttttatggtactaccgtagagttgagcggaccgggaatgttgggcaaaaccgggaccgggacctgagaagccgggacgggaccttggttttccgggaattttttaattaaaaaaaaaatcaaattttaatttatttcaagtgaaaataacacaaaattaatttttattttgctatttattttataaaatctaaaagttaaagctaaattaaattaatgaaatttttaaacgaatttacttcagttatttcaaacaattaatcattttggactaaatgatcgaataatcttagaaatccagaattgcttttcacataatttttcggcacgtttttccaaaaaactttttgggaagaaaggggtccggcggtgcagttaggcgccgccgggaaaaaattttgaaaatttcagtgagatttgtttacgaatttcaacaaaaaggctggttttttggactactgggctcaatttgtatggattttctttaaaaaaattataaaatatgcgcaattaaaaaaaagtatgaggaagcatagcttgtcgatatgtaggaacccatgaacaaaaagaaaatcaaaatatttgaatttctgcagagtgattgaaccaagggaaagaagtggaaaatcaagaggattccatattcgtgatcattgatcagcgacctcggaaacccccggcggatacttgttttctgaactttttaaaccaaaaaaagaatttgaaaaaatgttgaccaaaaatgtggatacaaactcctgtagtaccatttttataattagagaacaaagcggaaaacaatgaaaacaaaatttgagaagctcgaaaaacacagaaaaagggaacgcaacagaagaggagaggaggaccaccaaagagaatattttgcaaaatgatgaccatttgccgggcgttttaccttatccccccacccacaaatcaatcgatcaaataatcaattggacggatagagggaaaggatgaaaatagcattggggaaggaggagagacggaagagaaagagaggaaaaggaaaaattcgaagcaagaaggagggggagaaagaggaggaaaaggatgaaaatagcagtggggaaggaggagagacggaagagaaagagaggaaaaggaaaaattcgacggaagaaggagggggagaaagaggaggaaaaggatgaaaatagcattggggaaggaggagagacggaagagaaagagaggaaaaggaaaaattcgaagcaaggagggggagaaagaagaggaaaaggatgaaaatagcagtggggaaggaggagagacggaagagaaagagaggaaaaggaaaaattcgaagcaaggagggggagaaagaagaggaaaaggatgaaaatagcattggggaaggaggagagacggaagagaaagagaggaaaaggaaaaat

SEQ ID NO: 5386 - DNA, 1790 bp, Heterodera glycines
ttaaaaatttttaaaaaaaattaaaaaaaccaaaatttgtttaaaaaattaataactaaatccgtataatagtttttgcaaattgcgaattgtttaggaaattcagtgtccaaatttctcccccatagttgcaccaccatgatcaccacacctgtatcaagcgccaaattttcggttggatttgttccgcttcaactttgtctgcatcgtatttgagcaccttcgggcactctctatcggcattgggccagaacttggccatccgacgcacttgttgaattgtcagccggaaaatcaggaaaatcagcgtcaattgaaacgacaaaaacaacagtagacgagaaaagttggcatataatttcgaattcgctgcaaaacgtccggcaaaatgagggcaaaacatgatcacagatcgatggccaaatattttgcgtaaaaagagcagaatattcttttttgttgcttccaggtaaaggtttattggtcaagtgaaaaatagacggtgaaagtggtgcatcacagtgagcacgttgttattaaggcacctaaattatataagaaagtggagaaattttaaaatattttagcacttactcaaatctgacacttataacgcggaccaaattgtccggaattggagttgaaggaattgacaatggcgcaagcaaacccataattcgaaccatgtcgggcatttcttggaaactttaaacgtccgccaaaaccatttttgctcttccatgaaatgacgcaatgcatttctaaaatttacgcggcggcagcaaagaaaacaccgccagccaatcgtcggcacaaattgggctaaaatttggcatttttaataaaattaaaattacaaaaatcgcgaaaaaggcactataaaaggcacaaaaaattgaaaaaaaggcatgaaaaggcacgaaaacctcgaaaaaggcatttaaaatttttttattgaagatttttaagcagcaaaagacgtaaagccattcaaattaatgcttttcacattcacacaaagattagtttttggtctttaaaagataaaaataaaattattatataataaatagggatgcaatttatagttttcactatttttttcctgagctccctatagcctgaaaagcacgaaaaacatgttttttaggggggttgttaagctacttttcgagttattagcaactattttctagttttttatttttagcaactaaaaaatagtaaatttttgaaaaaaactattttcaactattttggcgttttgccaaaatttgttacgaaaaatgcataaaaacgaaacttctttacataatataaagaaaaaataaatccgggaattgcacaattaataaagattattgttttggattatttagtgattaatatataatattaagtgttaaacatgccaaaagaatcttcatctcgcgcatttcttttcaagaaatggatttccaacaatgttcattttgccaacaacgtataaaacaacttatttttaaaatttctatcaatttttgaaaatttattttagcgggaaatatcacttgggagaaagataaggtaaaatgagagagtgctaactttcagtcccagtcaaacaaaacatttttgatgaaggagggtagagaaaataattttaagagagaatgcaatgggaagaaagttttgttcccttctttgctgattcctttgggcatagacggagaattatcattatatttctattgtctctatgtctttgaatctattcacgataaccctctctattaaaattttttctctgt

SEQ ID NO: 5387 - DNA, 4158 bp, Heterodera glycines
cgccggtgaacaacggatttgcagtgacgcgtcgaaaaggcccccttttggggcatttgcgagtgaagcgcccgcttctgtagacggacgtacgaagaagggaaaagcgatgaaaaactattcatttgagcaaagtgctaaacgactaattaaaagaaaagcataaattgtccactaacttttagaccatttctttttgaacttcttcaaaagtttttgtctcatttgatcatcccgtcattataattcataccagacaggtacaaaataaggtagaattaaaatacatataaacgcagaaattggatctctatctgtttttacaaaattgcattaacaaaaacggtttggtctttttatgtgcccgtaaaacaaatgtaattgaaaccaagtcatacaaaaacaaagcaaaaataaagcgaaacgtctgaagaaagtctccctgagaaaagcaacagcaacggaatgctcaaataaataataaatacgccatttcttcccctcctctcttctcattggcaccgaacttcgtccgcccggtcatttccatccctctctattgcgcacccgcaataccaatgacacccaaagcaatggctccgcccgcgttcccagtcctttggctctccgattgatcatcaccaacaccacggcctaaatggcatttgatgaaatccgataatggtacatttttatagttacccaaatcgtcccgaaattggtgaacgacgagcgctcggccgatgacattgttgaagccatcgaacagcgaaatgagaccattggtcttgttgatgatcgaaggaaaatttatgctgctgccgccgtcgatatttcctaagtcgccaacatggcgaacatcatcctaattagaaaaatggaaaaggaagaaattcagatattataaacaaaatcgtgggggaaaattaacatttttaacaacaaaacaacctcaggtccaccatgggcttggttggtcggattgaaatggccacgaaccgtttcgtaatcaccagacaaatcgccaaactctaaaatgttatttggaaatgaaaaagacattaaattgaccatgtatggtgaagccatgctgagtcgaaccactaaggcctgaaaggtttccgctaatcgtaacactggtgtccctcgtatcctggggatgaaaatataattgatgaatttttggatcaacagacctgtttgaatgtaatggcccccttcgtgtccttcattttcgggcatgccaaccaacacacagccttcctgggacccgaatcacactgttgcggatgcttaaacagagaatgtaaatcaatttaatttccttttcttgtcaaaacttaccacggggagttccatgagctgttgaagcgatttgatcagagctccacatttgtcgtcaccactcgcacagcccaccaccatattccaccttttagtcgtctccgcagctctgtatgcctgggtcagttgaaggaactccttaaaacaaaatgcatcaaaaatttgtaaatttatgacgtaaaaatttcgacaatttttggacaaaatctgttaactaatttaactcaaattttcaacaaaaagtttcccggcggcgcctatcggtaccgcccgccttacgccccacttattcccaaaaagtctgaaaaatctgattttttgagctgattgaattcaaataaatgatttgcttatttcctcaccaaaattgttaaaaatgatcataggaggcaaaaaatatgaaatttgatacatattaattgattaattttcgatccgcaccctgctctaatacggcggtcccaataaaacttacgcgctgaaaatcctccgaacgagttgacatgttcgtatcaaaagcaaggccaatgacaccacacgacaaaatgggaccggcatttccgctctcgcggctccttatcacgtcctgtgtcccctcccctaaaattgtaaaagcaaaaaataaatgaattcactggaattgttaccaaagtcatcctttcgtgcatgtacagcgactgagcgcccaatgatgttattctgcccatacagtgagatcactttgtcagaccaattacttttggcgactcccttcggatcagcggtgatatttccaagatctccaacgtgacgactgacggcctgtaaatatttcaaaacaggttacttattaaacacatcaaagtgaagtttgagaattgtcgctgttcacgaattaaataatttgacaaaaaacctccggtggcccatgtttttggccaggatgactgaaatgctttccaactgaatggaaattgcccgaagacacagaaaggtcgccgaactctgaaaaaaacaccatttgtcagaaaatctaagaacaaattaacgattgatcgtcagcgcatgctgctggtccggcccgaggccgctgattacaaccgtaacatgcacatactctccatctttctaaattttagaatttattttggattattttaataaaagcaaattgcctgctgaaacacgacggttcccacaccctcttttgagtctgcccggtagtttgcgagcacgcaaattgccttcttgtcgggtgcctgttaaggaaaagtgttaaatatgaaaacaattaagtctccttttcagtgtcgctttcttagaaattcatgttgatgcgagtaattccctcaaactgtacgtacttgcggcacatccatcagtctgtccagagccaccataacgttgttgcatgcgatatcatcacgcgccgtctgtctcacaatgttccaatcttgtccagctgctatcgcgtcttgatagttctctttgagcttgaaaaatgcctaaattaaattgaatttcaaataaaccgtctcaaaaaggctcaaacagcgaacaccgaacacaaaaggaaacgcacaaaaaaaccaataaaaactaatggaaatgagaaaaggaaggaagaagagttaatcaccacattcagacaaaaacgtttaaataaataccaaaaataaaataacagaattgttagtgcaaaaataaaaagacaagtccaaacagcaacaacgaaaatttaaaaaaaaaagcggaaacatccaaaatcatactgaaacccaaattttccgccataatgaagcacgaggtagcattaaattgcataaaacaagggacgagaggcaaatgctcgcgtgggcatgttctcttcgaacacagagaacaatttcgaacaaaagttcggctgggagtttccttcccatttggtcgtcggccaaaatgttctaccctgtgtttcagtttcaaaatccatatcaatttttgaattcccctcccacaaacttggaggatgaatttttgggaatttacagctgttaatcatacggaaatagaaaaaaattatacagaagattggatgaaatttttagaaggagaagtcggaagggagccgtcgagaggataactgtaaacgaacggaacagactaattttactgtcataaggggtggacggccacccaaaagcaagatttattatgctaggaaaaccaaccgaatcatccattgccgtttttcagttgattgtgatggaaataaaggtcaaaaacgaaacgaataaatctaaacaagaaaataactaacgccgaaataaatattattaataagaaatttaaatgaagacaaacgaagacaaagcggaatgaagagaagaacgactgatgagagaatgggctctgctgaagacagaacaatgcccgggtaagaagggaatcgataaatggagtatgcgacgtgcatagctgcccgatggggtcaactgggcgtcgccaactgggcgatgggaaccggtcacttaggcgcggccacttcggcgcggccacttcggcaccctatataaaatgactatttcggcgccgaaaaattttcaaaatttttttttcaaaaatcttgaggaaaccctatcaaaagcaaaaaaaattctcgctcatggactacatcatatcgctgaagagattcgcaaaaagacgtcgacgaattaatttcttctacgaaagtggtgtttcgcaaagcgccgtcgcgcgttgctttctacagaaagaaattgccctcagttcctctggttcccaaacccattatcacacgatggggcacttggcttgatgccgtcacttttactc

SEQ ID NO: 5388 - DNA, 1853 bp, Heterodera glycines
ttttattattatgcaattaaaaaaataaaaagttttattcaaatgaaaattaataatttatttgttgtctctcatttttttaagtaaaaaactataatttgttgagagatttttcatttgttgagctttgcatgaccccacattaattaaacaataaaacagtgaaacaatggtgaataacgggcagcagaagaagggagggaggtcaattaattatgatttaattattctctaatttttattttacaattttaaaaacgttacaaaattctggctaatagcgaatttgttcactttaaaataatttacaaattgaattatatccaaacataattatacaataagtttactaattagtcagcggggacaatgaaatgttggccaattaaagtgtgttaatgatccatggatttgttttgcttctgtcagtctctccgatcagcgcctccgccgccgtcccccgagggtcaatagtcctcgccggtttcaatgtaacggaccaaccattcggagacaaagctgaaaaatgaaaaactttgaaaattgctcaagaggcacgagatagtcgtaaaatggccaacactttgtaaaattatgacaaatcgatctaaccaattaacttttaaaatcaataaaataatggacattttcgttttcaataaattctgattatcggcgatggataagcagcgatggcaacaacaaatcctctcaactctttctctcgccggaatttctgtgctaattttagccaattttatgctcctcaaaattttgttgcattggccgatgcgcaaaacacacaaagacaatttaaagtgggtgatttgaaaagtcattgaagtggccacggtggtcattttgatcattttggtcgtccgtccgtccgcgccgccccggggatttaaagagagcaaataatacaaaatccgacgagctaattgagctgtcttcgtggctctagtgaattttaatgatcagtgccgattccttgtcgatatttggcaacatttttttagtaatagccaaattaggaattctcaattaaaatttcaaatttccttgctaaatgtacggtttttcccgttccaatgcggggaagggttggggagggagaacccaatttcataagaaattggatcattttccgcctcgcgtccatctcttaaaattccaaaaattccaaccccccgcccccgcccccttttttttgatcacaaattatttttactccaaatgcccttctttttacttcgtcgtcccaatccgatgccgtcgttggacgagtggtgggagccgccgccacaatttcaacagttaatttaattggaaaaaaatatatgcctcaaaaaattggctacatgcgtttaggcaaatgcaaaaacaacgactttggcctcaattggcagctgaagatggacaaaatgcgaaatggcgcgtggatgtaagccttttcaagaacgagtcatcgtcacaatgttttggcatttccgcttcgccaccccaattcttcgggctaattaattgccggtcactcaaatcggcacaggcacactgtgggatgtcaaatttggcaccgaaccccaagcacttttttgtatattcttagctggacttgtacttgtgacttgtaaaattcgggactagcgaccgaatgactcgaagaaatttctcgagaccaagaatagaagagaactctgcagagttgagagggtaaaaacccaactcgtactaggccaactcgtactgccccaactcgtacttttttcgacaaaaaaatcgtcataacttttgttaaagtcgggcaaattaaacattcttggtatcattcaatagcccttaaaattctctat

SEQ ID NO: 5389 - DNA, 4859 bp, Heterodera glycines
ttgaattttcatttcattccttttttcagagtgtcgtcgatgtgtcaagtttgccgtggttttccgaagatgtctctgaacgttctgggagttcttctgatgtgagtgccacccagtgatacaccgctccttaatgtatttacttgctctgtttgtatatttctgtgtatttgtgataacactgctccttaatgtatttacttgcctctgtttgtatatttctgtgtatttgtgataacaccgctccttaatgtatttacttgctctgtttgtatatttctgtgtatttgtgataacaccgctcctcaatgtatttacttgcctctgtttgtatatttctgtgtatttgaataaatttcatttaatttgttttgactaatacgtccatgcgtgatgaaatttggccaaatttattgacatttccttccccattcaaacaccgaaaagtccttgccaaatgatttgcaactagaggcgaatgaccttttgaaggcgggggccttaaatatcaataaggctatacgccttatgacaagcgagatttctgccagcactgatgcttggaagtcatcgcacgtgcgaaagaggccattgatttgccggaagacatcactttgtggtaaattttggaagtgcggcaaaagtggggccgacttttaatgattcattttggtttccaaaatccattggtatttccaattactatcagttttcatttttggcacttttggaagtacggcaaaagtggggccgacttttaatgattcattttgggttccaaaatccattggtatttccaattactatacatatttagtaacctttcggacatcagacaagattttgacctcacgaccaaactggcaaacccagtgtttgaccagacgatggtggaaaagcccaaggacgcagccaaccaggttttggaaggccccaaggactcagccaatccggtttttgatggccccaaggactcagccaatccggttttggaagggcccaagaactcaaccaatccggctttggatggccccaagaactcaaccaatccggctttggatggccccaaggatttggatggacccatggacgcagaacattcggaatttttggtaagactaatttttgaattttttttgaacttttgaattaaggaaaaattgaaaattatcatcgaccggaagacgtcgcaccaagttgatatggagaaagttcatatcttcaacgaaataatggacaaaaaaaaaaatttcgcgccgtgctgtatgcagcacattcaggaaaaaatttgtgccgcgtgaactctccatttggcgccagttggaccatccgaacaccgtccgcatgcacagggatttccgagagtctggctatctgttcgaggtgctcgactacgcacagaaaggcaacctggtgagttcgatcaacgcggtggtaatcactacactggactgtttgaaaatttcagcatacctacctggaacgacacggcccacttgacgagacgatctgccgggcgtggatgcggcaactgaccaacggagtgtcctatttgcacgaaaatcgaatcgcgcatcgggacttgaagccggagaacattttgctcttcgaacgtagcgttctcaaaatcaccgactacggcttcgcgaaacaggtaatgaatgccacgcttcaacacaaacgttcaatttcctttttcagtgcgatgatggcgacatgtcttcaaccttttgcggaactaagctttacaaggccccggaactgctgcagaaacatgaatatgacccgttcaaagcggacgtttggtctgtttttttttcgtttccattcgctgcttttttcatcttcccttttcatttcaggtcacttggcgtcatttgctttgttatgcggaccaacacaatgccgttcagcagaggcgtgagccgaacacacatggtggaggaacagcgaaacagtcaatatcgattcccttctcacttggtcatcagtttgcagtgtcgcggcgccattgacacgattttgacgtttgatccggagcagcgtccggtgagcactttttttgtgttttttgaattttcaatttcaattccttttttcagagtgtcttcgatgtgtcaagtttgccgtggttttccgaagatgtctctgaacgttctgggagttcttctgatgtgagtgccaccagtgatacaccgctccttaatgtatttacttgctctgtttgtatatttctgtgtatttgtgataacactgctccttaatgtatttacttgcctctgtttgtatatttctgtgtatttgtgataacactgctccttaatgtatttacttgctctgtttgtatattgctgtgtatttgtgatacacctctccttaatgtatttacttgcctctgtttgtatatttctgtgtatttgaataaatttcacttaatttgttttgactaatacgtccatgcgtgatgaaatttggccaaatttattgacatttccttccccattcaaacaccgaaaagtccttgccaaatgatttgcaactaatttatcgaatttttgtctgctgcttgaacttttcaaaatttttttgtgataaaaaaaccgttaaaatttgtttctccgtggttttaagggtcgctgatcacgaatttgacatttattttgaccaatttctaatcccgaacccgaacaaaaatcgaaattttgaatttttcggcacttttccagttttatacaccccgaagcttccagtttatacactcccgcaaaaatagtggaattttataaaaagccaaaggggggacccttttgttttgcaaaatttttttgtcataataaatcttttataggggttttcggtgtccctgatcatgaatgtgccactaattttgatcagttccgaaccaaactcggaaaaagtagaaaattcaaatttttcaagttacgactttttttgttcacgtttgggttagggtgttttatcgaaatggtaccaaatcgaagtcgttcattggagttgcccgtaaaagaaccgtgaacggcacaatttatcgcagttaccccttggagcgttaaattgtataaatgcatgtctcaaaattcaatgctgacggtaaaattaaatcagtttaacatagggcccggtgcggggcgggatcccgcgctagattaggcgcaatcccgcatttttttgggggaattgcgggattaatccagcgggatgaagtcccacaaaaacttgagttccaatccacagcaggatccgcaaatttgtttttttttgtgcgggatcccgcaggaatcggcattgcattttttgaaaattcattaacagaataccaattttctgaataaatttaaaataaattcaattaaatttaaaacagttttccatcgtatttcatccaaaatttatgaaaattttcccggcggtgcctgttggctcgccggactaacctttaagctgattattaattctttaaatattctcaaaaagctacatttggccatttttggacaaaatctattaacaaagccaaaaaatttcaaaaaattttccaggcgacacctaattccaaaaagtttctaacaatttgaaaatgggttttttgaaaggccatggccaaaaatatacgaaaaaacaatgtaataagttttcttaaaatttgattattaacagaagatggtttgattttggttatttatatacgctatttccgacaaattgttgttacctatttttttctaaatttgacttcccctgtgtttagtgtatataaatggcgcttttccacctttttctccattattctattctttttcttccgccctatattttgacccctcggcgtcggcaccaccctaagtaattaatattctaattgttttcttttttccaattttaattttgttttcccccctcattaagcaaatggccggtgactccgaacgcgacacgggcaggcatcatcaccacaggcatcatcgacatcgtcattcagcgcgcaccgttttgagaaatttgggctaccaatcaccgcacaaactgggcagtggacaatacagcaaagtctacaaaggtggttcacaattccatgtgcttttccagcaccatttcccttcccttttcagtgtttgatgccgaacgacctgccgggcgtggatgcagcaactgaccaacggagtgtcctatttgcacgaaaatcgaatcgcgcatcgggacttgaagccggagaacattttgctcttcgaacatggcgttctcaaaatcaccgactacggcttcgcgaaacaggtaatgaatgccacgcttcaacacaaacgttcaattttcttttttcagtgcgatgatggcgacatgtcttcaaccttttgcggaactaagctttacaaggccccggaactgctgcagaaacatgaatatgacccgttcaaagcggacgtttggtctgttttttttcgtttccattcgctgcttttttcatcttcccttttcatttcaggtcacttggcgtcatttgctttgttatgcggaccaacacaatgccgttcagcagaggcgtgagccgaacacacatggtggaggaacagcgaaacagtcaatatcgattcccttctcacttggtcatcagtttgcagtgtcgcggcgccattgacacgattttgacgtttgatccggagcagcgtccggtgagcactttttttgtgttttttgaattttcaatttcaattccttttttcagagggtcttcgatgtgtcaagtttgccgtgttttccgaagatgtctctgaacgttctgggaagtcttctgatgtgagtgccacccagtgatacaccgctcctaatgtatttacttgctc

SEQ ID NO: 5390 - DNA, 3231 bp, Heterodera glycines
ggacattcgttcgctgcacgtcttcaggacgggccattcgcggcagttattatattctatgggggatattcggccgcttcgcggcctcaggacgggcgcttcgcgctctttttaaattttgtgggggacattcggccgcttcgcggcctcaggacgggcgcttcgcgctctttttaaattttatgggggatattcggccgcttcgcggcctcaggacgggcgcttcgcgcttaaaaatcgaatgcattttagtttaaattttttttataataaaatactcgttttattaattaaaaacaacgtcgaaaattaataattgaatatttgtttaatttgaaatgaaattaatttttttgcaaattcaaaaaataaataatgaaaatttttaattaaaaaaaattaatttaaataatttacatcaaaactattttaatttattaaatgcagtgaaaattacccaaaaaatgaacagaaaaataatgtacaccgaccggatccgaacttgccccccgccccctcaaaatgatgcctcagaatccccaatcacacagggattctgaggtcttaacgatgtcaaaagtaaaatctgattgcgtattcgtgatcagcggcccaaataacccataaagacatatttttggatgatttttgatttttaattaataaaaatatgtaaaaacagcaaaaaatacaaagaaaataatttacacagtccggactcgaacttcgcccccccccccaaaaaagatgcctcagaatccccaatcacacagggattctgaggtcttaacgatgtcagaagtgaaatctgattacgcattcgtgatcagcggcccaaataacccataaagacatcttttttgaaggtttttgtgagaaaaatttttccactcaaaaatcctggtcacccaacatgatttaaaatttaataaataaggaaattttttttattaaatattaaaaataaaatgcattttaattttaaattattaataaaaaacaacgttgaaaattaataatatttattttatttaaaatgaaattaatttttttacaaattcagaaaaatattaattgaagcaaaatattcgatattttataaactttaattttgaccagaagcagtttcaagcaaatatgaaaagatgtttatcttattatttgttacatgaatttataaaatgaatggtatttttaatattaaaaaaaatgagtacagcagttgattcataaaaaaagtattaattaaaataaaaaatgttttaattattactaaaaaatttaaattaattaaaatcattgaaaataacacaaaaataaatagaaaaataatgtacaccgatcggatccgaacttcgccccccccaaaaaaatgatgcctcagaatccccaatcacacggggattctgaggcctaaacgatgtcaaaagtaaaatctgattacgtattcgtgatcagcggcccaaataacccataaagacatgtttttggaagatttttgttgaaaaaaatttttcactcaaaaatcctgtccaccccctttggtcccgaatgccagaatcacttttatttttgtatctttattttaaaagatgataaaaaggtcaaataaaatttatataatagagcaaaaaattgcggatttttgtagtattttactcttctctaatgacttttcagaaccgagatataaatttttttctgaaaaatcgaaaatttccagaaattctggaataactttttttgtttttgaggtataaatttcaaataaatctcataaaattctcccgattttttgctattttttatgctttaaatgagctgaattggaccattttgaggcgagttatgaattttcaaagaatcacttaaattcccaaatccaaaaaattgacgatttttcaaaatttttttacctccctccaaaaaatccaaaacgcaatataaagtgcatattcgtgttcagcacctcaaactaccccagaaaagtattttttggcaattttaggagcaaaaaaatttctcacgaaatgcaaatccatggggtcccccctttggttttgcatttaaaaattcatttttattttatatctttttttatattaaagataaaaataccggacaaagcacattagatagagcttaaaattctctacaaaactgctctaagacaatttttcgctaaaatcaaccgctgacgagttataggcccgggactgaaatgtcccggtcaggccaaaaaatttttctatttccggacaaaaatggaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcccgaaaaacggaaaatgccgaaattgggtgccaaattttgccattttctgcagcattggcatttacagatagccccgccaaataagcgccaagttttcccaaacagtccaacttaaaatcctacctccaagcattttccgctcccgcttcttcccgcaaagttacaggccaccaaagacggacaaaaaaaatttcacgccgtttcagcgccgccggcgctgaaccgtccaccggatcggaatgccgatagttttcctgaatgcgcctcaaaaagttgtaagacccttccaccactttcagacccatcccgacagccgttcgactcaaattagtttttaagacgaactgcaacgtttctctatagtagtataaactagcgtgttgtggcgcagtaattgctcggtgtagacagtatgctttgcacagtaattgctcggtgtagacagtatgctttgcacagtaattgctcggtgtagagtatacttttggtatatatgggcgggtgctgacatgagcgcttcgcgcaaaggacttcgttgctagtgcatgcgcgtttgataagtgatgagcaagtgcattcggctgcttcgcggcctcagacgggcgctttgcgcttctaaatattgtggactcattcggccgcttcgcggcctcaggacaggcgcttcgcacccgttttttaattttttggggggaattcggccgcttcacggcct

SEQ ID NO: 5391 - DNA, 1120 bp, Heterodera glycines
  misc_feature (88)..(88): n is a, c, g, or t
aatattttaaattaattaaaatcattgaaaataacgtaaaaatgcacagaaaaataatgttacaccgcccggatccgaacttcgcccnccccctcaaaatgatgcctcagaatccccaatcacacggggattctgaggtcttgacgatgtcaaaagtaaaatctgatcacgtattcgtgatcagcggcccaaataacccctaaagacatgttttttgaggattttgggtgaaaaaatttttccactaaaaaatcctatgctcactcacccctttggtcccgaatcccaaaatcacttttatttttgtatcttttttttaaaatgtgataaaaatgtaaaataaaatttatattatatagaaaaaaattgcggatttttgtagtattttactcttctctaatgacttttcagaaccgagatataaatttttttctgaaaaatcgaaaatttccagaaattctggaataacttttttattttttgtggtataaatttcaaataaatctaataaaattctcccgaatttttgctattttttatgctttaaatgagctgaattggaccattttgaggcgagttatgatttttcaaagaatcacttaacttcccaaatccaaaaaattgacgatttttcaaaatttttttacctccctccaaaaaatccaaaacgcaatataaagtgcatattcgtgttcagcacctcaaactaccccagaaaagtattttttggcaattttagaagcaaaattatttttcataaaatgcaaaaccatggggtcccccctttggttttgcgtttcaaaatttatttttattttatatctttttttatattaaagataaaaataccggataaagcacattaaatagagctcgaaattctctacaaaaaagctcttggacgatttttcgttaaaatcaacccctgacgagttatgagcccgggactgaaatgtcccggtcaggccaaaaaatttttctatttccggaaaattttgaaattttttcaaaaatgccaccaatcgatagagctcgaaaaaaggttgcttgaaagtggtctccgttttcctgggaaaaatagagaaaaaataataaaattcaaaaacgaaaaattttcgag

SEQ ID NO: 5392 - DNA, 1299 bp, Heterodera glycines
  misc_feature (23)..(23): n is a, c, g, or t
ttcaaagaacaaggtggaaatantcgcgcaaaataaactccccccccggatcttttaagttttgttttgacggggaaaatcacatcggattttttgtcagatatttgggttaattacatcatgatttccagggcaatttgcgtgattttctacgttcccatcgtcctggtgcggaagagaacaaacaaaaccgctctctgccaaccgctgaacagtatttcaattgggctgctcaaattgcggacggaatggcctacttggagtcgttgcggttttgtcacagggatttggcggcacggaattgcatggtaagccaatcccaagtgctaaaaagtgccaagattattttgatttgttttccaggtccatgctgacgagtctgtcaaaattggcgacttcggaatggccagggacatttattaccacgagtattacaaaccggccgggaaacggctgatgcccgtgcgatggatggcacccgaggcgctcaaagatggcaaatttacgctgaaatccgacgtttggtgagtgtgggttggctaactgtgtccatttttcacacgattttcaggtcctatggaattgtgttgtacgaaatgttgacacttggtaagcgataaaaatttttcaacaattttacggaggaaacataatgcctccgctcaataaaaagtgtattttattctaataaatgggtttttcattaaaggacagcaaccgtacgctgggcttggcaatgaccaggtgttcaactacaccggtgtgcaaaggcacgtgttgcacagaccgacggattgcccagacttttggttggtcaatttgaatgcatacgcaaatttcatttcgaatttttataatttatttttaaggtatgcgctgatgctgtcgtgttggagatacgacccacgagaagtaaataagactcccaaagcaatggcgtggtcaattccgtgcctctgggaggcatccatggcgacgaattttttctatatacaaaaaataaagaacttaaggggtaaagcactgtgcctataggcgtagccggaaaactaagatttttaatccattttaaaatcctcacaattttcaactttgttttctaaattcaagacattttttgggccccaaatcccctgacaacgccatttgtcataacagccatttaagaagtttaacaaacgaatcacatttatttttaaagcgtccatcattccgtcaaattgtcagacacctcacaaccagttgttcagattttattgatgaagagttcaaagtggttggtttttatctaacttttta

SEQ ID NO: 5393 - DNA, 1740 bp, Heterodera glycines
acaaacaaaaacttgtctcatttcgtttcaaacagtttctccaacattctgttccaatttcgcaacgcaattgcggcggaggaaaatccggaccgttcaatgatggcgacaaagagtctggaagtgctgatcagtcgggtggacgacggactgatcaacgaagtgagcagcagccacaccgaaaacatgcgtccgctaattgttttgttgttgctattgcctttcagaatgcccaaatccttctgatcgttttgaaatcggccgtcggtgcgaccggcgaactgtgcatttccatgtggttgaaatttgtgcagaaattgcgtgccaatgtttttgctaatttggcatcacagggtacgcacctgactgactattgaacacacttgaaaatgatggtttaatctctgcacttcctccctttttagtgcttgtggccatctcaccgcttatgaagtttgacgtgtcaaaagcaatattcaacgagctttttgtggtcagggcgacggaattggccagttcaacaacgtaaagatgaagcgaattattttttaaaacaattaacaagatgtctgatgctttttttgtagcgaaagtgccaaagtgtacagcattttgctggcaatgatcgacaacaaagcgtacaaattgggccaacaccttcccgaccaaatgtctctcaaactgtccaccgaatcgcattttgccatcgttaaaagtgcgccatcgtccgctgtttcatctcttattttgtcatttttcgcttttgcttaggctgtgccgaactgctgctgaccggcatggtcgacctgtaccaaattgtgatggaacggctgctgaaagtgctggacggttgtgacctgttacagattgattccagccaattggtgtgatttgcgaagatttaaaacaagtaaataatctttttccatttttaaaactaaggcaagggcactcgtcttcgcactgcaccgaacacaaaacagagagctgagggaaatgattggaaaatgtgttggcaccatcggactgctcgaccttgacggccgaacagcatcctctcgacgaagcaatcccattgatgatgatgcaaatgcgactgcaatggccgaaattgtttctgttgacaacaaagtgcaggttgcgtaacggtaaatgccaaaatagtttaaaaaatttcgtttttcagttcaccgtcaacttcatccatggcattttctcaagattggacgaatgcgaacagtccgagacggccgtcaaactgcacgccgtcatctcctacattctattggtgccgctcaaagagcacgggatggacgaacaaatttggaagaagttggcatcgaatgtcgtcgaggcattgaacgcgtcacggcaaaatccgttccaagtggaccaatcattcaaaattgacgacctcttcaataaaaacattccaatggggggacaggagcagcaacatttgtacgcactttaatttaaaatgtcgccgggttctttcaaaaagccaaaattttcgaattttttgtaaatcaaataaaatatacgggtcaattttttgttgaagggcgattattgaccagtcgtgcaattttcaacaatgggtccgcggtttgtacttcttcatttgtgacaaggtgggaattataatagtgtcacagaaaaacaaaacggtactctgtaccaggggggtgtaaggggggaacaatagcctaataagtagttcaattttcaggagggaaa

SEQ ID NO: 5394 - DNA, 3956 bp, Heterodera glycines
ttctcgggggggaaacgagctgctcccgtaccagggatggttccatgatttggcatggggaagggttgtatcaaagtgcgaacgggcgtttccccctcatttcaaaatttattaaattaaaaaaataacgtgtttttctacaataaagtcccaacccccttaattaaggaaatgctttcagattggcgacccacttttgcgcactttgttcgcctctttgtgctgtgtgaagcacgacgcttcaattctgggcagaacaatgtctgtccgctttactatttttggtgttttatgtgtaaattttatggtggtttccttttttgaaggtgcaaaaacatcccccacatgatcatccaggctttggtcgaacaaaacgacgcaattcttgacaaagtgagagagaacacaaataacttctgattaagaaaaagtttgatcgcatggcaaactgctgcctcaaaaatggctaattcggatagctaatctgccattttcgagttttttttttcagtttgagcaggaggcacttgcggtgttttgcgcggtggttggaggccaaatttgttgggccaacgacgcgatggtcgctatttgtgccatagtggacgcaatggaacgcttctttgttggccgcactgctgctgcaattgttggcacgaggccaaaggacaaagtgagttttggacgaattttgatcaaaagtgaatgggactgatcagagaataatccgcaggactttttctttcatcaggcttaatatttcagtaattaataatactgaataatgcttttcataaaaatccaattttaaagttgacatgtttcttccaggatgtcctttccgaacggtttgatgcgttgatcagcaaaatccttgcccaacccaacccggacagtctgacggtggtgccgttgagtgtgttggccgcccaaaagtgcaactaccactttcggtcattgcgttggcttgaacaattcgccgcgtcacccaaaaacggcacagatggcgacaacggcaattttcgacatgacttttattttcttttggaggtgcttccactttgaccccccccccccgtcgtaagaggcctcggacacccccctcccccctgtcccaatcgtccgtcgtatggtccttgggtgagacaccccttgtacatgtatgttatagcatgagaaatgcaaattgaatgggtccaacacatctccgccggaacctcgccgcaaaaaaaacttgctttttcattgaattcttagttaaaaaaaaaaaaaaaaattaaattaggcttgataactaaatttttgatttttccttgatttttttcgacgacgatatgttctttttgtccagctctcaaattgaatacaattgaaaattcatgaaagaatccccaattttattcacccttcatccattcattgcccatgttcttttatttttttgacattctctctgttcagcgactgtattcccacttgggcaattcggacggagtgttgggcaccttccaaatgattcgcaaccgaaccatgccggagccatttgagcaaattctggcactgaaagtgcagggcaattatgtggacgcgttgccgttgtgccaacaattggtgggacaggaagtgagtggaaaagaattcgaaactcgggataaatgaatctttgggcgtagaatttaggagaatttacctcccaaaataatattcagaccaattcgaaaaatcaaaaattattggacaaattttgtatttgtgccatttaaacgttaaatatttttgcctgttccagaatgagatagtcaaatgtttgttgcgctccaaccaaccgttgttggctcaaacattcattgagcgcacattgcgacacattgaacaacaacaacatccgaaccatgaaaatggggaggcaattggcgccactgacggggaaaatggtgccgtaaatgctggagatgatgccaaaatggccgcaggcgattgcagcaaaagtcggcgactgcgcgagtatcaaatggaggcggtgtgcaagttgggcgactgggaccagctcgccatgttgcatcacaatttggtggaggaaggtcgaaacagaaacaacaacaacaacggtggaccatcccaaaatgtggaaagcgatgcgcaaaacggtggcagtattgagaaatggggtgcaaaaatggcagcaattttctgtaatttgcgccaattcgacttgaaaagctttggtgacggcattgaacgggcacgcgcttcgctggtcgatgcgttggagcgaaccacgctggaggactcgagcacaattgcgcaggcgcaccggaacatcatcaagtgattggacgcaaaataaaattttttatttaatttattatttgcatgttgaaacgtaattcaaacgccattaaattttaaaaaattctaaattgacaagctgcttcgctatatcccaccttatcttcttattgcaaactgatagactttgattatttgaaaatgcaatttgctatttcctatatttagactgaggtcgctgtacgaagtggagagtgtgcgggccgtgctctactcgggcggtgacaaatcagcattgttgcggaagaccatcgccgattgggaggtgcgtcggggttggggatgagtaacccaatggacgttgagttttacctctgtactacttcaactttttggccaccaccgctttagcgccagtccgacaattcgctgtccttcgccggtcgttcggagcgtgtgctttcactgcgtgcggaactgttgcgcgtcatcgacttgccaaacactgcgctcacccaatgccgtctgctgctccggtgctccgagttggcacggcaggccaactatttgcaacggtcgtggacatacattgccgaggcgaaggcactccgccgaacgtcggcggtgatggaaaacaccaaacaaacggagggaatggaagcggacacggccattgacatggaggaggccaaatatctgtttcaaaaggcaaaaaatggcagaaattcatgaggattttttaaacatggagcagttcaattttcccatcaatgaatttttaatttttttaactaaacaactcacatgcatttaaatttaactaaaattagtaaaaattgggttttcttttacaaacttaaggaaatttaccaaaataagaaaaatattttttccttcaaattccttttttgaaaaatttcaacaacattttaactttaaatttcttgttgatggggaaaagttcaattgcccctgacaaaaatatgcatttaattttcgacgattatttccattttcgaaaaaaactgttttcagggtgaacagttccaatcaatcaatttgctggagaagaccattcacacaaattttgcggaactgtgcaccgaactgaacgcacttaaagtggacatcggcggggggatcagcgacggcagtgccacggcgaaaaggcttaggaaatgtgtggtgctacaacagaatggggaacaggacggaggaggagcggacattgttgaggttgctcaaccgcaacagcagcagcgcagggaaaattttgttgaggtaactgtcgtcaatttaatgtttttttaaatttttttttaatttgacattggcctccactactttctctaaattttgtgaagaatttgcagttttcagtcttattttgtaattttaaaatttgtgtatgtaaagtattttgttggacgcaaatgtggaatacctacctggaaaagaataccgtttcaacacctaggcacaaatgctgctggccgagttcaatgagcgcgctagtgccaaacaaatggacgacttgctcaacacgtacaaacggttggaaaagtttgggcagttgaccgagtctttctactaccgatatgcgaccttctacgacgtcaagggcgagtcggccaaggaggtccgtgtttgtattttgttgacctgca

SEQ ID NO: 5395 - DNA, 1758 bp, Heterodera glycines
  misc_feature (13)..(13): n is a, c, g, or t
caaagtgatttgntatcattataaccaaaattgttagcatttacgaatttgatgtttttgtgtgttagagatgtgaaaatagtacgccaacacgagaggaaaagaaatgcatttttactttttgaactctactacaaaaacgggatgtctaacctaaaacatttgatatgttcgatgcagaattttctgctatattttctctgcacagtggagttgacccatagtgttcttgcaaactaaatattgattaaaaatttaaattttttgattctcaaaatgaatttatgaaaagtttagttttttaaatcctaactttgaaattttatcattggttagataaaatttgaagcaattaaaaaatggctgatcgtgcggggttccaaagtggatttggtggtgctgctccaccgtcggcgcgtgggcgtggtgggcctcgcggtcgtggccgtggcgctgccagagggcgaggacgtggaaaggacgccgagaaggaatgggtcccggttactaagcttggccgtcttgtcaaggatcgcaaagtccttacgattgaggagatttatctccactcgcttccgattaaggtttttactttcttttctttttataaagcttatctactatttttttatcattttaggagtttgaaattatcgatcttttgctttctggactgaaggacgaggtgctgaaaattatgccagtgcaaaaacagacgcgagcaggttggtgaaattgcattgggggcatagaagacgcccaaattaaggacagcgaactcgcttcaaggcttttgttgcaattggtgaccacaacggccacgtcggactcggagttaaatgctcaaaggttttgccattcaatcattaaattaaaccttggagatgaagctttgttttcctaattcaaaatccaaataaaaatttctttgttgatcttccggaaaaatttttgctgcggttttaatactgatcaacaatcaacatcctttttggttaatctgtacactacccaatttgaataaaaaaagaaaattcgattgtttccgagccggagtacgtaattaaccaaagtggacatattattcctaattcatcgacccttgctccatttaaaaatattctaatttaggaagttgccactgcaattcgcggagcgattatcgccgctaaattagccatcattccagtgcgtcgtggctactggggcaacaaaatcggaaaaccgcatacggttccatgcaaggtttctccttcatattcagtagtattctaatctgcaatttctttttgctgaagtttaaattcattagtccaaaaaaccgctccatagggccaaatataatgcggatttaggtattaaaaattatgcttttcttcaggtcactggcaaatgtgcatctgttctcgttcgactcattcccgctcctcgtggtaccggcattgttggtgcgcctgtgcccaaaaaattgctccaaatggctggcattgacgattgctacacttccggtgggtgtgtgtggttaaggatctgtaatcggtacgggtgagaggcaatttctgtggcacctattggcaacacgtaccccagctcccccaccggacccctcataccaaacttttggtttactccaccccatttcattcatcttccttggaaagcacattttcctacattgtgctacatttaccctttttagccgttggccaagacggcaactctgggcaacttttgccaaggcgacttactacgccatcc

SEQ ID NO: 5396 - DNA, 3789 bp, Heterodera glycines
cagggtaccgggtcttgaaaaagccgggtatccgggtctggacccggtcgggtacccggacccgtgtaaccctaaaagaaagaaaacaaaaaaatgaaattaaaaaaaacgctacgccaggaatttatatgaaaagtcacttttttttgtcccgggattcccggcacggcggggttccggtctcgtcggtgctctaatttttaggcagaatacctaagtaaggctggaaatgatgtttcacagtttgaaaaaaaaaattccggctcgtgtgtagtttaggccccatacacaaaaatttttacatttcagaataaaaaaagccaatctataggttttcggggtcgctgatcgcgaatccggcatccatttcggccaattccaaatcccggacccgaattcaaacaaaaagtcataaaattaaaatttttgtatttttcatttttagtctaaaaatggtttaaatgatttttaattgaagcactgatgactttcagttcgtttccgtgtattttggggcctaaaccacacaagagccgggaaccctacatttggggatttcaatgaaaaaaagttaattaatagggattgtttttttatgtaaatacatatatttttttcctggattctccatagcctaattagtaggaaaaacactttcttttttgtgtttgcgaacaaaagttgggacttctatttacatattttggactttttcgtacatatttcacaaattttcgtatatattttcatttttttttgcatattttgaggatttgagaatttatagaaaattttttgctaaaaattaaaaaaaaatttttgaaaatgtacagtatccctaagaaatctttttttttcaaaatggatatcaaaaataatttttaaaataataaaaagtgattctaagccaatttaggtaatttttcaggcattttgtacctgtttcaccctttactaggaatttttttcaaattttgggttttttgtacatatttcttaaataatttagcattttctatatatattctatttgcatatttcgcgatttttcttacataaaaaaacaatccctattaattaagtgttaagccccaacgtctgcttttgccagagttaattccattttgtgaaaaataacaatcgggcgccccactactgctctgtcttcgcatgctcgctatcggcgggggctctccacgtcctcagaaatagattcctgccaattataaaccgcgaggaaccgattgatgtatattttttgttgcatttttgtacgttttgaggcttggatcagtcccaaagccatttggccacttcagtcccgggtccataactccgtccaaagtgctttccgccaaaaaattctttcgtttcatgcattacagaccaagaagcgtcgattgatctatcatttgtgagaaatgatttagtgcaaaattctagacctttaccctcggtcaatgtgttgtaaagttgactcaaatccaaaactttttttgaattttttcgcctgtaactttttttgcaacttaatataattttgtgctttataaactggtggtttacatagttattaaaaaacatttattttaattgcccattttcacagcgactcaattttgggctttctgttcaaaatttcatgaacggaaatcggtaattaaccgaagtcaaaaaattattttgtaaatgccaaatttaccatttttctcattactgttttttctctgtttctccggaaatagaccagcaacgaatgctaaatggataatttatcgcggtaaagcacttatcttagcagaagagtgaatgaacaaaaaggaacggccaaaagcaaagggaggggaaaagaaagggggcgatcgatacggcgggggcaagggaaaagggtggcaaaagcccataaatttcaacgccatgtcaaagccattggcagtcccatggcctttttgtttttgttttgaaagttagcgatgttttgctgcttccaaaattgtaaatatgccgaggctgccgaaattgaaatgccaatgacgcaattccatccaaattatgtggaaagtctgtgggaacttttgtcatttgttacatttcaaacacaaaaagggtgtagtgcatgatagacccagctattcaaccccccgagctaagcatggaacaatatgtcgcgagctgcgaacatgccaaaaaaccgtcctaaaactcgaaaatgtgagagatttcgcactatctttttttcaaacgatcgaatcctgacaaatttggtaccatttgaaagctcttgacgagcttaatctaaaaatcgggaaataaagtcgaaccgatgccatctgaacactgggacagctgagtcccagtgaaaatggacacttcagtaccaaaaaataataatcgggaaataaaaatttaaaagcaaaattcgtaaaagggagcatgcgaagacggagcaagtagtggggcgagacgtatggcggaggaagcagtctgacgagcgccacaggcggttgattttcactgggactcagctttcccagtgctcagatggcgtcggttccaatttataccttgttttttagacagctcatttttagttgctaaaaataaaaaactagaaaatagttgctaataactcgaaaagtagcttaacaacagccgaaaaaaactcgtgtttcgtgcattttaggctacggggagctcaggaaaaaaatgaaaaaactataaatccgatccctactggcaatgaaatcttccccgcaatgaaagcgctggcaatgaaaccggacaataaaagcgcggcaatccgacgataaatccgttccctgataattatccataaaaaagattggttctagtcggttttatgcgtcccatgaaggattatgcgtcccatgaatgaccatccccagtttcttaggccaggacttttttcttactttttcaatacccatatccttggtaccaagcgaaagataaaagtctcgagattttataaatgcaagaaacgagcaaataatggcattaaaaaagaaattacaatgaaaaaatacgaaattcaacttttacgagtataattttttgtctattgccttcagctaaaaataaagttatataaaagcttctatagaccttaagcttttgtttaataccaagaatatgggtattgaaaaagtaagaaaaaagttatggcctaagaaactggggatggtcattcatgggacgcataatctgtcatgggacgcataaaaccgactagaacccggtttttagtcctaattttaatttaaccaaatctgagatcgtttgacaaaaagtattcataattttgctcgagagcaaccaaatttcgaattctttgatatcattcgatagctcactcaaagtgtgtcctcttctgttagcctacaaattttcaaaatgcatatctttcctttcatggcgtgccaacaatgccaataaaaatgaaggataaaaagaattttatgctttccaataataaccactaaattcgggaaaatttcaaattgagattgaaaattttgtgtgtgtttgtttatcctcctcctctcattgtcagaacaggtcgtcctcctccgccgccgcaattcgctctacgccacccgtccggtccaccaatccgtccatcactttgtcctcctcctccccctcgtcggccgaagtgtcctcctccgcctcgtcgtctgcgccgactgctgccgaatgctcatgcaacagcacatactcacgcgagctgaacccgaaccgcagcacgtccttctccctcaactcgta

SEQ ID NO: 5397 - DNA, 1012 bp, Heterodera glycines
tttgtcaggtggaggaattggtccagcggggcacgtcggcgaatcttcaaagtgtttttgtgaaatcggacgcacagaaagcatcaaaaacagtctttgcccgcgctggaacaaaaagattcgaatcgcttatttcttcgagtcgaagcagcgattgcgcttcaatgtgtgcgtttcgtcacttcaattggccctgtctgatcacaactttgtcccttcccttttcagctatgatattgattcgggttcggatcagctttctgatcacgactttttgggccggtgcgaatgcgaactcgcggacattgtctccgcgcccgacggcactctctcactgcctttgaagtcagtgccaaattcaatcgatcagtcattgatagcatttggacattgattgatcagaaaacccaacaatatgatgttttccgcgcagttatttcagagatttgcccaaccaaagcggacaactcacaatttgttctgaagaaattgacgaggggcagcgcgagtcggtccatttcgtatgccatggggtcggactgaaacggtcgcactctctgctcaatgctttttgcgtgggccgaggccaaagaatgtttttggagttttgccgaccgatggacaacggaaggtggagaaaggggaggaaaaaacaatcgaatggcggagtgttgagcaaaattatgccattgttttaagtcgtcaaatggtccatcggacggagaatgcccgcggggctcaccgctcggcggaatggaagccattcgaagtgagtgttcgccatttgtgcgctggcgagaagggccgccaattcgtcgtcgaatgttacgaattgagagaagggacgggaaagtgcgcgaatgaattaccctatttattattggcactgttttcagtgccgtaatgccatcgtttttcattttgcgattgcttttacgttttttttattttttccctttcttttagccaccgtttcgtcggctcttttcgcacttcggtgaacgctttgctc

SEQ ID NO: 5398 - DNA, 2061 bp, Heterodera glycines
  misc_feature (2050)..(2051): n is a, c, g, or t
aaaattggcttaaaatctcaaagtttggtcattgtagacaaaatgtgttaacaaatcacatgcaaaatttcgaaaattttccggcggcgcccccccccccttttatatgtatgtttatctcgaagaaagattctagaatttggttcaccacatcccgaaacgggacacacaaatttgtttttcctttactttcaacaaacataaaaaatattcattcattgtaaaaatataattggtaacaaattctgtgttgcatcatggaagttttatttttattgacaacattaaaacttgagaactttctttggtttgtgagaattttctgggacgagacgatttattggggagaagagtgagcgacaacggctaaacaaaatctgttgcattgaacagcgaccggaggaagggcactcggaagcgatggtcccttccgaatttgcaaattagcgcagttatttcatccgccaacgcacgccgttgcgatttgggagaaagggcaatgagtgggggacgcgaggaagtggaactgaaattggaataagatggaagcaaattaaaagggtaagttatatgagagcttggctaattgttagccaaaaggtcagtccccggacgttgactctctcacatttcattttcgccgccgctttcctcgttgcctccggccaaattccttccgtccaccaaatggagcaaatggaattgcaaagggatgggcggcaaattctgggaagaaaacaacaaaaattgcattttacatagccaaacgaagtgagcacccaatgcgatggcatcggcgaagggacgcgcggagtgttcgccccaccggcgcccattaaattcaatgcctttgagtgttttcggatggtcaacaaaacggtgagatgaaagtggagcgaatttggcagatgagcgaaaaaagtgcgcgagacgaaattgagcagatcggaatccgattcagaattctaaaaagggaagaaaaagcattgaaaacaaatctcaaggttaatacagtcaggagcaagattataaaactaattaaattgacaaagactaattcagaggggataggcgtacaatcggctctaacaattaaatactaattgttttttgttgctcccaccattcttcggccaagtgtcccggccgcactttccggggcacccgccattttgcgcgcgttcatttcctgtgaccagcgaatcacaatttggaaggccaaagcgttcagcgacaaatggcgaagggtcggaggacagagacgacggacgagcaaagtgcggacgaagggcgaatcgcgggagggcacctgacaaagagaaacaaatgaaagaaagacaaccgatcaatgcgctgaattcggggggaccaacctcattcatcccaccgtagaacaacaacgtatcgggcgggaggagaacggcacaatgccaaagtcgagggggcaattggtggtcaattgggggcacttggcgccaacggtgaatgattctgttgaaagaatgggttttccaagaaaaggagtaatcttttttttaaattttactaaaataaatttaccataaatttcccccagagcgtctaataacactggcagatcctattttttctgaattttggtcccaaaatagccaaatttagcgaaaatagctaaaaaaatttcctattttcccattgcgttgaaaactaagaaaattaaaccggataaaacttcttgactggaacggaacaggtcgctccccccccccaaacaatttttttaaaagaagctcttcgggtgcctctctccaatttttttttctgtataaaggcctagtttgttggtttacctttcatctaaattgtttttgtcgatgtgtcgctgctgcttcggactattcacagccgaacgttcgtaaaatgccgcgatgtccaactcccaaaggtcgctcaaaggccttccggcggtgtcgagtccgccgaaacaaagaatctaaaaaagaaaacaaccttaaaacatggaaatgcattcattactcgacctttttctgcgcttccacaagtgtaaaanngtgacctgca

SEQ ID NO: 5399 - DNA, 3619 bp, Heterodera glycines
cacggcatccgtttttttttaaattttagtttgacatttttatatttttaaaaaatttagtttttggcaggagaggtttggcattttgacattgctaagctcccattctcgggtggaattggttaaaaaagcatgttctcgctttaattaatacagcgattgtttgccgaaaatttcgcgacagatacggtagaaaaacaaaatgccaaacatttgaataattaacaaatgaatgtggggacggatgactcacatttctgtgccacgcatcaaattcgaattggccctccagcggaattggcatcgaatgcttgacaaatgcgtccacaactgcggtttggccgggactgaagcggacggcgtgagtttccgccacgggactttcaacctcaaacggaaaaacctatctatcaatcaatcaatactaacttgatcgagactctcgacactaaggttatagccaggggggagtaaagactcgttccccgaaccgaagaatttttttaatggaatttataaaaaaatatctcttttttaataaattttgtcaaaaaatttctctggcggagcccaaagccactgccggaccccagcccttccggcagaactttttgtgaaaaaatcggtaaaaatgattaagaccgatgagcaaaaaataaccgtcgctcatgagggggaagggggggggcttaatcgaaaatttcggaaaaacttaggtccaaaattgtgcaccaatataaaatagtgtgtccaattggtgccgggtgttggctgataagccacttggccatcaagttggcacagaaatgagccgtggtagacaatttcggtgtcatatttggccgaccgttcggcgattggttttggctgaaaattattttttttgaaattcaattattttacacggcttttctgtctcacattttcggcaattggaaaaatgagatcattgccatgccaagtgacctaaaatttggaaaacttgctcatattttctttattttttcccaagggtgtgaccgaattaaatttaccaaaaacttcgaaaatttttcaatttccaagtgggcctgcccccaatctttgtttgctgtaccaaaattcgttcggccaccacttcgccaccgaatccgccctcagggcaccgacccttgccgtggcacacgcggggccaaggccgtcgtgtcagctgagacgggtcgaacctaccaaagttttttaatttgcagtgatggttgagaaaccgaaaatttaactaagagacgcaatacgatacttaaaaaccctaagccgagactttccttaagtcacagattacaggctacgcgtccgtaaaaaccgtataacgggtccggtcgtattaaatctctctactcaaggccccaaaagccaaaggccaaacaaaaaacgaaaggggagaggtatgcattttataaaacatttttttaagattaagggttgagagggttggacttgctgaaatatttgaaaaaacggagaccggggcaggtcgagactctagacccggatcctgcacgggattttgcgggatcccagtccgcaatcctgaattttttgaaaaatgctggatttgtgggattaatcccatcggatgcggtccttcaaaaatttttaattccaatcccgcagcggaatccgcaaatttgaaatttccggtctctagccgagagcaccggaccggtaaatactttctcgctttggacccccttcctttaattatgtgcaaatgaacacaaaataacacctgtccaccgatttgattccgtcgggaacacatcgatttgtgaagggcgtaaccgcaatttggaaacgacaatcgatgctcatttatttttgtttgttctcttgttttatgtacactgaagtgagcgggggcggttaaaaattcaaatgtaaagaaaaaaatttttggaaaatttgtgcattttatggcattaaaatttgtgtgtcaaaattgagagcaaaaaaaactaatcggagcatggaaacttttttattattaattagattttctaaaaagtgttgttttcaaacatttaaattattattaaaatattattttgaaatataaaattaattttaatattattattattttttaattaaatgtaaattttatagtgtatttgagcctatgtaggtaactttttggttattaaccacaaatgtatgggtaatggacaatcaatccgcagcaaattgtcggggcgaatgcaaagtgatcggccgtcggtggaaaatgcaggcgagaaaattcaacgcattttgagttgccgccgagaaagtgtcaaaacaacaaatttgttttcaattgtttgattcattttgggttttagcggcgtatggaaaaggaagggagagaagggaaaggaaaggaaaggaaaggaagggagaggaaaggctaacataaaaaaggccgatggggaggaaaaagaaaggaaaaagggaggagagagaaacggaagtgcacccgggaaatagcaaggagagacgagagcggtggaggaatagacgtgggggaagagagtgttgtgagagaggagagagagagaaatggagagagtgagagaaagggtggggaggaactagaaatgggggaagagagtatagtgaaagttgagagagagagcgagagagagaggagcggaaaaggcccccgaaatgtcggggttttatgaaagccgttaattgcacttcaaataaaatggaagtgtctttaaatgagtttttaagacttttttgtttttgaactttttcttttatcttttttccaactttttataaaattttgtccccgacaaacgtgtctgtctgcccccgacagagtgagtcttttaaaacattgccgaaagaattaaaaactaaaataattccacatttttatttcaaatatggcatttcatcacagcattcaggtaagagaccagacaattggggtcggatgtaaattcattttttgatcggtcaccaaataaatgtcaataattttgcccttctgatcaatgccatcgccattttgtcaacgccaaattcattgccgatttgccgccgcctcagcgtcaaattttttagcatagtcctcaaagcaatcagcctgcgtttcgagcactaaattgttgttcactttatcactgattacctttttggttacatataattagcgttaattaacttaattgttatttatttttacccctttgtgcccaggaaatgtatttgaaattgttgtggtaaattgtcgcgagaatggtgtccaattgaatcccgaaaatggccagtgtcatttccccataaaactgggattccgtcgtcagccctacagagttttcgcagtcgaaaataacagcaagggctgagaatatgaaaaattatttctttgtcataatggcataagcaaattacggaggaagatactgtaaactgtaaaaaccaaaaatacggtagtactgtaaaaaaagaaaaagcacaagtaactgggaaacttgcaattcctcaggttacgaagatggatcggaagcaaacggaacgacattgcttcaattcgatgttttgcttgcgcaagccgacgtctctaaaaccaaaaatttgttaatttaat

SEQ ID NO: 5400 - DNA, 3451 bp, Heterodera glycines
agctcactctccactcggcataaattcatggcccataaatggattggcaaatgccaagaaaagaattccctcttgcaaacgcgaaattgcgtatttagtcatcgcataatcggcatattcattaatggaattaaatcattgaaaattatttttaaaaaattgttttctttttgttaatccaacatttgccaagtgtatgttttgtgagattttatttgtcatttataagcagcgcaacgttaaaggaacagaagaaaggtattgtgggtcgattagcaaacaatttgagaaatttatgatcagagcgacggttttgcaccgttagtctgcatttacaccactaagaaaatgctaaattttaattttaaaataacaacactgaaaattttaaaaaaatcgttttttagcattttcatgtcaacaaggtcacatcaaaccatcttaaatttgctactgatttgcctgcacatattcgtccacatagccctcagagtaattggcaagcgtttggatgacttaattatccacattatcgctcattaattggcatttttttacattgttgtgcccaggaaatgtcctggagattgttgcggtcaatagtcgcaaaaatggcgtcaaattgaattccgaaaatctccggagtaagttccccgcgaaattggacttctgtcaagccaaaagagttgtcgagacggaagtgagaggcgatgtctgaaaatatggaaaattatttctttgtcataatagtaatggcaaattacagtcgaatgatactgtaagcagtaaataaccaaaaatacggtaaaagtgtactgtaaaaaagaaaaagcactggaaaacttacgatccctcatgttgcgcaagcggttttcaaacagacggaacgacattaatttaatccgacgttttgcctgtccaagccgttgcctctaaatccaaaaaaattgtttaaataaattaaaaattaattgaaaaaacattttcttccacaattttttgtctgatcaattcatttctgatccattgggcttgttttttgtacaaaaaatggtcaaatgcaaaagaaattcgcacatttgcccagcgaatatcaaagggaagtgccgccacaatttcgacatttaattcggtcggcatttttctttttggcatttttgaattgaatttttggcataaattttgtaattttgggaggaatttggcgaagaatttgtcgctgttttgggtggagggcgaaatgaaagggcaaatgaatgagtgaatgattatgacgcccacttttgcgcactttgccctccgagcagagactaaaaccaccgctgagaggagggtggagggggtcaaatgtttaccaaaacgaaaccatcttaaggtgccgtttaaaaagttagttactgatttgcagaatggcacccgttataatggaaattttttaatattttcctcgggtactcgaagctgaaatcccgtttatttttcaagggcatgtaaaaatttccgataacaaatgaaggccgaatgtatcgggtcggaccaaaaacaaaattggttttgcatttcagcgactcggcaccattttcacgataatttgtgtggccacttttttggcatgttttaatgggtgcgcaatttggcacaaactcaaaaaggtcaatttttacaccaaataaaactaattcgtacaaacccaactcatattttacaaaaacctaggcctgacctaagcaattgtacaagttgtcatgacaccgttaaaaggtcagtgggttttcttgacttatacgatgtttttttctcgtggaccaatctcgacgaatatggtaccaatcgatagctctcgatgagacagatcgatctaggggtgggggaagttgatccgacaagtataaaccggtttttgaaccgattcaaaacacaaaaagtgaagaaaattgggcatttttaaattcctgcagttcattaacaattttcaaacaaattttccaaagtaagaaaaatttccacgatattccttgaaccatttgattgatttactagctcactctccactcggcataaattcatggcccataaatggattggcaaatgccaagaaaagaattccctcttgcaaacgcgaaattgcgtatttagtcatcgcataatcggcatattcattaatggaattaaatcattgaaaattatttttaaaaaattgttttctttttgttaatccaacatttgccaagtgtatgttttgtgagattttatttgtcatttataagcagcgcaacgttaaaggaacagaagaaaggtattgtgggtcgattagcaaacaatttgagaaatttatgatcagagcgacggttttgcaccgttagtctgcatttacaccactaagaaaatgctaaattttaattttaaaataacaacactgaaaattttaaaaaaatcgttttttagcattttcatgtcaacaaggtcacatcaaaccatcttaaatttgctactgatttgccgccaaatattcgtccacatagccctcaaagatattggcaagcgtttggatgacttaattatccacattatcgctcattaattggcatttttttacattgttgtgcccaggaaatgtcctggagattgttgcggtcaatagtcgcaaaaatggcgtccacttgaattccgaaaatctccggagtaagttccccgcgaaattggacttctgtcaagccaaaagagttgtcgagacggaagtgagaggcgatgtctgaaaatatggaaaattatttctttgtcataatagtaatggcaaattacagtcgaatgatactgtaagcagtaaataaccaaaaatacggtaaaagtgtactgtaaaaaagaaaaagcactggaaaacttacgatccctcatgttgcgcaagcggttttcaaacagacggaacgacattaatttaatccgacgttttgcctgtccaagccgttgcctctaaatccaaaaaaattgtttaaataaattaaaaattaattgaaaaaacattttcttccacaattttttgtctgatcaattcatttctgatccattgggcttgttttttgtacaaaaaatggtcaaatgcaaaagaaattcgcacattggcccagcgaatatcaaagggaagtgccgccacaatttcgacatttaattcggtcggcatttttctttttggcatttttaattgattttttggcataaattttgtaattttgggaggaatttggcgaagaattttgtcgctgttttgggtggagggcgaaatggaagggcaaatgaatgagtgaatgattatgacgcccacttttgcgcactttggcctccgagcagagactaaaaaccaccgctgagaggagggggggagggggtcaaattgttaccaaaaacgaaccatcttaaggggccgtttaaaaaggtagttactgatttgcagaat

SEQ ID NO: 5401 - DNA, 1772 bp, Heterodera glycines
ttcctttggcgaccgcttcacaaccaacaaaattaaaattgcatttaaacacaatgccataaacaggctgattgatgcgttaagacgatgaatttgaattagagtagagcgggaccgggaattttgagcaaaaccgggaccgggccttgccgggacctgagaagcctggaccgggacctcgatttttgtccgggaccgggaccaaccgtgaaattttaaaaattcaaaaatattcaaaaaatttaaatttaaatttatttaagtaaaaataatgcaaaggttgtgaactttcggatgcgtaaactcacaatttgtgttctaaaatgagttttttgagttcattaatccatagagcccggttcgggacgggattccgtgcgggattttaattaaacgaaagcaaaatacattttttgcgatgagaataagggcaaagcatctctgtatttaaatctgttaaattctcaattttttgcgaaaatttaaacttttttctcattttacaaaattttgggtcaaaatctggtaaaatttcattaaaattttcagttttcctccgacgtcgccttccaggcaacgccggacttcaaaaataaattcatcaaaaattcataaatttggagttctagaaaaaaatccaacaagtttcagcaaaaatctcgaattttccagggcggtgcctattggcaccgacgcttttcataaagttaattaaggtgaaaaaacgttcaccaaacacaagaaaaagctcgaaaaattcataatatttgaacaaatgaatatgagactttatgaagtgttgaagtttactttgaatgcataattattccgcttatgtactttgaaattggcttccccatactttaacagtaagtttattttcagctgtcggcactgtttatcacctggtaaaatgtacttcattgaatatataacaaacattagggcgcctaaggcaataaaataattattgataattatttcgctccttttatttccgcttatttgctcatttggagatttttaattaatgtttgggtgttacctgtcaaaatgcactttgattataataaaacattagagtgcctaaagcaataaattaattattaataattatctcaatctttttatttcaacttatttgctcattcggagaatagtctggcaaggttttaagcaaaatgtattaattttctttatattagtgaaaatcatataattataagtgggagtgttaaaaactcaaataaaaaaattgtaatgaatcttcatgtaatttcattttcaaggctaaggataaatttctatgtataaattttagtttttaatttataaacaaaaaatttcaatttatctttttgcattaaattcttttaaaaattattaggaaaaatgaacacgcacactttaaaaactgcttttttaagggaccagagcgtttgggcccccatttttgggcccccgtttttgggccccggggtcgtttgggcccccgtttttgggccccgtggtcgtttgggcccccgtttttgggccccgtggtcgtttgggcccccgtttttgggccccgtggtcgtttgggccccgtggtcgtttgggcccccgtttttgggccccgtggtcgtttgggcccccgtttttgggccccgtggtcgtttgggcccccgtttttgggccccgtggtcgtttgggcccccgtttttgggccccgtggtcgtttgggcccccgtttttgggccccgtggtcgtttgggcccccgtttttgagcccc

SEQ ID NO: 5402 - DNA, 3797 bp, Heterodera glycines
ttggcttacccatactttaacagtaagcttattttcagctgtcggcactgtttaaacgtgttaattaatgtctcgcgtatcaccttgtaaaatgtacttcattgaatatataacaaacattagcgcgcctaaggcaataaaataattattgataattatttcgctccttttatttccgcttatttgctcatttggagattttttttattatcggattcttctcaagaatttgctttatctggagataacctaaaattctgtgtctgacaggtcgggccgaaacagaagaatgtttttgaggaaggagccaggtgatagtcgaagagttcagttgcataaaaaaaaatttctttgacaaattggcatttgttccgttaccttttgtcgcagcgattttaacagtaaatttaatttcagctgtctaagcgttaattaatgtttgggtgttacctgtcaaaatgcactttgattataataaaacattagggtgcctaaagcaataaattaattattaataattatctcaatttatttcaacttatttgctcattcggagaatagtctggctaggttttaagcaaaatgtattaattttctttatattagtgaaaatcatataataattataagtgggagtgggcgttttaaaaactcaatgaatcttcatgtaatttcatgttcaaggctaaggataaatttctatgtataaattttagtttttaatttataaacaaaaaatttcaatttatctttttgattaggaaaaatgaacacgcacactttagaaactgcttttttaaatattcacccttaaatttttctgttattcaaataaagaaaataattgcatcgaaattccttaaattctcataaacgaaatttttgaaaatattagggacgtaaaaaaatatcgagttggaacttcaaaaagtgcgaccaaaaactcgagagtcatgaccaagacgcaaaaaccggaaacttttctcgagtcgagactgagactctggagcatcaatcactacagtggacaatttgtcagcaaatttattttttgagcaaaaatcaaaaatcttgcgaaagtaattgtccacgcatggccttacaatttaattcaaaggaacacgccggagggcaacggcatttcaaaaagcacttttttgccaatggagcgccaaacgacctttttccagggtttctcagacgagcttttcgtaaaaaaactttatttcaaaggattggatacaaatataattttttaaatatgaatgttaaaatgagacttttagagattttcaaattttttcaacgagagctttttgaattagtgaaaaatgccctgttttgcaatacctctataccagtgaacccttccgggcattatttaaatttggcctccatgttcgttagttgaatcggtcaaggttaaaaaaatgattaaattagtaattgtaataaaaaaattttttagtttcgcgctagctttgcaaaaaagtcaatatcaccaccgtgatcactccatcaggtcggagtgatcagaattttagcaccccaagggactttaatctgttcaaccaatgtcgaacattgtaaaactgcattataattatcaaaccaatcaataattgtatagtcaattaatataataaattacatttttgctttattcactgtaactttgcttacgtcagtcattggcattcaatatgatgccacattttttctttgttaatgccttcatcccctatttgcgcgtatttcatttatgggcatggcattttttattttttccatcagtaagaaactgctttccgcaccaatgctttggtttggcctttttctgtcgctgtttgcggcaataaacttatcgagtggtcaattgggcacaaacgatgaaagcaaaaaaggtttgaacaatattttcaatagaattttaaatattattttgttttgtttttaggtctttttttgatggcaaacgaatttctcgaatccgggaaaatgcttctcgacgaactccaaaatcaaacaggaaacaaacaggaggagaatgaatctgatgatggacttaaatcacaaaaagcgaatggaaaggcattggaagagaaaagtgacaattttcagcaaaaagcctttgagtttttgtgtggaatcgaaatgaaagcaaaaaatgatgagaaaggaaatgagaaaacaaagaaagatgacaatttgttagcttttaaagaattagaagaaaagcgactcaatttttgtcaaaattggaaaaatggcaaaagcatttggaaaggatggaaagaggcagggatttcaatagtaacatcagtgaacaatttgaaactgaatcagcaaatatacggagaaagtcttcgaacattggcgaaaatggaaattttcaacagcaaaaacaaagaagaatttggaaattttgcgaaatttggcatcgatttgctaatgaaagtaactgaaattcttaaaggtaaccaattaagttattctaaacaaagaattttattccaaatggggtaattaaacatttaattgaagatgcgagaattagttcactggctctggctgatcagtctgatcataaccaaaggaaaggcaacaacacatcacgacgaaggaaaagggcttttcatgggatttttcgccgagagtttagcctggaaaagtgttttctgtacttgctgttgacttgcatgtccgccggccttggcactgacatggtcgttcgtctcgcccagcacaaagtgcgggtcgtttcatttggcaattcggcgcctccgcctcccttttctaccgaaggccatcacacaaccccgcttgaaggatttgagattttcgtagctattttttgcttccttaccactttgattagtcttccaatgacaatcattgaaggctttaaaatccgtcgacactaaaaaggcgcgccgcctttgatttttttttcagttgccgagtgccgtgtcaaaaataacaaattacctaaattttgttgtgatctgtttttggcgctacaaaattagcccagtttattaattaatgccgttctgagcataaaatttagtaaaaaaaaactcagagcaaatttttatttataaatggcacggcattggaaaatcatttggtgatcatcaactaattttatcttttattcaatgtaatgatcacaagggttatgtttttttctattttttgcattcctttaacctttcctctgttcagcattccttcatttccttttctaatggagattttttttattatcggattcttctcaagaatttgctttatctggagataacctaaaattctgtgtctgacaggtcgggccgaaacagaagaatgtttttgaggaaggagccaggtgatagtcgaagagttcagttgcataaaaaaaaatttctttgacaaattggcatttgttccgttaccttttgtcgcagcgattttaacagtaaatttaatttcagctgtctaagcgttaattaatgtttgggtgttacctgtcaaaatgcactttgattataataaaacattagggtgcctaaagcaataaattaattattaataattatctcaatttatttcaacttatttgctcattcggagaatagtctggctaggttttaagcaaaatgtattaattttctttatattagtgaaaatcatataattaattataagtgggagtgggcgttttaaaaactcaatgaatcttcatgtaatttcatgttcaaggctaaggataaatttctatgtataaattttagtttttaatttataaacataaa

SEQ ID NO: 5403 - DNA, 3183 bp, Heterodera glycines
aacacttgggcgacgtccaaccatacccaatcaacacataaaatacaattcattttgttcctccgcccgcccttttttcgttccaaatccgggggaataaagacggggggagggcacaaaatgtgggacgatggccctccaatttgtgtgccatatggcggcggccgtccctgctcccaccaccgcttttgctgctgatgagccccccccccccccccgctccattctcattgggctttttctctgtcacgggagaaaggggcactcattcactcttcacaccgccccaaaaaagtgatgagctggcaccatttttagctccttttttcttgaaagccaaagggcggaggagaagaaaattttggcaattaaatgccaaagtgcttttgcattagagaaaagggagtgaggcaattagtgaaagtttgagaaaaagcacaaaatgccctacttattttactgttgttgttgttgttgtttttggatttagaaaatttgtggcttcttaaaaataaatatttgacttcaaatagccaatacgtttggcgcattacgccatcgaattaaattaagcgatttttctattctttggacaaacaaagtgtgacgaaaatgactataatcgtgaaaaggtgaaatgttattagaaaagggcttacaattgggtgacatttgtcacttttgaatcgcaacaaaaatgacggaaaaaaaagtttataaatgacacataaagcagcagagaaagggagagaaaagttgtgaatcacaaataaatgtgtgaagtaatcacttaagcgaacaaagagctggaggaggagagaataaaatgcagaaaaattggaaggaaaaagttacgataaaaagggagcgaaacgggcgaaagaaagccaacacttggccaaaaagtaggaataattattcacattgtccatgtaaaaaagtataaataatgaggaaaaggagcaaagagacacgcctgaacaagttaaataattagattggatgacaaaataagagctaaagttattttaaccccactcaatcacgaattcaaatttatagtcgttgctagggtaggtcacgacgcttattaaccgggggtaccgactttcggttagaccggtttaggatccccggttttcggtttcggttcggttggacgaccgggacttaacttagtcgttaccttacaacccccacaaaccatgaatttttttttattatcaatgacacaaaaactgatggaaacgcttattcatccaaagtccggaagaaccgcctccacttttccccatttctttttgggatgaattgaatgaatcgggggggggggggagaagagaaaggtcaatcgccgcgaggctgggacaaccaacagcccaaggagcaagcagcacacatcagctgcctggttggccacttctgctcttcctcacggtcagtcacaatccggaaaaaggggtggagagggaaatgaaaggggaaaggaggccaaaacatatggccaaccgaactgatcctacaataaaatattattaataataatggggggggggtaaaaaggatggccgcagcaatgcaaaaagcgattttcagcagtaggagaaactccgatagcaagacaaataacttttattatttaaaaaaattagatggacaataatttgtcaaattggctatttgtttatcacacaaaaacaaatggtaaggaatgaacctgttagtgaattttaaacaattcattagatatttcaagaaatgattttggtcagaaaatggaagaatgccgtcattttttcttattaagtttaaagtagttggcaaacaattttaattcattgtgacttaacaattctgagaagagcttacctcattaattagttcagagtaaacattcaccggcaatcacaagaacacccaaaataatgacaggagaaattctgaattaataatgaacacaaaatccgcttaaatgtttgaacttgtctcttcagcagtaaatggtggagaatgaggaaaatgatgagaaagaatatttgcttaagcacacaaaaagcgtaccacacaagcagcacaaaacaaacgcacattctgctgatggtggtgttgtgaaaaacagaaataactcaaccaaaacattcgccagcatttattggcacacacacaaaaagcacataaacaatcactgatgtgctcaatgggatggaagaatgatgagaaggcacaacaaaatgatgagccaatatcgtcaaaaagtcaattagtgatgagtgacaagcaaatgtgatggcaattaagctcatagctctcaaaaacacgcccatcattcccctctactgcacctaactaactgttgttgtattctgtagtgtgttttacttacagtaaatgctaatatggattctattgcaaagttaatttaaaatgggagttttttgtgacatgtttatgagtaaggaaacaatgtataaatggaccccaatctgatccatgattatatatcagtgtacggatgttgccgctgccgcggttggggtaatgtgctttgacggttttagttcttcccgcaacactccaacccccaagcatatttctctccgttttttgcacattccttcccaccaataagcaattatcagagtcagtgttgctcctcctctgtgctaattgcgcattgattgatcagatcagatcaacacgagtggaagacaacaaactctgccggtccctcacgctctctaccccctccccattactactgatcacatttatttcttcaccaccacaatcaacactaccactcactgatcatccgaccaaaaaggggacacatttggcgaattcaagtggaaaggaatgatggcacggatgggttggcggcggtgaaaagcccgcgcagagaaaagagtgcgccgctgcacacacatccttgtacaacaaccaacaaaaatggtacaagggataagcaaagggaattaattacaaattagcgtgttgttggatgtcattatcgggggctattagtaaaacggacactttaggcattattcttccaaaaagcaatcgcagttgccatcgcttaacagaaatgcactgttgtgtgagctggggaggcagtcaatcatccgtatttaattgactttatgcggcatttgttcactcatttttagagggggggggggg

SEQ ID NO: 5404 - DNA, 2415 bp, Heterodera glycines
taaaggaagtggcgatggggaggggggggggacactgatgagtgatgaaggagcagcggcacaaaaagcccctcgggggcatttggagagagataaaaggcggtcaaaattgaaagggcaaagtgctagtggcgttgccaatgggtcattcaaaatggacacgtcaatgttggcatttggcacaaaacttttgtagtggtggaaatcattaaaaatggtcatgggaaaaataaataaattattgcacattaagcataagatctatcatagttgattatttaattactcttttccagctcatttcctcatttctctggtgttgtaatgttaggaaataagtgaaggaaatgcgtaaaatatgccaaaattccaatttatttttctaaactgtcggtatgtgcacaattttttaaatatcagtgcagcgtttgacgaacttgctccgaccctccgcccaatttaagggttgttctgctttacgttgcatgtgctattttgaggtgttttgcaattcggcgaattttggacacactttatattattgtaaagggaatgaatgggggaccgaagaagtgcacacaatcatagggagaatgaatgaatgaaaggaatggagggggaagatttggccactcactcagttagagcaatgaaagcgcaaccaaaagcgaataagcaccactcgtcacaaccacaaacccttttcatagcccagcaaggcttatcccatcaaatgtttgttgaggggataaagggatgtgcttaaagtgaggaggataaaatgggggaatggcactccaaaccagggtttttctggagtgaaacagtataaaacgatgggtgttcagaaaattggtaaaagccaattcagaaaagggtgatatggaattataagccgtgttcgggatcagtgaaatctcaatcccgtccgggcttttgtgttcaatgcatataatataaaagcaaatgttgctgtagatggcactgggaaaaagaaattggagaatttcatcagcgagggggaggagatatttcggcatggcaaagcgcgcaaacatatgagcggggaggagtaagtcgggatgggtcaaattcatggcggaatcatccatttcggatgagggtcagccggacggtggaggctgagcgggaaggcactgccacacacactccatttataattaccaccacacaactcacagccaaacgaatttaaggcccaaatacagcaaaatatgcgcgattatcttgaggaggaaacatggaaatgcgaaaaaattggataaaaattcccacattcgaataacaatttgttttgagaggaaaaatggctgaaataaattatatacacttattatattccaataatggcaatttaataaacaaaatttcatcaaaaaccagcagcaagcaataataaacaatatgcgccgaccgacaatcatcatcataatcacccacacacacttcgccacccttaacgggcggaaatggggccggccggccaaatgccgcaccgccccacgcagccatccataaatgaaatatcattcgtcggttgtggagggggggggggattgggatgggtggtctcccctctctccacctgcacatgcacacccaatcaaattcatacagcagcaaccaacagaagaagagcattaagccgtccccgttgtccgtggaggtgaagaggaagcgacccgtgtggcgggcgctgcacgccgagccaccacaatcgacgaccgccgccacacttccgcttctacccgccgtcctccccatggttttgtccgctggcattgccccgtcagaaacactttttgttgcacatgataagcacagagggggagggggagggggggggagaatagttggaaacgtgctgagacgatcctaaaatagtatcaatggggcgttcctaaaaaagtatcaatgtgggcgatcctaaaatagtatcaatggggcgttcctaaaatagtatcaatggggcgttcctaaaaaagtatcaatgtgggcgatcctaaaataatatcaatgataaaattaattaaaataattattattcaatgaaacaaatattttgcaagtaataaaaattgttttctacataaaatattattacgtcggaaacgataatcaatgtatgtcaatatttttttgccatataataacaaatttttaatttaaaaatatatttcccttcagtgttaaattcattctttagattgactaaaaaatgaaaatattttttattagttttatttttcccttaattttacttgattttttaaaaatttaatgtttgttttcccacccatttttagcatttcttttttttcgccgcattttttcgtatcttattacgcaactaaaacgatgacttatttctaatggaagccgaaatttatgcaa

SEQ ID NO: 5405 - DNA, 2434 bp, Heterodera glycines
tcctaaaaaagtatcaatggggcggtcttaaaaaattatcaaggggggttcttaaaaaagtataaagtgggcgatcttaaaaaatatcaagggggcgttcttaaaaaagttcaatggggcgttcctaaaaaatatcaatggggcgttcctaaaaaagtatcaatgtgggggatcctaaaaaagtatcaatggggcgttcctaaaaaagtatcaatgtgggcgatcctaaaaaagtatcaatggggcgttcctaaaaaagtatcaatggggcgttcctaaaaaagtatcaatgtgggcgatcctaaaaaagtatcaatggggcgttcctaaaaaagtatcaatgtgggcgatcctaaaaaagtatcaatggggcgttcctaaaaaagtatcaatggggcgttcctaaaaaagtatcaatggggcgttcctaaaaaattatcaatggggcgttcctaaaaaagtatcaatgtgggcgatcctaaaaaagtatcaatggggcgttcctaaaaaagtatcaatggggcgttcctaaaaaagtatcaatgataataattaattaaaataattattattcaatgaaacaaatattttgcaagtaataaaaattgttttctacataaaatattattacgtcggaaacgataatcaatgtatgtcaatattatttgccatataataacaaatttttaatttaaaaatatattccccttcagtgttaattttattcattagattaacataaaaaatgaaaataatttttattagttttatttttcccttaattttacttgattattttgaaggccataaatccggatttgaaggattcgtaaaaaatcctcaagcaatatcacttgtcaaaagctatgaaaaaaaggaaataaagacacttgatgaactacatggacaacttatgcataaaggcatacagatttctatatgcactttgaaacgctaatgtttgttttcccacccatttttagcatttttttttcgccgcattttttcgtatcttattacggaactcaaacaatgacgtatttctaatggaagccaaaatttatgcaaaaaatttaacaaaatgttaaaattattcactgtaatttgacattatttaaaaataatttaaatttaataattttaattgaataataattattttaattaattattatcattgatactattttaggatcgcccacattgatacttttttaggaacgccccattgatactattttaggaacgccccattgatactattttaggatcgcccacattgatacttttttaggatcgcccacattgatactattttaggaacgcccacattgatactattttaggatcgcccacattgatacttttttaggatcgcccacattgatactattttaggaacgccccattgatactattttaggatcgacctagcacattgatactattttaggatcgcccacattgatacttttttaggatcgcccacattgatacttttttaggatcgcccacattgatactattttaggaacgcccacattgatactattttaggatcgcccacattgatacttttttaggatcgcccacattgatactattttaggaacgccccattgatactattttaggatcgacctagcaccagttggaaaggtggtggtagtagatggatgagcagagcaaagaaagaataggaaggcggggggggggggaatccccgttgtcctccgttgatgatgtccgtccaccgccgccaccacacatcccctcggggagggaaaggccaaaaaagcggaaattggaagagcaaaaacaaaacaccaacgaaagcagaagcacaaaattgggctgtgcatgagtgcgggaagtgggagggaattgttcattgtcagtctcacaggggaacattccgagctgtaactaagaaaatgcatataaatgacatatcattggatagagcagggtcgacttctattgtgaatttttaattttagcggtgcattttgcctccttcaaaagttacagggcctcaaatatgcgaatttcattgcctcggggcacattacgacaaagggaaaggatcgacaatgagttgcacggttggttaaaaatggttttttggtccatgggttcaaatccacttgcctgtaaaaaaaaattttaaatttatttttaagttttttgggccggcaatcgtgaattttgacatacattgggcccaattactaactcctgaacagaatccaaataaaaacaaattttatgggtcgagctactcaagaaaaataaaggttccaaaagtgaaaatctgagtcaagtaattttcgaatcaaaaatttaattcgaattttcccaattgggactctgatcagagagagggcagaccctctgatcagacagagtcaagaaggtatgatcaaagtaaaga

SEQ ID NO: 5406 - DNA, 1405 bp, Heterodera glycines
cccggcaagtgatttgaaaacctaaaaaccccattctgcggattttaattgaatgaaattgatgttcaaatttccttttttctcgtattttcagtgccaatttctcacaaattcccgactttccaatgttttgaacgacacataattaaccttcgaaattaaggaattatttattggaatttaaataagaataaattatggttttcggtgcaaattggatgatttttcttctcccacaaatggaaatttggtgaaccgatttgtcaacaaaaggtccttcactttcgtttccctccgccctttccttctccgtaattattaattaatttagggttgcgtccccgaccccgccccgaccccgacttttttgcccatttttcggggttaaccccgaccccgacgctcccaaccccgacgcaccccgaccccgacccttaaccccgactcggggtcggggttaaatatacacccctaagaatggcatttttgtgggagaaaaagcaaaaaatatatacaaattttgaattttttaaccattttgccaaatttttataaaataaagtaatttgcttttagcgattcctatgcagtagtggcgtagtggttagtgtgttaacactaacacaattcttgtcgtgttcgatcctggttgacttcttcttttttaattatttttttttgtaattaatagggttttttaaaataaaaaatacccataaaaattggtcatcattggcataatttattgacaaattaaacccaattttcctttcgttgaaattaaaaaaatttaattttccttgactaaatcatgaaaagtaaatattttacaaaatataaagagaaattcataattttttggtgaaaactgttagaaaaaagagcttaaaatttaagattcgcccggcgttgcctatcggcatcgccgaccccccaaaaacctgaaaattttgctcaaaatcaaaaaaatttataattttttggacaaaatctgttacagatctatccaaatttcaaaatttttcccggcggcgcctatcggcaccgccggacccctttctcctaaaagtctttagaaacgcgccgcaaaaaaaatgattttaaaaacaaaaaacttttcgggaacaagggttcggcagtgtctataagcgcggccgcgaaaattttttgaaaattagagaattagaatgcaatttattaactgatttcaccaaaaataaccaattttttcgactttgagccaaatttttttagaaaaaatttgtttttggggcccggcgccggaggaaaaatttgaaattttgactatttttacagattttcactaaaaattgttcattttaaaatgccttatcgtttttaataattctatacaaaaataattatgaataaaagaaataaaaaa

SEQ ID NO: 5407 - DNA, 1386 bp, Heterodera glycines
tcatgactgattatggactcacgtcgtaatgacggattacgggttatcctatcgtctggtttttcctgcgcctttccgtcatgacggattacgtaggtaatgactgatgatccaatcgtcatgcttttcttaatccgtcatgactgattactgacctaccccccccccggtcatgaataatggagtacggattagtttcgtgatcagcatttgctgatcacttcctcttcctgctctccttcctcaccattgtctttctttctttttcctcattacgcttttttatgatttctttgaccatgttgatcggtctgaacacatttctccgcttccacttctcctctgccgctaactcttccttggctttctccagtttggcctgggttggcccggctaatatgccgtttctgatcagtctgagcacattctctacggttttctcttccgcgtcggcaatttccattggaatcattgcggccgatgtggcggttgccaactaattaattgcaaaattgtagaattttcaaaaaatgaaatggtcgcggatgtcgctcgggaccaatggtgtagccaaacaccattgttttcggtcggatgtttttagctctattagcaaatttttttggagagggtccccccccccccctgggaccagccctcctctggtgcctgcccgcgccgctctcctcacaatgttggctggcagcataaatggtattgccatccatgtaaaattgctgagcggatgatgcttggcaatgagattttctatgtccaattcggccagcttcagtgcattggttttaacttttcgcgaattacgataaattgctgcaaaatcctttttgaatgcgccagtcagcagggtgtcaatttcctccaacgcattgttgggaattgagccgaacgctgccaatgtgccggcagccatcgctgctttcaagttctgtatcagcaccgcattcttcgggatgaacggtgcaccgcgtgacatggcgagggcccgcttgatcaccaacgagtcaaatgtttcggcgaacagcggcgtgatggagtacagtgcgatggacaacggtatgacccacacatggatcaagggtgcagcccatgcttaacatattgtaattagagctagggcttttaggtgctaaaattgcaacttgtcaagaagacaaataaaaacaaatttttgagataaatttttgaggaaaatttttcatttcttaggggaatatttttgaaattttggtcaatttttagggtatatttttttaaatttttttgatttcgattcgtagagtttatttttcgtttttattccatgtttgctatgaattttggaaaaagggcaaaatggttaaaacctaaaaatccgtacgctaatga

SEQ ID NO: 5408 - DNA, 5239 bp, Heterodera glycines
atcggcaccgccggaccctcccccctcgcccatttcccaaaagttttttggaaaaatgagccgcaaaaaattcttaaaaatctgattttttgatcccgagtgcactgaaatttacgatttgttaatttcctcaccaaaatttttaaagatgataattggaggcgaaaaatataatattaatgatttttgattaaattaattgtaaaaataaaagatttgaagcaattttgcaaaatgttctgatttttgaccccaaaatctgattttttgggcccgatgtcctgattttgaaaaaaattctcgatcgcatccctgcataaaatggcaaaaatatggacatacatttttccaattgagggtataatttcccaaaagttctttaaatttgttaaatataaagtaaaaccttcaaaaatggctaaatatggtattaaaatcattttagaagaaaaaaacacgataaagataaaatttacttatttttagcgaaaaatcaacccgaaaagcgaaattttcgttttttttttgcttatatttgacataaatttattaatttctaagaaaatttaaatttattcaatattctcgagaaaatttggcgaaaaaataattttttgtaaaatttttcggtttttgggctcaaaagggcaaatttagctgctgggagccgttctaatagaggttttttggaaaaatcccaaaaatatggacgaaaatgcgaaaatatggacataaatcgcgaaatatggaaaaatatggatatagaaatccatcctagaagctccaaaccaagctaaaaacatgtttttcgtgcgtttcaggcctcccacagtccaggaaaaaaatatggatttccatgtatttgtgggaataaatccatattttttgcaaatttcgaacccctgacccggactcgaacaaaaataaaattagaaaatttgtatggatgatagatatcctcattggcatcttgccaatgagggtaacattggtaaatgaatcataaaattctaaatttgtatggatgatatcctcatgggcatcttgccaatgagggtattattggtacagtaagcctataaattctttgtccttgtacagctcttgtagtgaacggtagtgctgatctgagcccggatgattcgtgatcagcgacccccaaaaccccttaaaacttattttcactaatttctaaaacacatttataggcatttgaaaatgtatgtgaaatctgtcaggtaaactgcaaaagtacccgacattttaattcacactaatcagtagtgatcaattcaatgataaatccttactgataattgtaggccacaaaaagagatcgaagaacaatgcgattgctgatgtgccaatgacgctccacatcaactgcttcagcaacccgactgtatccttcttattgatcacatagttcacaatttgcgcacccaaacggccgcgcaattcgacgccctaaaatttgtacaatcatttaaaaatcttttaccaggaacaggcctaaatttcaaaaaatacatatatcccctccgctcgcccgtatctttttcgcccgaaaactagtgaaaaaaaaattcccaggtccagtcataggtacaacaggctttaacaaggcaggatttactgagactgtgtttttccccaggttcaggcctgggtacaggctttaacaaggctgttccttggcatggaatattgctggaattttgtctagaaatcccagtccgggtccaacttggaatccagctccatgtcaggctttttttaaaatgccaattctatgcttgactgttttccattttcaaaattctttgatttttttctacccacttgcgggtcgaccacaccgttgtcatctatgtacagtgtctgttccaccaatttggccaatgcttggcatgtctcattctcactctccatcgcttctttggctctcggcatgtctaacatttccaaatatttcttttcattgacgctccgtccgcttattttgtgccgtagtccaccaattgggattttactgcctttcttatcaatgccaacagtgccgaccaaaaagtcgaacgggtgcaccttctgcggccgtagaaactccatggcctttctcaactttttttgctcctcttccattgtttggtgcactttttccaattttttcaaagtttcgatttttctgtgaaaagttttttaaattatgaaatttttttggaagctgccacccgaaccccgacccaatattttcgcgtctcaaagcccgacccgagcctttttggacgttcacatccgaacctcggcccgatattttctcgtctcaaatcccgacacgaactttttttttggaagctgccacacgaaccccgacccaatattttcgcgtccaggaccccgatcagaacttttattcgtcccctcccgaaccctgagccgatagtttcacgtctcggtcccgatccaccgacttttatatctttccctgtctctagttgtggttctcccatctccgccgccgaaattccgccgctgaaattccgccgagacataactccgccgggcaaaaaattttcaaacttagaaatttttcaagaaaaaaatcttagaaaaattttttcacataaaatccgaagataaaaatattttcaaagaattttccaacgatttttttgaaatttttttgaaaaaactttgtttttcatcattaattttgaaaaaatcgctggaaattttttagaattttttcttcgaattttctaagaaaaaatttttctaatatttttttcttaaaaatttttggcggaatttcggcggcggtgttttgccctgctccgtgtttttttgtgcaaaattttgggcatttttcaaatgtgttaaattgttctactgatccttttttgaggaactgaatttttcggctctcaatttctatgggacaaattttctgttcgcgctcacttgtccgctttcatttcaatttcatttcttttctgttcggtcagcatttccggatgctccttgattacattttctatcaactccgcattggactcattttttgtgtgcgtactccacattgcacttcctctgtgaaatggatggtgttttttaatgaaaaccgtaaggggggggggggtaattttttgaaaacttattggtatgtttcttcctttaatttgggtacttactatctgttatgccgttgagtggcaaacaaataaatcaatatttatggagcaaataaaaagaaataacaaaattggggaaaatgatgcgaatgagacaaatgacgagggaaggtcaaaaagcgggctatttatggacggagggagagacagagataagggggacgagggaaacatacaaaataaataaagtgaggcggacatttgggtaccggcctaacaccttcccccttaaaaaaattgatccgtccatccgcttcatccttcggcggtggctcatcggtcgtcggctgtcaggcgatcacgttttcacgctttcgctggtcacaatcaatgccgaccaagcccttcgacgtttttccatcgaatggtgcctctcttaggtccaaaccatcaaaaatttcttcgtccgagtccaaaacacatgcctctacacctttttctgggaatttgccggttgttccatctggaaaacggatttcgtacatcgtcccttgacggttaacgacgtatccagcgcgccaaggttgcagtcccaaactagcaatgacctttgctcccaaagcaaattttggcttatttccgcggtgtttattcttcgggttttcactttgagcatcagttgaatcggacttcgtgtttgcttctgccacttggacattcccttccaggctcttcctgaagctatccaacagtcccaaactgtgaagcatgtctatgccaagcaaattctttgttcctttggcaacatagaattgtccatcgcatgagcgatcaccgatcgagaactttgcctgcccttttcccaaaagagggcgagtggatccgtcgtggtattttgcccgttcagtgcaacggctcaaccatggacttccgatttggcggtgtgcgtccttcgtgaccacagttctttcagtgccaaaatcagcaacaaattccacttcagtgccatccatcttcagcgggatctcgatcaattttctccgactttctgagtccggcagaaaaattcctccaagccgaaatgtgtttacggcttttccatcctttttctccccatttcttttaagccaagccttgtgcttctcgcacattctctccaaatgtccaatttcattgcactttcggcaggtggactttccatgcgaacaacgcttgggagagtgccattttccgcatcgccaacacttcggttgcgatccatggctcctttggcttgctgacgattcgctgctccctttcgacgagtcggaattctttcgaattttatgcttctttttcaaagcataaacatttctcgaagacaccggctgctcaagcgctttagcctcggcaatggtcgacaggtacacttgcaggtcttccaccatgttgtcgtaccgaacgaggtcaccatctgctgccaactttgccaaaattcgctttctgaggtccgcgtccttcggcgatttcattgcgatcagaagcatcaggcagttaaactgctcctctttcagcttcttgaagttgaaatcccttaacagccttttgtgtcggttcacaaatgctctgaattcctcgtcttccagtttggatgcacgcaggcagtcgtatctgtcaatccaaatggactgaggcctggcaaacaaactcttcagctgctccacagtcttcgcgaagtcgaagtctgtcacatttttcggtatgcaggactttttgtattcggcaaacgcttccttgctgagcttcgtcatgagaagcttcaccttcagcatatcttgcaaattcggtgcggcacagtcaagagcaaagtcgaattgctgcagccagtcctcgatgtcggtgctttgctctccaaattcgaagttttccacattcggtagagacggcacattggatggttgctggcctgctggtggcgcattttgctgtgcttcaagcagttgcttaaccatgtccatcaattgctgaaccgatggatttgccatttttaagtgtcgttcaccactctattgataatagcgccaacgataatagcagagtgggtgcgcgtggacgaactgaaattatgt

SEQ ID NO: 5409 - DNA, 3169 bp, Heterodera glycines
cctttggcacatagaattgtccagtgcaagagcgatcatcgatcgagaattttgcctgcccttttcccaaaagagggcgagtggatccgtcgtggtattttgcccgttcagtgcaacggctcaaccatggacttccgatttggcggtgtgcgtccttcgtgaccacagttctttcagtgccaaaatcagcaacaaattccacttcagtgccatccatcttcagcggtatctcgatcaattttctccgactttctgagtccggcagaaaaattcctccaagccgaaatgtgtttacggcttttccatcctttttctccccatttcttttaagccaagccttgtgcttctcgcacattctctccaaatgtccaatttcattgcactttcggcaggtggactttccatgcgaacaacgcttgggagagtgccatttttcgcaacgccaacacttcggttgcgatcggtggctcttctggcttgctgacgattcgctgctccctttcgacgattcggaattctttcgcgttttatgcttctttttcaaagcaaaaacatttttcgaagacatcggctgctcaagcgctttagcctcggcaatggtcgacaggtacacttgcaggtcttccaccatgttgtcgtaccgaacgaggtcaccatctgctgccaactttgctaaaattcgctttcgaagatccgcgtccttcggcgatttcattgcaatcaaaagcatcaggcagttaaactgctcctctttcagcttcttgaagttgaaatcccttaacagccttttgtgtcggttcacaaatgctctgaattcctcgtcttccagtttggatgcacgcaggcagtcatatctgtcaatccaaatggactgaggcctggcaaacaaactcttcagctgctccacagtcttcgcgaagtcgaagtctgtcacatttttcggcatgcaggactttttgtattcggcaaacgcttccttgctgagcttcgtcatgagaagcttcaccttcagcacatcctgcaaatttggtgcggcacagtcaagagcaaagtcgaattgctgcagccagtcctcgatgtcggtgctttgctctccgaattcgaagttttccacattcggcagcgacggcacattggagggttgctggcctacttgtggcgcattttgctgtgcttcaagcagttgcttaaccatgtccatcaattgctgaaccgtcggatttgccatttttatttttgtcgttcaccactctattgataatagcgccaagatattatcagagtgggtgcgcgtggacgaactgaaattatgttgccaaaacacaatatcagcggcgcaaactttacaactgttaaacagtgccaaactgttaacagggaacgacgaaaatgtttaatgtcgcctagacaataaacaaagcaatccacaatcggcttcaaacaaatgccttcgactctttcccaaaaagaagtcgaaattggaatgatttattggatgctgaaagcactccaataaattccaaaagcagctttaataaatattcaaatcagttgaagggggcccgcagagacgtaatttcaaattacaaacaaacaaatatctgctcgggcgtcgccaattgttatgccgttgagtggcaaacaaataaatcaatatttatggagcaaataaaaagaaataacaaaattggggaaaatgatgcgaatgagacaaatgacgagggaaggtcaaaaagcgggctatttatggacggagggagagacagagataagggggacgagggaaacatacaaaataaataaagtaaggcggacatttgggtaccggcctaacaccttcccccttaaaaaaattgattcgtccatccgcttcatccttcggcggtggctcatcggttcatcggtcgtcggctgtcaggcgatcacgttttcacgctttcgctggtcacaatcaatgccgaccaagcccttcgacgtttttccatcggatggtgcctctcttaggtctaaaccatcaaaaatttcttcgtccgagtccaaaacacatgcctctacacctttttctgggaatttgccggttgttccatctggaaaacggatttcgtacatcgtcctttgacggttaacgacgtatccagcgcgccaaggttgcagtcccaaactagcaatgacctttgctcccaaagcaaattttggcttatttccgcggtgtttcttcttcgggttttcactttgagcatcagttgaatcggacttcgtgtttgcttctgccacttggacattcccttccaggctcttcctgaagctatccaacattcccaaactgtgaagcatgtctataccaagcaaattctttgttcctttggcaatatagaattgtccagtgcaagagcgatcaccgatcgagaattttgcctgcccttttcccaaaagagggcgagtggatccatcgtggtattttgcccgttcattgcaacggctcaaccatggagttccgatttggcggtgtgcatcattcgtgatcacagttctttcagtgcccatatcagcaacaaattccacttcagtgccatccatcttcagcgggatctcgatcaattttctccgactttctgagtccggcagaaaaattcctccaagccgaaatgtgtttacggcttttccatcctttttctccccatttcttttaagccaagccttgtgcttctcgcacattctctccaaatgtccaatttcattgcattttcggcaggtggactttccatgcgaacaacgcttgggagagtgccattttccgcaacgccaacacttcggttgcgatcggtggctcttctggcttgctgacgattcgctgctccctttcgacgattcggaattctttcgcgttttatgcttctttttcaaagcataaacatttttcgaagacatcggctgctcaagcgctttagcctcggcaatggtcgacaggtacacttgcaggtcttccaccatgttgtcgtaccgaacgaggtcaccatctgctgccaactttgccaaaattcgctttctgaggtccgcgtccttcggcgatttcattgcgatcagaagcatcaggcagttaaactgctcctctttcagcttcttgaagttgaaatcccttaacagccttttgtgtcggttcacgaatgct

SEQ ID NO: 5410 - DNA, 777 bp, Heterodera glycines
ccaaaagcagctttaatcaatttcaaatcaattgaagggggggcccgcagagacgtaatttcaaattacaaacaaacatatatctcacgggcgtcgccaattgttatgccgttgagtggcaaacaaataaatcaatatttatggagcaaataaaaagaaataacaaaattgggggaaatgatgcgaatgagacaaatgacgagggaaggtcaaaaagcgggctatttatggacggagggagagacagagataagggggacgagggaaacatacaaaataaataaagtgaggcggacatttgggtaccggcctaacagtttgaaaacaaacacggcgcctatcaacgccgccggccacaatttgggtcgcaaaattggtaatttttggtagatatctactactaatcgtatttaaaacctcaaaaaaaaaattcgatttatattgttttatttaataaattgacatctcttaaatttttttgcttttaaattgctctttttgtggcgcggttttccaaaaaattttggaaatattgggggagggggtccggcagtgccgataggcgctgccggaaaaaatttggaattttgagtgcgatttgttaaaaaattttgtcaaaaaatgattttgactgaggatttttcgaaaaaatgtttaagatttgaagaaaaagttcaaacgttttgccaaatatacctatttttcaaaaaaatggtgcgtttattgtcacttttttatcaaaagaccacaaaatattttaaatttctcaaaagacca

SEQ ID NO: 5411 - DNA, 4949 bp, Heterodera glycines
cttttcagaaatcaatgaagttgtcataatccatgatgagaccccaagagcaatgtggaaaacaggaattattaaaaatgtcataacaggaaaagatggtatcataagaggagctaatgtcgagttaccaaacaaaaatgtcattaaccgtccattaaaattgctatatccgttagaaattaacaaaaatgacggtgaggagaatgagactctcacaaatttaatcactgatcacgaacaaattggtacagttcaaaagagaaaacaagcaagtgtcttatcatcaccaaaattaagcaaagtatttttaaacacactcacgtttcttctattatttatgcaaatcttaccgtgcttatcatacccatacgaatgtccaagaaataatgaaaaatggagaactaaatatacaacattttgtgtaaaaaatggatttaccatcagacaaaataaattaacaatggaattttgttaccgtaaaatattttgtcacaatcaacacatcataaaaaatcatccaccctattgtggaccacaatgcaaatgtcctgattggacaattttttgtagttttgcctcatatcaccgaataaaaagagaaataactgatcaggagaatattcaaaatattatttcattctttaaaccaaacgtttgttcattcaataaaacggtaaaatgctccctaatggataaaaatatatttagttcaataatgctttatgataatagcattcattcagttaaaagtcttaatttacttcatacacaagccaattctcgaattgattatcgttgccttggggagggcaatctgacgattggtacacaaaaattctgtcaagaacacgaatgcactgacaaacatggaacaaaattttgcttttacgagccacacgaaaaaacttatcttgtgaaatcagaccgagaaattatcccaataaaagcatggggaagcatcgaaagaattttttatttggctaatgacacattaatggatgaactcaaacgtaaaaaaagagaattcgatccgttcgaaaacgaacaaatatccgctgaatgtataaaaggtggaataaaaataaacccaactcatgctaccacggaattagaaattttggttgataaatattttatcctaaaacgaagtccacagagtgaagaatttatttctctacctacaaaaattactatgaacgagtataaaccagtcattaaatttattaaaggcacaagctcacctgagtacaaaaacttaacatgctctccatcaccaatctgtgaattaattatatgtcgtttctgcatggaatacattcgaaacccacaatgcgttggtcaaatgcattgggctctgatactaatcatgataatgctcacactttacgtcattactctttgtcttaaaattataagaatactataccgcttcatcgtttttatttttctatcagtctacaattgctgtagaaaaagaaaattaaagaaaataaaaataattaaacggaaacaatttatttatttaatcatgattagccttttactcaattcaccgactattttttcatgtgatgaagtcactaacatggtagcaggaacaaacgactgcgcaattgatcaaaacggaaagattgaatgtatttacgatcaaacaacccaaatttcaatcacaccggaacacaaaacgtgtctaaaacttgacaatgaaaaaatgcacagtacgatagagacaattgaattatctgttgaaagtctgacaataatttgtgcagagagatctgaatattttatgcgagattatgaattactatcgagttcgcaaaagcgatgttcaggcgccggaaaatgcaccggtcaaatatgtcaaactttaacaatgaaagaaaaaaatcctgaaatcggtgaccatgccaataaacaaccaggatattcctattgtgtgccttcctgcggtggttggcactgcaaatgttttcttgtcaccgatggatgtttattttatagaacatataccgagccaatcaatagaaacatatatgaagtggtcaaatgtccgacttggacgattttagctacaatcaaaatttcgcttgatccaaaaaccatacatactgtggaattaaaacctggtgtcttaacacatgttaaagactcgaatttatctctgacactcacctcaacttcaattccaccaacgccactatttggatcaaaatttataattgatcgttcaaacgcaaaagctgtaatagttgataatgagaatttacttaagaatagcctacggtgcgaaactaaagaaaaggcgacaaaattcagttgcacattcccaccagaagcttgtcaatgtcacggaggtgactccgttgttcactgcgaatgtgagaaaaacccgctcactgaaatgttcacaagaaaagataatattttgcctctcgagacacaaggaagccaagtattcttcgacactttattaagggcaaaaataaaattaacaacttcactacaagtgcaagtcacgctaaaaggtcacaaagtcaaagcaatttacgacaaaaataattgtactgtaaaaacaaaatcgttagaaggatgttactcatgcaccaatggagcagaatttaaatttacatgtacaactaactttggtaccgcattggcaaatgtaaaatgccatagtcagaattttcaaataccctgtgacacaaaagggaaccaacagcaaattcagctttcctttaatcaaccgagtgtaaaagaaaaatgtgaagttatatgtccagatgaaaaaagtgaaataacaattgaagccactctgaattatgtgagccaacaagaaaaaataattaacccttcgaataacaaacaggaaacacccgtacttggaacttccctagaacaatttacagatatatttaatttcatatatactttaatcaaaacaaatctttttaattttttaactataatttttactttgattgtgacaataacatttataatttgtatctgtccaatgatttacccactgctttttaaatactttcctttccgtcgcgggaatgtcgcgaccacgcgaaatagaaaattttatttaaaaattaaaatcattaaaaacaaaaaacatttaaattaattttaaattaaacagataaaaattaattaattaaatgtgaatggaatgaaggaggaataaatgaaggaaaattattagtcatttttagtcacaatttttccattagaaaaattgtcaaatgttaaactttaattatgaataattggaacgttaaaagaaataacagattttaaacaaatgttaaaatgggacaaattgtgaatgatattaaagaaattgtaaaatgttagaaaattggtaaaggctaaagtggcacaaactggaaaatgagaaaaggttagaaaaattggcaaatgttagggacagaaatttggacatgccaagttggcaaacaatcgttcaagcaggaactgccggtataaaaggagggcccaaaccccccacaaatcagtacaccaacggtttcctgagaggcattgcctcgtcctcctttccctcccttccctttccccccgtgccgacaactgctccgcctgcccgttcgtgccgccgactgttgtgcagaaccgtgcgccgcccgttcagtgccaagccgatccgtgcgccacccgttcagtgccatgcccgatccgtgcgccgcccgttcactgccaagccgacccgttcgccgaccgttctgtgccatgcccattccgtgccgccgccccgcaccactgatgccgtgccgtgtcgccgacgttttgtgccgtcccccattttccccccattgtgccgtccccatttctgtgccgtcccccattttccccccattgtgccgtcccccatttctgtgccgtcccccattttgtgccgtcccccattttgtgccgtcccccattttccccccattgtgccgtccccatttctgtgccgtcccccattttgtgccgttcccccatttcttctcccttcggtttaattacccaagtttgaggactctaataaagtgcattttcatcgcttttcccgcctcacttgacccccagcaattccaccacccccgattgaccgccaagcgtccaccccaaaatttcgccacaaccagtccctctcctggtcaccattgcgcctgccgcccccaccccgccgactcgcactactcgtccacaactcaaagcccagcaccaccaagcagcgccggccctctaccaaccactgaactcatcagcacccccacatctcgccaaattcctacccctcccatttgtgcgccatcgaaagcgtacagtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttcaagacgccaattttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgactaaacataaccaattccgagtttcatgaggcatcaacttcattcttttcttgtcctgcccaattgtctcaaatgtatacctaaaaatgcgctaaaaatga

SEQ ID NO: 5412 - DNA, 1598 bp, Heterodera glycines
  misc_feature (1408)..(1408): n is a, c, g, or t
  misc_feature (1454)..(1454): n is a, c, g, or t
  misc_feature (1547)..(1547): n is a, c, g, or t
tgtcaaatatggacataaatttttcaaaattgaatgtaaaatttcttcaaatttattggttgaaattgcatatgagatacatttccaaattttttgactcggtaaggcgctttgacaaagacggctttcgttttggcaattagtcggtcaacattcggaaattggtctcgaattttttcggcaattatgtgcaatcattttaaaagaaaaaaaacataaaagctaaaatttattaatttttttagcgcaaaatcaacaacaaaagcgaaatgttcgcttttttgcttatttttgacataaatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaatatggaccaaaatgccaaaatatggaaaaatatggaaatatggacataaatcgcgaaatatggaaaaatatggatatagaagcttcaaaccaagctaaaaacatgtttttcgtgcgtttcaggcctcccacagtccaggaaaaaatatggatttccatataattggactccctagttatcaacggcataaattttctaaaaaaaactattttttgaaaaattctgagtgaaaattatctactcaaaaacaacgtgcctccccccgtggtcgaaattcgaaaaatcgttttattttatttcatacataggctaggcataagctttagacctaggcttaggcctaagctaggcttgtttgggcctacataagattaggcattatttagtaaaaaaaaacacgaatacacatatttattttacatatatgcaaccgcgcgaaaacgacccccgcgcgaaaacgacagcgcgaaaacgaacctggcgcgaaaacgtcagcgcgaaaacgacggcgcgaaaacgaccccgaccgcctcctttcgtccctaaaaacgagaggcgagagtccaaaaaatggcgagagttggcaagagacgagaagcgagagttgtcccgcccctgttatgatgtacatatttttatacattttttggagtctttcgtacatattttcattttttacatattttgagatgatacatatttctggatttttgtacatattccatatatatttgtgggttttttttatatatttatattctgtaattttttttacataaaattcccatcccaataataatgctaaatgttttcttttctatttttaatcagtttatttaattatccttttcaatttgatattttagtctcaaagcgaaactttgtcagttgaacatttcgccatgctcaccatgtacatcagtgagaatacgtttanatttgtcaatttcattcaaaatacacgcggggcagcgacgcgcgtncaaaaactaattggagcagcgaaaattaaatcaaattttatggaaacatttcagaagaaacttcgaaatccattatgtaagaagcagtacaanatgtcattatatttaatggaaactgcaaagaaaaagctaaaagattctcga

SEQ ID NO: 5413 - DNA, 7019 bp, Heterodera glycines
  misc_feature (43)..(43): n is a, c, g, or t
  misc_feature (76)..(76): n is a, c, g, or t
  misc_feature (116)..(116): n is a, c, g, or t
ccacagaaaaatgtggcacaaattttggaactgtcccgcctcnacggtggggcttaaaagcagggtaaagccaatntaaaaatttcagagaattatttgttctaaaaattacagtntaatttcttaaagccaaaagattcgaaacagaagcattatttaaaatcaaaaataattttagtaaattttttacattttagtttcaaaaaaacaaacaaaaaaatgttcccaattttgaaaatgaaatagtgcacaaaaaggggggatggttagacgaaaagagaaatttttagaaaagtccgcaccccatctaagggcgttatttttaaatgcaaaggtgccgatttaaaaaaattctcacattttccttaaacggcgtcgttttatattgcggcaattatatagcagcagcacacttttgtcgtaagttgtgattgcaacaaatgtcaaaacaaaaaatgatgtgcaaatttttgtgcttttgagtgagattcgatggagtataaaagcgatgcatttgttcccttttcccattattcattctccgcttcgttttccgccagtgctgccgccccccattttcggcaatggtaacagaattttttttctttaaattcttttgaatgcaaattattttttctttttcaactttaaggaaaatgttgttgctcctgccgatgctgcggtcgacaattttgagcaacgcactcgccaattcttcgccttcgtcaacgagggaaacatcggacaattgcgtgcgctggtcgactcgctggatgcggacgaactgagcaatttgctgcggatgaaccaaccgaatgtccgaccgcctcgacctgctctcattaacgcaattttaaagcagcacacggaaacggtcgttttcttggtaaaagaaagggtttagtcttattcggcagcgattgatttcccccatttttcattcagttggagaagggcgcagatccgcatcagactgtgcttggccgactgaacaatttggacatgagtgagcagcaacaaaagcggaattccgcctcatttataaagttttgtccccaattttgcagatgtgacgccgctttggactgctgtcagtatgaccaatttggagatgtgccgtgcgctgatcgcccatggtgccaacatccacttggggacggactctggcgagtcgacgctgctctgcgcatgtttcgaaggcaattttgagattggtgcgtcaaatgcatggatgatgctgccgtgtaattgccaatgttttcccatttctcagtcactcttctcgtcgagaatggcgccaacgttaatctcgcggacagcgacggaatgacgccactaattgccacttgttactttaccggaaaggtgtgcaaagttgttgcataatttgtgactgttttttcgcgttcttagattgacattgtgcacctgctgcttttacacggtgcaattgttggacagacggatttcacgggtgcaattagtctaattgccctaaaattattggattaatattcccttttttcaattttagggatgaaatttgctcttttgggagccgccagggcgggctatttggaagtgtgtcagctgctggtgaacggatgggcagcggatgtcaaccagcaaacaatccacggcaccacagctctgatacgcgcgagcggtcggggacacgtggacgttggtgagaaaaattgtggcaaatttgaaatgtttcctcattttcagtgacttttctcgtcgaatatggcgccgaccttgaccacaccgacattgacggatacaacgcgttgatgtgcgcagtgaagaacagaaggacggaaatggcacgtcatttggtgaccatcggcgcgaacactgaccagattggcattgatggtgagcagaaaagtggttaaaccgcacggcttttatgtaattttctcgcatttacaggcaaacgggcgcgcgacttggctgaagaaagcggacttgccgaaatgattgacattttccgtgccgcggctgagcagcgggaaaacgccgatgggtaaaataggatgttttttgatcaaaaaaacaacaacaaattttcaggcatcagaacgaacactaacagcggatgagagggaatcgcggctcaaaagaattggacggatgtgccattcggaggatattctcatgcacttatgtattattgcagtgtatttgttcatatttgaattcacttgtcgtgtttgtctgctctgattgtgtacataaataacattgtttgtatgataaatagggatgcaatttttaggttttttttcggagctcccgtggcctgaaatgcatgaaaaacatgtttttttgggctgttgttaagctacttttcgagttattagtgcctattttctaggcttttatttttagagcctaaaaagtagagttgagggtaatggtgaagatcattggtcccataaaaaagggaaaaaaagcccgattttaatgattttgcacttcacccgggggttatcgagggtgctgagcaagaatatggtcatatgacgacatcaaatctatgatttttcgacatgtctatgatttttcatcaagtattttttccaattctaactcaattatttagctcaaaaatgagctcagcttgtttattgcacgaaaaatgcacgatatttaagcattgacaacataaaactgaccaatatggtcaaaaatattttcgaacgccaaaagcgttttttccccataaaactggcgccacatatattcgtccatgtatcctggcaacaaatcacgttgtgtgcccgacatcgctttattcttcattttcaaattcttccaaaagttttccacgtgattggtgtgagtgccggtcaatggatcgacaaagttttgagcatggttaacggactggtggacatacggcgggacaacgggaattgcagctattgcgcctcccatataaggagcccactggtcggagtgtattgtggtgccagggaggacatattgttcaatgatagggaggagagtgttgcgcgtacgatctggtacaagttgcacaacaccgacgtgggcgtgcacgtcgtacatgccgaacacccattgctcacgcaccctccggcccctatgatatttccggcgagcgacgagactctcgtctatttgaacaatattcccaataccacccaaacttaaagatcgccggttacggtagaaatacaaaaaagtataccggatgggatgcgcaagcaaccatcgactacaatccattgataatttaaagtaaatgctaaaagaatagcaaaattcttaaaataattttgtggtgaatgtcggggagatgcagtatgttgtgatattcatagtctcatttgcatgtaaacaacattcattatttcaacattccattgtttaccttttatgggaaaaaaacgcttttggcgttcgaaaatatttttgaccatattggtcagttttatgttgtcaatgcttaaatatcgtgcatttttcgtgcaataaacaagctgagctcatttttgagctaaataattgagttaaaagtggaaaaaaatacttgacgaaaaatcatagacatggcgaaaaatcaaagatttgacgtcgtcagatgacaaatctgatggcatattcttgctcagcaccctcgataacccccgaatgaagtgcaaaatcattaaaatcgggctttttttccatttattatgggaccaatgatctccaccattaccgggttttcgcaggcgttgaatattaatatgacatccatttcgacctatttcgaatcctgaacccgaattcgaacatttttttgtaaaattttgaaaaattgtcaaaaaagtctctttggttttcggggtcgctaatcactaacctaacatcagttttggtcaattgcgaaccccggacccgaatttaaacaaaagtcgaaaattaatttttcaccaaatttcttgaactctgcttatacatatctgttttagcgtttatgaattttcttttatatcgtcgtcaacaattacttgctgaaattttggctgcaacccgccgactcaatgtgtttgatgctaacttggcgactgggaacatgggcacagaggaacgtgagcaagccatcgccgaccgtgaacaactgtttgaattcgtccgcgaacttttgcgacaactcgacgctgttcgggactcagaaaggcagctgcgagagagtcagagagacaacgacaatgacaaaaattctgaggtttattcacactggttttgggttcctctagtctgactgacttaactaattgtttccaccctttttttgacaaaaattagttgtatgaaaattcggggttgtccaatttgcttggccaaagactgttgcgatgagtgagtcaataggctctattcaatttacgcgtccaatcagtgactatcctcatggacaaaagcaacatacaaaaagtttttcctgaactaacccaaattcaaacaataagtcgaaaattcaaatttttgaacttcttaatattgccataaaagtgattaaaaaagctaaaaaataagctatagttagaaaacttcaaacattttaaatgttgtttttttcaacagggaggaccgggttcgttacgacgaagcaggagccattcgcaatgaagcggcgacagaagcgacaaaattgaggtttgttcgcattattttgaagcaaaatgccattaacagtacaaaacagagcaaattgacataattaaaaagttaaatctatcaaatttgaaaaaaatatttaaaaaaaagcgggcggttgataaaagaactgtaacgagcaaatttgggggcataaagcaataatagtaaccaaaacatgtaaataaaagtcccaactttttttcgcaaacacaaaatgaaaaattttttccttctcattaaaattttagagctatttacataaaaaaggaagccctaataatgaatggtccgagactaactgtctcgggaaggaaaagtcccgcattgattgacttatctcgatttgagcttaaagaaaaataatttctgcaattgcagcaatcggacgggcacaaaagagggcgatgtgttcagttttgcgactatttgtgtggagatggtgaacagagagacggtttggaatgggacggagagggacgacgacgtggacggtgggcaatggcattttagggggaattattgggagctgaccaaagtcgagttttcatcctaattacggaccacaattctaaattgagtttattggatttgttgtgccgtgcccattcattcctttggctcatcgactttttctcactcctcagaaatcctttatcggctcaaacgcaccaacaacacaatccctcaccgtcctcagctccgcccccgcgaagacaccaatcaaagtttggtacgatttgttgctgctgatcgccttttctttccaattcatttgtgcttttcctcaggtccatttgatcagagactgttgggctgaagtgccggccgaacgcccgcgcatggatatgatgcggacgatgcttaagcagatggtccaggacgggtgggagacgcaggagaagaagaagcattgcccttttgatgttcagaaaccaaaacctgatggactacgtgttcggcatgctcgagcagtacgccagttcactggagcaggaggtggaggagaagcgcaagagcgacattctgctcaatcggatgctgccgcggcaggtggcggacaaactgaagctgggcgaggcggtggagcccgagtccttccaaatggccaccattttcttctcggacgtcgtctccttcactactttggccggcaaatgcacgccattacaggtgacaaaatcagtgatcactgtctgatcagactggggaagctgagtgatttgggcagaagaaatgtagttggtgataacgaatgggattagtctgactattgtgatcaacatccattctgatgataatatgattcttacgtcctccccctctccgccgtttaggtggtgaatttgctgaacggactgtacaccgcctttgacggcatcatcgacacccacgactgctacaaaattggtcagtcagcggccgatcacttccattttgatcattttaccaacgcatttccccgcacagaaacaatcggcgacggttatttggtgtgttccggcattccgaagcgcaacggcgaccaacacgcgaaggaaattgcggaactttcgttcgctttcctccgcacggtgtccaacttccgcgtcgaccacctcccctccgaacgcgtcaatctgcgcatcggcttccattccggtccctcccctcccctcccatttcaaatttggcattttcagggccagcagtcgctggcgttgtcggtctgacgatgccgcgctattgcctttttggggattcggtgaacaccgccagccgaatggaatccaacggaaagggtaaaattgggggggggggggagaaaacaaattcatttcccattttagccggcaaaattcacatttcatcaagttcaaatcgcttcttgaccagcgtaatcggaggatatgtgacggagccaaggggcgaagtgattataaaggtaattagggggggggggggaatttttgttaataaattgcctgattaattcattagggcaaaggtgtgatggagacattttggctgttggggcgaattggcgaagtccatttgccggaggggccatccgtgtcggaaaatgcgggacggaagagcccagcggaaatgcgctgattgacgggaaaattaccgtttaatttgcaatgcttttcctttttcttctttgcccattattctccaattaattgcttcattttttttgttgttcgcataatcagttaaaataacgattgttggcagaggactcttaaagataaaaacatcggaagcttaatcttaattaaaggataatgccatcaaatttgtcagtgacaaattgtgtctcccgtgagactcgtacaataattcttcatttgtggact

SEQ ID NO: 5414 - DNA, 2297 bp, Heterodera glycines
  misc_feature (2281)..(2281): n is a, c, g, or t
gggaaacaacgtttcgagatgggatacaatattaatatataataatgaatatacctattttaaaattggagaaaaatcaaaattgaagacgatctttcagcgcgaccgagcattaaacaaaaaacttttaaaatgaaaagattataagcaatgctttttattaattaatacatttttgaaaaattttcattaaaaaaattaataaaatttaaatatgtcaaagaaaattaaacattattaataagaaaaataatatatacttaactaaattaaaattttagagcaaactaaaaaggtattgaatattactttcacctaattggattttaattaaataactctaaatatttcgaaacatatggaagaacaaattttacgcaattataaataaaaaataagcaaattttttcttctcattaattacaaaattctatcaacaaaaattataaaaaatgaataaataaaaatagaggcaaatttaattaaagaattctaatgagaattaatgaagggaaaaattatcattgaaagtgtcctaaaatggaaagcaaattctatgaacaataaattttgtggaggataatttcacatgggtaaagtttttttaaattttaattaaaaataacaaataaatgtaatacttttcaaatctagaatataaattgcaaatgagctccaaattaccaacgtcagcttgcatacagttttttaaatttaataaatgtaaagtaaattaacctaaaacgcatacgcttttaattggtaataaattcattagtaaacatttaaaaataacaaattaaatattaacatttatctgaacaatgaacttaaataaatttccgctgtttcgttaaaaaaaaaattgttcatttttattggataaacgaaaataaatttaaaaattcttttacgtaattaataaaatttatagtctcattaagtgatgcgacatttgcgccgcgcagtcaaaaaataatattttcatttcaatttcactaatattaataagatttactaaaaaccaacgacaaaaataactaattgaaaaatttcaaaaaatcactacttaaagatagacattattttttatttttatcattaaaaaccataacattgattaggttcatcaaagatatgaaaaatgaagaagaataacaactaaacagactggcactgtttgaattagtcctactcacagatttttgactgtccaaggctcaaaaaatagttgtaattgatgagcaagggggatttttagaatgactatttttgttttttattcaaaaagaggaaatttatgtatgtactttttcattaaaattgttgaaatttatttacatcgattttaattttgaaaaaagcacaaataatttctcgcacttatttcgcgatttttgagtgaatttcaatcgcttctaatttagaaaactttaggtcaatcttgtaaaatttttaatgagctgcgcaaatttcgcgacgcaaatggtgcggagcaaaagtcggctaaccgtcaaaaaagataaaagaataataataatattttaaaatttaaatattcgaacaattacaaggaatcaaaattaatctgtaaaaaattaaatgatttacttgaatcaatatataataaatatattgaatatatataatattttggattactacaattccaacgccgttggcagccataaattttggagatttcaaggataaaataatgctgattggtaaaagtcccactttttatctttttattttccaatgcttcgatcactttcgtatctaactatgaagatatagcataaaatctttttatactagttggcaaaacgtccggttggcgaaacgtccgaatttggcttagttggcgaaatgtcagttggcaagatgtccggttggcgaaatgtccgtacacctaaaatccgttttcaattagtgagatcgaccattttccaatataattaattcacttccgcgcaattagacgacatttttattgggcccgggtcgccgagaatgctttttcgtgcgggccgagcgacttacagctttgattttaaaaatgcttttaaaaatattatattattgaaaattaatgaaaaattttgaaaatttcgactacatgtaggaaattgccatttagcaaaagttatcaaaaattgtaaaatttttactgttcttttaggcattttgtcaattaaactatttgttaacatattttcaccaaaaattaccaatttttacgattttgaaccaatttctaagaaatttttttttgaanattacgagttttgata

SEQ ID NO: 5415 - DNA, 5966 bp, Heterodera glycines
  misc_feature (584)..(584): n is a, c, g, or t
ttttggatatacattccacgccgttggcagccatcaatttgtggagatttcaaggataaaataatgatgattggtaaaagtcccactttttatctttttattttccaatgcttcgatcactttcgtatctaactcatgaagatatagcataaaatctttttatactagttggcaaaacgtcctgttggcgaaacgtccgaatttggcttagttggcgaaatgtcagttggcaagatgtccagttggcgaaatgtccgtatacctaaaatccgttttcaattagtgagatcgaccattttccaatataattaattcacttccgctcaattagacgacatttttattgggcccgggtgtcgtcgagaatgctttttcgtgcgggcctagcgacttacagctttgattttaaaaatgcttttaaaaatgttatattattgaaaattaatgaaaaattttgaaaatttcgactacatgtaggaaattgccatttagaaaaagttatcaaaaattgtaaaatttttactgttcttttaggcattttgtcaattaaactatttgttaacatattttcaccaaaaattacncaatttttacgattttgaaccaatttctaagaaaaaattttttgaaaattacgagttttgatagcatttatatcagcaaaataaatcattgagcaccaaaaatttttaaaaaaaggtttgggaggcctgaaaataaggacaaatcttagaaataaggacacttgggaaccgcataagaaaggttaagaatattaaaatttagcctattttaaatattttaaaaatattttattatattttatatttttttcaaaaatttgcgattttgaggacccgagcaaataatggcaacgccacggtcattgcttggaacaaaaggagttgaagaaactgaagttcatgtcgtgcttttttgcagctgttgaaagagaccaaccaactcagtgaggaaatgcttcacttgcatttgcttcccattatcaccttttctcaaattaatagggccgcaataattaatgagttaactatttttttttttgctcaatggtttttgtgaaagatgcccaaaaaacacatttatgcactgaaaatttaattttttaggggctgacggcatttttttacaccacctataaaataaaaaaaatgtttcaaaaattgatcgcaaaaattttatatttttttcttgaaaaattttaaaatttaaaacttttcattaaacgaaaaaattataaaataatttatttaatgatcatttaaatgaccaaaattaagtttttggttaagtttttcatgttctgctcacggaaaatctttaataaaaaacattttaaatgccttttttcatgcttttttcaggattttcactggggtcccgcaaaatcccgcgcgggatcccgttccgcgccgcactttttatcaagaaaataaaatgaaattttggcgatcaatttttgagtaaaagtcaacgtagaagactcaaatcaagtggaaaatacgttttttatacttaatatgtataaactagtgcgcagaaaaacggcatctctaattattatcaatgaatatctaagttttctcgactgttgactgagcatggcattttatattacgcaaaaaaaaatatttcaattattaatagggctggcaatttaagtcacaattaaactccaaaaagtcgactaatttagagtcagcaaaaaagtaaattaacttaaattgcccctaaattatcaccattcatttaacaccagtaaagaaataaatgtctttttatttgacaattctaattttaaggttcgcatggccaaaaatggacttcccatggcatttgtggcctcgttatgttgttcgtgtttttgtgcgcgtggtccgttttatgaaaaacaagaaccaaaaagaaactaattattattcttttaggtatgatggcaaatttaatggcgaatctgccatgccggcaatttgggcgggaattatgtgcgaattttttgcatacattgcattaaacaaaatgtgagataaaaacttgaattacttgcaaaaaaatattattgtaatataattaaacaattttttttttactttttcttcagtttatccgttgctgaagggcatcaaattgacgaattggtgaatgagataaacaaatccgagctcgatgtgaacgctcaaatcggaatccaatttagggaagtgctcggaagaatgcttatttcttatacttaatttatgtctccgaatcttcatttttaaattggtttatttctaagattgtgcttatgttcattcttaaagaaatttttgaaaagtttttcatctttgaacaaaattgtttcaataatattcaaattacccggcgggattcattcataatcgaggaaatattctttttttattttcatttgacggatttttattcaaaatcataataatttcaaaaaaaattttttttttgtttatttgttcttataaaatagcaatcattcgattcctctcaacatgtaaagcattaatccgaaagaatttttgacaaaaaagaaattgacaaaagctatgggtcctcaaaagcgttaacttgttgataaacaagttcagtcagaaaaatgataaaaagtcaagtttaaaagattgagttttgattattgcgctaaaaacaaggcatatgcctcaaaccccggtctttaattatatgcaatattatagtttcataccaactataaaataaaggtaataaataaagaaaataaaacagagataatcatttcattaaatttgaaaatttaaaggagtttgagataaaaaagttttttaaataataaaatataataaacaaaaaattaatttaatgaaaataatacgcaactaaaagtgcaatcgaaaatgactctcatcaaagcatgattgattgaggagaggataatgatatagttcgcgaaggagacatgtaaaaaacataataaaattaatgtcaattgaaagaggttcataattaaaaaagaagataaaattaaaataaaatataaagaatgcttacataattaacaattttaattagatgcgaagattatttctttaaaaattgttatatcaggcaaggatttttaggtgcttaaatcgcaaaaaataacggaaaaattccaaaaaaattcaaaaagatttttcctaatcagagtgattacttttttctcggcggcggagtcaaaaatttttaaaaattttttcaagtgaccatttttgataggatataattttgaatcatttagatttattgggctcagacaatgctaatcggtgccgcgaagaaatttagaggtttattgaattttcttaagaaatttttcgcgtccgaaaattctttaggtgctacccccaaatagaaaattttaaactttttagaattgactctaattttaaagaacccagccccggttacaaatttttgcataaaatatttaaaaatattttaattatatgcaaaatattttcttttacatttgccgcatcgattccttcacgaaagttgattttctcaaaattgctcccataaaatgtgttgattttcgaattgaatttgtccaaaacttcaaatgaacccgacaaaaacattttgctggccattttcagtttaaaaacatcattagaagaaatcaattgaatttcttggagaaattgacggttgttatcgtgcattaattgttcagacgaatctaaacgatttatttaatgttacaaaatgaagcaccaacataaataaatttttggtcgcacggtgccaggaattaaccgtgaatgtttttgaattctctgtcggcccagccagaatagatggcaaattattcgtacaataatatttttatattttggagattttttttataaatatttgaagttacttttttaataaaagatttaatgttaagatattttttaagattattcttgtattaaaattgtattacaaatatttttaaaatttttcttttttaaattaataaatattttttgattattgtgcgaatgtcactatgacaaaattaagctaattccggcactttgctatctccgggttcccaaaaattcacatcccactcaaaatttaaaaaatgattacccgcatccaacaacactttgccaatttgcactttcgtgttcccccgtgcgccaatgtaggcaattgccaagccaaccgcagccaattggggggcaactaccgtatcctcctccttagaccattcatagtgtttttgaaggtaaataaatgtatttgaacaaatccaacaaaaaattccgtttgatcaacagcttgaaaagcgaattattgcgaaaatgatatgtaaataatacgtctcagcacaaagtccgggtacatcagcgtgccgtctggcattccgttacgtttaattttgttcaaatcggtcggttgccaattaaggagtgtttgttttgcgtattcgtaaccaccagcggcgtctcgccattgcactgctccgccagtttgcaaatccaagtgcagtccgcgcatctcttgcacacggccctttggattaaaacaattattataaaatgcatttttttcaaattaaattaatttatttgattttttcgaacattggctgtctgaagcttaggcagtcgaaagggtgctacgtcatttcgcgacaagtgcaaaaagggcacttcgcgacagtgcaaaaattgggcacttcgcgaaaaatgcaaaaattgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaaataaattttattaagcaaactaaatattttatattggtttttaatttaatcttttaactaattatatttgaatatgattaatcaaccaattaaaaagcaaatcaatttactattttaataaaattatacttgattatttaaggagcaaatttttgttattattttaaaaaatttatgcaaatgcttttaattttataataagctagttttgctttaactccgcaggatctataattgcttggaaatgtcccaattcaaaaaatataaaaattgacttatattctctcgactggccaacaagcatctaaatatgcctaatattttgatttatcgtatttaaatggataccgtatccagcatatccggagtataaatattccatacatattgtattccaaaatcttcttttctctgagggtttggactacatacgataacattaatttggaataattttgcagctgctagaaaatcaacattgctgccccacttatgtctttcggaggcagattttgccggctccttatgattctggacatatgtacgtatactaattatctatagaaagatttcgttatcaaacttaaaaaaatactgtacctcattcccacttgaatcatataatgtttgtccgggatgaaacatttcccaccatccgtgccatggaattcccatttcgttaagctcaacctctgattcaatatactctgtaatcgcgcgtcgtataatcccagcattttctttcaactcagatccagtaagcaaaactgataaagaattataaaagcaattcccgtcagccgcaacatttattaggcggccttaaaatatttatttaaataaatttatcaaatactaaatacctggcccagtttctaaatcaaaaaattcccgttgagtgccaaaagaataagtcgggtgggctataataggaattatataaaaaaattaatttaaatatatctaccaaatcttaaatcccatgtgtttacaatttgttgct

SEQ ID NO: 5416 - DNA, 1010 bp, Heterodera glycines
atttgtaatttttcaaatcggaaattttggtcaaaaatagtttttactcataagaaaattacatttaaagaattcgtcaaaatgaaatgtgaaggcgttcgaatgataccaaaatcgttagatttggtgaaaacaaaaaaaagttaatagcccaacaggctggcgccaaaacgacccaagtccactaagacatttcgcaaaaatattagtaaatttttcaaatttgacgcagtttcactgataaaaaatttttccatcctttttcagacatttcgtcgaaaataatgattaaaaaataatacagtaaatacaggtgtttaacgcctgtatcttgtacctgaattccaaaaatggactgtacttgtattttctccgaatggtgtctaaaatattctcgaaatcacagagaccccaaaaacaaaaaatatttttttattttttttttatttagccaatttctgctatgtaggaaaatgagtttgttcaaatgtacaatataatgaaggatcaatcatcttgtcgaggcaaattttttattgcttttggcgagtgaatgattatgattagggctgggaatttaattcaaattacttttttttgctgattctaaataaccttaaatggacttaaaagtattctacacttgtttgaaccttctaacatgcatttttttttgactttttatactttttgagatttttatgccttatgggatttaaaaaatagccaaaaagtaaaaaaaaacgccaaaaaaagcacaaaaagtcctaaaaaattagacaaagcttaaaaaatcccatttttagcattttaatgaatagcattttataaatagaaaccggattatcaggtatacgcctttatttttttgcttacttgccacttcctaatacattcgcacgaaaaaaagtttttaacttagtttgcagcttcttgtttaactttttggtgcctttttacactttttcgtgcttttcttggctttttgtgacttttttgctattttttca

SEQ ID NO: 5417 - DNA, 1292 bp, Heterodera glycines
ccaggaaacccaggtccaggaacgacatggaaatatttctccttgaatttagaaaagttttttttaatatatatttttttatattttcagttgaaaccaacgatccaaatgccttttactttacatttacgttgcgtaaatatgtcaatgttaatgaaaaagaaaatcatgaacaaaatgtcgaatgtgtggactatgccgaagctaaggacccaaagttggagcagttgtttctggagatgaagaaggggttggagcagttgtatctggagatcaagaaggtcgagcagaagtttgacgcgtacatttatagcaaggagaaaatggaggaggagcttatccccaaaatggaggatgttgtgccgaaaacggaggatgttgtgccgaaaattgaggaggttgtgccgaaaattgaggaggttgtgccgaaaatggaggaggtagtttcaaacagatgttcaacagcagcccacggtaggtgagggtctggaggcaatttagttttgcagtggaactcggacagaactagcccaaccgcagtgggacatttgcgacggacatttgcggacaattttggggaaaaaaaaaaaattcgtaaagaaattttaaaaaatttctgaaaatatggaatgggactgaaaactaaataaaactttgtttttgggcttttaggcctaatattttatttttacatttcttagaaattaatttcactactggtattttgagtgattaaagtaaaattggtccttaagatcggggaggtgtgaatgtcgcctgttacactcaaattctgtgagagtgctattttcatctttagaaaaaactctgagacatgcttaatcgtgaacaaaatttgcttataatttcaaaatgaacagcctattattctaaatgcttgaacatcagctgtactaaaatccgattctcgatatttttgggcatgagatttccgatttccttttttgaaaatttttggggcctaaaatgctttcccggctgatgaaaagtagagcaagacttatgtgtcttgggttcttctccatcccgaacaaaaggaaaagaaaattcagggggcgagtagcaaattcccctacaagatttgtctgtatggctagagaattttaaaaaatgtcggtggaaaaatttcacatccccgatcttggggaccaattttactttaatcactcaaaataccagtagtgaaattaatttcttagaaatggcctaaaagccgaaaaacaaagttttatttagttttcagtcccattccatattttcagaaatttttt

SEQ ID NO: 5418 - DNA, 1288 bp, Heterodera glycines
ggatcccgatccgtatcttgatttttttttttgaaaaatgcccggatctgatcccgagaccaggatggaatccccggaagcctgtcctaatcaaaattcccaaaaaaaacccgaaattgatgccatatggaatgatcatcataagctggggccgggattagagggatgggcaaaaaaaaagaaatgaacaaactacccgaaccaaaactcggaaaattccccaaatccgaagcgtaaaaatcgccattccaacgacattcagaggaggatgaattgaacacgaaaatggagacgaagctgaacattttgaacaatgggaaacatggcttaaacaatatgaaaatgatgggaagaaaatgaaggagcacaaagaagaaaatgattagaaaaaagagtgcactgaagtgggggggggggggtagcatattttagggcataaaaaatgccaaatttgaacggcaaagacaaaatcctgttattttccatttaaaattcctattttaaattattgttttcgtttaaaattcgaattcttcattcttccctttaaaattcatactttctattttttttcgttaaaattctaatttttccgtttaaaatttctatttccaattttttttttattctaaatttctcatttttaaaaatttctaatccaatttttcagttaaaaaattgctatttttccatttaaattgcaaatgttcagttttttgtgttcttattttgtttgttgttgttgttgttgaataaattcatccatggaaaaaagcttctttcaaaagcattttccaatcaaacaattagtcatcagcataaaatttttgttgaatgaaaagttttttaattgaatttaaaaaggcaaaacaatttcacttttggttagcaaacaattaaaaaaaccaaaaaaatttttttgataaaactcagaaataaattaaatttgatcgtagtccaattataaattatagtaccgaaaaactgatcattatttgctatattattaaacaaaacaatggggatttcaagcctcgatttttcctggatccccaggtcaagaaggtcaattgtgaaaaaaacccaggcctaggttcaggttttagacacgaaaaacccggatttcctggacattattttaggtttttgttagtttgagtgaccgtttttttaaatcaaaaaatgtttaaatagaaatttaaaacaatattgttattgctccacttagatacttttagatttttcctaagcattaattatttatgtttactctttaaaacaaatttta

SEQ ID NO: 5419 - DNA, 3658 bp, Heterodera glycines
  misc_feature (16)..(16): n is a, c, g, or t
tttagtttatataatnttgtttaataaaaaataaatattttttgcacatttttgccaatttaattgattttaatttaattttttgttccacatttcaatcacatgtccataaattatcacattttgtcaatttttgaccatttttgttatcatcattcttgccccattttattagttgcaatttttaataaatccaaattccgataattaaattaattaatcaatcatttcttcctatgtttccaaattttatgcactgattaaatacttgaaattttatttttgttttttggttattaatttttcggctataatccttcaataatgatcagtatttcactaatttttgcgggaacaggaattaattagcttaatttgtttccgatcaatttgccaatggcaattttaattttaatttctatttttattatttcaactttaaatgtttgttattgtagtgatgaagacgaactgttgctggtccaagcggtacattcattcaatattttaccaattaataataaatttttctttttttaaattgtccaaaaattttttaaaataattgttttaattatttatcgattaaatgggaattgcgattctttttcgatttcactaattatagggccatgggatataattattaaaaaaaatcttctatcaaattaattagcgctaatggctaataataaattgtaattaaatttggaattttccagaggcccttccaaattctcaaatccctgtatttgtcccgaacaaatgatcactcaccttgacataccatttcttgatcgcaacattttacagctgtggcgccatggcgaccgttccccgcttggcacattcaaaaacgatccgaaccaagaggacgcatggccccagggatggggccaactttcagcagttagtcattcattcatctattaattgtttgccaaattttttggcatttggcagtgccaaatttagacctaatcctggcagaaggaggatcaggtagtttggttatggcacagcaaaaacttttggcaccgccgccagttttctcgtgatcccgatcccgttattctcatgggttttgtttggttgcgaatcgagtccagaatttgaaaaaggcgggatccggatttgggattggcaaaatgctgcattgcctctaagtaccccataaagcctcgagaaggggtggcgggggggggaggggtgagtaaaaccataggaggcttagaaacaatacggtagcaccaattctttaaaaaatttctatacagtagcgcttaatttttaatggacacggtagaatcaaatcctgtacggtagcattaatttttatttatactttttaacggatatggtgcagcattattgaatttaaaacatttttttacaataattatatgcccattagtagggatgggatttttaggtttttacctttttttttttgcggcttagttatgatgagagatgcccaaaaatagcattttctcctaacaattttcgatttagagcgactttttagcacctaaaaacacctattttggcgttttggcacctaaaatagtttacaacctattttggcatttttcgaatttttagcacctattttgggattttcccagaaatttcatagtaaaaatgcaataaaaacgaaaaatacacccctaagaatcgatcccaaaaaattttaaaaatatacccctaaaaattgaccaaaatttcagaaaatattcccctaaaaaatgaaaaattttctcaaaaattcgtctccaaaatttatttatttattttcttgaccagttgcaattgtgcgggcgaaattgataaaaaattagtcacattttgaattgttgtacataaaaacactggattttttcaatttttaacacctattttggcctttttggggctttttagcacctattttgcacttttttagcacctattttagtacctattttgggatttttagcacctaaaaatcccatccctacccattaggcacctgaaaaaaatgaatgccttcagaaagggatggcccaacatgttaagcttggcgccaagctgaaagcacgttacattgacgggcttaactttgtcaaccggcgctatttgagcaaagaaatttatgtgcgaagcaccgatctgaaccgcacgctgacaagcgcaatcgcaaatttgatcggcttttttgaccgcggcattgccggcacggattacccgagtgagcggcaggcacagtggtggccacacgggtgggtgtgtatcagggatgttgctcgtcttgtgcctcatattctcgtgtttttgggggtgtctcgtctcgtctcgtatctcgtattttgtttttgtctcgtttttctcgtgtctcgtattttatttttctattcgcaacatccctggtttctaaataaagcggatatggaacgcggatgcggaacgcgcaacaacaaaaaaaacggggaatgcggtctcagtccccagaaaaattttaaaaattgattttttataatggaaaacattcaaaaaatttcataaaatttaaaaataaaaagatttttcaattttttaccggaaagaggatctgcttaattaaaaaattaggggacgcgacacgcgaaaaaaaaacacaaaccatatatgtaccagaaatggaacggtattccgatttccgatcgtttttaccgtacatttttcaaaaaaaaaaaaaattacgatacttagcaacttacagtttcacaccggtggccgtgcacacccgtgaagcctttaaggatcacatcatcccggacgtgccggatgtgccgtgcccacggcaaagcaaaattttgcagataatggcacggacatttgagtaccgacagctgacgaagcaaaagaaagtggggaaatttttggaaattttattaatatttttaaaattttacagcaattttttgccgatttgtccaatttgacaggcgaacaaattgacctgtttaacttctatttaatccccgacacacttttcattgaggtcaaatgcaccagggatagaagagaattataggggggatttaaggcaaattaaaaataataaaatattaaaaaaatgtaaaatttaaatcaaattaatacgattttcggactcagttttcggttcgagcaattctcatgtttttcaagtgtaggtgtcgattttttgcctatcgtactttcattgacaggacatctaccgtaatgagttgccagaaccggtgccggagtggacacaaaacaaaacgctgcgtgccgaactcaaaaagattgaaaacctgattgacagatggctcaatggcaaaggcatgccgattgaaataattaaatcctttaattagggtctgatctaataaactgatcagagtttgaacactgtcagaataagccaaaagcgatcagagtttgatcagtgattaagggaatggataagagcttgattagtttatgtaactgatcagagtctgctggcatcaatcaatagatgtacagaaatgttttaaactcaattaatagatcaaagagatccgataatttagacatttccgccttcgaaggtgtccaatttgacgtcgaattaccacggatccgtggcgtgccaaccctttggattctcattgacaacatgcggaacaag

SEQ ID NO: 5420 - DNA, 1837 bp, Heterodera glycines
  misc_feature (107)..(107): n is a, c, g, or t
  misc_feature (160)..(160): n is a, c, g, or t
tttttgaaaaaaatagagcgatcagaaaaaaaaaatgggttggtgagtgatcagaaattgttgtgggtgatcggtcattttctcgtagggttgacacgattttctgnaatttttctattaaaattttttctaggttttttttttttgaaaattttcgctntgagccagtaaaccaaaagtaaatccagattatataatctgtgacccatcccccggtttctcgaataacaatgcttttgtgatcaagctacccgcactacactgcttgtgtaacggttgagctatggcggaatgtgacgaatggaggggagccatatgtgaaggtaagggcggcaaaaagtgcctccggggatttaatttgttagcatttttgccaaaaaattactttttaatttgtgctaatcgtcgccggggatttaagcaaaattcgttagaattttttccaaaaaaaaaacttgctaggcgccgcaggagattttttagcatttaaaaaacagctaatttttgaaaatcgcagctggaaattttgacaatttttgtccaaaaaaaattacaatacgctaaggcagacatgaatttgaaaacaatttttgttcttttttttacacataaaaacgaatttttgcgccaaaacgcaaaaaatatcaatttaaattaaattttaggtaatttaaaaccgattttttttattgtccattttggaattaattttaaagagaatttcaattaacttaaaattttgcatttaaaaatattcctttttattgtctttttagggaatttttcgttagaaaattttcggtaaaaatttcttatccctgaaatgccattttctctatatgcccacaggttttgtattggccacccgaattggccggcttcaaggacataacgcacaacatcaccgggtgcgaaacaaatgccacattgaaccaatttgtggcacgttcgcgcattttcaagccgatgccgtcgccggatgagtactgcaaggacacatatttcccatcaaatactattgttgatccaacatttgatcagcaactgtgatcaaaatgataaagtgtagggctggcaaaattacttgaaaatccgggattttttaaattggattttgggaggtctaaaacccataaaaaccgtgtttttagcttgacaaaaatttaacaaaaatgtaattgataaaataaccccataatatttgcaaaaatggtgaaaaaaagctataatattttgaaaatgttgaagaaaaacgaaaaaaaattatatatggtatatgtttttgccactttttggtccaaattttgctattttatatccattatttaattgccagccctaaaatgataaaagttgcactcgcaaaatggactaaaaatgaatacaaagaacggagaaattgttggacgaaaaattgtataaaataaaattgcataaataaactccaaacaaaaccaaaataaataaaaaaagcaatcaaccacattgctacaaaagattggatttaatgaaaattctgatcaaattgacaaagcggattctaggagtaaaattatttaaatattaaaaaagcgttacaaaatccctaccaaaataaaatgacattcttaaatcctttaaaattcctatacgtaatatttaaataaaaaatacgtacatataaaaaatttaaaaaatcaaaacaaaaaaaaaaggcttacaacaccttcgattcccaggacgtctccgttccaagtactaagaaggcccaacgttgcttaacagccagatcggacgggatggcgtgctttcaacgtggtatggtcgtaagcgaagaaacacgcagcgcagccatcca

SEQ ID NO: 5421 - DNA, 5150 bp, Heterodera glycines
  misc_feature (7)..(7): n is a, c, g, or t
  misc_feature (13)..(13): n is a, c, g, or t
  misc_feature (33)..(33): n is a, c, g, or t
  misc_feature (36)..(36): n is a, c, g, or t
  misc_feature (45)..(46): n is a, c, g, or t
  misc_feature (51)..(51): n is a, c, g, or t
  misc_feature (56)..(56): n is a, c, g, or t
  misc_feature (86)..(86): n is a, c, g, or t
atttatnttattntatttattttatttattaanatntaattattnnaaatntaatntatttaaatttattttattttattttattntaatttattttattttattttattttattttattttaatttattttattttattttaatttaatttatttaattttatttaatttaattttatattttcagaacaattctgatgttttacagaattttcagaactgttctggtgtgtttcagaattatcagaactattcggacgcttaccagaattttcagaactgttctggtctgtaacagaattatcagaactattttgaagcattccggaacaatcagaattgttctggtgtttaaactgtaaaaattgcatgcaaaaacacaaagcaaaacacaaggcaaaaagttgtaaaaatgctcgaaaacacatgctaacatactgaaacacacgttaatgtaacgaaaacacacgtgaaatgttgaaaacgcatgcaaacgtgtcgaaaatacacgtaaatgtgaagaaaacacgtgaaaaaccggaaccggtttaaagaacgcacgtcgaaaacacatgtaaaccggttgaaaacacatgcaaaaacacaaaatccatccggtcggtcgaaattccggacattccggatgaatttgcaattgtaaacggattgtaaaccggaagaggaaaacacaaaaaaaatgggcttttttcgacctttgccggggtataactttgttcgaatttgtcgtagagctacgaaatttttttctcacccttcctctcgacgagctctacaaattgttcgcttactgcaaaagcgtagctcttacggttcccgagaaataaggtgaaaacacacattttacaacccatttttggccagttgtaaaaagccgggttttttttgttcgaacgcgattttctcgaaaatgtctgcttgtcgctaatttttccacacggttagaattgtagagaaaaccgagctctttcgaatggtaccggtctcggtgctcaactctcgatattcgcttgcggccaggtcgttttgtggttagccccccccttatttttatatatagataatcctatttcgcgtagtcgcgacattcccgcgacggaaaggaaagtatttaaaaagaagtgggtaaatcattggacatatacaaattataaatgttatcatcacaatcaaagtaaaaagtatagttaaaaaattaaaaagatttgttttgattaatgtatatatgaaattaaatatatcggaaaattgttcgagggaagttccaagtacgggtgtttcctttttgttattcgatgggttaattattttgtcttgttggctcacataattcagagtggcctcaattgttatttcactttttccatctggacatataacttcacatttttcttttacactcggttgattaaaggaaagctgaatttgctgttggttcccttttgtgtcacagggtatttgaaaattctgactatggcattttacatttgccaatgcggtaccaaagttagttgtacatgtaaatttaaattctgctccattggtgcatgagtaacatccttctaacgattttgtttttacagtacaattatttttgtcgtaaattgctttgactttgtgaccttttagcgtgacttgcacttgtagtgaagttgttaattttatttttgcccttaataaagtgtcgaagaatacttggcttccatgtgtctcgagaggcaaaatattttcttttctcgtgaacatttcagtgagtgggtttttctcacattcgcagtgaacaacggagtcacctccgtgacattgacaagcttctggtgggaatgtgcaactgaattttgtcgccttttctttagtttcgcaccgtaggctattcttaagtaaattctcattatcaactattacagcttttgcgtttgaacgatcaattataaattttgatccaaacagtggcgttggtggaattgaagttgaggtgagtgtcagagataaattcgagtctttaacatgtgttaagacaccaggttttaattccacagtatgtatggtttttggatcaagcgaaattttgattgtagctaaaatcgtccaagtcggacatttgaccacttcatatatgtttctattgattggctcggtatatgttctataaaataaacatccatcggtggcaagaaagcatttgcagtgccaaccaccacaggaaggcacacaataggaatatcctggttgattattggcatggtcaccgatttcaggattttttcccttcattgttaaagtttgacatatttggccagtgcactttcctgcacctgaacatcgcttttgtgagctcgacagtaattgataatctcgcataaaatattcagatctctctgcacaaattattgttagactttcaacagataattcaattgtttccatcgtagtgtgcgtcttttcattgtcgagtttcagacacgttttatgttccggtgtgattgaaatttgggttgtttgatcgtaaatacattcaatctttccgttttgatcaattgcgcagtcgtttgttcctgctaccatgttagtgacttcatcacatgaaaaaatagtcggtgaattgagtaaaaggctaatcatgattaaataaataaattgtttccgtttaattatttttattttctttaattttctttttctacagcaattgtagactgatagaaaaataaaaacgatgaagcggtatagtattcttataattttaagacaaagagtaatgacgtaaagggtgagcattatcatgattagtatcagagcccaatgcatttgaccaacgcattgtgggtttcgaatgtattccatgcagaaacgacatataattaattcacatattggtgatggagagcatgttaagtttttgtactcaggtgagcttgtgcctttaataaatttaatgactggtttatactcgttcatagtaatttttgtaggtagagaaataaattcttcactctgtggatttcgttttaggataaaatatttatcaaccaaaatttctaattccgtggtagcatgagttgggtttatttttattccaccttttatacattcagcggatatttgttcgttttcgaacggatcgaattctctttttttcgtttgagttcatccattaatgtgtcattagccaaataaaaaattctttcgatgcttccccatgcttttatcgggataatttctctatctgatttgacaagataagttttttcatgtggctcgtaaaagcaaaattttgttccaagtgtgtcagtgcattcgtgttcttgacagaatttttttgtaccaatcgtcagattgccctccccaaggcaacgaaaatcaattcgagaatcagcttgtgaatgaagtaaattaaggcttttaactgcatgaatgctattatcatagagcattattgaactgaatatatttttgtccattagggagcatttttccgttttattgaatgaacaaatgtttggtttgaagaatgaaataatttttttaatattttcctgatcagttatttctctttttattctgtgatatgaggcaaaactacaagaattagtccaatcaggacatttgcattgtggtccacaatagggtgggtgattttttatgacgtgttgtttgtgacaaaatattttacgataacaaaattccattgttaatttattttgtcttatagtaaatccattttcaacacaaaatgttgtatacttcgttctccatttttcattggtttttggacattcatataaatgggataagcatggtaagatttgcataaataatagaagaaacgtgagtgtgtttaaaaatactttgcttaattttggtaatgataagacacttgcttgttttctcttttgaactgtaccaatttgttcgtgttcagtgattaaatttgtgagagtctcattctcctcacagtcagttttgttaatttctaacggatatagcaattttaatggacggttaatgacattcttgtttggtaactcgacattagctcctcttatgataccatcttttcctgttatgacatttttaataattcctgttttccacattgctcttggggtctcatcatggattatgacaacttcattgatttctggaaaagattttacacaattctttggatttttattttctgttttatatctttctctcaggcttggtaaatattcttctatccaaattttccaatagtcatccaaaatttttgttgtctttttccataactctattgtttggtcataataagttggttttggtaaatatgttgggtcattagtttcatttacttccaaaattgggggaatgcatagatttttgtgcgggagtataaaatcgattggtctaagaatttggtacgaatttatttcgtcataaatgaatgtaattggtcgtgaatttactaaggcttcaatttcacaaataagtgtttgaaatgagtcaaattctatcaatttccttccaattgcttttttcattgctgattttacattttgatttaaacgttcaattgctccgttttgccaaggagctaattcgattgaaaaaatccattttatgttttccttttcaaaataatttttaatggattcgtctttaagcatttcctttaattttaggacttcaggtaatacttttgaggcaagtttcagttgtgatgcattgtcactccaaatatttttgggtgtcccttttcttgaaataaatctgcgaaatgcattgagaaagtgttgtactgataatgatgtcactaattcgaggtgtattccacgcgtggtgaaacatgtgaaaaggattatccaacatttttcagtgaaactttttacttgaagtggacccatgtaatccaggccaacgttttgaaaaggctctgttatttgaactcttgattttggcaactgcggcatttttggttgctgatatggttttgcgttatatcttttgcaatagaaacactgtttccttatttggtcaacaattcttcttcctttggggatcctaatatgttttacgaatttctgctaatgttgtcattgttccagcgtgtaaatttctttggtgatggtcccataataattaaatgagta

SEQ ID NO: 5422 - DNA, 2576 bp, Heterodera glycines
tcgctgcttcaattttgacatttgtcagaattgtttttcagtcaaaggactgccaaaagtcacaaattgtctcacccgatgcaggaatattgcacaccggtgccaatgagcatttggccaaactgagcaaatgccaaccattcgttcctttagacaagcgcgggcgatgacatgcgtgacttcacagtgatcatcaaaaacaaagtgcgccagggcaaaagtcgaattggctatttgccggtcgaacaaataaacgaaggaccgccgctcgaatgcaacgaccaaacgccacagaacgcggaaacagaggcaatgcaccagcgaatgcagctgatagccgcgagattggacaagcggcaaaccgaagcggccgaggcttttccgaatgccattgtgccgtctgaagaaggtcggaaaatggcaaattgggggaagcaaatcggcaatgatgacatatcagggaaagtgaagaacggaaagggggacgaagtggcggcgcaagtcggccaatttggcactcaaaatgcgcaaatgccaaccgcaataggcccaaggaatttgccaaatggctcggcatttgcatcggaaagccaacgagccaatttcttggcgcaccaacacgaggcgaagtcgcccaatcagttgatttcgcaggtggagcaggcgagcaaggaggagctgggacagatgctgcagaagctacaatacgaacatgagtaaaaagaaaagcacaccaaataaataagaaaattatcattggaacagcgaattgaaaagggcaattgacgagcggaagatggcactgaaagcggcgggaatgccattcccttccggaacgaaatccacgccgaatttattctatcaacgaacaccaatgatgggacaaagcataaacggaacagcgtaagaagaagcatttggtcctaatcacttctcttgtaatgaagaatgccatcggatggccatcagtcactcgaaatgggcgaagaatcgcggggaaggacggcggcctcaggtggaggatcaaactgttcagcgactgatcggatcatataaaattggttttcagtgccgcgcagtttgccgcctcagaattcgtcgtcggcttttcccgtccagcaacaaactgtgcttccgccgcccatccaaaggcaaatccccgcctctattcatcgtcaacattccctcgcggacgcttcttccacggcttttgccgcctccgctgtgtttcctgatgggcctcgttcgcaagcggaccaatggcaggaaatggccgtgctggcggaggcacaccatttgagacaacaccaaaaaaggctggaagagagagggattgtgctggaagatcaaaacagacaattgcaaatgcaattggaaaggcttcagatgctaatggcaaaggtggacaaacccaaaaaaggaagggagagaatggaaattggatgattaagaagggaaacgccctccaaacactgccaacaacagaagagcaacagtctcacaatcagcccggctttatctcctcaaccgacgcggaagacacggacatggaaatgcttgcgctggcgatgccaatcagagagattaaagcgatcggaataagttcaggccaattgggcacggaaatccgtcgcaatcggatggacaggtgaaaaagtggggaaatgagagaatggaaaagcattgaatgttaaggctgagagagacggtggacgaattgaacagggccatggagaactttgtggttttcacgcaaaattgtgcccagaaggagcagcagcaggacacggacgacagtgggacagcagacaatcaccagcaaacggtggaggagttggagaggtagcgagggaagcgggggaagcgaatggatgagaacgaagggggaagcggaaagattggaaagagccggaggaagtgaccgcatatgcacaaaagcacatcacataagcattgtctcattgcaaagtcgttgtttgctcattttttttttgtttttcattgccttttttcttttgctcaaatgtttttttccatttttccgtttcgtttttcccttttccgtccgttatttctccgttgcgtctccctttccgttgcttttcgtcttaattcgttcccttcgctccgttccttttccgttttgcttttatctgctgatccatcatcaccatcggttcgttcccatcgttcgtcaaaatttcgaagtttttcccattttcgatccaaaatcgttcaacgcatctgaagggaatgcgctgcctttgcaaatccctccctttctcacactcccgtgtagaagcaaatctcgcgggcgattgaactcgtcgtcaggccaatgttgatcaattgatttgggatgccttaggggtgacaaagtcaaaaagtcaatcccccgggggtttgttgtccattcgggtgaacctgcgattgttatcgcctcgacgtaagtcaacccatcagcttttcgcgttcccacaatgccggtgccgctatcgcccctaaagtgctttcctaataagacaaaatgtttcggatggattttatcccgagttttggtttgggcctctttgagt

SEQ ID NO: 5423 - DNA, 2047 bp, Heterodera glycines
cgtgtgcaccgattcgggtgattgcaaacagatcagtttgtcagagtcgcattctgaactttcgtcaattattgcgatgtccccatttttcgcacttttctttctttccgcgtctgcttcaatttccctttttcccagcagtgccattttgatctccagcaaatgtgccgatgggttcgattcgtccatttttctttctgatattagttccaaaggaaaaggattatcgttttgccaatttcctattttatttcttctttttttgtcattttgccggtttcccagctttccaatgcttttgctcaccttcctcgtcctgtgaattggttctgtccatgttcctctccgtgttcccccacccgtaaacattcattctctccgatagcttttcaaaatgcggtaaacatgcaatttgcactttggcgttgttcttgttgcccatttgccgtttctgctctgctttcaatggcacaacgttcagatcctccgccaactccacaatggcaaagtccgtctcccgacgtgcaatttccctacttcgcggttttccccttttcccccgcttttcaattgccattgatgccttagggtaaatcgctcgggaatctgtaaagcatgctttttgcgttctcatcggtgcaaaacttacacggcacgtcgaacatgtcctttttacggcatccgtcggccaagtccacctgcgcacaaacaccgcccacctgaggaaaagccaaacggaatcgcgggacttggggtgcttctcagtttgggcatttttacttcgagccaccaatttatgtggtattgtttctcgacttctcgaattgcttccatgcaatgccgtgcagtcaaaacgtgccgttgtgaaattaaagtgcctccgcaaaacgtttgtgtgccgagggcggaactaattgagagagcaaccgccttgaaggaagtgaagcttttttgcagcttttgctttgtccgtcttacccaagggtattcaccgggctgaagcggccttcctccgccgataaccatcccacggattttcactaaaatgcgcagaatcggcgaatcattgccattacagtaccaaaatattttaatttattttggcatttaattgatcattaattaatattaatcccccaaatcctccttcgttcttgtctgtttttacctccatttgtaaagtcgggatttcggcaaaacttttggatccgttcgttctcttctgcgcttattcttttcagctgcgatttgattttgccgacgaatgccagcagaaatatcacaagacaatgaattggcaatgcttttaaattcattttctctttctttttcctccgtttgatttttcccttttcgccgcccttttaaacggccaatgaatgctttttctttgctgttttatggcattttaatcagcacattttattctttgtgtgcttcataataaaatgttttcaaatgcattttaattgtttttcatttcaataatttttcgttttattattttaattttccatttaatttcctttgccttgccaatgaatgccccgccgctccctatgggctaaattaaattatttttgtctatttttgccacttccatcaatcctttacccacccgaactacacaaataataataggtaattccaattagttattttgcccttttctgatattctgatgtcccaaattttatgcaaaggtccgaaaaggaaaatttaattaaaagtgaaagaaaagaaaaggaaggacaaacttattcattcattcagcagaagaagaagaagggaattgttgaaagtagggttcagccccgaccccgagcccccgacccgacccgagacgttttttggacctattccccgacccgacccccgacatgtcgtccccgaccccccgacactaattcgggggattggggactccgagcgttgtaaaaatttaaaagttaattatacaatgaaggaggaaaaggttgaaaatttttgaaattttgaacaatttttcttaataaaattaatttaaaattccgaaaaaaccgttttc

SEQ ID NO: 5424 - DNA, 2434 bp, Heterodera glycines
cgcggcccccactcgcacggcatgccccgccggcatcagtgcttttgctgcagaagcaatgcttgcaactgaatttggaataattgaatttataaaaattatgggccaatttatcgccatttttctggcaaattaccgaaacactttttgtagcttttaaaaagccattgaatttcctatttaatgtatcaaataattatgttaatataataataataatcaatttgaatcgcttcacagtctaggtagcgaagctcccaaagcgcgaagcgctttttcccagctaaatagccgacggttaaaagttaattatacaatgaaggaggaaaaggttgaaaatttttgaaattttgaacaatttttcttaataaaattaatttaaaattccgaaaaacttttcggcggcgcctatcggcaccgccggcctcccaaaactccaaattttttcctaaaaattggctcgaaaatcacaaaatatggacaatttttggacaaaattctcttaacaaagtatactcattttcaaaaattttcccgacggcgcctatcggcaccgccggaccacttcccccaccccaagtttccaaaaaactttttgagaagcgcaccactaaaattgtcatagtttttagatattttgaacctgggaattcgatttacgatttctgaaaatttttggggcctaggattccttgttataaaatgccaaattggacgcacttttactggcgccaatgaatgaatttgaatcagatgattaaagtgaaaaaaggaagatttacgagcattaaaaagaaaaattgtttttttttgttaaataatttcgttgatcactacccgatcggggtccccgacccccgacatgtcgccccccgaggtccccggcccccgactttttgcccccgagggctcggggccgaaccctagttgaaagattcgtcacaattggaaaaagtaaaaataaaaaaagagaaaatgtaaaacaaaggaaaaagacaaattaagttaattgggctaattagtgccatttgcagcaacgacccgcgctcaattaggagttcatttgataatttatgacgacaaataaaaggaaagcatatgaagaaagtaaaatggtcagatttgttctaagggcaaatgtttggtccgattcatttggtcgtattttggaggcgaacaacggcaaaacattcggaagaattgttgccgaaaacgacgcccaaaaagcgaataaatgagaatatttgttgcactgaaagggaactgctgacattgctctacttaaagtcatgtcaaattcacctgttcagacacaccaaaaagttgccaattggaattcgcatattccgtccgtcgtcccttaccaagtcgaatgcttcgattacgtggttaataccttcattaaggacggtaaagcttgatgttggacctttttactgctcaccggccaaccaattgaatgccacgaaagcggcgattgtaaccaccgccattttggtgcagcgcgagtccaacgcattcgagagggaagagcccgtctcgtgctggtggagggagaagctgcgtattgccatggcatttccgttttcagtgcctttggcattcgctttttcatctgttgttgccgatttgcgctcgttccttctgatgatcggcggctgagttggccttttctgctgctgcgctgtgctgcctttcagcagcgactgtttcggctgaatgactccgcccgcgaaaccattccgtccgcctccgtcgctggtcgttgtgccgctgccacggctttctcccgttgttctgtaaatgccaaagtcatagaacgaaattcgaacggaatttttttgcaaatttggatggaaaatgaaaagtcagtcatcctttgatcacctccttctgatcacgcgcatttgacaacgttgcgcattggcctttcgaatgatggacagaatttgagcattcagcacaattataaacagaaagggagcggccaacataagcagcaaatagcctaaaatgggagtggggttaaattaattaatggattcaaattagatgaggaaaaactcaaaagattgttgcaaattaaccactgaatgcgctttaccataagtgtaataaatgatgaagtagaggtggtcctggcgcagttccgtcttcgtcagtcggccacattcgttcagtgcgaccttaaacaatcaatcagtgagtgcgaatggcactttttgctatacttcaaaaaaggacggcattttgaaaaggacggccactgcggtgatcgaaaaaacgacagttcgcgcgcgattggcggtgcacctgagaaaggggcgaccattggcgaggctaagcaaatcgttcatgccatgctcgcatgtgaagcgggtacttaacagccaaataacggtcgatggttatggccacaaccagtccaaacgct

SEQ ID NO: 5425 - DNA, 2933 bp, Heterodera glycines
  misc_feature (2854)..(2854): n is a, c, g, or t
ggcttagaatcacattttattattttaaaaattaatttctggttaatttttattttttcataagaaattttataaattttcaaaaattctcaaaatatgtaaaaaaaaaagaaaatatgtacgaaaaatttgccgaaattatgaatttattttgagcattttcaaaaatttctgtaaaaatcctcaaaatatgtaaaaaaaaatgtatgaaaaagtccgaaaaagtccaaaatatgtaccatatgtgtataaaaccccgaaatatgtaaataaaaattcccaacctttgttcgcaaacacaaaaaagaaagtgtttttcctactaattagagcatggagaagccaggaaaaaaatatgtatttacataaaattgacatccctattaatgaccttaagaggttttaatttggtaagaaactaattgtttttattttatctgccgattcttttcaaatttaagtagcttagttaaagacttttttcaacattgtaatagccgatatttgtgtattaatttttaaattttaatctatcatcaatagcatttttgttggttgttcgtaatcgttgtttgtcgtcgttcccttcgggtcaaaaaagacaaagtgagcaaaaagaaaaattgcaaaattatgccacagaacagaacagaaagcttttccgaaaaaatgatgaaatttggtaatggaaggaaaacaaataaattacggtgggattatcgtccaattgttcaaagcttaaagtgttgtggtggtcaacgagaatgccaagcacacaaaattaaaattattacagggaatcaatggaaaaacggcggcgcgaatttcacaattacaaaaaaacgtttttttaaaatattttattattttttaatttaaaaatgtaaaaatccgcggcgcttttcccattgaaatacacaacaaacaatcaaagaaaataatataataggcataaaatacggcaatattcatttttaaggtatcaatttgctcgatggctcctcctcctcccctcattttctgttgttgttgtcacttctccccaaacaaattcaacgccatttgctgccgttctctgcgccgcccatcggtcagtccttcagctgagtgccaatgtctccgctttcgtcgttgctggtgccatttgtgccgtcatccgtcggaggggcaaatcctgcaaaaaatgcgtggattgagtcagtcatttctcggcaaataaatgttaattcgaattcgcaatcctgcattttttggaaaattcaggatttgcagattaatccggccggatccggcccggcaaaaaattttgaattacaatcctgcaacaggatgcgcaaatttgatttttgtgcgggatccggcaagatccgcatacattctttgaaaattttaaaagacggaataccaaaatttttgaataaatttataataaaatcaatcaaaataaattcaattttcatctcaaatttcacctagaatttgcaaaaaaatttcccggcggcgcctatcgacaccactggatcgacattaatcctgtagaattgagtcaaaaggtgtgacatttggtcattttttggtcaaaatcagttaattaattgataaaattttcaaaaaaaatttcagacggcgcctatctgcatagacggacccctttgttcctagtttttgaaaaaattgcgctgaaaaaaagcgtttttgaaaagcaaaaaatagtcaaatttattgaccattaacagatttgatttccgatctctttttaccgtctgacccattcgaaaaatcctagtcgcccttttaacgcatcccgccaacccctacaatttcttgtcaggtattttttttttggaaatttcattcgaattttttcaaaatttctaagaatccgcaatcctgcgcgggatcctgcaaatttaaaatgcaggattaatccggccggatccggtcctgcaaaaatttttgaattccaatcctgcaacaggatccgcaaatttgaaattttctgctgtaaatttgattaaataaaaattaaaaattgaggagttgaagaattcgaaatgtgaatgattctaaaaacaacgcaactctaaactcaaaatatgttcaccttcttccgtctcgtagagaatttgcagcaccgaagcgacctccaaactgccgacattttcactgtccttaagcaaattttaattttttttcaaagggaaaatttcgtcgattttcccccatttgtgcacaatgacctgacaaagcacctcaatctttcgaagtttggccttaaaatggaagacagaaattattatttctttttcgaatttggcaaatttcacaaagtaaaagtcgcgttccctctcgaggccactgatcacttctaaaatttcactaattttgtttttgaaaaaattaaagaaatttctcaccgtccgactcggccaattggttgcgcagctcatcaatttcggtgttcttctgcttcagttcctcgatgagctgtaaatttggaggaaactttgaatgagtcatcaagaaagagaaaagaacttgaaaaatcaaccaatttttcaagattttgctaaaaatttaaaatttttcccagggcggtaacccgaatttaactcaatttgttgttgttttattttcattttgaacttattgttaaatgatttaaaaaaatccttcattttatgaaaataagaaacaaagagagatatttcaatggttggtgcacccctccaaattttatcacaaattcccaaattattgaaaattcgccactttataaattgaaatgtatggtgcacttcatttcccaccgtcgttctcacccccccccccccaaagttaaaaaatattctcnaagtttaagatttttgttgaaaattctaattataagtctgtttttttttaattttcggtgggaatgacgaggggggggg

SEQ ID NO: 5426 - DNA, 3535 bp, Heterodera glycines
tcctgctaaatatcgggacttgtcggcttatgctcttccattctcccaactcatggtctcctaatttgccacttttctcctgctcttcagttgggtggtcgtcgtcgtccgttgtggcattttcagtgcggtactgttcgccgtcgctttgtttattttgccatcctttggcaattcttcgtaattgcctataaatgattgctcaacaaacatttagccccgcatttgtccgttttgcttacgcatttccaccgggtcgtactggtggccgtcgtaattcgcgtcaaagaatttcttgaaccattgcaaaaactcgaaattgtcctaaaatggggcgagaaaattcaaaaaaatatgaatgaataaactcaaaacgttctaattccctagccaaaagccaacctggaatttgcctttgatgagctaaaacaacgagaaaatgttgttgttttttttgtaaaaatcaaacgaatgtgctcaccttttccacgggtatcactttttcgatgcccaattgtttcctgaaacaaattttcggtataaataaatgttaggtatgtttttttttgaatataccatgaagtctgcacaattttccaattggacagccaatcctacgaaaagaaaagggaatcaacacagttaagaaacaactttaaaaaaatatataaattctttcgaaaatccgagcctccccccaatttttaaaataatttagaaaaccaaagaaatctttccaaattcaggtaaacattccatacctgtgcaagggggggggggtcagccaagaggtcttacgatcgacttgaccccccccccatggggtggtcagagcccatttccattgcgatcgaccattttttcaaattcttttctagtgagacctttttttttttgcttctcaaaacacctttttttgcggcgcgctttttccaaataccttttaatgaaccgggggggggggacggcggtgccgataggcgccgccgggtaaatgttgaaaatttgagtgcgatttgttgacaaattttcaccaaacggtgctatttttgcgactttaagtcaagttttttaggaaaaattaaggctttttataggcgacgcaagggaattttttttttggaattctttaaaaaataggcaaaattttgggattttttttaccccctctcctcttactatcgacgaattttcctcacaaatcggaattagtcgatcgtaaaaatttggaatttttaatgaagtttgttaaaaaaataaggcaatttttctttgtaaattttcttttttcacattaacgatcgactttttcgtggatttttttctctctcactcctttttcttcttctcccttcacccccctcttacgatcgactgtcctgaacccttatgatcgactaagacccccccccgtgcacagatatgaaatattcaccagcaaaattcatgaaaatggggcaaataacaacaacaaaaagacgcacaacccgtaaaacgggtgaaaagcatattttagaagtgaatggcccgtacaaattaatataattttggcctaccaattcgagacgactgttgaacttcaccttcttcagttgaagtgcgccggggaagagaatctgtgaaaagggacaattgtttttttttaatttattataaattttcattgtttttatctgtgaaaaggcaatagccggcgccggtgtgcaactgaaaaagaatcggtgaatttaaaacaatgggattcatttaattaatccggaaacgaatatgcttagtaataattgtctggtcacctgttcgagtttggcaaattcggactgaaaatgtaaaaaaaaattgatgccaaaagaattcacccaattttaccgccaaactgaggttgacccacgtcaacatttcatggcgtgacaggggctcaacatttgcggaggttaactgaaaaatacacaaatattagattttcctagccggtcgaaattgagaacccgctcactgtctaagggatgtttcgggatacgaaaacagcagaaccggttttttcaagtcgagattcggaaattcccgcacatcaacgccctcaagatttttgggtgggaaacttccgttcaaaaaactcactggaatgttcgtgactagcgccatagggaagcgtgtgttgatgaaatgaaagcagcagaaaaatacagctaatgttgaaaataaatttacaaaaataaacaattaagcaaaaataaaatccgtttaattacgttttcaatttgttgttggacaaagcaaatagtatttggtaatacatgcatattatatatactacaataatagataataataataataataactgtgatgaagggacaaaaatcactaaaatgcattgctgctgatcaatggtgattgtgtgatgtttgaatgaggggcaaaattcaagaggattcgatttggcgatgcgttcatttggtctgcttctcctcctcttctgctggttggtcctcttctcctccttcttcttcttcctcttcttctgttactgtttgctgtccgctgtacaattggaccaacgagttgtagacgctcagcggacggtgggccggcgtgtgtttgatggacggcactcggacaatgcgggcaatgtcctaatttttgtataaagaatgagtcatgtttccggaagctttatggtgtttttgttgtcatcatttgacacccatttacacagatctgaaatccccgactcggacaaaaattaaattttggagtgggcgggtcagaactgtacaaattatgtggccaatttatgctgtattctgcgtttttttattacggatttaaaaattagaatttttgaattgttattaaatttgcgaaattaattgggaaattagtgtcaaatgacaagcggacccccaaaaattgaaaattttcaaatattaataaaaaatagcaacaaaaaattgaaactcaactgtttgatgctgcgaagtgaaccctaaattaaagtgaaaattatagtaatattatactatataaaaaaaattttccacctcccctttaaatgaccattcaatgtaaattttttaacaatttaaaaatttggcgcctgaggcgggagacaatgtcaatgcccaaaaataaatattttactaaaatatttaagaaaatgtacatttgcttttgcgtattttgagcatgtcccagcgcttctccggcttcttttgcagcacgccggtcagaagttgggtcaacgactgcgaaatgggcgtcggtggcatttgcagcggtgccgtcgtgatgttctcgaagagctgaaaagtttccgattgaattaccctaattttggggttttcccattctgattgtcacaaactgactttcatgatgacgtcaccgtcaaatggataacaaccgctgaaaaagaagaaacaaattgttgaaaaaagaatgatatgtttgtttgtttgttgcttccttctcacctgaccaaattgtacagcgtcacaccgcacgaccaaatgtccaccaaacggccgctgttaaa

SEQ ID NO: 5427 - DNA, 1470 bp, Heterodera glycines
  misc_feature (7)..(7): n is a, c, g, or t
  misc_feature (27)..(27): n is a, c, g, or t
tcaaatntaactctaaatataaatttnggaatttgagtgtgctctttaattattattttttgcacataaatatttgtccctacagatcgcatatcttcagtatgccgtccagactcagcagcaaattggccggctttatgtccttgtgaatgatccgtttggtgtgcaaaaagtccaaacctaaaaatcgaagggtgaaagttggatggattttgtggagaagccatttttgcagcctccatttatttgtaaaaaacacatttttatgtcagaatcggaagaccaaacacattatgtacaaaaacagtttttgaattttctgaaaacccaaaaaccaaccatcgatcagttgagtgaagtaaaggtgggcctgaaaaacaaaattaaatcaagaaattatttttgcttttacctgaaattctgagagcattttctcagtgcaattgtccaacatttgttggaggctgcaaacacaaaattccatcactgaaaatttgaagaaaaatcagttgaaaatgtccgactgatggctgaccaatgtacaacttctgcttctcctctatcctgaaaaggacaaaacattgaaaaagaagttaaataaaataattgaaaaatgtcaaaggacctgaaaatgtcgaacactttcaccacatttcggtggttcagccggcgaaggacgtcaatctcacggtgcacattttgctcaccgcccggaattttgcgcaaccgtttgtcctcaaaagcattggaaatttgatggaaacggtgtcataaaagcggaaattggttgaaaaaacggggaaaatgttttgcttttggggaacttattttgaaataaatcagaaaaaatgtcgataaattacaattcttgtcaccatttcgagtgcctttttaaggagggggtaaaaccttgatgattttgacggctcgcctcatcagtgaccgcacatggaccacttccttcactttgctgtacgaaccctcgccgatcagatcgccgaacaaataaccctcaatgattttgggcggcttctccatgaacacctcctctggaagaaaggcaaagatttgttgaggtattggcaaaattgtttatacggcaaagggccggcaattgtgaagattattggtcccacaaaaaaagaataaaaaaactaaaaaacatgtttttaggggttatttgatgcgctgagcacgaatatgacatccatttcgaccaatttcgaaccaggacccgaattcaaacaaaaagtcgaaatttaaattttcgatttagcacttttagtctaaaattgactaaaactagcagaaaaaaatcataggcaattttaacagcaaaatgagtcattctatgcaaattaaaacatacccagaagtaaaattcagaaaatttacactttcaactatgttcgaactctggtccggggatcgaaattggatcaaatggatatcttattacgagatcagcga

SEQ ID NO: 5428 - DNA, 1799 bp, Heterodera glycines
aaattttaaaattattttcgaaaaaattaatagagactacgaatcaaatatcctagagttgaaaaatttttaaaaattttcttaattaaatttttgtaataaaatggcgctggaacaaaaaccgaatggtttgattcatttaaaaaattttaaaaattattaaaattaaatttaaaaattggaaattttacagcaaatgcgcggcttctcctttgacctgtcgcttgcctccgtgttcatctttctgctgtcctgtttgctcggcgtgctcggttccgtggtcggctttatgcacgcccagcagcagcaccagcggcgccatcgacggatggacaggcaaaaaaatgaaataaatataaaatgccatcaggaatgcctgccattattttcaaactcaaaaaccgaacaaaatgccggtttctaggccaaaatggcactcccgagagtgccatggggaggaggaggacaccaagatgggccaggccgggttttgtgacaatttatgtacttagtgatgaggttgttgggtacggatggatcagtcactttggcacgggactttttttggcacaaaaattttcaaaaaaaggtcgaaaagttttgaaaaataatatgttcatcaagaattttcagataattaagttctttttgtttttggttttttgaaaaacctacaaaattcaggaaataaatccttcatataaattctttacaaaatatttttaaagttttctctattagcctggaaaatttcatataaaattatcaaatttattatattttcatacattttttcccaaaattgaccaaatttttttaaattttctatgacttacattcccatctcacattatcattatcattaagtggattaattatatacccttattgatatccaacttttgtcctcgttcaattaatccaatttttttttgtgaatttcagcaaaaccttcccgaaaacggagctcagtacagtatcctcgtcagccaatgaccacaacagtaaccaccaccaccatcatcacaacgagcacagtcagctgagcatgaccaacatggccaaccaaccccatctgatccgcatccgtaacgaaggcgccggtgcctcggtgattcgggacaattccatcggcgtttgaattagcgcgctttttcccccatttttggcatatgatcttggcactttttttttgcattggcaactttcatctccatatgtttataccatttattctcttaaaattgtaaatatttctttatttattattcatacatatattcatgagtacatttatacaaatatatttttttggtcctgtcctcccacggcattttttaaaggtctaacaaaatgcaatttgttttggcacatagcaaacttggctgggtctgggatttttgaaaaagccatggccggcatggagccgggatcctagtcaagttttcgggatttgactggaaaatagattaagtctattttcggcggggatctgatccccgaaccccggggtaatcacaaaaactaatgggtttaaatcccggagatggaattttacctcttttttccgtttgcattttcatctttcatttaatttaatgcatttatttaaaaattctttttaaccaagatcaatttgtaaatgtattcaaattgataaattgaaaatcgctttaaattttttttaattttaagattacttacatttttttctattttttaaaaaacgttgccaaaatttctttaaatttttaaaaataaatttttgcatattttaaattatttaaaaaaattatttt

SEQ ID NO: 5429 - DNA, 2391 bp, Heterodera glycines
tttgaattagcgcgctttttcccccatttttggatctgttcttggcactttttttttgcattcgcaactttcatctccatatgtttataccatttattctcttactttatttattcttcatttttcatgagtacatttatacaaaaaagcatatatttttttggtcctccttcggcattttttgacggtctaataaagtgcaatttgtttggcacaccgcaaacttggctgggtctcagatttttggaaaagccatggccggcatggagccgggatcctagtcaagttttcgggatttggctgaaaaaatggataaaaaaatttttcggctgggaccagatccccgaaccttggggtttatcagggaaaactcaagggttgaaatcccggagaattttccgggtcttctacagtatgctacatttggtatatcgtacaaaaaatttgtattacattttatatgccgttgttttattttatttttctttcctgataattcgaaaaacaattctgatggcatggattttacctcttttttccgtttgcattttcatatctttcatttaatttaatgcatttatttaaaaattcttttttaccaagatcaaatttgtaaatgtattcaaattgataaattgaaaattgctttaaatttttttaatttaaagattacttacattttttctattttttaaaaacgttgccaaaatttcttaaatttttaaaaataatttttgctatttttaattatttaaaaaaattattttgttattgcttagaatttattacttttaaaatttaatattttcatggttgacaaaatgtgagttgggccaacaaaatcaacaaaaatagacgaaataaatatttatttaatcggtggtcgctttcgtccgtcaacatttggccctgttttcactttgttgttgactttagttaatcccttttaaaagtgcgaaatccccccccccaattttcttgtcaattttttgattttaaatttttcatcaatttctttctttatgatatttttcctattttaactgacaaattttaattttattataattttcataaattttaattattttataatattttatttacattatttctccctgaaaatttgttcttcaactgatcagtttgtttgcatttgtgcttggcgattggactttttgttgattaaaaggggattaattgcgtggtatgttatttttctaaaacttttaccgttgattaacccgggattcgttcatgaggtttcgaacccattgggatttagccatgggccccaaaattagctgtgagatctcgaggtctcacctgccggccattttcccgaattcaattgtgtttttgaatgatacccaatctccgagatttgtatcgagaaaattggcattatccggcaagatttatagttggctttctgtgaaagcattgtttgcttctttttcaacattggaatatatatttcttaaataaattcttacaattaagcacaattttccttttttattcatttggacatttaaaaaaataaaaagctcttcgattttatgaatttcaactcaaaaaaatggcgcagaaatattaaaattttggttgaagtcagtggtttaggacttgagttataacgtaataaaagttttagagactcataaattttcgaatatgcattaaattgcttagcattagctaaggaaaaattctataattcaaaagctttcgaatgatacaaaaattgttcggtttagtggggaatgaagcgagttatggctgatcaaaagaaacaacacaaaaaaggcatttatcggtgttttttgaattagcgcgcaaaaaaaatttctttttggcgttctgaacaattttgtctgacacttacgcttgacagcgggaggttcagcatctgccttaattgtgggaggaaaaaaacccatttttgaaaaaatatgaaaaatctgaggcagaatttgcggaaaacattttttcagggggaggggattcgtgatcagtggaccttgaaaatccagtggaaagaatttaaaaaccaaaaattcgaaaatgggaggggggattgaactttttgtacgatgttggaatcacaagcaaaattgaagttaaagctgattttttaccatgcgaattaacgcagttgaacagcgacggcgaatatgcaatgggaataatagtgaaaatggaagccgaagacggaataattaaatggcggaaaataaagtgtcgcaacgcttttatatgcccaattgggtaactcaagcgcgcggtaggggtcagttgcgtctgagccaagcataaatgatcagcagcatttgtgagtcgctgtataaatgtccgaatatttcacaaaatttctgaatttctgaaatt

SEQ ID NO: 5430 - DNA, 2851 bp, Heterodera glycines
gggctgccatgtccatgtcaccgaaagagttgctctcgcgccaattgatgcccaaaattggcaaggttcaaatattttgttaattagaaacatttaaaaatagaaaaaaccactttctttcccttttatttgttggaatgagtttcgatttttgaaattcttggtaattttttttttttgtaggctaccggtcttcgtccgtcgctgaactcggacctgacgctgaccgtcacattggaaaatgacgaatttgtgcagtccgattttgactttctcgtcctgcattttcccgacgaattcatgcgaggccatggtaacagttttccaatagatttttttgacgttttagtgattttttttttgatatttgggagtttttagtgggttgtccatattttttggctctattccaaattaatggaatttatgaccgtttaaaaaaaaatattttggccccaaaacggaggcgccgtggcggagggagtcgcacaccaaattctggtggcacaaatgccgttgttgaagaccatgccgtcgtggacatggcctcttctctgctgaccaaaatgaagatcaaagcggcgcgcgatcaaatgagccgtgccgtggcaaagtgagcgatggtgcaccggggacggtcccacgtgaaattatgaaaaaaaataatagacctaagttttttttatcatagtacgcccatcccatccaggcaaaactcacactgttttaacttctcgcaagcacaaccaaattcattttttccgcataattcgatttcctatttctctattagcatgcgtaatgtcaagaaaaaatatggaatcaatttcctgatgaatggaaaaattattttttttcgaatcgggcataactttttttttgaactttattcaaactttgaacttgaattttgtgtgctaatataaaaagtgcaacgaatttacttaaaataaaatgggcgaatttaaaaataagtcagaaatattttaaaattctcctccatatttaaattccattttttgctagcattttcaaattttcgcccgcctcgcttccatgcacttgcaaatccgtcactttggagcggttgccgttgttcatcggcggtcgctattgcaaatactcgcgcgcactgccccagtcgccatggattggcgccagcgatgaagaagcaccgccggcggcggtggtggcgacaaatgacggtggtccagcgactgttgaggggatagcgattccggcgactgttgcggatgagacagcgacgccggcgactgttgaggggatagcgattccggcgacttctgcggatgggacagcgactgttgaggggatacaattccggcgactgttgcggatgggatggagactaaggctgcgcctgccgtcaaaattggcactctgccgacggcagcacggcacattctgccgcacagttcggtgagacaccaaacgagctaaacaaattattgaaaaaacgcttttttctaaaagatttccgagaaaattgcgggcgcaatggtgcgacactttggcgccgatgggagtcgtttcattgcgtccggccgtgaggacattgacgtgcgaatgctgggcaatgggcgaccattcgctgtacaggtgtggtgggtgtgggtgtttttgtgtactgcttgaaaatgtagtcgttttttatggaataggcccagagatttcgtccaacaatagccaaaatacgcttttttggaggacattttaagtaaattttaataggatttgggtccgacacagtcgtcatgctgaggaagtttggattacattagaagttctgtcgcgaaaattcactgaaaattttgctttaaaataatccacccgttttcctcagttgctcaacgcgcgcaaaaccgcgtgcctgcgcacgcgtgcgtctgccgccacggcactgtccgcgctggccgcccaaatcaatgcgtcggaggagcgcacgcgggacatcagtgtgcacgcgctggcccatgtcagcgcaaagcaggcgcagcagctcaatgttggccaagaaggtgagcgttgggggggggggggggaggcgtaggaaactttaaaaaatttcatttaaacttaatggtttttcaaataataagttttaaaaaaaaaattcttttttaattttttttaaatttcttacaattaggaaggttttatagtaggtaaattattttttacaattttcataaaaaggaattaaaaacccaagtttttttcaaaaacaacaaaaaaaaaaataatttttttttaaatttttcttgtcaatagaaaagcgcaagacgtactccgcgctgtgctgcacacgcacaccgctggtggacgacgtgccgttgcgcacgctgcacgcgcacccattccctgtgcaggtggcacaacgcaccgtggtaaaaatgggggggagggacaaggcggcccaattagtcttagaattgaattaggtaattattttttaaaacatttgaaaaggtgcgcgtgctccggcggcgtccgctcatcgaccgcacgcgctttgtgtacacaatgcgtgcgttcgcgttggaccggcaccattttgtgctgcggctggagacccaggcgggcacatagtgagcaacgaacgaattttcaaaatcaacccccccccccctaaccaataaatgatttatttttccatgaattttcactttccagaaaaatggactgccatattttttgttgtcctaaaattttatttagttttttgatgactaactatattcaattattcaaatttaaatattatttattttatttatttattggaaatcatcgcgtgctaatttttcacaaaacaaattttattaatcat

SEQ ID NO: 5431 - DNA, 1963 bp, Heterodera glycines
  misc_feature (10)..(10): n is a, c, g, or t
  misc_feature (22)..(22): n is a, c, g, or t
tatcactcanttgtcagtcacnttgctgtgttcaggtgaaccgttgtaaaatgccaaaatgtgcacacggaaagggtgccaatttgcggtacggcaaaaaatgccatcgcctccccccccctatcgatttcatcattttttttcttggccatgccattaaccggcgccgccccggggggcgggcgaagtttccgattaccccacaaaaattggggcgcacctttcacattttcccccaattttttatcccattaaattgtctgaattaataacagtaaaataataataaggtcccaatttttgtgggccaaaagcgccaaacgatgtcctaaaaatcggaaaaaaatactggcaaaatgaaaaaaaaacaatttttttttgaaaattttgtagggtctaaaaatgttaatttaaaaaatctcaaaaagaaggtgctaaaagcccgaaaattaatctataagagtataggaaaaaaatttgagggagctctataattttaaatttaaattaaataataaatttaaatttttcctaattcaaatttggcctttttaaattaaaacccatttaaaaacattgaagaaatttaattcaataaaattatattcttaaattttcatttattaacctaataattaaagaaaaggaaaattattatttacatactttaattttagagaaaagtatgcctttaaaaataattattattttgtgatttggaaattataaattaattttcaggggaataatttttgtattttaaatgattttctaaatttaattttctttttttagaaattaaattaatttcatttaaagaaccaattttttaattgcctcacctttcatcacacttttattatattatttttcatttaaccttaaaaaagtaaattaaattaaaatacgcaaaagttaatcgaatcgaaaagtttatttaataaagttttttcaaaaatattacttttaaattaaaatttttttaatataaaatagtttttattaaattttattaatttaaaaaagttttccttttaaattttcttttattttccgttcattttaattttaacattcttttaaataaacgttctatcatttttctctttaatcaaaaaattattttcaaattaatataattttaattaatttttttttggattttcgtcatgacgctattttccaatcctcgatggtttggcggtgccaatgccaagccaacaaatcggaggataaaagaaatttaaattaaattacgcaatatctaaaagtgacggtttttaaactaaaatttattataaaatatttttattcagttttattgaattaaaaaaaggctttgaaacaaaaattcatttttttaatgtaacttaattttaataatttccatcatgacgtatttcctctccgcccacggagggcgatggtttggcggtgccaatgccaacaaatccgcggatattgccctctgcccgatttgcacaatgccaaaagggggtgtgtgcttgtgtgccacaaatggtgtagtaatccgtcggtgtttcctccgcgtgccgtgccgcccccatttcttgccgatgtgccctttgttccattggcattatgtacataatgtacataattaattttgcaccacatttttctcgcgcgtccatttccgagattcaccacttttttttcttccacatcgccgcaagcagagcacagagtgccaaagattgttatgagtctgtttttttttgttgcctcaaagttcgttgcgtttttatttcctatttttgcatttgccgattattttttgagttttggcattatgtaagcctaagaattttaattagccaattattatttaattagattttgttagcctccctcataagtctgtgtaccgggcttaattgagcgccgggttcaggacaaattgcgtaaaatgctcaactctgtcccaaattcagcgaagaaa

SEQ ID NO: 5432 - DNA, 4798 bp, Heterodera glycines
aataaagataataaataatttactatttaattttttctctccaagtggcacgccgcaagggaattaaaaaaaactcattagttatgcataattagtttcctatgtagacaaaatgggagttatttcataaaatccacaaatctaccaaaaatacggaaagaatagtaaatttaaaatttaacatgctgtctcgcaatatctcacactgtctctctctctctctcacacagtctctctctctctcctctttctatctttccctcgctctgtttctcttctctttatctttactttatatcactcattctttgccaaatagaaagcgacacaaagcgacgctaacatttcgcacaattgtcattattacggatgatacttttagtgacgaaaaatcccgaaagagttaactaaaatagttacgaaaaagtgccaaaataatgacaaaatagtgaaaaaatccaaaatagtgacgaatagagacataattttcagccaaaaattgagcaaaaataatttttattcactatttgcagttgcaaatgagttggactgagatttttaagagcaaaaaacccaaaatagttacctaaataaagtttttaaacttaaaaatttttgccaagaaagtaaatttttgaataaaaattttttcatttcataggaggagtatattttgaaaaattttagctcgattctgaggggtgtatttttttgaagtttttttaggtcgattcttagaggtgtattttttatagtgacaaaaagccaaaatagtgatttttaactattttagtgacaaaaccctcaaaattgtgatttctattgaccgataatggcctcagaatcaaaaatttttaatgcagaaatgcgttttttgagcccctttcttcaaatcaattgagcaaaaaatttaggtatccctacaaatgagagcagtgccaaaggtgtgacgcaacagcgtgcgtcaattggtattgattttctaacagacacagaaaaaaaataatgagagagactgagagataacaaaagttatcggtgcatatcgattcagtgccgacgattcagtgccgacgattcagtgacgacgattcagtgtgaagacgattcagtgccgacgattcagtgccgacgattcagtgtacgttgaaaagccgacaattcagtgccagaaaatttggcaaaaaattttcaaaaaaacaactatgtagatgccaacggagaccggctaatttttgaccataaccgagcaccaggaacttgccagggacctagataatgccggataccgtagacctcagatcttttttccagaaccggaaccagaaaccgcaagaaattccggagaaccgctatctcatccagaaaaattttaaaaattcaaaaaaattaaaaatttaaaaaaaaattcaaatttaatttatatcaagtgaaaataatacaaaattatttggttttttataataaattaaattaatgaaaattttcaaacaaattttcttcaattatttcaaacaattaatcatttttggactaaatcatcgaatattaatagaaattttttaaagaatatattaattattattttttatttttccctttgactccaattttcttcactaatttttcactcagaccccattcttaccagtgcttgtttttcccggttcccggttgccctaccgggaccgggacctgagcttttcaaaatccggtctcggtcccgtggcactctactctaaatagtaggaaaaacactttcttttttgtgtttgcaaacaaaaatcgggacttttatttacatatttttacatacatatttcgggattttatacatatttggtacatattttggactttttcttacatattttgatttttttttacatattttgcgggttttttacggaaatttttggaaatcctcaaaaaaaaatccaaaattttggcaaatttattattgttttatacatattttgagaatttttgaaaatttttagaaatttctagtgaaaaaattaaaaaaaactttttttaaatgtacccctccaaaaataatttttttaatgttaaaaggtgattctaaacatatttaggtcattattttaattttggattgatttagcataagagtataacaataacatcagacagaatttctaaccacttcaatttatattgtatttttaggggtttttttgaaaattttttgccaaattttctggcactgaattgtcggcttttcaacgtacactgaatcgtcggcactgaatcgtcggcactgaatcgtcttcacactgaatcgtcgtcactgaatcgtcggcactgaatcgtcggcactgaatcgtcggcactgaattgaccggctccgaaagttatgactttttatttacataattttcttttattttacaaatatcatattttaagaatttaaagaaatttcgtataaatgtaaatgaaatttatttgaaaaatgaaatctaaaaaacgattctttcaaaaaagagaaataattaattaatttaaaaattctaactaagcctaatgaatttatttgtggtagttttgttttttcacccccggtctgaaaatttttcaattctttgttttgggctaatattatctggtcatgaatccgatattttattttaaccatcgtttttccagtgagttatgtgaaaatgtaattcaaaattttgaaaataaaaaattaaacaggcagcataaggcaagaatattttgtaaaatttcatcaaactaatcaatccttgcatcgtttaacacctagcctccacaaaaattcgcaaaataatgcaagtgaaataaaaaacggttttttcaaaaatgagaaataaaaattaatttttaaaaattttaaattatattttaatcctattaagtcattttgtggtagtttgtttttttcacccatgagttgaaaatttttcaatttattttaggctaatttttgtctggtcacgaacccggtgtagtgctaggaccgataaattaaaccgagatttacattttaataattgagcgtaccccgtaaaatttgaatactagtgtcattttttctggcatttcaatgcatgattttgtaaaattttttgtccaaaataatctttaaaataattttttattcttttgtacatgagtgagagttttgtccttaattctcattttttatggaattttttttgctattttatctacatgttttgcgaaaatccgttcttgattatataactgctatttatgctattttatttaaattccgatgcatttaaaattgtaaattatgccaattatttattatacaaggaacaaattttattcagtttgtaattgtcataatcatttgaattttttcagagaaatggcataatttaagtcatgcctacttacacaaaaattcctattgattaaagattgaaaatttatggccttgccgaaagtttatgtttcaagttttgcaaacatggcgattttttattaatgaaattttgcactccataaaataaaatgaataagaaaataaccttttttatgcttcttgacaaaagcatgatttaaatttataaccaactctttcctcaatgtccgatgtttttaaccccaaaagattgaagcgtaaaaaataaattcagtatattattattatttttataatgcaaatttgttgtctgtctccacattcgtgacttaatagaatttaaattttgctataatttaagctaaaagaatattaatttatttgttatcctttaaatttaaatttaataaaatttcttttatttgcaagttttctttttcttttttttattatgattaataaaaaaattttatgtcactatgtcgcagaatgtacaaaaaatcactggaaaggaaatatttccctccaagggaattctttcctttccctgtccaacggggacattgttgaaaagtgcaagtgctgaattcaatgtccaaatgtggacactgaaactgagagttctctgtaaccctcttaatgacccaacgggggtcaaattaatggtctgtatgaaagggctcctgattgtcccttttacagattgagagaagagcttttctcttactctttattcaattaaatataaatataatttggtgctgagcagaagtgaaaactgagaggaagtgatgagaatgaaaatggggcgggcttttataccctcacaaatcaatggggcggagcaaatcacgtgaacaaatgcacatacaaaaaatcgatcgattactcatagggaaaatgaatgaagagggaaaaggatgactcataatagaagcgaccgagagcaaattgatcgacaaattaatgaacaaaaaactaattaaatggtgaatgaattttatgtcgctttccgcgacaaaagtgaattttagtgttttatttgtttttaaggattttataagccttaaagacctctaaattcaaaaatgacaaaataaaaaatttgtcaagctttttttttttttgtaaaactcccgggggtttttaagtttttttattatatcgttttttgtgaaatttgaagttttggattatgcatcaggttttaaccagattatacccttagggattttttgagattaaatttgtttactagtctctcaaatttactcatttgtctaagtcactttaaaaatttcaagtggatgtgcaatgacatttggatggacattttccccaattaaaaaattttccgaattcaacaaatcattttgtttttttctgtaaaagtgcggcattgttcatttgatattattt

SEQ ID NO: 5433 - DNA, 3749 bp, Heterodera glycines
  misc_feature (3727)..(3729): n is a, c, g, or t
ctcggataaattataaataaataaataaaaatattattaattaatgttcaaaaatgaataacaccaacacaacaaaacccgacatacaaattttgaattcctcagaagagcctaatgaaactcttttgcatgtactacttttttctcattatcttcttgcatttcccgtgtttttgcttttttggttcgttttaattaggtggcttaaaagtctcggtcacttatcgcccagcgaggccgagtcagtaatggaagaaatgcaaaatatcccccgacatccaccaatatttttcgcaacaaaatgacgcagaggttaaagaaaacagacactgaactctctctttagtatgacaaaatcgataatgactcatgctggcggaggcttctcatcgtcattcattttttacaaagcgttaacgaaaatgtctccaaatgaaaattctgaccgtccctatcaacaaaccgacaatgttcaacctgttcaactgccacagcaacaaccagatgaagacaccgagttgagggcacaaattgaagacgctgaggaggatttgctcttgaactggtggcgtaaagacccgacaatggtaaacttatttcaatttagcatttttgatttcttcaaatttcagattcgttttctctttggacaccgtcgagcacctgccatcgaagctgcgcttcttcaacgcgccgaacgtgaggccgagattttgcgccaatatgccgagaatcaacaacaataagaagggaccattcagatattatgtcgtatgttatttttcttgtttttattttttatgatgataaaaaattttgcaatgtagaactaaggaggagaaatggtgatggggggggactaaaactcgcgcaccccttgtccgattgacaccaaattttgtgggcagtcaattcatcaccccctaagccgaacggctaaagaattttgtctctagcaccattttgagtggtacaatcccgacgccccgccccctcgcgcaccccaaaacttgcgcatcaaaacccgagcgcggcggctgaagttttaacagatgggggggggggggatccacggagacggagagagggggtcaacgatgacggagggaggtgaccgtgtcactgactgcggaacggtggggaggggtccgcggcagtggaaagagggggtccgtgaaagagagggggtccgcgctgccccgcgaaaagggcggagggcgacgagcggggaggggtccgcgccgcccgttgaaagggcgctgcgagccgcggggagggtccgcaccacttaacgcaaaataacacgacccgtccattccatcggtggccgactggttaacgcttcgggcccaccaccatctcgggttcaatcccgcgcggcgaagtcagagacgcagacacaaccacccaataggcacggacccgcccgctcagcctctctgcgctcagcggagaaaatcaatcaatagttaaggtggtctccccatgtagtaatatgtaatgctatttatcagtatgtaaaacgaaattttatttataatttatatatctgcatgataatattgcattttttacataatcacacttaaatatgtttagatgttcatttaaatttatttaattctgtaacttaatcattttatttaaatgctatcttaaatttaagctaaaagaaaaatttttatatcagatataaaaattagaaaatttttttaggaaaactattaattatcatctttttttcaattagaggcatgaatgtaattttcattcaggttgtcaaggtttattttcatttttattttatctcttttattgtgtttttgaattacaaattttttaacagtctaagatttcttttgcgttattaaatattctttgtacttttatttttttcttttagaatattcaaatatgtttcatcctaatttcacacattctgtttcgaactcatcaacggtaaatttttagaatttaaacttttgagttttgttttacatctgattttatcttgccaaaacacctcaagctttcttctaattaatgtttgggttttaattatatttcttctagtgtttagctcattcccatgcaataatgtatataaacattgcttgctttctgacagcattttcatttttcgataaaaaaatttcgtttaaattattttttttgagtgcgtttttttaagaaattgtattttcaattcaaatttaaaattgatatcttgctaattttcaggatatgccttttgaaaattaaaaggtagattattaaggctgtattcttgggcattggattgattcatttatattttttgaaaaatataaaattataacgaattatcatatcacatcatgttttaaatcaaattcattcatttcatgcgatgactggatttgaattaaattgaaattaaacaaattattcacaatatctaatgttcttctgacgaatttctcgattaagtcacgccgcatctcaaaaggattatctgatttcgcctgttgattgtgtattattatttttgttgttttatttttatttgatttttaagatagtagttatttcataatttaatttttgatacaaagattttgaaatatgttattttttgggttaaattaattatggaaatattcattattggaaatatttctgccttatcattaaaaatctttatcattaaagtaaatatatatcattcagctttataatgaattataatttttataattgaaattatagaggaaacaaaccttttataattttcatatcacaaatagaaattttcgaatatttatattttttagtcataaatttaatgtttttttataagttataaaagaacttattatttttcaatttatcaatttatttaaaatcgcacttcagtcgatgttgggagcccccattgacactttaattttttagttaatctctactaatatttgtatttatacattttttaattttaattattaattttactatgtaatttataaattaaaaagattgtttagaaaatataattttaacttaagaaattacctgattgtataatgtttcatttgatttgatttttataattattggtaaagaacaattttttattcaatattcctaatcaaattgtgttaatttcttttatttatctcataaattcagattcattaattcattgtatctcaaataaatacatttaccgtatttcttcgattatacccctcggtcgctctattgttcaaaccccctcaaaagggggctttattcgagagggtggatctaatcgaggggggggggggctttatagttcaaccctttttttacaaaatctgacaaaaaattgtgtttttttttgtaaaattttttgccaaaataccgaaattttttagtgctattaattaaaaatgttttttttcatttcggcagatttcattaaataaatccgggttaattccaaaattctttaggcttttgggccatgggttcaaatctcattgcctgtaaagttttttaaaattatttttattgtttagaattcgtgttaggggttcggaattggactaaactgaagtaaaattcttgaaaaaatagccaaaaagtcacaaaaaatgcatgttagaagaagcttcaaacaaagtttagatttggaacccaaacaatgccggcgccaaactgaagtagacagctttttagaagtaatgttaatttttccgaaaaatcnnngaattttatgtaatactttt

SEQ ID NO: 5434 - DNA, 5270 bp, Heterodera glycines
aattgtcgagccaatttttaggaaaaattttggagttttgaggggccggcggtgccgataggcgtcgccaaatagtttttcggaaattttaattaattttattaagaaaattgttcaagatttcaaaaattttcaaccttccccccccccccttcgttgaattaactttttaaatttttacaacgctcggagtccccaattccccgaattagtgtcgggtcgggggtcaaaaagtcggcggtcggtgggttcggggtcggggagcaacaataatttaaattattaattcttttcttgttttaatcaaaaggattaaccctcaaattaacaacaaaaaacttttgtcattatattgacaatcagaaaaagttttttccgaatcaaagattttttaaatatgtcctaattattgtactaatagttcagtaaaaattttaattattttgtttttataatgttatttttgcattttaaaaattaaatttaactttgaaattaagttgaaataaactataaattgataatgcatttaaattatataattgagtatgtaataatatttacttttcattctttaaattatttgttttcttaagagaattataacatctgcatatttcaaaacaattattattgtttatttatctcttgcatgaattgttgcaattattttaggttttaatttacgaatataagagataaattattttgaataagaattacatcgtatttcttttatattgatctaactcaaattttattcaatgtcattaatatttattacattttgaactaatattaattcaaaatgattattattgtttatttatacacaacttattttgattaagtattacattgtattgcttttatatgtttctaaaagtttattaatttacgaagatgcagattttgttcaatgtaattaaataatatttattgcactttgaactgatattaccattgttacttttacagacaattttgtatgcgatttcattaatttaaaaattttttttaaatcataattatcacgcgcagtgtagtgtgttatgttaataattaaattgaatgttgaaattaagttaaatattattcattaagtgtttcgtcttttattttgtaggtaggtaggtattaaacattctcattaaatattatatgaattattttattaagtttattataattttttattaatttattaatttttcgtttttattacaattttattaataatttgggaaaacgccaaaataggtcaaaataggttctttaaaaaattattttattaggttttttaggctctaaaaataaaaatcaagaaatcggcactaaaactcgaaaagtagcttaaattaaattttaatttcatgtaatttaatatttcagttttatttattttatttctgcgttttaacagaaattgacgctttgcataaataattttcttaagcaaagtaataaaaatttttgtaaaattgtcgattagtgggcgtttgtttatttctaggatttttacttataattttcctacaatttattatttataaacgtagtttattttaagcattattttattgtatttaaaataagcataaaatatacaaattattccgcaattatctttactttactttctgcaattattttatttgttgctgtcactttataatatatttaaaatcttttaaatttttatattttatcaattaaacattttcttttaaaaagtattatttgatttaaatttttatttttaattagtttttgttttatatttattattgtcagtagctaccctactacactcatcgtggggtgtgaaaatgattaatgggttttcgggggaggggttccctttgatcttgccgccctaattaatcatgggggggggggcagctgttaataggtttcgggggaggggtggtaattaataggtttcgggggaggggtggtaattaatcatggggaggggggttaattaagggggagtgcgcgaatttttcatgggtattaggagggtaagtgcgcgaggggggttaattaatggggagtgcgcgaatttttcacaggcattagaatggtaagtgcgcgaattttttggtatgtgattggggtggggggaatgagcgaaaatgtcaggcactgaattttacgatttttaatgaggcgtattatttccagtgctagagaaatagtgtaggaaatagagagacagttagagatattagagtgaaagagaaatagtacactatatctctgacttctctaacctatcttacacccaatcatattgtaataccaaaagttttgaaacgatatgtctttgcgtaagatttacattcaaaatgggcggacaaagtggcttggttttgtttaaatcacactgttattttaaaataggacaaccataagagggggattgtaaatttttatattttatcaattaaacattttcttttaaaaagtattatttgatttaaatttttatttttaattagtttttgttttatatttattattgtctaccttgtcagagagttaataagaattagttcaaataatgtaatttaattttttttgttaatttttaggtttaacaaattgtaatatgtcatctttttcagttattgggtgaaaatgggttaaaaatttaaattaaaagttcattcattaccaaaaaccaaaattggtttttatcttttattgaacaagcaaagtattaatttaattaacactaaagttcgtattcagttttatttgtgaagaagattttttgcaaaaatcaactttcttctatttttattgttttataatttcatttttatttaatattttttttatttgtttttttaaaaagttattctaatttcatcaattttgtaattctcataataattaaacgttgaattttaataattgatattctgatattccgtttataaaaattccacctaattaaatttattttttcttaagaattcgaaattttattgaccgaacatgacaaaaatttcattaatttgaatgagacgacagagttgttcagtacactgttgtttgtccaatattttatatttaaaattattttttattttagatcgtatgtttgttataaaaataattaaatttcaggtctaaatattcatataccggtgaaattaaattagttttttccagtgttgtactattttttataataccttttttattaataaatattccttaatatttaattatttattatagtaatgtgattaatacaataaacaaaatatattgcgtaagctgattatttcaaatatattattttaaatatgtttgcctttccttttcttgtatcctccaaaagctgtacgcactctcatgtcaattaatttctaaaataaatttgaataaattttaaaataaacttaaaacattaaatcttgtattttttcgtaataaaattaaatgtaattttttattctaaataaattggagtttaatattttaatatcaaaaatttcttaacagataatttagaagagacatatttgttatatcttcatattttatatttcatgtgtcctataattatttaaaattatgaacattgtttggtttattttttctatttaaatttattagtcttttgaaatgttgaggtatgattgatatatgtttcatttattagtaaataatcttttgtataaaaataaaaataatttattggtagaaaattatcttattcagtggacaaaattatagaaaaaatgattttaaaaagtaagaaaactttaaccaatgttttctatcaataatgtaaatataaagctgcttaataaaaaccattaaatcctcatgctgtattgtcaattataaaaaataaatatattatttcctatttatttccgattaatatttatatcatttttattaaatttgttcagttttaaattaattttctgtcattaaatatgactttcaagtagatattgatcagtatattcgttcaaataattctacgacagagctacgtgattaattttttttaatttgataatcatttcatgaaaaattctttattattttgtgatttttttagttattggtaattttgattagcataatagcaaaaggtgaaaatgaaaatttgttattctcttcttcttaggcagccaagtatgagtatttaacccctagattattcagaccaaacttttattttaaatttattaaatattatttagctatcaacatttcggaagtactttgtcaaatgccgaaacaattattacaagataaatgatgtctttcaaatatttttccacgaaatataatttccttacgttgacccttggagatattggttagtcatcggtatttattatgtaaaggatttttttgtgaacaatttatttttaatggaagtatatatggtattaattcattgtcatttttttttgttaaggtgcattttgaagcagaatatcagctgtaatttcatgttaattttcattattttattgaataatatatttcaattaaaatctttttaatataatataacaaaactaaaaaattaatgcgaatgccgaagtattgttttttacaataaatgttaaaattaaattttatgcaataaaataacgcgataacaatttttttgccaatttttaacggcgcattaaatttaaataaaaaatgtaaaagtgatcttaaaattaattacctaagtgggaataaaattaacttattaagaaaaaaatattgtacataaagaataaaaaagacaataattattttaaaagcatatgaaatattaaattaaaaaatgagaattcgaaaaataatatttttattataataataaaaaacgaaggcaattctttttagccaaatcgattatgaaatggctaattttatggccatttcttcgctatccattgccttttcctgagatgagatgtgcgattcggcagaggggggggcggtgcgttggagaaaatttttgtacgctattgttcgtaaagcgacgaaggaagagaggggaggggagggggggggggggaataaaaaaagaacggccaccgatttagcttttaaaacaaaaattaacatacaaaatgaaggaaagataattaatttttgaaaattttaattagttatttttaatttctaaggtatgctgttgaatttgaaatatttttatacattcttttatttgcaaatttttgaatttaattttttaaattttaacagcctctgagatttgttagaattag

SEQ ID NO: 5435 - DNA, 1306 bp, Heterodera glycines
tgcatttttgagcagaatatcagctgtaatttcatgttaattttcattattttattgaataatatatttcaattaaaatctttttaatataatataacaaaactaaaaaattaatgcgaatgccgaagtattgttttttacaataaatgttaaaattaaattttatgcaataaaataacgcgataacaatttttttgccaatttttaacggcgcattaaatttaaataaaaaatgtaaaagtgatcttaaaattaattacctaagtgggaataaaattaacttattaagaaaaaaatattgtacataaagaataaaaaagacaataattattttaaaagcatatgaaatattaaattaaaaaatgagaattcgaaaaataatatttttattataataataaaaaacgaaggcaattctttttagccaaatcgattatgaaatggctaattttatggccatttcttcgctatccattgccttttcctgagatgagatgtgcgattcggcagggggggggggcggtgcgttggagaaaatttttgtacgctattgttcgtaaagcgacgaaggaagagaggggaggggaggggggggggataaaaaaaagaatggcattgatttggtttttaataaaataaaaaagcttatggggggggggcaaaaataaaaaaagaacggccaccgatttagcttttaaaacaaaaattaacatacaaaatgaaggaaagataattaatttttgaaaattttaattagttatttttaatttctaaggtatgctgttgaatttgaaatatttttatacattcttttatttgcaaatttttgaatttaattttttaaattttaacagcctctgagatttgttagaattagtagttgtttttttcttttttgaaaccataaaattgccaatattatttggtataattttttgtatccttttttttttgttttcgttttttgattcttttaaaattttaaattattttaagattctatgatattatttgtttaaattaaagttatttatttactcaagtatttctttaaatttaaatatcggttaagtttaaatacgacattcattcccatatttgtacttttgcgtgtttatatttacatcaaaattcaattaacgttttgctttttctgtttaaatagttttaaattttcttttctttattggggttttggataagtttgtttgtaagtggaaaagctgcaactgttagaaaataaaaattcaatgacagaaaaaataaataaataacgttattaggtacttattaaaaatgaattttt

SEQ ID NO: 5436 - DNA, 986 bp, Heterodera glycines
tctttaggacaacttgatattcttcaaatttgatagataaaaagtatagatgattgatccacgcaaacatgatttggcatttcttagcattttttatgggattttgaggtaccgtttttctaaacaaaatatcgattagcatagaaatcaaatttttttgttgaatttatcttcaccctttaacaaataatttttattgatgtttgtatttaatctacttgttgtttgtaaagcttatttcaattcaaattatttttttacctaaaatgtttatgcataaaaatatgtattaattaaatatataagcatttaaaaaattttcaccagtatttcagcttttttcacaacaaaatcaattgcttatgccacaaaggataatgttgtaattatttaattaagattctatgatattttatttctgtttttcttttcatttatttattatttttaactatcatttgctgttttatttatttggctttaaatgttgcctttatttatattcatttaaaaggtcttctaactaaaataatttatgttcattagcttcgtctttttttgtcgcgtgtgttttcctacgatcccacagaagcttgactgaagcgttcttaattcaaaatttgttgatttcgaccataagtttactattggttaaaagcaatttatatttatttttttaatcttaagaacaatttctggtctaatgttaaagtgtttttttaaaatttatttatttgatatattttaattaaagttattagaatcggtaacattttatttatttatttttattatatatttttttattaaatgtaatcacgcgcagccctttaaaatattcataaatttcttgtgccatcatatgcattataaagaattttgtatattttctaataaattcatactgataaataaattataaaatttaatttttcatggattttaaatatatgtattattcatagtattttctttcatgaaattta

SEQ ID NO: 5437 - DNA, 8578 bp, Heterodera glycines
tgaattaagccaatccattgacctgatcagaccattataatccattaatcaatagctgaccaattagtaatttttgatcattttaccaatgtctggtcactttcatcatctttttatctttccctcttccattcccattcattaatcaaccgcacactgcagatgaactgctccaattcacaccactcggcacaattccgttcaccgccatggcgccaacagctgatccatcggcgacacgttgtgcacccgcttcattggcatcggcacaactccattccgccaatgcggcgcaacattcggccgaccatttgtgcttttttctctgtccaattgagcagggactgtgccgagtgcaggtggctggagtttggacaaaggtgtgttgtgctcatgattttcgaaatttcgtatgatggaaataacagttttagtatggacagccgggcccactgctgaatggcactgttgtgtcaatgacagcgttgccgtcactgttgcggcaaacgatttgcaacgtggcacgtcgcaaggcggccgaattggaaaggtagggagaatcggatagtcaaatcaatcaaaaataattgaggcctatgatctgcgagaacaaacagctaaatggtttttatatttccattttttagttaccaaatgacccacgttcgacgtcgccatgccattgccgaatttggccgacgatttccttcccggcttaattacaccgactttgttgagcaactgatcagcgacaattgatgcgcagaaggaactgctgctgctgctctttgccaattctttttcgttctgatcagtgatcactttacccaatttctttctctggtcactgttcccaaatacattctccttttatttttacgctagtgccttttcatgtcttcttccgcttcaaaaactttcattttttgttcaaataatacgcatagaaaccgttttgactcacattccgccctctgaattgtgtctcataattattgttttcaatcccactatcatatggtaaaattgttcggtttttaagtgcctaaaaatcccatcactaatgatttttattccgttttacacatcggtaaatgttcaaattgtaaagataaataaaagaaaattcaaaaatggataataagtaaaaaaccagtcgtcattcgtcaccattttttctttccactgcattattcttggtttgattgagtttgatatggatcagggacggcacggaattccaatttctgggtgttttttgggcctcggaatgccatccctggtatggatgaaatgcttcaaagatgcaaattctttcggcgaattcatttaattatgcaaatttctctccctttttggcctttcgtccgttagccgtgccaatttaagcaaaaaatgcccatcaccccagcagatgttttcatttccctgccaatgggtgccattaaaacattttaaattcaattttattagccaatatttttccccctttcacaatgtgagttatccattcggcattctccccgttttattggcatcagttaaaccaaattgagtataatgccaagattttgccccaatggctcattggcattttgccgtcccccctccttcctttttttgattgtcttttggccgtttccatagtcacccgctccctcccccccccccggtgccaataatactaataaaacgatgaatttctgtctttgcttttggcctatcgataggccaaagaaagaccaggccatacaagtaaataaaatattaacatttattaggttcacaatttacaaaaggtattttgaaattaattcaattaactaaaccataaaaataacatttttatttctatatttaacattaatttacacccaaattaaaatgcttaattcggaagccaaaattaatggtcattttgaaattggaatcattccaaaaacggacataaaaattgaaatctcatttgacggagacaaatttgtcaccattcgatcataagacgaacgcattaatgatcaaataggaaatttacagcaataatgcgtttattttagtaatttgcttagaggaatttattttttgcttattgacggcaaaaattcctatgcctctttttccctaaaaaataggtaattagtaagtaattaggtaaataattcaccaccggcggattttgaaaacttaagttaataattagaagagatttttaaccaaaaatgacttttcaaaaattgtgcggagaaagtgtgtttttggtgcaccaaatgacattcgtagaaaaacaaatacaaaaccttccatgataattacttaaaatagttcattagaattgtaatttccgctaaataattttccccaagtttccattagaaaaaaataattatacggtagaaaatggaacaggcgcgactaaccgtccaacaattgcgtcaggaggcaaatttgcagcgaaagaaagtgtgggtgaattactaaataaatatccaattatttatttgatatttattttttttaattccatttcccaattgtttcagctcggaagtggccagagagtttggtgtttgttttttgaatttgaattcattttggcattttgacagtctcgtcgaatattgtgaagggcacaaggaaggcgactgtttgttcaccggacggatggaccacaacccgtaccaggagaagaagtcatgcgtactgatctgaccgatcggcggaacggcccaatcgatcaatgccagctgatcagttgatcaaccgattgattattggaccattgccaaaaaatattttggcattttctcaatttgtctgtttgcatgcgattttcttataaataatgtcctcttttaaaaaatcacattcttcattcaacaaaaatgaagcaattttgaactgaatttacccaacaattagcaaaaaaaataacataatgcgccgaattcgttaaaaacgcctcaatatgacagctgaggaattcgggaaatttgctgaagaaaaataattgtttgaagaaggattttaccagaaacaaaacaatttttaatcttaaaaaatggtccccaaaaatggcaaagaattgacatcgaattgggatcaattttgcgacttcacttctcttgtcggctttcgattgctccattccaatcagccgttgtgggtcaggtgaacggatcaaaggcatttcaatggataaattaactaaaaataattagattattctgttatcttcaataattggccattaaaaggatgtttgaatttgtttaataaaactaataaaattatgctctgtctatccaaagacatttttttaaaatagaggcaatttgaacaattaataaacaaaatataataattaaataaattatatttaagaagtgttgccgcttccgttatgtttttgtgctcctttttcatctgtttccaatcgctttacttttgggacaaatttcgccaatcggcgggccaaagaattgcgacggtaacggagacggagggacagcccatgcgacagccgcggttcctcgtctgtgtcggccaacagagcgggcaatggaaaatgggggaggggggaaatggaaaataattaaattaaattaaattaaataaataaataaattttaataaaaaataattcgaaaaaaggtaaaataaagtgatgtgaatttagattattattttatttattttgttctcaattttaaagttcgctgctgcgcagccgcggcgaaagtgttgactttcgccaattggtttacaattatcaaatggaggaaaaattgaggcccgattttattaaacaggcaaaaaaagaaaaaatatttaaaataaaaataaaattaaaattaaaaaaggaacgaattaaaaatcctttttagcttcaaaacgaaatgggtttggtcaacaaattcctcagttcctcctccaattcttcgacgagtgttctccaatgcgcgggcattgtcctctcaaaaaacattcatttgcttgtcgaaattgggacggcacttcgagtgaattttaatttttgatttcgaaaaaaatatttctttcagttcgattacgcaaattttacacttccaaaaacgcccgacgaaattcaggggaaaagcgaaggaatgagcagcaaattacttaataatattctttgaaaatgaattacacatttcttttaaataaattaaatttttaggatttcgtttcgaaaggttacagtacgccaagttacggtcatcattggaccaatgtttggccaaatatttactggacgagatgctccagcaaaacaatgaaaatttggtaaaaaatattttttgtaaataatttaataatttttaataaaaattccaattttaaaaaagaattccaactcaaattcatcaaattttgaaacatttattcgctgtcgcatgaaacgaatcgccaaattatacgccgaatttgagcgacaacagaaggaatatttcgaatatgtgcaaaatgtttggatgcgaccggacgaattaatcgtaaaaagtgcgaaaaatttaaatggaaaataataaattccgaaaataaatttcaatttttaaaggcgtttttttcaaaaatgacccaggcaaatggaaatggagttggcaagtggacaacggactgtgcgcattgggagggccacggaaaaggcaaaaaattgggggaggaataaaaatagaaaataaattagaaataaaaaataaattaaaatgggggtaaaaaataaatttggaaattgacaaaaggaagcaaataacgccggaggcgatgaacaaccagcaaacatttgattacattttggtgaaaacgaacatgctcgagtcgcacccggacagcaaaatccgcgtctttttggtgcacgaagagggcaccgacgacggtggaggaagggaacggcacacggcaattagggtaatttggtgggggtaattaataaatagaattggacttgtttaaacaggcaaattcaattgaactcaactcgggaaagcacgtggaagtgactctgcgtgggatgtccgagattttggcatgatcactttctaaacgttcgtttgactgatgccaatgccaattaggacgaagactgtgacagcaaatacgagtcgggctgtgtgccgtccaatttcacttattcgcctatggtaacagctgaaaaccaattaatcattttaattataatttgttattattttaacgccacaaataattaattatttgttaagtaattaatcaattgaggtgtgtcgctggtgcaaatccgaagtgcgcaaagcgtgcccatgcacagttaggcaattaaatgcactttgttttgtttttttcatattcaaggctctctttttaataaaatctttttatttccataattaattttaaaattcctccattttaaaatgccgacctctttctctctgaatatattggcgaatctgtgcacaactgttcactgctggaggtgctcaaatgcggacccattcaaagtgaactttaccaaacaggtgggcaaaatcataaaaatttaaaaataattttattttttatttaaaaagtaacgtcaattctttaaatgcttatcattaaagccctaaaaaagcattgtttgtgtttttggtgctcttaatatttggttatctctcactatttattcttatttattttattttaataatttatttttttgaaaatacccttgtccatcaaatgcctttaaaatttcaaattccccccccccccccattagtccatgccattcatttcattcgttcgtaatttgtcatgttttctgtgccatttcagctgattgtcccaacgcgtgtgtgtcggtcgaatacaccgccgactttgcggtccatgaactgacgctggagaagctgaacacgcgggtggacgacgcgatccaaaccaaatgcatggctgaacagcttcaactcgtggacaaattcaacgaacacaaattcccaaacggtggcggcaccgatccgtgggcgagggacggacgacagacaaaaatgtccgagaaaatgatgaaaaataactaaaccttaatgggggccggattttaaaatcattataattaataatgaaaaatgtaaattgaagatggaaggcgagtgcgcagttgagccaatttctggatgattattacgtgatgatggtcaccgtttatcgcattctctacggaaagtaagttatgctaattgaatacagtcagtgtaaaatattacatcattttcttcaattaataatgttttttcctaaatcatgccaacttaaaactgagggtgctttccgagttgagtgtgtccattattttggccaaaatgttaatcaccggcttaattgcaattagtttttttttgatcagcatcgaaagtatatgtacaaacaggtagaaggaaatccattgatataatataatatgaggaaaatgccaaggactgtcgggacaatggcattttttatcgggggacggtttttttacggaaaagttttcccaaaaacggaggcacactaattaatgcttaatcttcctcataaatcacaaattttcttcgcatgttcaaagcttgttgcccaaatgttttgcgttcttttggctccaaaatcacttcaaaatgtgccggggaattgtaaatgaatgccgacattcgagtgcgttcttgggcggcatccaactgaatttcaaaattccatcgctttaactttccgttatcaattagttaatcaattcattaattatgtaattagtgctcacattgtccggcgtcattagtggactgtaatattgccatgtgaaattattgtcctctttttcttttttgcaaattatcacattaattccgtacaattttgaggctgtaaatgcgtcaacctcattaaaccatttcgcttgttctcccacattttctgctgctgttcttttcgtttcggcatattgccgtgcctcctcttttgtagtgaaaaacatttcttaacaaagtgccaatgtttatttatttgtcgcttaattggccctcaattacttaaaataattgtttcttttcctaattacgccattaaatagggaaaaatgaaaaaaataaaattttatttttataattttactgaaaattcaaccatagtttgcattcttaaaatcatcagatggcttttgcttctatttgctgcgaaatccaaaaaaaaatttcaaaatgaaaaattaacttcttttttggcccataactttgaaccgagaagcgaaaaatccgagaaattctcgagccgggaatcgaaaacgatactctcgcacatccctaattagagctttgatcacattacactaccagattgcctttgatcattttgcatttcaatttccttaccattggcccatttatgaaaatccctaaccctaaaaaacaaataatccatggcacttaccccaccaattgctttttgctggatcatcttcactattaattaattcgctgttcaaaaattccatgatgtcagcccttatttgcctatgattggcttcagtcccagtcaaaatccacgacaacgatcggaagccgcagttgccatcgctctcaattggcacgactccgcccggcccaaattcctcagatggaaagtcaaattcggcaccgaaattagtgccctgttcgtacacatagtgccattcctcacagaattccctccggtcgctttcggtcggcggattaaataaaaaatgtaacggattttgcaaattttgcggcttctgctcattgtcagcagatgccaatgccaaactgttcccaatgtgatgcttttcctgtccaaaatgaatcctttttctttccacttcttccgattgaatttccaattttcttttgcgcccaaatttttcttcgtttccatttgaaaattgaaaaattaaggaaacaattaaacatttgaataaggatactgacaatgagaacatttcattcagtttgattctgcgtcaaaaagggaatttgttttaatattttaataatgatttattataatttatatttaatataattataattcattattttatattattttttgtgttgttgctaaagcgttttttaaagattgacaaaaaaaaaatttatattaatgcattggataagtcattaataaattaaaatatatgcacaataaaatgggatgtaaaaattattgcccaattattgacattaaatgatcaataatttattgcaaatatctcttttttataatgcaataaatctttcttaattaaaaaatcatagggaaattaaatgtttacttttacactttttgtccatcggaatagcatcgtcaaatcaacactttttcggctgtaattttgcaaaaaatataaaaaacaaataatttaattgagcataaatctttataaaagttatttaacaaataagtttaaagagaacggttttcttttttcatttcctaaaacattgatggatatgcttttacatttggctgtcaattggcatcattagggcattaattgagtaattagcgtttttaattgtctctccccatttcccaatgtctagttcct

SEQ ID NO: 5438 - DNA, 1332 bp, Heterodera glycines
tttatttttttgattaaatttaattctttgaagggtaaccgcgcggagaacttttcaaggtcagttttatcttttacgaattgtttttcatttggtttggagttttcattaaactaaaacaggacattgttgcgcgggaatattacagcgaagccgacgcaaggttttgaattggatttaccagggaatctgatcagtttcttttaagccaatgcatccaacaaattcttgaatcgatcgcctattgccacgacaacagtgtggtgcacaggcaagtcacggcgaatcccacaattaataattgggcattttaagggatttgaagccagagaatttgctgcttgcgagtcgtgccaaaggagctgctgtgaaattgggtcctttgcttaacttattcgcgaaaatacgcatggaatttagctgattttggtcttgccattgaagtgcaagggaattccgaatcttggtaaagatcattttcattacacatattacaatatattacaacctattcttctttcaaaaatttgattagggaaaatcgaatttttattttttttaaccaaataatgtttaggaaaaatttaagtatttatgtaaaaacactatacgcatttcaaatcatgccaatatttaactattctttcattttaggggcgggtatactaaaaaattacttgatttcacatttaggtatggttttgctggaacgcccggatatctgtcgcccgaagtgctgaaaaaggacccttatggaaagccggtggacatttgggcatgcggtgagaatattttgtgtaaaatttgtttcaaagtgtcgtctggttttcccaggtgttattttgtacattcttttggtcggttatcctcctttttgggacgaggatcagcaccgcctttacgcacagatcaaaaacggcgcttatgacgtaacttttcctttttttctacataattcccattcctccacttcagtatccgtctccggaatggtaagcgttcggttaaaagggtacagtaagccaaattaaccaatcaatcgccagggatactgtgacgcccgaggcgaaaagtctgattgactcaatgctaacattgaacccgcagaagcgaataaccgcagaccaagcgctaaaagtgccttggatttgtgtaagtttcgagtggggagggctgaaaagtcaacaccttgggaatttttcggttttgtgcaattatataaaaaatttctcccgtttttaagaattttgtaaatagcaattgttgctcttatgcttccaacaaacaactaacgatcagcgtttttttctcatcccccatgctctttgttga

SEQ ID NO: 5439 - DNA, 6847 bp, Heterodera glycines
acaatcagcgtttttttctcatccccatgctctttgttgacatattttttattggattcaaaaccaaaaagtgcattttcctcattaaaaataaaacagaatccgttaattgttacggtcactttttccaggatcggtcgcgggtcgcctcggtgatgcaccgacaggacaccgtcgactgtctgcgcaagttcaatgcccgacggaagcttaaggtgagggcttttttggcatcgtacgggagcaaaatttgggaaaaggagaaatgtgtttttttcgcattgaaagtgtgcgtttgagtttaaattaaagcaaatgactttccttttccctttgcattttgatgtttggcgtacatttgtcattgtctttttgtggtgttttgtttttacaattaccaattaattggtttttgttcgtccctttccctccctttgccactaatagtcggagtgattttatcatttaattgtaaggcgctttcgacctttcccctcactaatcgatccaattgactttttccgttgagtgcctttccctttttccctttgagtggtttttttgattcctttccctccccaattcatttgatttctgatcagtgttcgtcttcgcttttattgtaggctgtcatttcggctgttgccattgtaaatcgtatgtcccattgtatgagtcctcaaaacagtcggacgaccgtcccaagtccgtctccatccccaaattcggccgcacagcccgacattggatggagtgtgaaggggccgaccaacaacaacggcatcgccgcttgtgccgattcatcgggtggcacttcagcaaataatggggtgggtggcgttgtgtgaattgtttaattgtttttgcactaatttttctaaaaactaaccaaattaactaataacacactgcaaaacgtccactttcttattcaaattatatttcaggattttgttccaatttctgtgctttttttgttgagtgatttattatttttgtttgtttgtgcgttcgttgctactttctttcttcatttcatttttttatttataatttttggtctttttatgctttatttacctttctttttcttttatgtttctaaaaattaaagtaaaataaacgaaacaaaaagattaattaaaaatgacaaatttcgaatgatattttaatcattatttacaatttatgcttatcacgcttgctggctgtttattgttaattacatatatttttccgtcttgttagtgacctgatcgactcatgcaaaataatatttgaattcgcattcgaaattcgaatgttttagtttattcgaaatgtgtgtcctttgtggtcagcaaactgacaagcagcacaaaaattatttaaaacttttgaaatttgtcatcttttttgtttccagattgtatataattctcgtcgtaatttgaacttgattttcagggtgccattctgactacgatgatcgccactcggaacatgtccagtaagttgttgtcgtccgaatgtcccctgactttctcacgcgtccctaattggtgcattaggccgtaatttgctgaacaaaaaggacgtgccgccaagcacaatcaaagaaagcaccgaatcctcgcaaacaatcgacgaaccggacggagtgggcaacgccgccggaggggacaaaggtgaatttggattgattgactaagcatttgcagtggacgaactcacactgactgactaaccgacccaatcattttcatttcaatgttttccctttaccatttgtcatcacttcttcctccgaactgaacgagccaaaaattcgtcaatattctgcaagaaattcttgtttttaacgactaaaaggaattctttcttttaacgaatttttactcgggtgtttttttgggtagaaatcttttttttgcgtgtgactaattaattaatttaattgcttgctcttcttcagtgtctgtccgttcttccctttaaaattaattcttaatttttaagcgatcatttctatcaaattgtcactgttaattacctgaatggaaatacctttcgagttttttcataaattaaaatcataaatatttcgtcaaaacacaatacccttcaaaatgcacttttgaatgctttttttggttaaagctaaagactaactgtcttaactttgttttcccccttttccccattaattgatttcgaaataattctgtttttcttcttttgtctgacactttttccgcttaatttcctttgtcccaccattagtgcgcttaatccatgtgctgacatttggcgcctatgtccaaaatcgggttgaaaacttaagttctttcaatcctaaaatagcctaatcagcattaaagtcaaacatattcttcgggttctgtttgaatattgatgattttttcaaaaatttgctgctgatcaaattatcggacacactcatttcctatcacttattcaatgctttttaggcttaaagtttgaaaccgattttggaataggcgcaaatgtcatgtaacccttaaataaactgttttggtttcatcattgatcattgagcagttacgctttaaacattggaattggttgccaaatttcgctttcttttggttaccgtattccgccttccaccagttaccgtattccgttcccctttggttctgtttgtctgtccatctgtcactgtctttctgcacaacttaaacacacttttctttcttcgctagcgcggatccaacatgagaacactgtggttgaacgggtccttagcaacagtttgaccgcgaaagcgtccactcagccgcagcaaccgcttgctgtggtgaccggcgccgcttccgccacgttctgtgcccactcgccaatcggcgcgtcggccggcacttcctcgcccgcgcctccgcttgcttcttgcgcctcccccgtcctttccggtgggtgctttctttgttcttctctcgaattttttggctttgtcttttcacgcgggagtggcaaatgcgctcagccctttcctctccttctgtttgctgcttctttctttcttgtgtttgtgtcgttgcttctttcttttcttccttttttgtttgcttgtccattttcggttacttttgtgcttattcgtcataatgccaatcctatgtatcaattgaccattatatccgagttttactaccccttggggctgtccttatgtacaaataatttgtcagtccatcgccactttctccccctttttgtttgctgctgcttcggtgtgtaatttgatgctttgcttttttactttttgcgttccgttcatttccccccccccatttttcttttaattttgcgtccaatcggccaaatcgttcgttcctttcccgtccatttaacttttgttgtgcatgacaaattttagtggtgtttagtccactgctgctccagtggatgcgggtgtaaaagtgtgagagtgttattaatttttggcccctcccttagacatacgccacacaaaattccgccttcagcactttcattccaaacaatccctcattttttttccattggcgccggaaacattttgtggggcggtgggcatgtggctgtgaaagttcgttttatcgattcattcaaagagacgggcatttaaaatttcgagaaaggaaattataaaaaacgcagtgttttaattttttgaaaaatgagtgggcatttaaattattaaaattacgctatcattccatgattaagcttaattggcggatgataaaaaatccaaataaatgctgaagggatttgtcccatttgggccgatggttaactctgaaaaccacactgaccggcctcccccgcacctccaaccttctcccactgactctaatccaaagatggcctccgcagcaaagagtaagggcttaatacataaatcaatgtttattagtagtagcagtggtgtgaacaaaaacttttttgcatgtttttcttaatttgtgtgtttttctctctttcctttctcattattccatttctttaaatgaatatgaaaaattcactgtgtgatgacgtagcgttgtataaaaatgttattattgttaaaatatacacaatccgttgaaaagctctgcgggataaaccatttacaatctcaaaattaagcacaaaagcaggaaatcgtgaaactcactcagcaactgcttaccagccaggactttgactctttttcgtatgtgcaaatgaaccgaacccattcggcaattgtcaaaacagagcgatttaggaaattgtgtgatccaaatttgacatgtttcgagccagaaacacttggcaatttgatcggtaaatgaatgggaagggaatgcacaaaatgcaccaccattcttcattttggcattttcagaagggatggacttccacaaattctatttcgacaacggtgggtttgggcgagggcggccaagggattttcaaagtgttcaacaaacggatgaataatctaaggccctcaaattccactaggcgtaacaaccgccgggatcaaacatcaccaccaccaaatccacacgaccattctgaacccgaatgttcacctgttgggtaattcgaattgtccccctttctgtaaatgttttggccatttcaggcgatgatggcgcatgcattgcgtacattctgctgacacagtacatcgacaggtgcttttcttttgcttactgtatccggaatggacgttttgttgtcattggggatgctattttggggtattaatttgctgcagatttggcgaagcaaggacttgtcaggcgcaggagacgcgcgtgtggaaaaagcggaacggcacttggtattgtgtgcacacccatcgcagtgagtttttggagaaatttgtacaggactacagtattcgttaattatagttaaattaattccgttgccaatgatgatgaattaaggtggtgaattgccgaattccgctggcccttcttcctccagcccggcggcgttccctcagaatttccattgatttgctttttctgctttagccgtatcaattcgaagtatcattatggacttttatgaattttgagaatggcttgccgatgatacttcctatttcgatttatttatgtatttctaatgctttctttctatggccaatgcctcctttggagtaacacttttattctcttatatgtaaaagacgaagcctgtgagataaatttgaaaactgaagcgaatctttttcttttgtttaggcttttgaaatgccgattcaaatcccttttaatccactggctcgtctttattttttgtcgcaaatgttcatcttatttctggtctattttctttgtctttttctgtttcttttcacagtcatggaaaattttatcatttggcctaccctcggggttagtttcctgaattagtattccaaaacatttgtttgccgcatttttttgccaccttttacggtctatcatctggtcttttcctatcatctcaaatcacaatggataaaaaatgaactctgttataattacacctaattaggcaaatagaaaatgaattaacattttatcgtcaatttctgtacaacactgcgcccaagtttatcgaaaagccccccaaagcgtagacattcaaatccaatagctcaaataggaatgtttaatcggacagaacttcggaatgtgcggaagtgttcagactagagcagtggaaggggaaaaggatgttttggtcggtcacggggattttgaggcctaatttacaagggaattggtgggaaggaacgcaataataaatgtagggtggaagggggtaacaattccttggcttcattctgtgcggcgtgtttcgccggctgccgacttctcagcgcccacgaaattggggttttgtatttcgagatcaccggttggtgcgagacctgaaaggaaagtgaggagggaatgaatggccgaccattgacaagcgaatggaatgattcaccgctcacccggacactcaaaaacgctgtaattgtggtccatttcgtccgtgtcttcttcgttgtcgctcacattgtccaccaccggccccgacgctgtgcccagtattttctgtaactttctttttaattttccaacttttcatttcgaattcctcgcctgtttctgctgctggtaatggtgcagttgcgctttgtaagcttaaaaatgcaaattactccttcggtttccgttgttttttactcacccaaagtgtcgtcgccgctctgaccgaatatgggcgaacccgacttcttaagtttgtcttttgtgggcccggcgggggaatagcgagtgaattcgttgaaggggtcgtcaattcgacttgaacggacactaaaaaagagggaataaatatgccaatgagtttcgagttagtccaactgattgtaatagtaaacaccgccgacagcgcccgcgacaatgccaaaacagcaaacggccagataagctgaaaaggtgaaaaaataggacaaagggtaagtgtggcaaacccatgaagagaatgttgccggaattggtcaggaaataaaaggcgtgcgtttttctgtccgaatcggttggcacactaaaaaaagaattgttaaagagatggccaacaataaatgttcaccgtttgtccatccattctttgtggcggttgttttggtgttgacgtggctccacaaactccacaaattcgttttggccctttttaacggcagcaattttcttcccttcgttttcaccgaacatttcggaagactcgagttcaccctggaagttgggttcatcggtcaaacgcattccaatattcgttattattcagctcatggcatttttggggtcataaatttcgg

SEQ ID NO: 5440 - DNA, 1931 bp, Heterodera glycines
tgcaacgacacgctggaccagaagggactcagccgggactcgttcatcggcgtgctggacattgctggcttcgaaatttttgatgtaagtgccaccagacagaatttgtcggggttttcgagcgccgtttttcttaaatttctctaccatgcgtattcttcggagacagaaattctatagaattttccatgcagaaaggaaattaaaaaaaaacccagaatttacgagaaaaaaaaaatcaaaaattcattttcttcaccttgctgaaatagttgcaaaaatttgaggataaagttttggcgatcagatgaaaaatgcctagggcaactaaaagctatgtggattctggaaaaaatttttcacaaattttttgtcgaaaaataaccaaggtggcggttacttgctactagtatttgttggttaacaatgtgctgtttctgatcataatttgtaaatggtcggttccaattcattttttttgatcactcaaatttaatgactccaatcctaattttgcattcaaattagggttaaactccgacccgatgcggcgagttatgaatttcgtctgttgcactccaaatccggatgtaattgtctttaaatgagtcttaagactttttttaattgtgtcggtaaattccctcctagatccccgaattttctctcccccagggtcgtggcttaaccctaattaaattttttagggctcttcacctggtctagatttaaacattaaaattttagtttaacagctttgaacaattgtggattaactttggttggttttcaatatatttgttgaaattatttaatttagcagttaaataaattacaataaaacaaatattaatattaaaatattgaagcaaaaactaaaaatttaatacaaaaaaataaactaaaataaactgactaactaattgatggatgcaatatgcataaacaatgaaatgggaattgtttaacaaaaataaaacacaaataaataaaaagtgtaaaatcgctatcaaataattcgactgctctcaataaatcgttccaaaatgatggttgacaggcttagctgaaaataaataaaaatattaaaaattaattttcctaaattttatacgcatctttaaattgtaagtcgaaagtctctggatatattgttgtggggcttcaacccacacccactatctttccgtggaaaatgatctaaccaactgagctatccactgcgcaaggggagactcaaggattttagaaaaaaggtctttcaggcctttttgttttaagatattttaccccttggggtgtaccggtatcagggctgcacgcaattacggattacggattgcggattacgggaaattacggggtttttggacccccgtaattacggatttccgtaactgagaaaatcgccgtaattacggattacggatttccgtaattgcaaatccagttgcgtgcagccctgaccggtataccctaccccctgggacggaccttctctgacagtgggcgtttattgttgttatcactaacccactgattgatctaagtagatcagttagactcgaccaagaccctagaagttggtcccgtgagctacactttgcttccaggatttaggattttagacgctggaagaatacccggtcaaaaaatgtctttcaggcaatttttcggtttgtttttcagaaattttatctctcgaaggtataccccaccccctgggacggaccatccctgacatcgggtatttactaataacagttatcacattgatctaactaggtcattggtcgcgatcaagatcctccccccccccctcccatatgttggtcccggatcatgtcaagatatattctggccaagtctctgtaattgtgtttctgtctctgacctcctctgccttctgctgttctgatcagttgtgcgtt

SEQ ID NO: 5441 - DNA, 3964 bp, Heterodera glycines
ttccctttcattttttgtctttttttttttttcctccaattttataagttttttcacgatgttttttcatttgttctgtttctcgctgctcccattctctctgcatcgctttttctctgtgctttctctcttcaacaagcttccttctatgctcttcctctctcttctcttcctctcgcaatgctctctcagcttcttcccatttctttttcctccgttcttcctcttccctctttttttctctggccaactcggctgcctcctctttttccattatctttcgcgtttgcttcaatttgttttctttgtaactgttcttaaaataattgtgcgcaatgcttctatggtgtttttctaaaattcttattttcattaaaaattttttaaaaaatcgggttcatctaaaaattttaatgagatacaaatttaaagtttttaattacccttcctggtactattattattattattattttatttaagtaaatttggtttctctacctggcatcttctggttggaagcctaaaaataaaaactaaaactaaattttcatgacataattaatatgtctgggctgattattttttattataatattagagtacggatttataaagaaaaattgtaaatgttcgagtcaaatctagccaaaatattttatttctttttgcttaatagctttcaacaattttaaaaataagggctctaattaaatattcatcaatatgcctttttgactaattatttggatttgaaatttcatttaatttattttttattattatagattttattgaattttaaattttgtcaattttttttttgttttaaatactcaattactttggcattaatttgcaatggatttgttgccaattctgatgttctgcccatatttttgttttcttttttgtcttaatagagaaaaggagttagcaaaaattaaataattcttcaattaaatttaccataataatccgttggaaatttgtgcctttcaccataacccttcagcccaccgtaatcaattggcactttgccaccaaattgagcggcgattgctctacttttaaccaaatcttaattgttaatttgtttcttaatattaaactgttgtagttataatcctctcaaaaaaatgttgtgcaattcagtaatttaaaaaaatttttttttttttttgctattttgatgcatttttagttaaatattcattcataactcaaaaaatcaaataaatctttatcaaaattaaacatttaaatttctaactaaaataaataaataattagggctgggagttatatgtaaataaaaaaagggttacaaaatttcaatattttcggttcacttacaatttttttaaaaagtctgtatttttttatataaaaactttaaaatttcaggtaaacaaaaaaatttaaattttcaagtttaaaaacacgctaattgtttcaaataaaattttatgaaattttgcagactgttagccccttatattaagttattttcctgtcaaaattccagtcattcttctgacaactatgaattgaataataaattcgccattttcaaacttcgtaattataattcaccgtcatataaataataatttattaataatttttataaatttctttgtataattctattaaaaaatttaattaattactttgttccggcattctctgctcatttgttcgtttttcattggcaatttttgtgtgatactttgtcaatgtttctgttcgttttacttttttgggcattcgtggtatttttgactccccattaaccaatgcattgaatgctttttcaagtaaaagcatcaattcattctcatccattatttcgccatttctcttaaaatttattatttttaaaaccttttcattttttcttttttttcaaaattgaagtcgaaagcataacgaaaaaatatttaaacctataaattcaaaataaatttaacgaatttttttgaattttctttcgcgaaaattttttgagaatttttttccaaattttaaaatttcagttttttagtctttattttcaatttaaattttaaatatgtcaattatggcctcttgcgccaactgtttgcagttaattaattttctccctaattaatcgtttgtcactgattacctcgtaaaggggtgggatgcttaattattcgcactaattaattgtctccctaattgatcatttgtcactatttacctcgtaaaggggtgggatgcctcggcgttgcatctctctgccaattgctgcccattgttggtaagcttcggcacgctcattagtcaaaattggcattttgcacagttgccgatcattttttccctgctgctcctttacattgcttgtcacaaatttcaaacatttcttggcatttcgccacgattgttcaacacttttgccaagcgctttttctttgatctcaccgcctgctccgcggctttcaattctgtacactgtccgggcaatttcatcttctcttgggatcaaaattatccgcttcatcccatgttcccgcacaattagttgtccggcatcgtacgggtccgcaatttcaagccgctttctatagtgttctgcgcctaatttttgagttttacataattttgaggaacaaaatatttgaaatttataaaaaacttaagggggggggggtttgcaaatttttttgagataataacaagttaaaacttgttcacggagggaggaggtttggagttccagatcacgatctgacatctattttgattattttcaaatcactaatccgaattagggcaaaagttaacactttgacactagcgcctctaatttgatggagttgcgcagccgtgcgcgatggtcgtgccggcgtagggaatttggtttttaccaatcaacaggggagggaataagggaaagtgccatatcttcacgaacgatgcaggggggtgggggataccacggagtgatcagtaaaagcgtaaagtgattaaacaatcatttgtcgcgaaaaggggggcgtgaaaataaacggaaaactaaatgggaataaaatgaaaaatgtgagcatgaaattcctaaggcctcggcattagcctaattatttggcaattttctttttttttataaattaaaaaaatattatttttttggaataaatcatttaccccgtttttcgtattgttcacgcaaatttcgttcaatttcttcccatttttgcaccaacatttggtcattcttgttgaatgaatgttctgcataatttttggccattttttcttttatttctccgtctgatttttcgctgtcacttttcattgaaacagcggaaattgaactatcggaatgctaaaagcaaaaaataatggaaaaaaaaattttcaaacgtacttttcagtatttgacgaaaaccaaattaaacttaaaatcaaatccttaaaaatttctttcaagtattttttcggaaaaatttactttacctttttcaatatttaattattattttttatttgaaatatttatgaaaattttttgggcatttaaattaaattttacttaacataaataaaaattcgacctcattgtgatcagtttgataattgctctgatcactttcactgcttggaattgaccttccaattgcagcattttctgaatccgaatcattcgatcggccaataaaatttgtcttcggtgcaacagtccaattggtgccaccattttgtgggtactcttccgtttgccacaatttgtggtctcgagtttgttcaaacaatgggttatcgtagactacctattgaaaatttttttatgaatttgtaaaattaagtattttaaaaaataaagcaccctccccccccccccccccctaaattagagtcccgccctgaaatgaagccttctaaattatagccacctcccaaaaaataaagcccttcttttgaggggggttgaaaa

SEQ ID NO: 5442 - DNA, 2654 bp, Heterodera glycines
cccaatattatattttattaatggaaaatgctaattcgattatttttttttataattttgcttaaattttcaatgttttcccaaaatccgtggctttagatatccatggataatactaatgtatttacatatttatcatcagttttgggaagcaaagtgttcttaatttgtttcgtatttgcggtatttctgactacgataggcaatggcggttcagggaaatttgggtcatcatcaacaattccgtcaaggaccaaattgttttgaagaattgggactagcagttcacgtgcactaaaatttagatttgtttttaattattaattaattcattggcatgaatatgtagaccaattaattacccaaagcagcgacagaattttttggctatttttcggcaaagccgaggaggaaatacgaaatcttaaattttttttctccactgttatttttttttaatttcagcgccggagagcaaaaaaaaaacaacaagaattcgtagccgtttttccaaaaaaggactaatgcgaaagtcgtctgttgcacccccaaatcttctgctgaattgtctttaaatggatttttaagaatttttttgttttggaaaattttctgttgaaaatacaaactccccaattagggctattgctccccgaaattttttaaaatttttcccagccatcccgataaattttgtcgagaaatttcctctccgatcgccgactttttcttcccgaaagttgaaataattacattaaaaaaatttacgcttaatttattttccaaaaatgggttatatttttcacttttttatatgattcccttaccaattttaatttttactatttttaaaaataattttaaaccacatttaaaaaggcttacattttcaatatttcttccacctttggcacatcgtttacttcaaaatccgtgcccttgtagtgatatgcccacacataggtcggtgtgtgcaaaaaattgcccacaaaattggcccatccctcaactttttcaaccatggctttgttggtgaatttgagcgcgtcctcaacaaatgtgccgtgccatttgtacgcatctttgacccgtagcatggcaaatgtgagtgccatgccaccgcgtttttcataagctggttttccattcaaaaatggcggtttcctgccaaaatttggcattgtgccaatgcccgtttgaatggtgtcaatttgcgcatgtgctggccataatcggggccgaactgcaacagtggccaacaattggtcatcaactacaatttttggcacaaatgcgtttgcgtttttgatggcaaaaaatatgatgaagcgcacaatggcacggtgaattgctttccattcctcacaaaggcgcctttcagatccctaaatgagcccaaaattgccaattgcacaaatttattgatacccagaaatgagacaggtagactaatccaaaaaaaactcaaaatgtcaatttaatttcgcgaaaatggcacttttttgtaaaaaataaaaaaaataaaaaatttgagtaatgcctcccgaaatatgattattttttaagattttatatcaattctacggcccaaaacttgtgaaaccattgagaaaaaatttgttaaaactggtcaaaaatttgagaaaatattatttaaatttaaaagaggcttaccattaatcttgcgcaatgccaatttggcggttctgtgttctgctggtcgtttaaccacaagtccgggtctctggccgaaaaatcgttcaatttccgcagctgtaaaaacatttcattttttggaatatgttaatatgtatgtacacaaaaataacatttttattttaaattatttttcaataaaagagattaatttgaattaacttttggattatttttcaatttttttatatcagaaatcgtatacgggtaggacccatatctgggtttttacgaagtgtaaattttaattaagttttggttaatttttaaattttttcaagggggattttctctattttttttttgtttctattagggggctgaaatccgttttccatgaaaataattcattggataattttgaagaaatttttgatattttatattaaaattttctttttgtgttcttggggactttatccctatagtgttttcgaaatttcaaaaaatttcaattccattttcccccgttctctcacctcctcattttccgttgtcaaacttattgttggcggaaatttgggcttttgtgaccgtgtccgatcatcatgcgatgatggtaaagtgtaatatttctcgtcattgtcactcgcctcttcctcggttactgtagtatctgtaattgtctctaatgatggcaaagatgcggatgaggatgagttttttgtggtatggtaaccatttcgactgcttgttgggctactgtaagtttctgtgctcgaacttctgtttgtttcactgctatttgcatcacttggctggctacagtaggcatctgtaccggaagtaagcggcgagaaacactgtagtattcttgttcctgctctattcaacacttccacacttgaagcaggtgtactgtacttttctttgctgcttgtttcgctgctatttgggtcatgtggcgggctacagtaggcatctgcaccggaattaag

SEQ ID NO: 5443 - DNA, 866 bp, Heterodera glycines
actttcatttcaagattttgaatattcaatcttatatgttaaaagcataggaagatattaagaaaaaggtcgtccctagaaaaagtttttgaaaattttatttcgggttcaaaatcttcggaagtgattttttttgcggaaaatgatgatcctgtttagaaccttgtcttcgaaattctcatgaccaggagtcctcttaaaacagcagcactttagtcctatctgtccttgtccatcccgaaaatcttggccctggttcaggctccgggttttttcaaaaattcagtctcattattgtaattttatttgttcctcatgtaggaatttggtggatggcggaggtgtaaaaggtcagcctgtggtgggaattgaacccacgaattgagatggaactgtttaatgagccgttatggaattatgtgagagtttttggaattgatgttaatgaagccgagggtaatgcacataaacaacaaatttaaaaagcaaaaatattaataatttatttctgggcatgtcattttttagctgtggttaaattttgtgaagaccttcaaacggttgttcaaaaagatgtcaaaaaccttgctgtaaatgttgacaaaaaattcaagattgatcctaaagttaaaaatgtgaaaacattaaaggaatttaaatttttgcattccattataaaatttgtggaagataagaaaaattcagatgaattggaaaagttttccacaaattatgacggaaaaaaattttctcagaaaacaaagttattaacggcacttttggtaacattggatgaaatccacacggactacagcaatgccagcaaaagagaaataggcaaaagtggaattcgtttgacacattct

SEQ ID NO: 5444 - DNA, 6617 bp, Heterodera glycines
  misc_feature (52)..(52): n is a, c, g, or t
  misc_feature (56)..(56): n is a, c, g, or t
  misc_feature (61)..(61): n is a, c, g, or t
  misc_feature (64)..(64): n is a, c, g, or t
  misc_feature (67)..(70): n is a, c, g, or t
  misc_feature (103)..(103): n is a, c, g, or t
caaaaaaattttacctaacacactacctctgcaccatctgtagaggttaagngaanaaaanaanggnnnnttttcttttcttagaaaaaataaaaactttggnacgtcataactcggcactcgtgctcatttcgcagaaaataaaaatatttttcttaagaaaccatgggtgctctatccacccaccaaatttcatttggaaatcccacggacacctggggaccttcctttgttagaatttttaattactttttaagaaatttaaccgagaaaagcaaaatcagtgatgactttgatttcgtgctaacacttcaaacagttgccgaagagagcacggaattaaaggcggagaaacggcaaaagtcaattaaggctaaagataatgtgaattgtttcaattgcttttctcattagcaattcgtttgtgcttactaattgacgaaaaagaaaaattggcagaaaaatatttgccaaaattcgtattcgcattgaaaatgtgcacaaaagaaactaggtaaaaataaaattgatttttaattttttatttcgatttttattttattaagcaattaagggttgggaaattttaaatgaaaaagggtgaaaaaatagaaataaaattccacttgtattaagaattttaattatattggtaaattaactttattaattaagctgtaacaatttcgaactctttgaacacaaaatgaaaattgatggtaaaaatgtgcacataaatttaagaaattggcatttgccttattttgtgtataaggaaaaagaagatgaatttaaaatggaagaagcggaaggtcatttttgaatatgatttcatatttattatattaattataatattatttaaatttaattaattatataaaaatattatttttttaatagtggaagtgaatatacgaaaactgaatgaattggtgaacttggtaaagccagacgatgaaaaagttatgggtaattttgaaattgttcattatttatatatatgtttttattaatagtgaacaaaattatacaaaaattgcatgtattactaaaattgcaagagaaaaaacgaaaagtgaaaaaggacgaagccgaaggtatttttaaaattatttttaattgattaatttgaatatatttttaatagtggaaatgctgagagaaaaattatggatgagctagaagaaaaattaacaaagcataaacaaaaaaagatggatgagaaaaacaagaattgagccgaaaagaaaagcgagagaataatgagcaaaaataaaaaaattttccaacatcatattgtccatgttaacttttctttattttttagggatcgcagatcacgaatccgacatatatttttgcctatttctaatccctaacccgaactcgaacacaaatacgaaaatttgaaattttcgatttatgaaatgaggcttattgacctaccaaatggggcttttgaaaattttaatctgggagtcctgtttatttaccaatacccatgcaaagcatacatatacaatgggtaaaattggcgaaccgtacagcctatgccctgggggcacactttgattggacaaattgggttctgtcaatttcattttccatctttggcataaagttgagcattcaattggattaaaaacatatatgggtaatatgtagggctcaggcataaaaaagttgaaattgcataaagaatacaaaaacgactaaaaaggcacaaaaatttaattttggaaaaagtgcgccgaaaaaaggtggtttggaaagcaaaaaaaaaaaaaaaaaacctttttttacattgctcgacccatgaaaattgttattttgatcttattaattaattaaattgttacaaaagcgatttaaagtaatgttgcaaaatgttcttattttgaccctaaaaccttattttttggccttgatgatcttattttaaaaattttcgatcacacccctggtgtaggcacaaaacggaaaaatgctctgaatcaactttgattcaaatcaaaggtgctctgtcgttatttaaaaaacatcataaaaatcagtatttaaaaaccaccattatagttaaaatcaatattttccgcaacccacacaaaatttaatacaactttttttaaattttaaatacataaatatatcaggtatttttatatgaaaatccacgttctattcaatgattaaattgagtaaattaaatccctaagcatacaaatacaagcatttcattcaacgaattaattgcatttcatttgaaaaaatgacaattagtaaaaagaaaaaggcgatatagtacatgaataaaagaaacgagagtataatgaacatagtgcaactaactgtctgtctttcctcgccacttttacagcccatctaaaaatgctgccaatgttttcaactatatataaaaaagaaataatacgttgcttgataagcgatttgttcaccggcgccgtttcccgctcgctggtcgctgctgctgacctgtggcgagtgaattatgctcgccgagcgcttgagcgttagagcttgcctatggtcacggcgagcgttgtccctccgcgtctgcagcaagcggggcgaggctgccaaatcccttggctgaagaaggccgaggctgagaaagctgaggctgaccggtcttggttgaacagcaccgcgcactggcttggagatggccgggcattgacgacggttgtattcggtcggagtcggtttgagcaaaatcgccattttttaaaattggcaaaatatgcttttttgttagccgatggggcgaagtagggttcgagctccgtgcgcgggggtggcttttcgcgggggcgggggcttgctttgaattagtacaagaaatctcacaaaaaatcaatttgtttgtaactgtgaaattttttcaaaaaattacaaactttggaagcataagagtgcatttttgtctattcacaaaaaaacaataaaaattggatcaaagcctcgggcgaagtttgaggcttttgagttttttttatgaaaaaacagatattctttagtaattgtaatttttttaattaatagaaaattaaagaacttgaactaactgtgctcctttttttctcataatgaaaattcacttttgcgttttctgactttttttttcattattttgacattttttggagaatttcttaaaaaacaataaaaaagaaaagtacacccctaagaatctaccccaaaaatttcagaaaaagacacccccctaagaattgaccctaaattttcaaaaatgcacccctaagaaatgaaaaaaaactttcccaaaaattcgtctcaaaagcttatttatttattttattgacgagatactgatttggcttaattttattgctttgtgaataaaaatttgtcattttatatccctaatgagcctttttagagcctattttccatttgccttttttatgggttttttagagtctaaagcctaccaaaatattgtcaataagtaaaataattataaaataattttttttttcataattcaaattataattctactgatcacataaaaaatcataaatatatttagttttagaaattaatttattcactactatattaactattaattaattaattatcatctcaattatacgggttatgaagactatagaaaaattgacaaaaacaattttcgaaacaaaccacacgaattttaattggtttttgctgcatttttcagcaaattttaatcacctataaatcacttaaaatcatttaaaaaattcccctaattaaaccgtatttaactatttgtctttgtagcattggtcaagaataattatgcgttaggatgctttagacaagaattgcaccatattgaaatattcattacaaaatgaaaataaattactaattatacaattaaaaattaggaaatttttagctatcaatatttattaaaggaataaaatattaatctattactttgaaatgattacaaaaacgaggtaaatattagagaccggacgggatcgggatcccgcgggatttcttcgggatcccgcgggattaaattcgggatcccgacctcgggatccgtcccgagcgattttttaaattcatcgggattgatcgggatcgggatttcatcggaatcccgaaccgggatccctcccgaccatttaccaatcccgcgggatcccgcgggattgaagtcacgataatttttcaaaaaatgtccattttttaaattaagatcttgaattataaattaaaaaatattgtcatttgctaatttttcgtaaaaaatcccttaaaaatcccaaaaaatttacaggtctccaaaattccactaaaattttcaaaatttgacgcaaaagttggccattttgtcacttttatttcttcataaaaagaattttttttttaatttctaaaacattattctaaattttattaggtagttttatggcacaacgatttctaagaattttgtccaataatcagaataaaaattttgtctacgcatttttccttcggtgccaatcggacatcaccagacccaagaacccattattttcttataaattagttcaaaatcacaaaatatgggcagtttttgtataaattctgttaacaaattacatttcaaattttcaaaattttcccggcggcgcctatcggcaccgccgacctcccccccggttcccctaaagtttttgaaaaaatttgcagcaaaaaaaaatcttaaaaatctgattttttgattccgtttctctaaattattaaaaatgatcatctgaggcgaaaatacaaaaattgatattaattgattaaattgtaaaaaaattatttaaggctatgttgttaaatgttctcatttttgaaaatctgattttttgggcatgatattccaattttgaaaaatttctataaaaatctgatatcattcacatctctttttttttcttcaatcgaattgatcaattataaatattagataaacatttgaacaaaaacttggcacaaaaatgtaaaaaaaataggtttgagcaaatcccgaaaatcccgcggcatcccgaaaaaaaatcttcgggatagatcgggattcggtcgggatgtgcgatcccgggatccctcccgatcgtttctcctataggttgggtattcgaatcgttgaatagtacgaatcgtgtaatagacgaatcgtggctttttggctgagtagacgaatcgtcactttttggctgagtagacgaatcgtcgagtagacgaatcataggcgcgcccctcccaagccttgaaggccttacaaccaactgcgacagttccgtcagccacgagtgtcccaagtgtcagaggtaccgcgcattggactatctccccgatatcctccaagatttgtccaccgacatgtcccacgatttgtccccaggaagagagagagagagaaaaagtgccatacgtccatgttgagtcctaaccaaaaaaagtcaatgaggcgaacctattcttgccaattttctggcctcgctcatatcgtggccaagccctacactacggtcgcaaaacattcgttcggctattcttccgccgaacatacaggcaatttcggccatgacttgcttccttgtgcttacagggcgcgtttccgtgtccgtttaaccttcataatccccgtttgggtctggcacgatacacacctaattaacaaatcatatccaaatcaaatctcaaatccacttcgatgagccgctcggaatggcgaagaaaccatacgaccaacgtgtggccgcattcgtggattgcaactctggccatattttgctcattccacaaatccgcttcatccagctcggccataaagttgcgaacacgattcgaataagcatttacggcacgatgggcattcatattgccttgaagcaataaaagggataaagcatttgagataattagagttaaaagtcataagctaatgattaatactgtaagcataaataaggcatttaagcaataaatggatatttatattaaccatatgcttagagaggttttaaaatagtaaaaggtaaaacattttttagataattagagttaaatcatatgctgatgagtaataccttatgcacaaattaaggtattaaagcaataaagggcaaaaatattttttgagataattacagttaatcagcgaccttttcgcatatggtcttgttgaaactgtgaaatcaaatcttcatataatgttgctttttaagttggttggaagtgggccattgacgcgtagtaagaaagcgcgaattgattttggccagggcaagacgaatggctgaggcagtcctttggccgaactgaaaattaatcaaaaaagtggttgcttttttgtaaattgcaaatctaatttaattccttatagttggcaattaaactttattctatgggcacaatggactacaatgaagttcgccggtataaaaaattttcagaataattttgtatagtgtgagcgaattaaaattggtataacagtaaaatattggtactttcttgttttggttacatggctttaaaaaaaacaaaaacgagcgtaaattcacataacttagttttacttggagacataa

SEQ ID NO: 5445 - DNA, 1818 bp, Heterodera glycines
  misc_feature (13)..(13): n is a, c, g, or t
tttttgcggacanaattcagcgttcgccgttgactgtgtgctttcccgagtacaaaggtgttgttttttgtcagtatctttgttctcgactagggaaattttttttttaatttttgttgcgtttttttcgaaattgaaaacaaaaaaaaggggggggacatggcacggcatggatgtgtcgtcggaatgccgatttatgattgctgctttccgatattttgagggcgtcggcacaaatctctggtacacgtttcactgcccccaaggggagaaaatcctaaatccaaagacgtcggcacatttggggccaaatttttttaatttaggccaacaaaatcaaacggaatgcataaattatatccagtggaattttgagcatatgaataggtcacggcaacgggaaacttattgccaccacacatgcgcaacggacacaaacgtaatttactagtggccaaatcggaatctcgggacacttggcattactggaaaatcaaagaaattttccgagtcgagacattccgagattcccgaccggtcaacatccattaggagcaattagtgacagtctgtgttcgggactgaaaactccgagtaatattattaccaatcaatcatcatcaatcatttatacgcataagcgtgacgcccaaaaataagaaataatgaaacaatatcaaataaaacaaacaattggtcacttttggagctggggtggcaaagaaatcaacaaattcagatcagatctttcaagaagtttggcaaactcattagaatttagtaatctcgtctctttaggcaaaagtctatagagacgagaggttcgaataaagaacgaattgtatctagcattggttgagcaataagctgttcttatagtgcagggctcccatccgtccttgaatggcaaggacgtccttgaaattgggccctctttcttgaaaataaaaaatgtccttggatgccaaggacgtccttgaaaatgaacatttagaaagttttaaaaaaattcaaagaaatttgagaaatctttgtaattttcaacgatattttgattatattatggcattatgtaaataaaatgcaaattttcaaattttctcatgcttgtgaatgaatttgttacgcaatttttcgcgtttgcgacataatttatattttagaatgttcccaaataagcgcaaatgttctttcaatcccgattgggaaaagcaatatacttttgtcaaaagaagccgaaaagggaatggatttttttattgtgctttttgccaaaaagacatcaatgtcgagtcgatgggagtttcggccataaagtcgcacacggaaaacaaagaacataagcaaattaaagaggaacggcgtaaaagcacacaattgagaattttgttcgatccaaatcgacgcttaattcaattgaccttcaagttgcaacggctgagggtcatttctctaaaattttcagaattttccacattatgttcttgaagttctggattaccatcaacatttaaaaatcattgcattaattaaacgtctgaccatttttcttcccttatctcaacacaaggtgacgatacaataatattaattatggacaaattaattacaccagcacaattagatgtcaaaatcaccattcaaatgtagcaataaatagaggaatcaaatggctgtcaaatcaccaaaaacattcatattatttattattttatcgcatcttttcctacaattcaatttccaagaatggctgccaagcttcataccatcatcctctgctgcttgtatgtgcgatgattaatcacgagataaaatact

SEQ ID NO: 5446 - DNA, 4794 bp, Heterodera glycines
  misc_feature (1481)..(1481): n is a, c, g, or t
  misc_feature (1539)..(1544): n is a, c, g, or t
  misc_feature (1550)..(1551): n is a, c, g, or t
  misc_feature (1554)..(1556): n is a, c, g, or t
  misc_feature (1558)..(1558): n is a, c, g, or t
  misc_feature (1593)..(1593): n is a, c, g, or t
  misc_feature (1629)..(1629): n is a, c, g, or t
  misc_feature (4787)..(4787): n is a, c, g, or t
ggatgttttgaggtgcacagaaatgttattattattaaaaaaacgtggctttacgtcgctgcttatttctttaaatgtcatttgtcttctgtttgtgtcccctccccggcggaaagcggggaggggggggggggtgaaaatattttttgttttattcaaaatggcattaaataaatgccaaacattcactcagacacattgaaactccaaagtactcagaatttgccacattggttctgtttgtgttagctcaacattgccatttaaaattcatttctttaatttaatgtcgacaatttttcttcccttttctcagcccccgaggggacgatgaataataataattagtgacaaattaattggggcagcacaatttgttggcaaaatcaccggccaaatgtgcgtacaaaagtggtgatcaaatggctgtcaaatcaccaaaacattcattcattttattattttattggcccttttcctaaaattcaatttacaaaaatggtttccaagcttcttccggtcattctctgctgcttgtttttggtatgtttaagcattcggtataaaatactgtaattcgagtagaaaatcagggagtacggtatctatgatattattaatttctaaaacaggcttaattaaattcagttaaatattttaaataaagtaataaagcttaaactttcctttttaggcttctttcgccctctgctcgcccaaggctgctgatgtgctggtaaatggctcatttttggcattatggaaaatcaaaataatattaatatcttgagacctaaaaactcaatttcacggacatatttgcaggattaggattcaaaatccgttaccggatgaatccgctttattaatccagcaaaatgccaaacaaatgcacacgattgtgggcccaataaaccctacaaattcttccgtctccactattatccatattaaaattgattttttcagaaatttaaacgagaagcggcgatcagcagttgtggagctgtaagacatatttaaaacaatagaaatattcgacaaaatattcatggaggtcgcttaatccctaaatttgttaatgaaatttaaatttatttgtaccactaaaagcgttagatgttttttaattagccatttttgtcctgttttctattttcggcacttttagggacagtttgaatacgggggcggctgttgtacgacatgcacaagcgatgctgattgtacgggcgggaaggtgagttatccaaataatgagaagcatttgccactgttagaaggggattgggcgcagatctaaagagccccttaaatattcatcgaataattatgtacaattggatggagcaagagcgagatatccgacgacgttaatggtcaaaaaatccctcgaaggaagagaactatgaggtataatcgcattaccttctgaggggaaccgtatacgagaaatcaacaattctaaacgagacagggcntcgcaatttacatcaaaggtagaaggtgtgggatgttcggtatagctaatacgaaacnnnnnnctaaannctnnncnatattcattaaatgttcattttcaaggaacgtccntggcatccaaggacattttaatttcagaagagggcncaatgcaccactgagacagggatattcgtcagagaaatcagacccgattttgacgaaaaactttcggttttctaagtaattctgaatcaatgcacttggtttcctccaataatgggagttgacacatcgcataatgcaatggaaaccggaagtgccctaactcgcacgtcatccctcctccctcccttagtccaggtggcagtactttatatccatatttaagtgcagatgagaatggggcggcatcggaacagtaccgcacacactggactatagctcgtttgatttatgcaatagagatccaaggctttgtgtaacgaagttggcatgccaacctggcttggattgctcttttattgcaatttgagcatgtttttggcaacaatgttcagcactttcgcttgaccttgggcatcgatctccctttttggagcatgcacacggacattgttgccgtccgttgctcgagagaaggccgtgtataattgaccgtgggaaaatacttccctttctaggtcaatgccgacagtgcggattgtttggccctgacctttttgaatggtcatagcgaatgcaggctttattgggaactgcaaacgctcatattttatgccgccaggcgatttgtcttcatagacatttcgtgttctttcaagaaagaatcttacttggccgccaatagcattgctattgataacacgaccaatgaggcgatcatcgccaagttcttccagaactatgcgtgtgccactgatcagtccttccttatcacttttattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtatccccgcacttgacctggcacattcgccatcatgatctcgttgacttcatcacacgtgtcaatgtgcggagcgagaatcaaacgattgagcagctcttgtcatttgccaaggagttgttggaagttaggatagacataatctatcagctcttccttgctcttaacgaggaactgcggaggaatccagaagtgctctccggtttctccaagcccgatttggcggcacatttgcaagaacgcttgctgaccttggcccagtctctggttgatggtcaatttcatcgtggtgaactgaccaaacaacggagacgtttgaaaacaggctgtcacctgagcggttaagccttcatgaggcacgaccggcagcgactgtttgaagtcagcgctgaaaatgaccgtttttcctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagacgttctgttggtcgctgttaagtggcggaggggtatttggctgtggacgaggatttggttgccctggaggcaaattcaaatcatcatcgccaaagaaaaactcttcaattgccgcgtcagtatttttggcaattgaagttggcgggtctggcaggccaaaatggacacaactgtagccaaagttgtggagccgccaatcaatgtcggctaaggctctatcctctgctactttatgctgtgccggagtaataatgccttgcggattgtacatttggtctttgtacttgttccacaattctatggcattactcggctggccatagaccaggatgctcacaaaaagccatctcatctgatctggccagcgcgacagagctgcctccgccagagttttgtcccaaattttgtcgtcttcaagaagaccatgcattattgcagcctcagtgaatgaggtacaaagcaacccgttaaccatcttaagatggtctgggtctccaggggcctattcaaattagcatcgtatcaacgatgcgatgatacgatgtgatggctcatcatagccccgatgcccgttcaaattaaaatcgtctcccgcatacgatttatcacaccaagtcatcacatgtacgttcaaattcatcgtatcatcgcatctacgatgcgatcgtcacatcgctcgtaaaatcgtctgcggcagacgattatttgtacgatatgtcgtatgtgcgttcaaattaaaacatttctacatacgacgagcccatcatacgatgagcctccctctatgaaaatcgtatgtagacatacatggaaggaaccagcgattttcctacatcgtatgtaggaaaaaaattcgtaaaaaattcgggagacttttaaataaataatatttgtatatttcttatagattaaagtctcagctattttttcatataaattttaaatttttagtaccaataaaagccagtcaaattattaaaaacataaaacattcaaaagaacgcatttttcctttaatttgaaaaaaggatcagcagctaccttattaggtttgtataaattatttggagaaaataacagcgaatattaaaagtaattatttttattaaatttttgtcgaatttaaaattattttaaaattgccaatggaaatatttttaagacataaaatgatttgtggtaaacatcgtatgcattcatcgtatcatatcatcacatcttatccataaaattaatttgaacagccatacgatcgtatgatgagaacgtacgattggatcatcgtacgatctcatcgtatgatgagctgcaaacgacagctcatcatatggcgaaagtctttaatttgaacacgcatatgatcatcgtatcatcgcatcgttgatacgatgctaatttgaataggccncaggaaa

SEQ ID NO: 5447 - DNA, 1943 bp, Heterodera glycines
cggccttggaactccattgattcgccgtacccaagggatggttccgaagaactttttgtcataaagttcttctcggaactcagcgattttgctgctccagacacgcatccacatgtcaaaacggtcagtaaatacttgaccgtttttatatatattctctttgaactcaggccattccctgttgttggtgaaagtaatgaagagacgcgctttcttcgcgtcatggcaccgtgcaaaaacggtgttgcaatcttcatacattttcttccaatattggagagaatttacgttgtgttcggaaagccgaacaacactgccaatgtcatcaacagttttctgttgggcattggggttttgccgtgctttctgcctgttgtattggttgaccaaatactgcagcagattttttggagtgctgatccgcagatccatgtcaggtctatgcaaaaatgttgctatttgccaatcaatttttgcagcctggtcaaggatccagcgctgaccaagtcctccaccacatgaaagaatgtggtggtattgcaactccacattttcatcccttattgcgagataatacttgcaataatctcgcagggagataaattgtttggatttgtcaatccgccggtgctgcgatgaaacagatgctacagattcagcatctgaatctgcgactgaccccgcatcagataatgcaattgactgagtctcgcacgactcattatctgactcggcttccgagtcaaataggccagatgcattctgagcaccttttcgcttacgcgatggtggcttagcatatttaacgccagttgtgtatccatcatcgcccattggcttgattaatggatacgtaagactatcagtccacggactgaaaggagcaatttcatttaattgcccttgtttgttctctacccaaattcctttgggcggaggagcaccagtggggtccgcatgaatagcgaacattccttcacccgtagaaggggtgattatttggtgtgggtgcaattttgggtctttcagaccagctggagccctgcgctcattcaacaaagtcatgcgaaagaagcgaagctcttccggagtttgttgttggagaagctcagtgagctgctcacgcgcctgcttatatgcctgcgcagcaggatgatgcacttggatcatttgttctaagatctcaagagtctgctcatttagctggtgaccctgcacaaactcatcttcgtttgtgattttctccccagtaaacctggggttgtttcgacgctgttccatagcctcgactgggtccagaatgtacaactgccaaagccaggaatctgagttgtaccagcctgcatgctgcttatgcggcgatggaattctccgttaagaataacggccatcggaccgccagcagggcttggtttgttgccagcggaaacgcttgcaaattggaacaggttgttataacgcgacatgtttcgcacaaattctttcccttcacgggattgcttattccccacaatcagctctttgagctcatcaggatgcgagttaagcattggcagcacaactcttcccttccggcagcaaatgctactgtcttaatgtgagaagagatgtgcaccgcaatcggcgcattttttgtcaccgagtttcccggagtcacaatattccgggaaatgtttggctgctgctgcagcgcattgccaccccttgtgaaatgcagagcaacgccgtgtgatcggcgttgccactcccagcgaatttgctggcggggggcgtttcggcgccggtgaaggcgaacggctaacagaagctgaaagccttttttgaacgcgcattgatcgccttggtggcgtcttaggtctgatgaaaattacatcatcagcctgcgcaattggctcttgcgggatgcaagactccgacaccaaaccaagcgtgtcaagggagtt

SEQ ID NO: 5448 - DNA, 7325 bp, Heterodera glycines
atataatgattagggctgccaattttatgtaaatacatatttttttcctagcttctccttgctctaaatagcaggaaaaacactttcttttttgtgtttgcgaacaaaaaccgggacttttatttacatatttttacatatttcggggtttttatacatatttgtacatattttggattttttcatattattttcatttttttacatattgagtattttttacggaaatttttggaaatcctcaaaaaaaaatccaaaatttcggcaaatatttttgtacatattttcatttttttacatattttgaaaatttataaagaaaaaataagtttgaaaatgttgcctaaaaatatgtaccaaaaaaagtaatttttatgtcattttgtggctatttcatattttacggggattttctttcccaaaatataacattaaaaaattttatttacatatttggggttttttgtacatattttgggatttgtcttacatatttatgtacatatttggaccactttttgtacatatctttggcagccctaataatgatgaatattaagcattaacaacacaattatggcgagtaaaatatattcacgatttttttttctcaaaaaattttgcaaaacaaaaggtccccctttggtttttgataaaattcaaaatctgtcatttttaaaacaaaagggtcccccctatggttttgataaaactcaaaagttttcattttttaattagcgccaaatttcttttaaaaattattttatgcataccatatattaaaaaaaaacaaattctgcatcaaaataaacaaaaaaaaaaaatgtaaaaaaagtgaaaaaaaattcaaaaaagtactctttgtaactagcgcccggaaagtccccaggaacaattttttcacgagcatacatcttacaaaaattttgcaaaccaacagagtccccttttggtttaaatacaattaacagataaatgtgaactattttcaatttacacattaactttttgagaaaaaaattaggttcacttaactgaaaaagtgccatttattgcgaaaaattgtattttcattaattgtaaacgactcttgatatggcctttaaatttacacaataatagaatattttaggaagaattcattcaacgatttggaagacaatttggcataacggaggaatttatccgctccaactcgcaacgaatgaaggagttcaagcagcaagtcaccgagggaaaacagcgcgaggaatatgccaaattgctgcacgagcaaatggaatttgagtcggcgcgccgtttcagagagaaatatggactctgatctgatctgctttattaaatcaactccgtttattgtctattaaaattgtgtttccaacttttttctgaaacaaaaatagggaattattaaattccttttttaaatacaaatgttgaatttgttttaaatgattcatacctgtatattataatatttaaatgtctgtacacaaaaagaccaaccaatttttgagaaattcaggaattgagaatgactgaaaacaaacaccgcaatttggggaacgataggcaagtttacaatttaaattcttgagcgggtcgatcctacggtttcattttagtattctacgtaaaaacgtttttgataatgttatgctttgccttaaatttcttttacataaaattgtacacagtcactgatcacgaaattttgctatttttatttttcgggctctaaatttgattgaatatactccagactgtatgtattccctatccgaaaaccataaaaatgggccttttttggtcgcaggaattgaataaattgtgccatttctgtggacacattaacttttctttttttaattttctagtatcagaatctgtgatgacgtctgttttgaccttctccactttttgcatcgtgtggaccatcagcgcataaatttggtcagtcgccgcttccgttggctgagtgcgtccgtcgagcgtcgctatccctcgcgtgccattcgcgctttgttcgtcgttggcaccccacaaaatgatcaatctgcagatcagcaacaccgttttcttggcaattcgatcagtgtctgtccgtcagttggggcaccttatgccgttgaattcgcaactgttgctccgcctgccaatgtatcgcgcatttccgaattggaaatatgcgatttcatcggcccgcaactcatcgaatttttacgcgtttcggcgcctttgttagacggatgttgtctgatttttgatggtattccttaatctacttattcttttatgcctttaactgttgtcagattttgagaatttcgtccgtttgcactccttccaattcgtctaccaattctttgccctttttccggacaatcgttccgttgagttgcgtttcgtctcttccgccaccgcccctttcttttccaatcatccgtttttgttcggttgtgtcgaattgggcatcgaatgcaccgccgactttccattgggtactgattttggcattcggtttttctgaattcatttttaagactgtctctacgggtggctttgtcaggacataacggaggaaaacaaacgaaagcgttgtttggacattcgcttcggtacttttgttcatgtgaagaagtgcttggatgccgtgggacagtttgtcaacttcgtcaaacatgtgtgtgaaggggggtttcgttgcccatcattgccaattgctcccgacctccactcaaatgctaattcactttaagcgctttttgcattcctccgattggtgtcccttttacgtggaaattgagctgctcggcgggccacacattcccgaattggacactttcactgaacacaacgaacggaccggagaacaattgacttttgcaagagacgaattggcacgactttactcattggaaaggcgaaaaagcacagagaaagggccggacgatggaatgggcggagagggccaaagggcggacaatggcgccgagggaggccatggaagtgacggtgtttatcagcacagtgcagctgaatacgtttattcgatgtaccattcggtggttttcatccgacaaattttccagggggacatttccattggttgatcattcccgggggttttcattgtttcgatgtttctttctcctaaagtttctgctgttattttgtgcttgattcgtttgttttttctttgttattcgttggacaataattattttcttttttcttccattcttttctctttttaatttggtaaaaattattctaaaaatgagttcctctcccattgtcgccgttgccgaggggggcgacccggtggagcgaatgattcgtgcgaatggatgttgggatgaacacgtcgcactcggcgattgtgtgggggaggaaggcgactggcgaaagtgccaaaaacaagtggagaagctgaggttgtgcggaggagcgctgaacggatataacggacacttcgaaaatggcattttcagggaatgtatgggaaaagcaatggcacagcaaaaacgaaggacggagtggcaaaaacagcaaaacgaatgaggacgaacattggtcacactggcccactatttgaacctattgtcgtcgattaacataaactgtggtcgcattgtctttaagtttcatgccgttgagtcttacccaactcttccactgcacgcgtggcatttcacgtccacgccctgtggcattccttgtgcatggatgagttgcccgtcccgcttttcccatggctatccgtttctttcgtcccctccccctcattaacctaagttttgcgcctcattctcggccttttctttatgtggcgtcattagcaacgtaagcaattagcaaagcacaaatcggagcatcaacggacggaatgccaattaaaatttggcggttcggtgcctttccttttatttgaaaactttttgtgttttccaattctaagaacagtcagtcttttgagagtttgtcaacacattgaggcctctgccttcatttgatagtgttgctttgataaggtgcgaattcgcttcccttttggtcgttcgtttccgccgtttcggcgtgccattggcacttcgttgcgctgttccctttcaaatgccaatccgtgcccttcctcttcgtcgagactgaccctctcccctctcagtttagcaatttgtccgtctcccttttgtcccctcagtttaacaatttgtccgtttcccttttgtctttttgctccatgtcttcctcccgcttctttgtcctccttcctctcctctttttcctcctcctttcgttcgaatgcgttcttttggctcccaatttgttctcctccgtaagttgtcgtccatttatcttttcccatcaaaaatacgcccaaaaaacgaacagaaaatcgtcgcttttggtgagagtggcgatgcgtttgattcgccgtcattcgccgatggcacatcgacggaacgcttttcggcaacggaaagcgacggaagggcaatggccaaacggaacagtcggatggtcaacgcattgagcaccattctgaacaaacggaaagaattgggcaccaatgtgagcgaaactgtcaatgtttttaccgcctaatggcgccatattttaggatgcttttcgagttcgaatccgatcattggaccaaatgggtacgcttttcaaacacttatttataaaattgacttttcaggcaatacgaattgctacttttcgccggttcagtgttatttctttgaggaacggtaggaaaaagtgaaccgacgatggaagagaagaaaagaattggaacagacaaaatgaaatgattgttttgggaatgagaagcgatgccctttttgtgatttgccaattaaattgcgactcaacgaattttcccgcgttaaacgcccattttttatcaattcgataatttaaacgatttcatcggtcggattggtctgtctttgctgtgctaaatccaccgcttaaaatgcgaaaatgtttcaattcgctgttttttttctttccctccatccgccgttagtcaatccatcactttttttatccaaaacaaaaacagagaaagcgatgtttgtgaggcactgattcactgtttacacttagcaaagagtgatcggaagggttaagcgatcggatgagagcaggcgaagggcggagaagtcgccctttcactgcttaaccaaagacaaatgcccgcgaccgatcaatggccgacaaagcaaagtttggccgccaaatgtgagcagtgagcacgagggattgatcagtgagtgggctgcttgctgatcttctgcttttgcagtgaatgtttcttagctgctcagcaaaggattttcgcattcatcgaatgccaaatccccgccgggctcaaatctttacgcccattgcttttgggtttggccatctgtcacttttcttccgatcacttttattgccatatttttgctgataaaagagagcaaatagctcctcattcattccactcgcttttactcattcatttttaagccaaatatttaaaatggaaaatatcgaaattacgcacgaatggagcggccaacaatgggattggcccctgcaggttggcagtggcaccaaaaaaaacactctcaaaatggcacttttcattttacagcataatgacggggtggtgaaggttcacaacactccggaaaaatgggaagttgggttggacgtggcattcttcacgccaaacgaaattgaggtgggaaacgcaacgaaaaggacaaagtgcgcattttgacaggtgaaagtggtcgcggaccatctgaacatccattgcaaagtgagcggaaaggcaaaaaaacgaaagagaaatgccaaaaagggaaatggaaaaagaaatgattaattattgtgcccttttaagcacgaggctcggagcgatgtgcacggctcagtgagtcgagagattaaccgctcgtataaattgccgaacgatgtgaacacagtgagtcagtcgatggccgtcaaaatgccgaaatgacccaatttgtgacactgtccgtacggcacattccctctcccccacagggcacaatcaaatcgcatttgactcagaacggcgttcttcgcgtctctgcgcagaaaaaatgagaggaaatggcgaaccatggaagaagagaagagacaaagtgttctgtttcacaaccaataataatcctgtttatttactttgctttttacttttgtaatttatcgccgtttcgcgaataattaaaaattgcgtccatcgcttcttcagtttaaaaaatggttacgccaaaatcatagtttattttccattacactctctttaatataagtaattcaactctctttgatggttgagtttgagtttaactttttatttttcgaaatgaaaaataaaagaaagttcattgcattttttgaaaatttttgaattcatgggattaatcccagtttaatctctttcgaaaattacaatcccggttccgagttaaatgttaattatctttcttggcactgcgcttttattttcattacattttttcattaactttttttgggctttgtgccgaagagatgtgaacaaaaattagaaaagtgcgatgggcgggcgataaataaacggagaaaagagacaaaaaaggggacaaaagaagggcggataaacgaggggataaaagtggagattaaagcggatattatcgcttgcaaaaacggcgcgtgtccttctcagtttgccgtcctttgcttctgccctttcccttctctctccgttaagcgaatgcgaaatttcgataatttcgctttgcgaatgcgaaccttcggctggcgccgccgtccgcaaaagcaaagcgttttcttaaaaaccaaaattgaaaatgcgtaactaattaaggggaggaaatgcccactcattccattggggcaattccgccgttcttttggcaaaggcaaaagcccttccccatccgttggcatttcgcttcgcaaaagcgaacgatctggcgcgtttggcaaaggcaaagtgtcgcggcgatcgcttattctccacaagttcggtagggatcagatccaaaaggactgcgcgaggctgctgaaaaaagggggaacagtgatcaggacgaaacaaagcaaaaaaaaaaaaacaatacaaaagggaaaagaagagagtgaaagtgatcagaagagagaaaagcaatgacagagataaagggaaaagaagagagtgaaagtgatcagaagagagaaaagcaatgacagagataaaagggaaaagaagagagaaaagcaatgacagagataaagggaaaagaagagag

SEQ ID NO: 5449 - DNA, 1624 bp, Heterodera glycines
gagataagggaaaaagaagagggaaaagaagggaaaagaaaagtgatcagaaaggaaaaaaaccaatgaaaagagataaaaggggaaaagaagagaatcaggagataagggaaacaaaagagtcagagataagggaaaagaagagagtgaaagtgatcagaagggagggagagaaaacgaataagagactagcaaaggaaggaaagaaaaatgttccaaaaatcatgatcataaataaattctgctaaattgtgatggcttacctcggcggatggctgctgcccctccacagaaacacaaagtgcgacgaggacagcaaagagcgtcagaaacaacggcagaagacgacacattggacgaggcgaaccaaagaatgaatgggaggaactgaaagggatgagagaaggaaaaagggagagaatgtcaaaatgggagaggaaaatgccaaaagtgaaacaaaaaaagtgccaaagagagcggaggagagattggagaaaaagaagaggaagagaaagagaaaggcaggtggaaaaagaagtgcaatcaatcataataattaagtgccatttgagtgttcgtggtaattcatttaagtgctttttgttaaaacgtcagctttagtcaactttattaattaatggcaaaatgtgtttttgggagggattggcaatgtttggcattggcggagaaaggttcaaattgccggcgggggataatccgcttttgacggaacattcgaatcggagttttaagcatcggcggacgcattaatttgctacgatgtgcagaaaataacaacaaaagtgagacagctccaaattgacttattattcccggggaaatttaaaaatgaaaaataaacaaaaaaagagaaaataaccgcaaaaaatgggaaaaatgaaaatgttggaccaaacccatcggactgagaaggaattgaagcagaatgagcacgagttcgagcagtgagtccatccgaaggaatgccaattcccccccccccccgccaatgtgccaatattcgaattttcgttgcgtcacaatattaaaaatgaaaaatgcaagggaaaaaatagcgaatgattgcgtgggtttgcccattggcaaatgaaaaaacatccaacaaaattatttccgatggtttagggtgggggggggcgagggatgctaccaaaaataggatgttggtaggagggatgtggcatggttctcttttttgagtgtttcgcttttttcgatttttattgttctctttgctaacgtcactgatttttaacaaccaaaagactgtatactataataataataataatagtaaaacaagagaatgctaacatttaaagagagtctataaacgaatatagtctacaattaaagttctgtttgaacatgagcaaaatgaatgtttaaaagcatatgagctagttgattggactcttaaaatgcgtttggactaataaaaggcgtttagattcataaagtgctttagagctaactcagcattggttccagtcaaaagaaaattcatatttgaaaattaaaaattttaaaatctattttcaatatcagtcatatccaatccatgcccacctatgtggttgatttgatgcatgcgcgctccttt

SEQ ID NO: 5450 - DNA, 2669 bp, Heterodera glycines
ttggatggacattttcccactgttgaccgtcctcaactcggtttaaaattggaactgctttcgcccgtttcgatgttttagtggacaaatattttgatggcaaaaaaagtgattttttagggttttttttaaggattttgtgcgaaaaggggcctccaatttcaaacgaattttgcttaaaagcaaaattcggttttttttgttgtaaaagtgaaccttttttttagggtttttgcttatttgctgattttttatgttagaaaatcacatacatttttaccaactccagctagacagatttattttcctttttcatgtaaaaatagtaactttttttagggttttcgttaatcatatttttgtattttataaaatatttcgttactttttcagcacatgagcaacgacgtttggatggaaattttcctttttttgaccatgctcaactcggcctcaaattggcactgctttcgcccgtttcgatgttttagtggacaaatattttgatgacaaaagcaaaatgactgtgggccacaaatcgaaaggactaacttaaatgcggtaagtatttaaagttttctcggttctaaaaatggcccgaaaaataaaaaaaaattcaaaattcgtaatgtgtgtcaggtttttttagtgtcttattgttacgtatttttggatttaatgatttttaagctggaccttacatttatatttttccattatagtcataaatttctttgtttggcaattacatggcataaaaaatttttttggtaattttgtatgtttttgcatttttaatagaaaaatttttgtttcgtgtaaaattgctcagagtttcggtcaacaaatttttgtccagccctattgcttccctttccgctaaattattaattttcataatttcagttgatgttcagcgatgtttggatgggcattttcccactttttgaccgtcctcaactcggcctcaaattggcactgatttcgccccgtttcgatgttttagtggacaaacatttcgatgggcaaacgcgaattttttcaaatttcggtaagtcttttgtttttgctttttttgtaagtgattggtttttttttgtttactttattgaagtcgtaagtttcattttttcaaattggccatgaaaatattttctatctaaaattttgattggattcggtgcttaaaaaggaatttgtaatattttttagaaatttgcgattttacttatgtttcagcatattttatctatgttttaaattattttatttgataattaaaaacggtaacaccttaagggaaacttttttctcttaaaattaaaatttttttttggaaatttgatatttttaatttagttttatggccctttttactcaattaagactaaaaatggattttctatgaacaaattttctcatttaactaacatattttttcaaattttcagttgggtttgcaatgatgtttggatggaaattttgccctgttttggccatgctcaactcggcctcaaatcgggcactgtttttgccccgttttgatttgctggtggacaaacatttcaatggtaaacgcgaattttttcaaatttcgataagcttttttgtttttactttttttgtaaaagtgattgattttttggttacttaaactaatagtgttttaatggaatttaggagccccaaacttttcttggtttcaaaaaatggatgaaaattattatttttccaaaattcattattctttttgatttttttattagagtgtcgggtttttttagggtctcgccgggacaaaatctcgccgcaaaaatttaaaaaaaattcaaaaattgaattttttcaaggaaaaaatcttagaaaaatttattataagaaaatataagaaagaaaattattgttaagtttttcttgaaaattgcgcggccaaatttggaagttccatggcataaaaaagcaattttttctaaattttgaaagtttttacttttaatagaaaacttttggttttgtgtagcagtctctaagagattttggtcaaaaacgttttgtcaaaaacttattgtaaagatttctcattcgttttttggtgcaaaagttccctttttagggtttttgcttttttgttgaaatttattagaattttcacaacagcttagcaaaggaatagtttttttaaatattgtgtgcccaaaaaacgcgctccagttttaaataggctatgaaaataaaaaaaaactttctgaattcggcgtttttttaagggccagaggctttttgctgcaaattttttaagatttataattttcatgactttttcagcacgtgcgcaatgacgtttggatggacattttcccttttttggccatgctcaactcggcctcaaattcgcactgatttcgcttcgtttcaatgcgttggtggacaaacattttcaatggcaaaagcggatgctgcgcaagttttaatttttttcaaattaaccggtcaaatgttttataagctctaaaaatttttgattgcattcggcaattaataaattcgaaaatgtaaacttttctttgttgaaaaaccttttattaaaaaaaaactagcaatttaatttttatgaaaatcaattattgtgatgttttgaaaatcttaacattgatgggctgaaaccattc

SEQ ID NO: 5451 - DNA, 3667 bp, Heterodera glycines
tctcgccgggacaaaatctcgccgcaaaaatttaaaaaaaattcaaaaattgatttttttcaaggaaaaaatcttagaaaaatttattataagaaaatataagaaagaaaattattgttaagtttttcttgaaaattgcgcggccaaatttggaagttccatgccataaaaaagcaattttttgtaaattttgaaagtttttatttttagtagaaaacttttggttttgtgtagcattctctaagagattttggtcaaaaactttttgtcaaaaacttattgctcacttttccgctatttattaattttcataatttcagttggtttgcagcgatgtttggatggacactttccctttttgaccgtcatcaactcggcctcaaattggcacttctttcgccacatttcgagcttttggtggacaaacatttcaatggcatatcgaatttgggcaagtttttttgagtttttgttgtaaaattgaatacattttttggttttttgttgtttttaaggatttaatcccaaaaatgggccttcaatatcaaagaatttttgcctaaaaacccctgaaaataaagatttctcattcgtttttttggtgtaaaagtgccctttttagggtttttgcttttttgttgaaatttattagaattttcacaacagcttagcaaaggaatagtttttttaaatattgtgtgcccaaaaaacgcgctccagttttaaataggctatgaaaataaaaaaactttctgaattcggcgttttttttttgctgcaaattttttaagatttataattttcatgactttttcagcacgtgcgcaatgacgtttggatggacattttcccttttttggccatgctcaactcggcctcaaattggcattgctttcgccacgtttcaatgcgtttgtggacaaacattttcaatggcaaaagcggatgctgcgcaagttttaaattttttcaaattaaccggtcaaatgttttataagctctaaaaatttttgattgcattctgcaattaataaatttgaaaatgtaaacatttttctttgttgaaaaaccttttattttaaaaaaactagcaatttaatttttatgaaaatcaattattgtgattttttgaaaatctcaacattgatgggctgaaaccattccatccagttaattttttgtgaaattaaaaaattctcacaggcaattgccgtttggccggttaaatctttaaaatttatctatctctgatgaactgaatagaacaaggaaaaatttttagatgtaatatatgaaaaattatggcaaagtgtatactaagtgaatagttatactaacccaaatctgaggttggttaggaataagtttcgtacactttggcacgcataagctcctaaatagaatttaagaagtctttacgcttgactgaaacttaaatgtgtacttaaaattattttataaatattattgaagtcaattgtaaagatttctgtccttatccccatttgagactcacatttatttgtttcaaaatcttatcggtctgctttgcgaccatgatgagatttttgcacgtgccggtctgcttagcgaccatggcaacatatcggtcagcttagcgaccatgatatgtagtgcaaacgccggtctgctttgcgaccatggcgaggctggtctgctttgcgaccatagccagtagtgtcggtctgctttgcgaccatgacacaatgccggtcagctttgcgaccatggcaacatatcaatctgctttaagactggtatggaaatcaagctcagacttgcactcgcctttgcgatgcatgtggctgggctgcccaatgggagcgcctttttctggccttgtatcccagctgaatgtttgcaaaaaggattgttctttgattacttagcaatgctaattgttcgaaggtcccattttgtaaacaggaggttggctacggtgggattgtcctccaatcaacagcaaagcgtctgtcgttaggagttccctgcccctggctattcagagaatggaacaaacaaagggcaatatatgtggttcgctgacatgcccttcggggcatttgtcgcaccaaagtggttcgctgacatgcccttcggggcattgtcgcaccaatgtggttcgcagactggcccttcgtggcatgagtcgcacctaagcggttcgctgacatcccttcgtggaacgtgtcgcaccaacttttggatctgcattcttaatgggatgtgtgagccctggctgatggatttcagcacaggacgactacacttcacggcgaagaatgatgtctttgatctttatttgtgcatttttgttaataaagttttaacgtctgtgtgcatttattggttaattacctcatatttttgccacatttgcaaacttttctgatttgttgtttcagatgccttctaagcaacgaaatttgcgaaaaaatgagcaagagcgttatcagcggcggacggagaaatctgtcagtcgggatacctcacccgtctcagtcgggagtgcagatgggaatggtgaggcatcagcatctctccggggcaccaccaccccaagtttaagtgctttgcaaataagcacgcctgcttcttccattggaagtaaaaaaaggggaagacccttgaaagcaggagcgaagccaattttggcaacgcaagaaactgtgtcctcaattgacacacctcgaactgctgtcacccaaagtgaccaaggttcgccgtgcaaaaaaagaggaaaggtctccgagtgtgaccaaccaacgtttgccaatgaagctattgctttgacgcctgtttcgactcaaagtcgtggagggcgtcctgccaaaaaaattagaggcccaggccgaggcagactcagtgattccatgagcaaaagctctgaaatggatatcaatcttgaaaatgcgccaattccggcaacctcgcacactgtgtctgaaaaaattgacttcagcactgtgcaaattaatttcgccacatcgcgaaattttgcctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctaccacatatggcaggttggatccgcaactgacggataaaattaaaaatatcatttcggatattttgccgtcagcagtgttgacagggattgttgatgtcgaaaatctgacggtccaacacgatggtaatagttgtgggtacttcgtgtgcctgtatgctgagtcatggcttatgaacaatcgcacatttgttctgcctgatttatccatcaattatgaaaaaaagcgcattttatggcacattaacgagctatatggctctgataatgtgccatatca

SEQ ID NO: 5452 - DNA, 2049 bp, Heterodera glycines
  misc_feature (1996)..(1996): n is a, c, g, or t
  misc_feature (2009)..(2009): n is a, c, g, or t
  misc_feature (2011)..(2011): n is a, c, g, or t
gaggaagcaatacaaattaaaaaataaaataaaatattttagcaatgacagcggcgtcggacttacggacagatcgggaaaagggggtttgagaagagcgaaacctaattaagaagaaaacaattaaaccattgtaattttaaagactccaaaaatgagagcacttcgacggaagagacggccaatttgagcagcggcggcggagacgaattttcattcagtggcggcacatctttggcaagtgcgacggcatcgggggaaggtggccaattcaaaacagaaaatgaattggatagtaattaaataaaagcaacgacatttcagattcaaaatttgtgccctttcgcccattcattcgttccgtttccatccacggcgtccaacagtaccacgacttggagctgatcaaatacagcgatgtgagtttcaaatttaggaacgcattataatattggtattttgacactcttaaaaaaatactactcaatttgattgaaattgatggagcctaattagtacggaacgggccaactccgtttggccaactccgtttggccaactccgtctgagccaactttgagtcaatataactcttaaagttattgactgaatcaaacaatcttgatatcattcgaaagctcttcacaggctctattagcctactaaaaattacagaaaatttcgaactataaaaaaagatagaaataaaaaactttgaaaattctgtcttttttgcggttttaaactgacaacttttttgagagctgattaatcactgagaaatagcttataaatatcttctaaacatctagggctttcgaatgataccatgattgtgaagtttggccaacaaagaaaaaagttatagctttttgaacattgctgagacggagttggccagacggagttgacccctaccgtaattagtataattattttttccacctttttaagacgcccgcccgtctcgcccttctgggcaacaccagcaaatacccaatcactttggctgaaattgttcgtcgcgtcagtcccccggagtgtctgaacacttcctttttgagtggcattctcagacggtcaaaatgccaaagaaaaagtgttttaattcaattttaaaactttttagagcaaaaaacaaagacggcgggaagcgatttcgcacggaattgcaacagtttaattgcggcgtcgatttgcagacggggagaagaaagacgggcgcaatcacaacattcaccgcactttgtgaacgtatgaaaatgaatttggaaattaaaatggaaaataaaataattaaatcgtaaaataaattaaggagaatctgttcaattggccaaagactttgacaaattggcaaaggacgaatgccatggatttcctgaaaagtaaaaaccaagaggaaataatttcgcatcaattaaaaaggcaattggctaattagttccaatttactctcagggaattggccatggaaatctgccgaagggcgggcgtcgattcgatggaaaaacaaaattgcaagcatcttatggactcttttcagaatgcgaggtgggcagacacatcgacaaattattaaacatataataataattttaaaacaattagcaaaattctgcgcgatgccatcgattttttggagagggccattgaacaggagacgggcgagttggcctcagtcactccggcacaaatggtggtccagcaaaggcagcaacagacaaacgatgccattggggccgagacggacttaatgaaccgattcaaacgctttgccagggtcagtggctaattttggtattgtcaaatgccaaatctagtcccgggcccttcccttttcagatgtcccattgctttgggaaccggggaatgttaagcgcttggcaatgtttgttggggtgcgtttttctctaattaattaattagttagttttttaattgtttatttttgaagtgtccttaacaattgcgaattttccctccaccaacaaanttgccacaatccntntgaccgaaatcgagcaacaaaagcctttgacatctgcc

SEQ ID NO: 5453 - DNA, 3732 bp, Heterodera glycines
ttgaaacttttccgcaggtcaatccgacgggggatgataaggccccgctttttaacagtaattaatttttttaggaccagcgaggcgcgggcagttcacattggatgttgccttaatttgcttttaatttttaattttttaaatttaatttttattcgtctgtttccatcctttttgattggatgcgacaactaaaaatgggttgagaatgagctttcattttatcatcggtcataattgttttttttaaatttattattatgcgaataaaatgtaattaaaagtaacaaaaattaaaaagtttaatttctgcgtaagagcccagcaaaaatattcatggagtttatgtaaatagtaaatattatttatatttaatattaattttttacttttcgaattttaaattattttgtcgctttgtttttctaattttccgtttcctcaattttagtatttatttgcttccataattccccaacgaaagaattcttttccatgtcaatgaaaatggcaaattttgttgtccttttttgcccctccgtcgtccctttctttctttttttgtctctttaaaaatgcaattctgtcaagcacaaatctgtgccaacgccgtcaaatgccgtcccggaaagatgggacatcattcccttgggggaattacggaggcaaagggcacacatcgccggaggggcgggcggcacagagtttggcccaaaaaggcagcagagatttctcgcctcacccctcgaccagttccatctgtgccattcgctgttccaaaaatattttttgtcttcatttgaaataatttgttgataaaagcgttttatatattcttgaatttatttatttaaaactaaaattttaggccaaaaaaacaacgactaattaacctcaaatttattgctatggccgagaagaaaaatggcattagccacgaatgctgtggtgaatgataattaaaaaataataattttcatttattttgatcttttttcattttcagtatcaaataattcatcagatgttaatgctaattgtaagccaaatcaccaatccgttgcacaacgcgtgcctcaacagctgcttttccaccatccctcgccttatttgcgtagggttaaactgccacgacttcatctcacagtaccactcaaaaaagtaccattttaaaaatcataaagtttaattgcggttacggtatgcatgactcattcctttcctgcccaattagacaaatgaatcgtcccatttatccgtttatattataaattatttttttggctttatccgccctttaaaataatttttttgttttcagtgttattcgccctgtgaatttgacgatgatttgccttctcccgacgaattatctgctcgagtggaattcattaatttaaaaaatgcccaaatcagacaacagttggtcagtggtgttaatagtttttttttaaattttaattttcagaaaaatagggccaatgaaattaaaaaagttgcagaacaaccaaagccggcacaaatacggttggtcggcattaaaaaattaaaatgaaattttataaaatttaataatttaagcgcttttttatgcccatcaatggctgaaattggaaattgcgattgaacaaatacacgaggaaaaccaatgaaaagcaggcactgttttgctgactaattgcaattttaaagtaattaaattcttaattaccgactatgttcttacacttttaccaaaacaacaagagaccgggggaatcgatcttttatgtatgttttctactcacttatttgttagttgaaatttaataatttagatgcaaaaattgaaaaaaattattttgtacgattaaaattgacatttttattggctttgccgatcggaatcaaaaatcacttggacaaaatcacgctcattcaactcattcattgattcaaaagtgtgtgaaatggcatatgtattgtaaatcaaagaaatgtgagaaacattttcgggtgaatttgtagcgtaattaattaattaatggggcgaaagtttacacaaaaatggaggggaaaagaaagagcagcgaaatgaatgaatggatgataaaagttgtgaaagaaaaactaaataaatgcccggttttcgttgtccatttgtaaccacagattgtgtctaatgagaaaaatgattaggaaatgcggaattgacgcgatttatgaagacaaaatactggtcaaaatggtcaattggccgacaatcatttggacttaattatgctcaaagtgccaaaaagtgtttgtggtccatcatcggttcatcagctgtgcactgacaagttggagctgttcgttcagctccatcccggaatggccgtgctgctgctgctgttgtttcattgccatggaaccgcggaggccgagcagtccgtccaccgcggcactgcaaaaggccaaaaatagctttgccgctaattgctacacccacctatcgttggactgaactgccctcagcaatccgttgaaggagttcatttggtgttgctgctgcgcgtgtgccattggcgaagtgttatccccggcacaacactggtccatgttcgtctgctgctgatgcatttgctgctgttgcgatcgttgaaaatggcgcgtgccgttgccgccgacccctccggcgacgcttggcctccccaaacccaacggtcgggtgggcgaagaggactgaaaaggacgaaaactcgaaaggcaagcaaatgccaactgatcgatcactcatttatcagttctattattagtaaatgtttaaaaatgaaccatcgcattggaattcttgtcgaattaataattttttataaatgccaatttcaatttataaatttgattgattaaaaaaagcccccttagccaccagcttccccccatgactacgccttggctgcttttgccgttccccgctttttctctgcgcttcgacctgttgctgttgttgctgccgccgctgttcgtccgccgttagttgtgcagcggccgcttgtgccatctcctgctgttgctgctgcggttgtttcagtgccaaatgcgtcgtccgctccctcgccgtgccgcacagcgccgcgtcgccgtatccgccggccgcgcccactaagccgcccaaaacggcggcactcatcgccatgctgcccatggaatgcctttccctgttcatatgcgttgcctcgtgccccaattgctgagaccgttgccgctaaaatgacattttaacgggatttgggtgggataaaggcgattaattggcggaaggaatgcgtgtcaaatggcactcacaaattgacgcccacaatattggcacgtgaacggcttaaggccggtgtgaattcgctcgtgctggtccaaatggctctgcaacaacaattaatgaaatgggacggattgcgttttttgaccttttgcgtaaatcgtttggggcaatagcgacaatggtaagggcgatcattgatgtgaatttctaaaagaatacgacttttgcggttgaaaaatgtgcaaagcgattaaggaacacccaaaaatgaattccgccgaaaattaaaaaaaattaataaaataaaatttgaatacgcaatatcaaatgccgtttcccccccccccccccaaatttgactacgagtcgagcacaaatgaaaaagctgatcaatttgtataattgatctgttccccaatgggcaaatgtgatcaaactctgatcacgtagga

SEQ ID NO: 5454 - DNA, 642 bp, Heterodera glycines
atcataagtagggatgggatttttagtgataaaaaataccaaaataattaactaaatagtgaccaaaaaatgccaaaatagtggcaaaaatagtggcgaaaaagttccaaatttaggggtgtaattttttaaatagctatttttaatttgaaaataatttaaaattaaggaaaaagattttattcactgattgcagttacaaaatattttcgtagcaaatattgaacaggaaaaaaaaatttgggggaagaatttttgcgaaatttttccaattcttaggggtgtatttttgaaaatttttaggtcgattcttaggggtgtatttttgaaaattttttaggtcgattcttagaggtttatttttcgtttttattacaattttgggaagtttttcaaaaatgccaaaatagtggcaaaaataatgacgaaacgccaaaatagtggcaaaaaattattttagtggccaacttccgaaatagttttttttagtggcaaagctccaaaatagtgattcctagtgatgaatagtggcactaaaaatgaaaaattttcgaaaaagaatgtgtttttcgtgcatttctcgtcgagttaaagccgcagaaaaaatagttaaaaaactaagaatcccatccctaatcataa

SEQ ID NO: 5455 - DNA, 5626 bp, Heterodera glycines
  misc_feature (61)..(61): n is a, c, g, or t
atggtggcgcatcatcgagtgggtcttttaattattttagcaaatgtcgccttttttcccncgctttaaaaattcccattaaaaatgcgcttaatttgtatccctttcaaaagttgtgccatcgcaactttcgccttggcatccgatttcctcttctttgtccgtccaacaaccgcaccaatgttcgtgccgcatttgtccaattggtattcccttcgatgacaacaaaagcggcggtgacgacgacaacggaaaagtcaaaggaaaatgggacaaaaaacactgtccaaacgacgattatcgaaggcgaaaatgaaacaacggcaactgcgagagcgacgacggcattttccacaacaatggcacaagctatgaagataattgggggaatgaaaagcacagaaaacgcagcggcgatgagtcagcggacgactgcgcattatgcgctgcccacaccaccgccgtacagccccgagcagaacatcgccacgggtatgtagagcaacacttttgctacaaagagtgctattgggaacaatgccattcgggggtggggagaggacatttcttaataaaaaaatggacttttcgggtcttccccaccccaatattgcactttctgatcaaaggctcaactttgactgattagctcaatgatataggcgcaaatgtcatgtaaacgtgcaaaacaatggtcattttcagcgggtgagctgattgtgcggctgaatccgtgcccgcatggtcagccgttggtcaacgaattccgcaatccgatcacttgcaatttcgtggttcagccgaatggggcatgcccttcggactattggtgccatactggcgagtcaattaataaaagcacttagaataattgcccaaataattgcctaattaaaggcgcctcttatgagacgaccacctgctgtcccatcggccaattgagtttgtgcaattcacaatttgttgtataaaaatgccaaatttttcagaggaccgttgtcagttgccgcgtgccaatggcgaggggggttcgctgattccgcggtggtatttcgacagcgggtgagttcattttgagggctaaatctgaatatttaaattcacaatttaattatttttatttgttttattctttcattttgacagtgatcgcaaatgcaaaaggtttctttacacgggaatgcgcggaaatgccaacaattttgtgaccgtaatggaatgcatggagagctgtgaaattggtgagagaagcaacagaaaatcttttaaatgtttaaggcttcttcttttagctgctaatgctgcggttgtgcgaaatccctgcgccggtggtcctccggcgcgtgacctcaacggggaacagtttctatgcggctcttccgattcgcggtgccctgcggggtattactgccatttgggcaacaatccgttgaccaatgtgtgctgtgagctatcatcggcaggtagtatttaacaataatatttatttttttactcctctctctctctctgtgcctcccacttctcctctgttctctcttccctcggttccttccccctctctctcttttcctctctctttcttttctctcggttccccctcgcccctttgctctttctcttcccttcgcccctccatcccctctgatctctctctctctctctctctcttttccatgttccctccctctttctaagcttccgatcggtgccatttggcacttcgtccgggcgaaggttcggctcatcttcggcgcttttacttcaacactttgacccgtcgctgtgttcagttcgtttacagaggcgcaaaaggcaacgaaaatcaattcgcttctttggtcgaatgtcgcaaggaatgcgaaagtgaaacgatcagattttgctaacaaatgagcaattaatttattgagtttttgtttttgccaggacctcccaatccttgtccgacttcgtttgattttgcaatgcgaaaggaatgccgaagtgacagcgacggatgtgacaagggcgagtggtgccatttggggtcgagccgggagacgaccgcgtgctgccccgggggtaaaaggaccgaccgaggcaaaaccgattaactaattaattgaccaattagccgccgacgacccgtgcaaattgccacttgaccttggccagggattggaaaatttgacgcgatggtcatccaaatagctcggtttatttaactgttattttcaggtatgccattcccgcggaggattcgtgccaacgcgagtgccgtccctttcagtacaaaggtgggccaatgagaaaatgcgtgccaaagttggcacaatctgttcgacatttcagggatgaaaggcaatcagaataattttcggacaaaggcgagctgtgaagcgaattgcaaaggtgcgtttggggttggcattggaacggaacccatttttaaattagtttttaaccattttttaacttttctatgctttccctccccctcccccctttagccgactgtcccctcaccctcaacccgtgcgctgacgaggagccgttgttggatcccgaggggcgaccgcagcggtgcaatgggacgggggagcagtgcccggcggactattggtgccatgtcggagcgaacgcggagaccaccgtttgctgcagcggaggtgggaaaagctcgaaagcacgagaaaacaatggttgttcatttgtgcagccactcgcgtgtgcgcacttccgctggccgaaggcgtcggccacgctttgctgtcgcggtggtatttcagcgccaaagacggaaattgccaccgctttatttacaagggcatcggtggcaatcaggtgatggtgattagaagggggacgacacaatttggcatttgataaatcccttacggggataactgatagcttaaccctccatgcgcataatattctacccctctgtagaacaactacgtggactacgagcagtgcatgaacgcgtgtcccgatggcactttgtcttccgtctcttaccctcccccctcaacgtcccctcttccatcgccgcgtccttcgtcgtcccttcagccttcgtctcttctctcactctctccgtctccccctccgccgtcggtcaatccctgcggcattggcactccgttaacagacagcgaaggacaaaagccgcgcgaatgttctcctaatagccgttgtcccatttcacacttttgccatatcggtggcgaccctttggcattgccaaatgtttgctgtccgaaaagtgaggcccaaaaatactaaataattaaagtgatcagcagaccaaaatttgggtgggaaattgatagatttcaaaaataatccgttcacaaatcattgtttgggcgacgagctcaagacttactgatgatattatgatatccatgttttaaataatcagcagatggcgacccgtgtgaacagcctttggctgaaggcattggccaattcaaattgacgcgtttccatttcgacgcttcttcgaggcgatgccgcgctttcgtttaccgtggcctccggggaaatgccaacaattttctgttagcggaagactgtgaattggtgtgccaagctgagccaagtgggtgtatgccattgctatatattttcacaaaatgccaatgcttttcagcgatgccgtcgttccgtgtgaatccgtgcccacggggaattccgttgacggacgaccaaaatgagccattagtttgcggcaacagtttggccgcgccggacctcgcacagtttggtcccctgacagccgcgcatcagaatcaattggagacggggtgcccaaggtggaggagggatcagatttgagaccgatggtcccgagggaagcgggtttatggcataattggtggacttttgccgatgggaacctaatcacggccaattaacagtgactaattgctttttgagtggtttctggtgccatgttggctcttctccggacacgaccaactgctgccctcagcttgcggatggtaataattaaggcgacgtcttaccatttttttcattcgtgtcattttccccgaaaggtggcaaaagaccgtgcgatcttccgttggaatacggtataccgatggaaatgggttacggtggccaatcacttctcaaattctttccttttgccttaggcactggcgaacagaaattggacaggtggtacttcgacgtcgattcgcaaatgtgtcggcatttccgctactccggtgggtttttcgcttttttggtcatttccttcatttttctttcaccaaaggaatcaaaggcaatgcgaataatttcgtgtcgcgcgaccattgccagcagaagtgcccttccgacccggtcaatttcggcactgacagcgaccatcagcagcagcagagacagcgcacttcgccgccgccctttgcggtcggtcgctcgcggttttcgtcctcctctcctctcccctccttctcctcctttccatcaacctcaagtccgactccaacaacaaactcattgtcagcagttgtgccacttcttccaaatccgtgcctttttggcgatttgttgcgggacgaagacggaaatgtgctaaaatgtaagcaaaacgaagacaagggatgtccagaggacactcacttttgccacgtcggccaccgcctcactcaaagcggctgctgtccccggacaacgacaacaacaggtgaaacaatgtgcaaaacggcacacattaaatgctctttcgtctataattttggtcagacccgtgtttgttgcccgtcagtcgcggcattggcacagtcgcgcacattcggtggcatttcaacgccaacacaaaacactgtgaggcgtttgactacgcgggacaaaagggcaacgagaacaattttatgacgaaaagacaatgcgaggaacaatgcgaccagcagaaaaagccgcagaaaaagaaaagtggggaaattaaatggaaaaaacactcaatgtttttctttagttaatttttgcccgcacggagagccgaaatgggagagaaaggcatggggacatgggcagaaaaagccgcaaaagtgtgggccaaacaacgaatgccccgagggattcgtgtgccatttgaacagtgacattggcatggcattgtgttgtgaggtgattttgatgatggagaatgcgtcggcacatcctcttttcagaacccggcacatttttgtctgcagtcgcgcgagcgcggcccctgcggcgcgagggaattgcgctacgggtacaatccgctgacggacacatgcgtacagtttcactacggcggctgcggggggacgctgaacaatttcgaaagcatcgatcggtgcagggaaatttgttgtcggcaataccaaagaaggaattgaaagggaaacgaactcaattcaaaggacacattttacacattgcttttggggaagtgagagagaaacgctcggattcctcggggactttttcatttctcgacgaatttcgcatatctccgaaatgtacatttatttattttttccaaattgcttattacctactattgcaggttcatcatgaaataaaaattggcaaagtgaatggataaaattgtgaaagatgtaagaaaacatgcaaaaagaaatgtatgtggtaa

SEQ ID NO: 5456 - DNA, 2084 bp, Heterodera glycines
  misc_feature (70)..(70): n is a, c, g, or t
  misc_feature (79)..(79): n is a, c, g, or t
  misc_feature (108)..(108): n is a, c, g, or t
acagtgactattgcttttgagtgtttctggtgccatgtggctcttctccggacacgaccaactgctgccntcagctgcnggatggtaataattaaggcgacgtcttanccatttttttcattcgtgtcattttccccgaaaggtggcaaaagaccgtgcgatcttccgttggaatacggtataccgatggaaatgggttacggtggccaatcacttctcaaattctttccttttgccttaggcactggcgaacagaaattggacaggtggtacttcgacgtcgattcgcaaatgtgtcggcatttccgctactccggtgggtttttcgcttttttggtcatttcctttatttttctttcatcaaaggaatcaaaggcaatgcgaataatttcgtgtcgcgcgaccattgccagcagaagtgcccttccgacccggtcaatttcggcactgacagcgaccatcagcagcagcagagacagcgcacttcgccgccgccctttgcggtcggtcgctcgcggttttcgtcctcctctcctctcccctccttctcctttccatcaacctcaagtccgactccaacaacaacaaactcattgtcagcagttgtgccacttcttccaaatccgtgcctttttggcgatttgttgcgggacgaagacggaaatgtgctaaaatgtgagcaaaacgaagacaagggatgtccagaggacactcacttttgccacgtcggccaccgcctcactcagagcggctgctgtccccggacaacgacaacaacaggtgaaacaatgtgcaaaacggcacacattaaatgctctttcgtctataattttggtcagacccgtgtttgttgcccgtcagtcgcggcattggcacagtcgcgcacattcggtggcatttcaatgccaacacaaaacactgtgaggcgtttgactacgcgggacaaaagggcaacgagaacaattttatgacgaaaagacaatgcgaggaacaatgcgaccaacagaaaaagccgcagaaaaagaaaagtggggaaattaaatggaaaaacactcaatgtttttctttagttaatttttgcccgcacggagagccgaaatgggagagaaaagcatggggacatgggcggaaaaagccgcaaaagtgtgggccaaacaacgaatgccccgagggattcgtgtgccatttgaacagtgacattggcatggcattgtgttgtgaggtgattttgatgatggagaatgcgtcggcacatcctcttttcagaacccggcacatttttgtctgcagtcgcgcgagcgcggcccctgcggcgcgagggaattgcgctacgggtacaatccgctgacggacacatgcgtacagtttcactacggcggctgcggggggacgctgaacaatttcgaaagcatcgatcggtgcagggaaatttgttgtcggcaataccaaagaaggaattgaaagggaaacgaactcaattcaaaggacacattttacacattgcttttggggaagtgagagagaaacgctcggattcctcggggactttttcattctcggcgaattttgcatatctccgaaatgtacatttatttattttttccaaattgcttattacctactattgcatgttcatcatgaaataaaaattggcaaagtgaatggataaaattgtgaagtatgtaagaaaacattgcaaaaataaatgtatgtggtaacatcatcagaaagggagaaaggacgacaataaaaaaccctttctaccaatgtccgaacaaaatgtcctttcgctttgcgtagccccgattccgttggacggcctcctcataatggcgaatggacaacgctttcgacgtgcgatcgtccgttcgtttttccatagttcgatggttctcttcgtcgcggcaaaacaccgcactctccgtaataatcgcctgaaattgtaagttttttcggagaaacctgttaaaagttcactcaattcttgaaaaactttttcgccaaaatcgaaaaagcactggcaaagatgggaaaattttacgaaattgaaaaaaaaaaaagaaaattttgtgccaaagactcaa

SEQ ID NO: 5457 - DNA, 1378 bp, Heterodera glycines
atgatcaatgagtgatcaggaaagaaacaaggttgctcttaattgtctgtggggtgataatagtgtcattaattgttacggaattggtgatcaaattgtgcgttaattattcgccagaggggtaaaaatgttaccggaaaataccgattttgtgatctgaagagaattgtcggagaaaaatatttttcttatcagaacactgctctaatgttatgataatcaccttgaaaatcagaatgttatcagatcagcgtcgagttgatggtaaaattgagttgggaaatagatcaggaatttggctgagcatttgatcaattagcgattgaaaatattattaacattgcatgtgacatgtttaatgataattttgattatcgtaattaggcaaagccaaatcatccattttttgcagatcatttaccaatcaaacaatgtccgctatgttctgctaaacttgatcagccatatgagcaagagttggagaagcatattgcagaggtaattttggcacttcaatgcatttattacttattaattgcctttaaagacacacaataattaattaatgaattaattacttagtttaataattgcttttaaagacattttcattaattaatttaataaaatgttgtaatttaaacccatcaattaatttgctttttgtttaaaggaacacaaaattcctgccaacattgtccaacgactgatcaaaacggaaattgatgaccaacacaatcaagcaataatagatcaagaagaacatcaacaacaacaaaagtcgccaagtgtcggccatccaaacaggtaattaatatgtatatattattattaattagcacaaagccaatatataattttaaaaaaaaacttgttaattggctaactcaatcattcattttccttcagctttttgtcactctccatttgatcaaaaaatttctttatccaaacgcttaatctgatcagatcaataatgatcgatcgataatttaaaatatttcaatccgtctttttttatttgactactggtcagaatttcgagctttgattttatgtctttatcgttttttcatcggatacagtgactaattagttccctaccgtatgccttttctaattgtaatcagtttgcttaaacccattcttcttttcccaccaaaattttgatcaaattcctccactttccacactaattagcataaactatttattgatccggcggatgtcgtcgttgttgttgctgttgtttgctgttgatcaggccactccgaacactttgctcacaccaaatttgtccctctcccccccccccccccactatttcccaaggacacattttgtctcccctcccaccccaaatttctcccactggccc

SEQ ID NO: 5458 - DNA, 6434 bp, Heterodera glycines
cgacaccggcagaatggctgagatggagcaggcgagtttggagtggcgtgggagggggtaattttcccagaaatcatttgaattttaaacattttagaggctggaagagcaaaaagaaaacgacaattttttggagcattcggatggtgaaaatgaagatgacgctgtcactgactctcctcagtgatcaaatcatgttctctttgctaacatccatcaaacactctcagaatagtatcacttcatcatcatctatataattgttgatagcaacgtgtagtattgtcgacgtctacacaattccgcgccatcgcgcggggcctctctctgcggttgtccccctcccacccctcacccccccccccctgatgccctgacaaaaacagaggaattggcccaaaattattttgttggtagggcaccattttggggtgggggggggaagggtgtacgaaaatcacattaatattaatgagagagggaggggagggagagggaattatgtgggatccatccgaatcatcatcatcatcatcattgggacatggccggcagcaggggacacaacaaattattatttgtgtattatttttggccaggggatttggtgtaccgtggcgctgtcagcatttagtggacagaggggggattaaaagattaaaactgtaacaattactataactttaattaaaattaattaatatatgctctaattataaaattgactttcggtttgtgttaagttttttgagcatacaaatagtctctctctctttctctctctctctctctttttctctctcttctctcggtatctctctctctcccttttcctctatcactcacttcctttcattctctctctctctcttcctctctctctctctctagtcctctctctatcttctgtctctctttctctctttatctccgctctctttctctctttaattataatgaataatttactctctcctgttaattacgtacgactcgtagagccgcatcacttatgccgttaatgaggtgttgttgcccaacagcgacggctagcaacaagcattatcgttgagcgcgccgcttaattatcttaatgaattgctgcgccgtcagctgtcattaaggaaaggcactttcaatgggttttttaaatggccacatttggcttttcatgcttgagaaatgcaaaatgagtttgtctcttgcatcataaaattgaaaatttcaattttaaaattatatttatagcttaaagtattagcatgaccattctttagaacttttattaattttttcgtacacccaaaatttaattttgtagcaaatcaaatcaattgaacatcagtttattaaaaaatttggtgcacaaattttttattccaaatatgaattcaatgattttcatacctattttttaaattttttaaagagtaggaggcgtcgccgtgaaaaattggaaaatttggcactaattctttaagcgatttttgcaccaataattgctattcattatgaatttttgatcaaaattctaaagaattgagtgtgaaatagcaaacccttggcaaaaaaaatcggactcatgcaaaaaatacagcaaaaacccgaaactaaccccaaaaacctaacaaatgccggattctccaggcaacatccatggaatcaatacatatttgaaccctggtggatttaagccggttttaatctttaaattgccgtataaaatttgcaattatttttgcaaattaaaaaaagccataaagcattcattattttctgctctttacatggccaatttactcttccttttttgggggcggtgggccgaaaaaatgaatcagcgcagcgccaagcacaaatacacacacacacaagcccatatataaatttcgcaccgttcattcaattcattaattctctctgaatcatccattccccccccccccccccccattaatgactttttcggggggggggcgcttaaatgagcactttttaaatcactaatttgccaaattttcctctttaaaatagtgtgttcgctctctcttttctgtgtcgatggattaattaattagtcttaattaattactcaaacgagcactttaaatcactcatttagccattttcctctttaaaatattttttccgtgttgattaattatttaattaattagagttccgagagcaatgaaaatatattgaaatttgggggaattaaaatttactagggagaggatttgttgctttaaatcatttttctttgcatctattttggcatttacccccttccagcactatgtaatgttgacatttttgccctaaaattccagggttttcggcactttacctcatcctggcatttaaaattttttgtcctttgttctccttaaattttgattattttcgatctttcgttctgtctggaattcaagcttttggcacagtcattgctttaaatttcacaaattctggcatttcccccacaaatgtgtgcctgaaaatcttccgcaatttggaattattatcccatacattttcataaattttataaattaattttcccgcaaaagttttaaattttctatattttagcccctccggtgacgacggcatgctgaacaacatcatcgcagccctggccaataatcccacgactccgccaagcagttcgacagcaccggcaacggcggtagatgatccaacagcatcatcatcatccaacaattttggtgcccaactgttgccaatctttccgcaccaatgccggcactgttccatcgcttttcgtaccgcggaacatctgcaggtggtcgtcgctgtccaaaaacactcttttgagtcccggactgaatttggaatgtttgcgcacttttatcttgtccaatcaatctcgaactcagtcccgaattaaatgctggatttacccgcccccaaataaaaagtttaaaaatttttcagaaaaataggcaaatttcaaaaaaattttttgaaattttcttaacaattgcatcgaaaacgagttcctgctttttctccccggcgctgaaattttgtaaatatcactgtaaaataaaactttggaatttttggctcaaatagcacaaaaaaggtcttcagattccactttccgaaatctttttttatgtatacgggccctgtggtcccgagattaacctcgtaccatctctaacggctcttaacattatcgcttcgattctccgtcccctggggtgtcaattatccgcctaaagccaaatttctgcaattgacactactagccgtgatgtagggtcgtaggcctccggagatttatcacagtgccaaaactgatcaattttttccaggcccacgcattggcccattcgccggccaaatttcgcctttggcaccgctgcgatgcgcctccatgcgccaccggcggcacagattccgacgcggctggcacaagtgccgacaacatcgcggaccaacaaacgacgacggcatcggcacttttccccacaaaacgggccctggagcggcatcagcggacaacggcacacgccggaggcgacgacggcaccgccggcggtggcggccatttttgcgacatttgcgcggacgggcaacgctttgcgtccgacaccgcattgatggcacacttcaacacggagcagcacttggtgaaggcacgcggtggcagtggcggcggcgcacaaaacggggtgggtatactataataattgggcgatacgtgccattcatatattgtaaaaagaacttgatgttacgagacagaggggttggaatgctttaataatgcaatggcatttttatttggcatagttcattataatattttagcaagattagcaccaagaaaactaaatttctatgcgatgcttactgtaattttgattatacggtaatctcacaaaacttgctccacaagaagatatatgtgtatttttggatgggactaaaatttggtgaagtttaattgtgcctttgtaatctcgttttccaattccatttccaattcgggataaaaccagggaactaaagatagccaaaaatcaaaaaacgggcaaaattttctatggcatttttttatctcgaatctcggtttgatggctttcttatcaagatcactacgggtgcactaatccccccgccgacaataaatttgagttttttctttttctaaatttcttaagtagaagttttttcttttttttaattttcaaaattcaactttttgagaaaagaattcatttttatgaatttctccgagggggtggggaaactagctgatctcagatcacttcaatcagctttcagtctcgactctcgagatttgtgctcgagcaaaaggtcccattaacgatttcccagtccaattaatgccgtaaattttttcaaaaaaaaaaatttttttttttgaaatttaagccttccaacgctcccggctcagtcccctcctgctcatccgcctcatccgcttctccatgctcatcatcgttcacttccaaagcggtgaagaggccatcctcctcctcgtcctcatccggcaaacatttgccatacacgtgcaatgtgtgtgcccaatcgtttggccaacccggcacattggacacccatttgaggtgggcggcagtggagattaattaaaatttcatagatttttaatttttgtggactataaaaattttaaaaaaacattggcttaatagacttggactcagtcttaaaaaatattttggtttttttttaatttaaaatttttaaatatttttattatagaaaaagagtgcgaaaaggtgactaccaaactgttaaaaaaagttttttattgctttttgtatggtcgaaagttcgtattttaaaaattgcccaaaatgccaaaaaaaaaattgacataatatgaaaaaaaatgtgccagatccctgtaagaatccaaaaatatacaaaaagcttggatttttttaaatttcttaacagctgtactgaaattgataaaaaatgtgttacaaaaattgaaagtgaacattaagtggcacgatctaaaatgccaaaaattcaaaaatttgaaattttgcctaaaccaaaaaatgccaccatttttccccttggtaaggtcaatggcacatgcccaacgcatgtgccggctggctgaccttgtgcagagcggcgatgtggagccaacaaagccggtttttgagcagccgggccaccatccgccgcagcgaaccatcggcgaagtggcggccgagcgcaaaacgaaggtgggccagtgaaattttacaagaaaatttcaacaaaaaatttttgtaaaaatttgtttcaccgatattttggaaaattcttttgaaaaaaaccataatttttgaaaaaattgattggaaaattttcgagaatttttttctttgcaattttctgctataaaaaaaatcaatgaatttaaaaaccaattttttttttttctgttttgtgactatcacttaaagcattcaaaaaaaaaaagttgcaataaattttcttttaattttttttaggaaattttgagtgaatcccaaaaattattatttctttttgtgagtgtttaattaaggaagagattactacatatctatttcggcatttcaattgggctttatttactattattagaatttttttgtttttgaatttgaatttcattttttcgcgcactcatccgtgccgcaaggcttaattcatcattcataatttcataatcattcatcatcatcgtccatcatcattattatccctaattcccccgtttccattctcagtcaattcggggggatttgggcgggggccgggggattgatgattatgatttatgatgaatgaatggctttttccggcggggatgaacacaatgaatgaatggatgcgattgggggacgattaatgggaggaccgaccaatttgggcgggaaaataatgcccgcggcgatggcggatgatttgaggaaaatggagagaaaaaaaacctgccagcaggtgatggagatcggccagctgctggggctgacttattgtgcccattcattgtatgtatgctggcggcgcggaattccggctggcagaaattgccggcggcggcgcaaaattttgggggcggcacttttccgttttgccgcccaccactgaattttgccattaaaatttctgttttttcgggcataatgccaaaaattgggcaaaaaaaaacgaatgcttttgtgattatgccgaatggaaaattcgactcttagcagaattgatcggtcactttttggttttcgattacaattgtgtgtgcgttttgaccccaccccgttttcagtcccatcccatttcagctccgtcccatacagtccctccccgttttttgttcagttttctaacctatacgcttcgcacgcacacacacactttaccta

SEQ ID NO: 5459 - DNA, 1424 bp, Heterodera glycines
ggagtggggcgggggtcgggagcaatgagtatgtattattattattatcctaataataataatatacacttatgtagatgaaacggagccgcaaatggtgggtgctgcacgcctcgcgccggagggcgaaatccatttcccccccccccttcccctgaggggagtaaattgtgtttttattgttcctcgtccccgcggggggcatgggcacccgccacgccccagaaatgtgatgagtgtgaaaggcaaataatgatgaggggaggggggcagggggtaaataaataaataaataattgagagaaggttggagaggtgagtttgggggaggggagaaattggaaattgagaaattcgaggggctccgggggccgggcaattttctcattcaaaattcaaaattcatcccccaagggctcatctcatttcatccatttcccactccccgcctccctattattctcccaccgtggcgccgccaaattgtgtgctgcacaaacattgtgctgctccatccctgcccccaggggcaacatttttgttaatgttgccatttgtctaaattttcgtttcgttcgcttcctaccgtttcttgccccagccatgtgatgtgccatatggtctctcctctgaggcgccattctgtgccaaaaaaaattttttttttgcctattcgtaggtatgtttgaaatttctcggagtttgcatcttcattctagggaagtctcggtttttttttgtagggtctcgagtctcagagtcaattctccgttctcaagcctcgggaaacttttggtctcgaacatccactaattaaccgtttcgggtagttctgctgctttataatcaacaaaatgttttgtttattgcttttcctgcccacccccccccccgcccctctctagagtcttggaattctttggctctgaaaaattcttccaaatctctccaaaggatgcttcctatccttcggcttcttcgattgtcttgagttttcccaggctctctttttataatttcagaatgccaataattggcttaatttgccttttcggcatttttcagtagcgagccattcaaaaattttgaaagtcctccgagaagcaaaagtcaaacacaactctcgacttgcctttcttgacaaatttgggatcacttgtcaccggcggtggagtaatttcattatcgcgtcggcgctgctcaacaaccacttaactcaccctcaaaattgccgtcaaaatctcactcattctcctttctctgttacccattgtttacgtgtccccccaaattgacacctccggggtcgtcggggcaactcacttccccccgggggcgacagcggcgatttgcggcgccttacaattgttccccgccgcccacccccgcgggggaagtcggtttcatttcgcacccctttctcc

SEQ ID NO: 5460 - DNA, 4960 bp, Heterodera glycines
ctacgccatagcacacgcacaaccacatgaatttgcatttaacttgtatttgcacctgcagttgcaaagaaacacacttgcacctgtacctggacacacccacacatacctgcctagacccaaaacgcgtgcacatacacttttcacctaatcttgtgtctgccctgcaccgaaaacacgcacacatttgcacttaacaaccacctgcacctacactttcaggcacatcacatgcactttgcaccaaaattttaacaacaccagacactcacgcatgcacacacacacacgcacgcacacacatacccacgtacgcacggccgcatgcacctacgcacatacacgcacacacatgcacatctaaatgtaaatgcgcatacacacatgcacgtgcacgcataagcacattaacactatcactcatacacaaacacatgctcactcacaagccccatcacaacacctacaaatcattaagatataggggccgcttgttattttgatcattcattcgcaatctgatcatcttctgatcattctgatcactcattctcactctgatcatttcacactaactagtgatcacttactttttctctttgatcatttattagttcccaatcactatctgacctctaactcttactctgatcattttctgatctacttactctctgataacactcactcacaccgatctctctgtgtctctctttgatcacacactcattcctaatcactcactcgtcccttatcacacgatcactcacaccacttacttgatcatttcataaacaccacttccaagcatccgtagacatctactcattttagagcattcttagcaatgatttttcaccattttcactgcttgatcatgagattaattcctaaactctcatttttaatcaccaatcaacaattaattttctgttttacctccacatttataattaaattattaattaatattttaattatcattttatttattatttttaaatttaaatttatattcatacattcacgaccacttccatcttttaaagtataaccaattacaatgccggttgcaaccgaaccaagtattattggagttagaacaattgccgaaataattgcaatagccgcaagagtccccagataaattccattaaatctaggtgtatttctttagccgtattataattgtcatcaccactcagtaataaagaaagtgtacgataaaaacaatttccatcgccaacaattgaacaaacttttccttttacagcattaaaatatgaacttattaaataattttctgtttaatatttacatgggccatatttatgtggattaattaatttgttttgaccaaaattgaattttggttcaacttaaatgaaatgtttttgtattattacataatattatttttattttatatttaaagcttatatttcattttatcatactaataattctatttatatttattttcttatttattacaataattataatcccatttattacaaaacatttgcattgcgtgaaaattcattgggttaaataaaataggaaaacttttagtaccttaaataaaattttgaaagaatttaaaaagtacttgcttgtttctaaataagtaatttcttcttcatcgtcactgctcttttctcgaacagaaatacttttctgtgattgtgtctgtgaataaattcagaaacaatttgttgtaaataatgtacaaaattactaaccgttctatgtttgataacgtaaggatcgctttttaatataaattatacaacaaatagttttttagtaaaaccttttcatagaagagtgaaaaccttcatcagcatttattcctcttgttctcacaagacgattaaaattccataaaagatatctttccagtgtagatttgcttaggttttgagatgattcattattaattttttgaagtaattcatttattgttcggatttctcttttttcatatttatttaaaagatttttaattatattgtcattgataaaagagtcaaaggaagaagcacggcttacaccagtaatgtaatcgtaaatccgatttttaaaaagaaatttgaataaaataaataatatacaatatacggcttttgatggtccatgcatttccattaatatgaataataaaaaatataaatctagcgaataatttttttttagatgacgtaacatttacataaatccaataattgattacatttaatgtcaatattgtataaaaaatatttatttaaaatgatttattattttatataggttttattttattggcacgattgttttttctaaattaatacggtaacaataagatttgatggttttttatataacgccctttttgagggttttttatataacgcccaattttgatgaaatgtcttacaatttgattgatttgagtgttttttatataacgccctttttgaaggtttttatataacgactcagcaccgggctaacatcttcattggtcttaaattaaaattactttaataatttaccaaaaaagcagataaaataatttagacaaaaataataaaagtttttgaaagttaaaatggataatttgtcatatagtgcaatttttaaaactaatgaaagaccagaaattttcgtaaatataaaaaaagcagataagaaggaatagtaatattttaagttgtaatataaaataaaaaaccaaatttcacattcagagaactaaataacgagtcgataaaaattaaattaattttaccaaaaggcttaaaaaagaaactttagaattaacgtattttaataagtaaaatagatataataaagaagtttacttaaataaagagtagtcttgtaaattgtacaaaatttataatggattttatatatatgtttttttaaataaaaagagccatactatttatttattttttttggtagaatatagttgatatcaaagaatacaaagttttcccattaaattcaatgtaataaaattatatcttttagtaaaaattgttattgttttttttggtataaaataattaaaaaactagaacaaaatgaagataaattttaatcagattatgaacaaaacaaactatctaaacgaggacaatgctagcaccggggtggcaccttttgatccctccccagacaattgcgaaattgctggtcacgtgcaaatttttttgcggcaccggagtggcaccctttgatcccccagacaagtgcaaaatcgttggtcatgtgctcattattttgccggcaccggagtggcacctcttcattcacccctcctacatatttgactcatagatgacctagcgcctatttttatgatatttgatgcgcaaggtgatacattagccatcgctaggtgtctctccgcggtgtattttaggcgcgtctttgatggatcaaaatttctctcggccgagttgctgactgaaaaataaaacgaacttaaattattgcatatattgtttataccaagtctattgatattcttctgacgacttccatgataataaatacttatacaaagtttatctttttatatatttccgcatcccaaacatggatggaaaataggcaataaagcgacaaatattttcaagttttgccatgctatttatctttcgggactcaatttatgacgaaaatatgggctccaattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtaaaaacataactcgaacagtaggtatatttgttgtgcaattttatagtccagccttcgttcgctagggctctcaccgcggtgtattttaggttgtctttgatgtatcaaaatttctctcggccgtgttgttgactgaaaaataaaacgaacttaaattattgcaatattgtttagacgaagtcttttgatattattctgacgacttccatgataataaatacttatacaaagtttatctttttatatatttcctcatcccaaacatggatggaaaataggcaataaatcgacaaatatttaaaagttttgccatgctatttaactttcgggactcaatttatgacgaaaatatgggctccaattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaaaagtaggtatatttgttgtgcaattttatagtccagccttcgctagggctctcaccgcggtgtattttaggtgtgtctttgatgtatcaaaatttctctcggccgtgttgttgactgaaaaataaaacgaacttaaattattgcaatattgtttatacgaagtcttttgctattattctgacgacttccatgataataaacacttatacaaagtttatctttttatatatttcctcatcccaagcgtggatggaaaataggcaataaatcgacaaatattttcaatttttgccatgctatttatctttcgggactcaatttatgacgaaaatatgggctccgattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaac

SEQ ID NO: 5461 - DNA, 1537 bp, Heterodera glycines
  misc_feature (57)..(57): n is a, c, g, or t
atgaagataaattttaatcagattatgaacaaaacaaaccatttaaacgaggacaangctagcaccgggggggcacctttcctttcctccccagacaattgcgaaattgctggtcacgtgcaaatttttttgcggcaccggagtggcaccctttgatcccccagacaagtgcaaaatcgctggtcatgtgctcatttttttgccggcaccggtgtggcaccttttcattcacccctcctagaaatttgcaaaattgctggtcacgtgactttttttatgccagcagatgcgcacggcgccccattcccgccccccaactgctgcttgagcatccccacacacccccacaacacaactgacggtcgcgacgacggggcacgctcgcctctccgatgtgtctacccgtctaccaattaactattttctgatcagcttaactaactatagaagggctaaatggagacaaaagaaaaattcaaaacaaatggtaaatactgattacaaaattcttaggcaaatattaaatcaaagaggtgccaccggtgctgacaaaaaaaggcacgtgaccagcaatttagcaattttctagtcggggtgaatgaaaaggtccaccacagtaccggcaaaaaataatgagcacatgaacagcgatttctcaattgtctgggggatcaaagggtgccactatgatgccggcataaaaaaatgcgcacttgaccagcaatttggcaactttttttgtggggagagaacaaagaaggagtgccatacgctaccggcataaaaaagacacgtgaccataaatttgcaattttttgcagagaattggttccaataaatttagaattggatgagcacctaattggatggggcgcctatgattgtgtgtgctcctcttcaatgctattttttgtgccatttttttacccgcacgggcgcatggacttctgctgcacgccctcagccccgcctttccttccctcctcccgaggtgagtaaaactcatttgtttaatcatttgagttcaacccacccatttgcaaaaatattccgattatcatttttaattttgctttatatatttctgtttaccaaaactatttctattttttattcagctaatatgttcgattttaccaaaaatacggagttttattttttcggaccagactccatttaatgggtaagtcccaaacgaccccaaatttttagctaatttaagtgagtcattttttcgaaattccctcaaattttcaattaatacacaaaaatgggctgtaagaacaacgaatattagcaaaggtaaataaatggcattttataatttaaaatggatattgataactaacttaaaaataataaaagattatttgtgaaattatgtaaccattgaatatttttgtttaacaaatacatgattgtatagattcaatttggaaaagattgttgaagataataagaaaaaaatatattatatatcttatagaaaaaataaaaaatttgaataaaaaaaatgacctctaagaggatccccccg

SEQ ID NO: 5462 - DNA, 2703 bp, Heterodera glycines
aaataatataaacaccaaattgtttaaaaaattatttatcagctattcgtcgatttaactacactaacccaatgtaccacaagtattattaaaatgataaaaataaaaccaataaaatataaataaaatattaaaaaaagaaaagagagaatcttaatttaactagagcgaagctaccggaaattgtaactcttatctttacaatagaaataatattaaaaaacgtctgttggtaaagcagtttaaacggtttttcgtaatttttttataattttcacaacagtcaaagctggaagaccccccaaccccgcaagtcgaatggctcggattgagatcttaagcaattttaaaaaaggttaaatcggacataaaatggtttccttttaattaaaatgataaaatataatcaacataaagtcttaatattatttttaatatttctttttatataataaattttgttaaattaaaacaaatcatttgaacaataaaaatttaatatatcgagagcaaaattaatacacattatttctaataatatttatcaaagataacaaataaacattaaaaacattcatttttatattttataaagaaaaagtttattattaattaaagaattaataaatagcgattaaaattaaatcaagaattgatttatgtgtgttgttcaaaaatatatgagcactctaatatgaaatctagacaaaaacaaagcgaccaaataaaataaatagtgaaaaaaagcttttatttttgatttttataataaataaataaatttatgtaaaaaaaattcctaattaaacgattaaagtgtgttgagataaaaaataagacaaattaaaataaggattatataaaactatttactttaccaacaaaaaataaaactaatttacaaatgatttaacattctgtgattttttaccagaaatccattgcacaacatatcaatcttgtacgcgtctcaacttggaaaaaatttaactgagttaattattaaaacaaatgtgcttttaaaattctgataattctgttaaacaccagaatagttatgaaaattctggtaaacgtcagaatggttctgaaaattctggtaagcgtcattgttctgaaaattctggtaaacgtcagaatggttctgtaaattctggtaaacatcagaattgttctgaaaattctggtaaacgtcagaatggttctgtaaattctggtaaacatcagaattgttctgaaaattctggtaaacaccagaatagttctgaaaaattctggtaagcgtcagaatggttctgaaaattctgttaaacaccagaatagttatgaaaattctggtaaacgtcagaatggttctgaaaattctggtaaacaccagaatagttctgaaaaattctggtaagcgtcagaatggttctgtaaattctggtaaacgtaagaattgttctgaaaattctgttaaacaccattatagttctgaaaaattctggtaagcgtcagaatggttctgtaaattctgttaaacaccagaatagttatgaaaattctggtaaacgtcagaatggttctgaaaattctggtaaacaccagaatagttctgaaaaattctggtaagcgtcagaatggttctgtaaatgctggtaaatgtcagaattcttctgaaaattctggtaagcgtcattgttctgaaaattctggtaaacatcagaatgttctgtaaattcttgtaaacatcagaattgttctgaaaattctgttaaacaccagaatagttatgaaaattctggtaaacgtcagaatggttctgaaatttctggtaaacaccagaatagttctgaaaaattctggtaaacgtcagaatggttctgaaaattcaagtaaacaccagaatagttctgaaaaattctggtaagcgtcagaatggttctgtaaattctggtaaatgtcagaattgttctgaaaattctggtaagcgtcattgttctgaaaattctggtaaacgtcagaatggttctgtaaattctggtaaacatctgaattgttctgaaaattctggtaaacgtcagaatgtttttgataattctggtacacacgggaggagggcgggggtgggggtggcgcaaaacgcccttcgtaaaatgcgcggcggggagggggggcgtgggggccaagtggcaggcacaaaaaaggataaattttgatgcgatttgagtaaaattatcatgataaaaaattttgattaaactaaaaaatattatttatttataaattatttttagaccgactaaaaagacaccaataatcgaggaaaaggcactataataggcaccaaaaattgcaaaaaaggcaatcgaaaaggcatgaaaataggcatttaaaattttttaaacgtacatttttaaaaaaagttttaaagtcaaaatcttttattccaacctagtctttaaaaaacgaaaatcatttctcaaaattgcaaatcaaatatatttcgaggatttccggtgttaatttcaaataatgaattttatgatcaaagcattgtttaagatgaccgtttcgacgattatttagcccagagcgaaatttcctataatcttaatgaagcaaattcaattaccaaaatgaaaaatccctaaaaatttaaattacccggccccacaagcgacccgcatgcccttgttcattgagcagtcagtttgccgg

SEQ ID NO: 5463 - DNA, 7357 bp, Heterodera glycines
tttacagcaaaaatttgctcaaaatccggtcatttttcggacaaaatctgttaacaaattgcactgaaattttcaaaattttctctttgtgaaattctttttgaaaaaaccgcgccgtgaaaaaaaagaagttttgaaaagcaaaaaaaggtcgtcttacatggcgaccatttcgcaaaattggccgctgacccccccccccttttttcatgtatgcaatgaacacggaggtaaaaaaaggggagaaagggggggggggggggagagcaatcatccaaagagtccaaaatcaggaaaaccccgtgatttgaccctcaaaatccccgatattttgccatcggtctcacagtttgagtcgctttagcaccgcccgccttggcacctccggcgccctttttagtaggtgattgcattgcaacgccgcctgaaaccattgtgggcgtagacggcgtcgttgaagccgcagcagtagcagcagaatttgctgcagtctgtgatgatgaaactgtgccgctgctgctcactgattgttggcattgagtggtcgtcgtcgatgaggcggaggcgacgcttccgccgttgccattgccgacggtggcgtcccgttccggcacaacggcgtgcttttgggcgcttgagtattgcgtgtccacaagcgcggccaacacctgcaacagcgtggccagcagaagcggcacacgctccaacaacgcatcctcgggctcgcctttctgcacaaaagggggtttctgatggaaaagtgccatccgacacgacttgccttgatcagttcggtgagcgcggagagaagggcacacgcctcgctggacaccactttgatgaagctgccgccgccgaggtcgacaaactcaaaatggggccggaccaattggggagaaaaggcgggcgaatggccaccgctgcgactgctgcctccgctcgtatctgaagattaaaaagtaaaaagatcagaccaataaaaattcaatgtatttatcacttcagcaaaacatagggactgactacggtagtacgcggtaacttatagacaaatatgccaatgacataatattcttaagttaccacaactttattttctagttattttcagttggttcatcaccagctgcttgtggtcttgctccgctgctctccgtcacttcctgtccgatcagtccgctcctcaatttgttgacattcccatgtggtgcggcatcgccggcattggcacgcaacaggtcaatgacgtagtcaattgccaccacaaattgggcatggtcacgtgccatcatcatcctcacctcagacatcatcctgacaataaataacatttttgaggaaggggatggacagtttggcttgttgggtccgcatctgtttgtatgggagtggctgtttgagcagaacatggatggccaagtattggtgatgggcggagaacatgttgaacccgttaagcagttcggtgtacgtctgaatcatggtcgtttgtgctaatgcgagatggtctagcaatttgttgaacagcacttcggcctgaataaattgttaaaatggaatgccaaaaaagccaatgaaatgccaaaagattcggttttccactcccacgcacttccatttgcaaaaggtgaccacgcgcggagatgatgcagctcaacagttgggcagacgcactgctaacgttgctctgacggtcggacaacattttgaacaaggccgagatgtacatttgcacttggttctgcggcaaccaacgttcgacctccttcgagtaagggtaacaagaaaattccatttttattaatttttttaacttttttttgggcttgaaccgcttgaatgacaccgatcatttcaagcggattattttggatatacttttgataatcaatgaaagtgaaataaagatcataaaatgctaaaaatcaaatgtgtttgcctagtttttagggtaagcctattattaaaatcaaaatgggagaattgaaaaaaaagtggatcacttttgccatcgccgagatcactgcccggcatttgttcgaatcgagtcggccttcgttgccggccccgaaatgtgagtccacaaaatcgcccacgtcaaacagcgtggagttgaccaattcggtgtccagcggagaatggccccggtgcaacagactgagtttgaacgccagccaaatggaacgcaaagcgaacagacggacagagccgagcgagtcgcacaggcggggacagagacggcccagaagatgggacaacggggagaactccttggcaacgcccaacgaacagtcggaggcctgcggaattggaaatgagagacggacgaaaaggtcggtcagttaaagaattgttcaatgtccccaaatcgaacattttggtgcaaattcgatgacaaatctcaccaaattctattagtctccgtgcgggtaaatttgtttttattgcacaacaattttcgattccactcacattttccgaataaatgtgcagaatcaacactgtgaaatccacagctcgtgccctttcgtggtccttctcactcccgtaaaatgggtgaatgatctgaaaatttaaaaataaacagcaaaatcaagacagggagtttgaactcgataagtacccaaaaaagcgattgtctttttgaaatgtctgtagagtctcgcgcacccttcccactcactttgagcagtttgacgagcgttggctccacacaagggcgtctctgcaccatgttgccgatggcattccgacattgcattatggtcgcctccattacggtggacgcttcgtcgtcgtcgatctgggggtttggcgaaaattccttttttttatgggtcatctcgttgaatcaaagagaccgtattcaaatgagggactagaaaaagcaaagaaacaaaaaagacagaacccataaagagaaagtacgaccgaatcaccatcaccaataatcaatcacatttcaaccaaatcgccgaaacggggcaaaaccccgggaggcctttcttaatacaacaaaaaatgttcagttggcatgccttgccgtcggcttttccattgccatcgccgttgtcggcgccccttttgcccatttgtcgacggtttgccgctctttgtcgttgctgctgatgctctcctcctgatccccccgacttcgccgatgttggtccatttttaaaagcattggccatggcaattgccttgggccatccctggcattctccgtctgtcggttgaccgttttttgagtggcccaccgagggaaggcgttgcccagcaaaggagtaaaggtggccaacaaaggcaggctgaaaggtccattcgccctgacgaagcggcgtgaaatgcggaaaaccgaaaacgcacaacgcatccaactgaagaggacagacagacagcgtaaaagaaaggaagagaaagcggacgaagcgaagaggggaataatcccatggcaaaaggcaaaataatgacgaataaaacgttaaaaaagggttaggtgtgtccaacgcaatgttaaaggaaaacagaacaaaggaaaggaaacatcaaaacaaaaacaaaaaataaataaaattcagtgccatacattcgcattcgtccgacgaaggacaaaacaccgaccgttttaagcccacttcgctcgcgacagatcgaaaagatgttcaagatgagagagttggccaattcaacaaattcattgtcactgagcggtggctctaacaggctgaaagtgttttgaaaggcttgaaagggtcagattgtgcgagaaaggtcaacctaataaatacaaattagcatcaataattgatcaattaaaaattaatcaataattgatcaattaaaaattaatgtgttagcaattaacactaattaattggtgttacagaaaacgctttctaatgaaccaatcaatagtaacaaatttagcagattttttacattagcgaagcggccgcttttgcacccaaaaggcgaatccaactgttcagctgatccggcgacttctcttcgttcaaataggtcttagaatggctttccacacaataattttgcctttcccactgtgcccactttaacataggtaaggcattcgtagcgaggttcgaatttgtagtcgcgaattcgactcggatggacggacagtgcgatcagattcaacgtctccaagtgcgcctctctgacgatggtttcctgcataaaaggtggcaacattaggcaaaagaagagaaaggcccttggaaattgtcaactcacttttgcatttgccgtgtattggcgcaggaagggcagcaccgtctgctgaaggcggaggaccaatccctcggtggggcagtagaacaccacgtagccgtagctgagcaccaaagtcgcgcgcaaattgagcacctcgacgtcgacagtccgaccaaaggaatagtcctaattggaaaaggcaatattatattgccaaaataaaaaatgatcagcattcagaaaattatttataattaaaataaatgaaataagcactcgaatgtatgaaaaaatgccaccgcccgaggaagagcttccgctgccggcggccccgccgacgccgccagaaatgccttttttggtgtgctcccatttggcgatgttctccaactcggtgagcaccaaatcggcgtggtccaacgaagcggcacagtgacccattgcctacgaaacaaaaactctaaatcatattcaacccaaacttatactatagaaacactcgttaatatggaggataatgaccagcctttgaataaaaacagaaaaaattaacactaaaattatcgccgttcccaaaccgttttacggacatttgaattttcttttttttgataaaatggaagatccgttttagtgcattttctggtccacctgagcacagccgacccgttcaggtgtcagcgcatgttgcgcttggcgaaagagcaactgcaggtgttcggtgatgaactgaggcgagtcgacgcgggccaacgtgcagcccaaacagcgcatcagaaaggctttgtcatgggacggctgaagcgctgcggacgacgcttcctgcagttgttgggcagaggcagtgaacagccccaactgcttggcttgtatggccgccaacgcctcgcgccattcctttaaacaaagcgcattaacccagtgggcaaaatccaagcaatggataatgacaaaaaattaggggcaaaaatcggctgaatgattggacaaacagttaataaataatttgtttttgcctgatcatcgacagcttcgatcagtttgcacaacatttccagcacagctgcttgccaacgctgagcgcggatggagcggaattcggtgtgcgcatattcctccctggcaccgcccgttgctgggggaggcgatttcggtggaaaatctacgacggcaccggcaccaccacagaattcttaggaattggctttgttcgcttctttctccctgttcttaccgtccagcatggccagcaattgggccgacagtttcggcaccactgccgcgtccacaaaattctcgtggaaccagccggccaactcggcgaacagtcgcagtgcttcggcagcgcgtgcgttcagaaaagcgttcaatggggcgccgttcatgcacaccaacagacggcacatcaccggcacggggccgggcagtcgagctgatgggaagaaaaagcgataaaataagtgccgaattagaggaatcgtcgatagattttatgaaaaattgtttaaacagctttacgattttcgccaaaattaaagtccaattcgcggccacattcttttgcacgaacgcataaaatatgcaaacatttgaaaatgtcgccgatgaccggcgcataatgctccaaacaaacaaattccaacagaagtggccaaagcaactgaaaagcaccttccagcattaaacacaaccaaagggggaattgaaagaacattcttaaactcatataaaggggtcgtaaatgtttccgtaattccaatttttgggagtgttccgcgcttacatcatttgccgatttgctggtgttggcaattgtactcagcgcctgtgcgcattgcacttggagctgttgctgcagggattggccttcgccggtggagggcggcggcggcgggacggggcgtttcgtctgacaatgataaaaaaggggggaatcattaaaaatgaaaaacaaatctaatgtaaaaagctaattttgtgagtaaatgtgggatttgttatccccatgattttttaattgagttttccagggtaatgcactcacataagggtcaaagcgtggtgggataaggttgttcagcaggaaatgcatcacttgttgaccgccctctgaaaatggggaaaagatttgtaataataaattcatgagttattgttttacagaatcggacgggggcaagacagaacacaaattcattcccgaattaatatctttataattgaaattttcaaatttttaaagaaaatgtcgggggaggggtataaaaccattcttttttttgcaaaaatgccaaccgtccccttgcacatattcgttgtccgccagcgacacgcaaagttggcaaaggctcattttcacacggaccgttgcgcagtcgtcgaccaaaaagggcttcagtcccatggtgatcagtgctcggttttccttcatttggacatctgaaaaatgggaaaatgcaaaaaaggtaaaatccgaaggaccagcagaattgagcaaatgccgcagcagatttattgcacccaatttcacattttcattcggactttgcattttgtggaggataaaataaatctgaaaaaagggagaaagtttggagaaatgagtggcgacggcacttctttgtcagcggagcggcacgaagacacttgaaaggagcggaacacttcatttcggagtttgatttggagcaaattcgagcacaattggtcttcgtcgatggaaactcctgaacaatttaaatgcccaagtttactgatgatgatgaagtcatttcggtactctgttccgtgacagcacaaacgtgggggaacaacagctcgaacagatcgttcaggtagtggtcaatcggaatggcgtcgtcgggacaacaagcttggagaaagttggcgacaccctgcaatacaaaacagcaatcagtttttaaaatttaatacaaggcaatacttaaaaaacgacaattattgcactgtaattcagttggaaaattatgtctaacaatttacaattagtggccgttggtaaactttccgaaaacgagttgacaatgccaaaaatcgaatccgaaaaacaaaagtacgatttgccaagatttaatgcacctttacaatggccaattgttcttca

SEQ ID NO: 5464 - DNA, 2485 bp, Heterodera glycines
cgataggcgtcgccggacatttttttgtaatttcgttctgatttgttaacagattagcaccaaaaaatgccaattttgcagttaaaagccaagagacgactttttttttcgcttttaaaaacacttttttttgcggcgtgcttcttccaaaaattttgggggataggcgccgccgggaaaatttgtaatttttaatgcggtttgttaacagatttttgtccaaaaaatgaccaaattttgcgacaaatcttatattttaagaaatctctgaaaaattcaaatagtgattattatcaaaatgccattataatgacgtaattatttagtggcgaaaaattcaaaacagtgaatgattcctagttatgaaaagtggcattaaaatgagaatttctctgctaaaatctgtttttcgtgtacttagcgctaaaagtcgcagaaaaattagttaaaaactaaaatcccatccctaattaattctaaaacttttttgatttaaggaaaaaggcgaaataaaaatttctaaaatgaaaagagtggaagagcaattgcttgagtatcgacgaacgcgaaaagcggctcttgagcagcaaagggtggacggcgatggaaaatcggacatgccaatgtcactgaatggccaagaaggtttttgggatatttaaatttaaaaaattcaaccaaaagattaccttttgatgaattaaattactaagcaaaaaggctcatttaaacagtaatgatcagtgctctgaactagggcggggattttagtggtgaagaaaaaatccaaaatacccacgaaataggggcgtaaattataaaatagggcaaaattttgaaaaattaaatttttcaatgatgataaattagtcgactaaaaaccatctttttactattttaattgtcaagacatgcccacaaattgaatgagtaaaatgagagttgcggctcaattgcaatttacacgaccagcagaaaaaactagggttgttccccgaccccgatccccgacatatttttaagaaaaatctgttaacaaatttcaaattttcaaaaaaaaattttcctcgcggctcctaacaccaccgccctcatcacccctttgttccccaaaagtttttctgaaaaagagcgccgcaaaaaatggtggtcaaattcgatcttgagacgggttcgcaaaaatttctgtttaacccaggggtacgatcgaaaatttttcaaaatcaggacatcgggcccaaaaaatcagattttggggtcgaaaatcaggacattttgcaaaattgcttcaaatcagttatttttacaatttattcgatcaaaaatgtatcaaatattatatttttgtctcccattaatgatcaacaattttggggagaaaattaacaacccatgaattttagcacattcgggatcaaaaaatcaaatttttaacaatttttttgcggcacgtttttccaaataacttttgggaaatggtcgagggagagagagtccggcggtgccgataggctccgccgggaaaatttttgtaatttttaatgcgatttgttaacagatttgtccacaaaaatggccaaattttgtgtaaacttatatttcttgataaaatagtgacattctgccgtaaaatttcaaaattatgagtttatttaagaaatcaggacaaaatttggtcggtacctccaaatcaggacaaatctgacaaatcaggacactcattttatcagatttgaaccctccaaatcaggacaaatctgacaaatcaggacactcattttatcagatttgaaccctccaaatcaggacaaatctgataaatcaggacagatcgcacccctggtttaaccccactcctttccacttatttttaaaccagggcttccatcgaaaatttttcaaaatataaacaccaagcccaaaataagattttagtgtcaaaaatatgaacatttagcaacatttttccaatcagttatttttccaatttattcgatcaaattttatatttttagtctcctattatcaattttgataattttggggaggaaaatgcaaaattataaatttcagtaaattcgggatcaaaagatcaaaaaaattttgcggcagaccttaaaatttcttgaaaaatgtgacattatgccataaaatttcaaaactataagtatatttaagaaatcagaataattttagtcactacccccccccccccaaaatcagaatattcttataaataagaacaaatggaaaccccaggtttaaaggccaacttggactcactcttactggcgctaacgaaatcagatgattaaagtgaaaaaagatttacgagcagttaaaaagaaaaaatggtttttttgggttaaaaaaaattggccattccccgatcggggtccccgatccccgacaattgagctcctccccgccccgacccccgacatgtcgccacctgaggtccccgtcccccaatattatgcccccc

SEQ ID NO: 5465 - DNA, 6494 bp, Heterodera glycines
  misc_feature (6475)..(6475): n is a, c, g, or t
ctactttgtgctgtctgcgctgcttttgctgctgctcccttgggcgtccgacgtgagggtgaactgtccgcctattccgtgttcaaccccaactgtgaacggttgccgggccaattgactggcgaacactttgagcgggacatgctttttgccaggaggcagtaatcgatcgaacaccgacgggttctaaccccctcccccccccccctaagttaagccattttttgggtgggcctgtgatttttgtactgttgtatcaaatattatatatttagaaatgacaaagaagtgaagcaaagaataccaaaagcaaaatttaatttctttttaaatttatatttcgtttgtttttttagtcgattcataggagatgttctcgttttattgtaaaggtattttttgtacagaattttctgaaaatttccaaaaataaaaaccttaaataagtacaaaaaatagacatctaacatcgaagaagctccaacccaagtggaaagtgcttttttcctgtttatctcgattattaaaaatgctcaaaatttgcagttctttaaaaaagcgtgccctttgaaaagaattttttctaataatctattttcacatcttttctagcctattattgtaaatataaagtatatttatcgctaatgcgatatttacttttacgatattttcttttatttatgccaacgattttctgatatttgtcttcactgtacatggaatgcatctcttttcgggtgtatgtatataattgatttgttttttcaatttataaaatttttcatctctaacagtgctttttcgattttgccgaaaattagccttagatccccgtacgatttacgagatttacctcccccttgaccacctattatttgcacacaatattaaaattgtaattaatgagctctattttcatgaaatttatccacaaaatatagagaaattaattgaaaaaaacaataattaataattaagagcaaagaaacaagaacaatgggagaagagattgttttgtgtatttaacccagtttatgaggagagaatggtcccaaaattcggcacaaatttaagcaaattgaaaaagtcaaaaatgatttaaaagtgccaaatcttcacattaacccattaaagctgaatggacaggcaaaaacaaacatttaagaatagtcggcattgaccaggggccgtcgtccgtcggcacttccctcactcgcggcactgcttcggctgcttccctcgtcatttttgtcggcattttctttctccaccagcagcaaatgattgttggtaccaattgcgactccgttgccgggaaaagtgatcagaccaatgccgtcgttttttagcatcagtttcaactcgttgttggcaacaacaaagccgttcattagcttctgatcagcagccggtgacaaatgctcacggcaatggtggtgaacaatggcggcaccatacgcatccccaagcacattgatagatgtacggaaacgatccctaataaatttataaaatatagatttaaaaatgatctgtacggaaacaacccctaagaatttagaaataaataaaatttatgatttaaatttaatttaattaggcaattaacttacaggaaccaatcaacggccaaaatcaatgtgatgaattcaattgggagatcgacagctgtcagaatcataacctagtgaacaaattaacttattgttagttaattcaaaaaaagagttttaccattgccaccaaagcgccggagggaatgctcgcggctccgatggatgccaaagttgatgttaagctgaaacaattcattttaatttgttttttcatttaacctctactatttgtaaaattattttataaaataatttataattatttttataaaaatatacaattaattttttaaattcgttttaaatttatttttcgttttcattttccgatcacctgatcaccatcacttggccaatgttcagtgttcggcccaccatttgcgcaatgaaaaccgttgcgaccgcttcatacattgccgagccgtccatattaattgtggcacccaccggcaacacaaaacggcacacgcgccggtcaatgctcaagtgttgctccaggcaacggattgttgtcggcaaagtggcggcacttgacgcagtgccaaatgctacggccattgcctgaggggcaagaattatgaatatttatagcggaaaagaatactgtttacattaattcggaaaattacttgaagcatgccttggcaaaatcgcagaggatttttacgcgtcattaaaaagtaaatcagcggcaaagtgatcaagaaatggatagcaaatccggccattacggtagcacagaactgtacataagatgacggtattaaaaattttgtaattattaacccaccaagccaaggcgagaaagcgtgtcgcccagtcgctcaacctcgagaacttttgcggcgatcagtgaagcaatgccaatcggcgagtaccacatcagccagccaatgatacgcatgctgacctggtccagaacggagaagaaatcgatctgggaattaaaaattaattataattatggaaagttaaatataatgtcaactattttagctttgattgtaattgatttttaattgtgccaattagcacaaaaaattaaaataaattcgcaaagagacaattagaattttttttaccattgtcctcgccttgtcgcccatttgactcaacacaatgccaacaatgatggagcagacaataatgccgagaatgttgctgcttcttaacaaataattaataattaatttgtttgtgtactgtacccgtcaatgttctgtagctccgtccttatgaaacggtccctttgtgcctccggcaaatgtaccgtatgcttctcgcagagggcgcgactcgtcgtcttcctaccatcaatcacacagtaataggcggtttgctgttggcgcaacgcggtgccaagcaaattgtccggaagcatgtttctttaaataaaggatggttggttactaattaatagataattagcgcgtttaaataaataataaatattttagaaaaattggataatttacgccaatagattttttaattatttttgatcacttatcgacctgatcaggtcgagcatggtgtccatggtgtccgttggctttgtgttgctgccatttcccaaatacccattaccattcgtgtcgtgacccaaatcacccggacgaatggtcaagacgagaaaaatgccagtctggaattaaatattatgaggaacgaataatttattttttttttcaaaacaaaatgttcaagggcatcaattttttttgaaaggtaaaaaacatatgaaaggtgcaccgggaaaacttttggaatttttagccgtttttttcaaaagattttcatcaaaaattggcaattttttgggtcaaattctgtgaattttaatgaaatttcttaagataaacaaatctttcaatttttcattaaaatttttatttatggtttctacgcccttgccatgtatcgaatatttttaaaattattttctaattaaaagcacaatgaaatttaaataggggaaatatttcaatcaatttaaaattttatgtttgctttaccatgacagcaattgtcgttgtgacgagataataaaggacggcaatgcccccaattcgacccgagtcgcgaatgttcagctgggccaatccggtgaccagcgaagcaacaatcaatgggacaaccacacatttgagcatgcgcatcagaagctgaaaaatttaaaacattaaatttattttaaattttcattaaatttaattacattaaaacccaaaacaaattgcgtacttcgccaggaaatccgatcagtttgatcattcggtagttgggctccacttggcgaagtccaacgccgagcagtacaccgatgcccacggcactgacagtgagaatcagcaacaaattttggcgcaaaaaaccggggcttccattgctgttttctaggacccggctaccaccgacaattcggtaatggccaagatttggcattttttaaatattttgaatttaaatttgctgaatttcgatcgaaatttattttatatttttaaagaataattaagaagaaatttaaggaaaattgaataaccaaacaataaaatttgtgattaaatattttttaatttcgtttttatttggatttaagcttctcataaaaagcaggggatagatgatgcaatttgatggagaattgaattagcagcaaaaaaatcggcttacaaatgatgcaataattaaatgaattaattgaaagtgaaaagggaggggggggagggttgaagatgactgagataatgaaaaaatacttgggaaaagaacgaaacaaaaatttcatttactattatttgtttattatcttttatttatttattgcgtagaaaacgcaatttaaataattaaaattaaatttcaataaaatattaatgaacttttttccggtttaattttagaggaaagttgccacttttagtcattaattgtattaaatttaattattatttcacttttttgaataaatagaaataaaattaaggaaataattttataattattttggaaacaaaatgacagaataaatcaaaaattacatatgtaataatgcattgcgttttggccgatggatgtgatgatgcaatcggacaaccggatttcatagccgcttttaaaaatggaaagactcccacgagggaacaaatgaatgaatgaaaatgaaagaataccttggctaatgaaatttgagaagccattctatgcgaatgaaatgatggaaagagaaaagttaatagagaattaaatttaaacattaaatcaaatttgacaaatattttaataatgaattcaaaatgtaatttaaattttaaaacccatcaaaggtcaaataaaaaatgagtcataaattggaaaagttgttgacattttatattgtatttccatttgttccaacgttaaaatttatgacaatttgacatttttagttgccaaattcgtcaatttactcatttatttgttagttaattttggaatcgcaaataattaagtcatttcccgtccattttcattgaacatcggcctccaaccgcagctcattgacgcggaaatgaaaagagattaaacaaaagttgaagtcaaaggtcgatggacaaataaagaatgaagtgaaacaacgctctatatctttggtaattcatttttataaattaaattattctaattttttacttgatatattggaaagtaacatatgtgggctctactgcactttaggcgtccaatcttcagtttcttggccataacttttttttacatgctcaatacttatattcttggtatcaaacgaaagcttaaagtatatggaattttttgtagacgaaaattatgggctaaaatcaacagacaaaaaattattcttgaatatgctcgaaaaagctgggtttagtgttttttcgtaacttagtattagctcttttcttgtgcatatttgtgaattcccgggactttaagcctttcgtttgagaccaagaatataggcattgactaaggagaaaaaaagttatggccaaagaaactgaagattggacgccaacatttgttagtttgaagaaataaaatatggcactttgagctcacttattgccctgtttttaccccatacaaagccttgcttcatctcatctcatctgctcccggtccactttgcattttccatcctctttctcgcacttttctacctgtatattcagattgagccaatggttccgtgacggctcagtgtcactgaacgtaactttttcccagctaaatttatcatcgtcgtcaagtcggatgcaatgaaactgcgcaacacccaaaagctcacatattttttaaaaactttaaaactaaattccaaaaatgacaaaataacaaatcaagaattgatatttaaacggcttaattttactgaagaaacttggggttgacccattttggggatttattattattattattattaaaaaaaagaaattttggcaaatatctaccgcaccaaaataaatatttttgaaggctaaaattattagtttattattaaggatgcaaattatacgtaaagaaatttcacaaagtttgaaaaatgattattcaattcgtagttgtcagaatcgcggggggaagtttgggcaccaaattgttaaagtttactaaattttattagatttataaaattttacctacttaatttattttattttttgaaattcctccctatggtgcccaaatttctggtgccaaacttcatgtcaccgtcagcagaatgacttgaaatttggcaggcaaatagcttagtgtaaaggacaccactcttcaaatttcataaccttttcaaacttagtaaaatatatttacatagatttgcccanacattgttggtatcattcg

SEQ ID NO: 5466 - DNA, 1118 bp, Heterodera glycines
atgtgtgaaaacggaaggaacttcgaacgcagaagctcacttgggacctccaaaaatagtggtgcctaagtggaagtctgtattactgtaactttttattttttgcatttttgagattcatccatcaaagttttactaattaaaacagacacatttatttcaaatcccctaggcccctccgcatcgaaaaaatagtatttttgctgaaaattttagattttcattggtgatacccctcaccagacttagccgctcaccctaattttctaaaaatttcactaaattttcaaaaaatcgacattttttgacgaaaatctcttaaaaattgctcaaaatcgcaaaattcgtcacttttttggacaaaattcgttaacaattttcccggcggcgcctatcggcaccgccggaccccttgttccccaaaagtcttggaaaaaccgcggcaaaaaaaagaggagtggaaaaaaatcgtcgcccggcgggggatgtaccccccccccatgaagccgaaatcctgggaccgtccctgggcacagagcttagaaaattacgaaatccctcggcattaaagtttagtcaccttgttcggtgcatgagacacccttgggcctccaattgatcaatcctttgccaaggcaacatcttaattcattaggaaattgatgcaaaatgtctaattatattcttcctaattaccaccccaatgcctccagtttcgagtaaaggcactatccaaaaccttggaaattttggtctcgattctcatgaaaacattcaatctcaagtctcggaaagctttcaatctagatcctcatgggtaaatctcggtctcaaatagttcactaccactgcacagtcaagtcacctgttgctgatcaacaattcccaacaaatgtagcagaacattgcaatcacaacagcactgagcattccaagagcggcgaacagtgcgacaagagttgaccgatttaaacattgcactggttcatctgcggactgtggatgtgaagctggtgacgatttaattttgttgttgttgttgttgttattggcattttgtggtggtatcaaatcgcgcgggcgcactcgcgttttgccattttctgacggcacacaaa

SEQ ID NO: 5467 - DNA, 3689 bp, Heterodera glycines
  misc_feature (2748)..(2748): n is a, c, g, or t
aaagacatacaatcaggcatttttatcctagacaaatacccacccaattcgtgactaaaaatctcgacgaagctcacgatcgagcaccataaatccaggtcaatcacgggtaaaatgttgatcaaattgctttgactctattgttgttaatctcaaaaaacgctaccgttgctccactccaagccgtgcagtccgtcattgattactgtagaaatggctaccacatcctgacaacagcagtttgtataatttatgccaaccccaaaatgggttcatgtccccaaatggtacctgagtgtgctcctccgcacggcgttggcgttgccgtaattcgcgttcctgaaaatggccgagagtatagagaaaagaagctgaccgataaacatgtgcgataagagtcccagcctcaattttctactcgaaaaatttcttagttttttttttgagtctcagtctcgattctcgaaaagctgctgcccacgactgggaacagagatgtgcaaaatcgaaaatcgaaaatgaaacgaaaataataaataatctttctcgtaaacaaaaccaaaactaaaaacattaaattttaaaatttaaaagaaaggaaattttttttggaatatagaaaatgaaatttaatttttaaatccaaaaccaaaacacgaaaatgaaacataaaagtgccgaaaaggcgaaacgaaaacgacacgaaatctcgcacaaccccttactgggatggagttcgtatgttatcagttatcacatacttctgctggaattggacggaagaagcgtcgagcagccgcgctaccggcacttttgttgcccgtgccgaaaatcaccaacgatgggggccaactgccgtcctcgttgtgcctgaatgattagtatgcttaatttaaagtgccgcttttttttaccattttgcttatcgcataaacactagacttaaatctaatcagttcattactgatcaagaattttgattctgtgatcagcccattattgttcaagtcaattagagagagtgtgtttaattagcatgcttaattgcttccgcccacttcaactgttgcgtggccatcagaatgcgatgttccaactccatctgttcccggcgtccttgtgctgttggtgctactgcttttgttcctgttccggcttgttgttctccaccattttgttgctcattgtcagtgtcccgccttgtttctgcccggtgttttgcgccttttttgctgctgctgcttcttggccacggccgttggagtccctggagcacttgggagggattgccctgcaaaacgctgtccaatgggagcgcatttggcggcgatgagggcgcaatctatggaacaatataaaaaataataatgatagaagatttcgtcgaaattttcaaaaatgttccccggctgtgccttcctacagccggaatcaaaaacacctcactttatcattaaaaatttttgggttttgatactgtaaccctgagaattccagcgccagtaaattcgttcaaaagggagcaaaaaaaattctaaggaggttcagatttgcgaaagctctggtctcggcccagtggttgtgaccgaaaggctgcgcaaatcaaactgtgcaacagtaggcctctacctaccgtagttcactcaccccggcgccgataaacggcggatgctgtaacatcggttgttgcaaataagctccgacgccaaccgatgaagccagcgttggcataacaaagttcggagttggcggaggatctaggaaatgccacaaattcttgcgataaagtgatgccaaagcagcgccactcacttatggtatacggtaccacggggccagtaggtggagcactgtagccttcgccgcttgatgcgcctaggccaacaatgttttgctgacagtttggaggctgtaatggaaaaaaaattttaaaagtcattatttggagtagtatcgcatccatggcatctacagtaccatttctaaactctaatttgtcaaaattgcagtgccgtcatgcgaaaaatagtatttttcctccccattctaaatttggccttgtgtccaagtctctggcctggaaaacccaaatcacacacatccaaaaccccatttttgtgccaaaatatttccggtgccactcacagttagtccttggcactcattgtccaatttgttgcacgtctggatttggcaccgaaaattcatctgtgtacggtctgggaaatggaaggcgaacaccggcgcaaatgccatgttcagcccgtcgctgtacaccggcggactttggatcactccgctgtgggtggggcagctgaaaaatggatttttcaaattcacatgaatttcgtaggaattaaaaagcaaattaattatcatattttgaagacctggatcattataatttgggggacttaaaaaataaactggattttttcaatttagatcttaaacaatttttttgtaaattttgaagcgttttatataatttttgaattacttatatttttaagtcataatttattggttttatatgtatatcccagattataggacagttgtttagaaaattaatttttttttcttttttttcaaaaatcgtagtgatgcgattaatttaaatatttttttatctatttttatcgcccggtaaaagcctgccgggcccccgggcccgtccaggctctagtattaatcatttggtttatatttgaaaaatctagtgttgttctattttctgaaactaantatataaactatattaaatttatttaaaataattattttacttttaatttttttgaataattatttgatcagtgatcacttgcacttttcgtgcttcgacatagcaccgagaaaagtgtataaggcgacgacatttacttttgcgggcaaatatttttgggttgaattgtctaaaaaaacaaaagattggttgatcaaaattcaattttcataatgtgatttttatgagttaagcagttaaggcgaatgaacatttgaaaaattcatataaacttgtccgtccaatagaacagcaatttaaatgagccacaacaaagagacaccagcagaaggcagaaacgaaggcacgagaataggccgagaacttaaaagtagggtaggatgggaccgggaattccctgtccttcgaggtcccggttcccggtcccgaataaaaaccgaggtcccggtccctgcttctcaggtcccggtcccggttttgccaaaaattcccggtcctgtcctactctgcttaaaagcaaaaacaattgcagggaccgatgatgagatagatgtggtggtggtgggcggcattgtggacttgaaaattgactgaaatttgttggctaatttttaattccgatagattggtgggaacggaaaaccagtcgaaatttcggaattttagggtactattttgggtcccctctttggtaatttttaatgcgaatttcaagggtcaatggcaactcgtacaaaaggcaaaacgtataatagtaaattttacaaaaaacctgcctaagcctaggctagacctagaaacaagatttggcacacttccaaatctcttcgttttttttactattttttgtgacgtatgaatttggatgatcggacattttctttccatttatggaggattacgggaacagaaaagttgagatttcggaattttggatccc

SEQ ID NO: 5468 - DNA, 1879 bp, Heterodera glycines
  misc_feature (1755)..(1755): n is a, c, g, or t
  misc_feature (1816)..(1816): n is a, c, g, or t
gtctatgaaataataaatttaaaaaaatagtgataaatctttgacaattcctaaatgatttcttgttgacatgatcaggaaaatttgagttaagattttttttaatatttaaaattggtattcctaaatttaaaaaattccttaattatgggtttggaagcaggaaatctttttaatttttagcatagaatttaggtcgacatttaatttaacgctaattattattaattctaactctaattatcattaatacctaattaaaataaagtaatttcaaaaaaataaaaatggcaaattcagaaagtcaaaaggtattaaatctgtaataatacaaagcattagcatctatttagcctagcggccaaagaggtaattctttagtttttaattaaccctccgcggtcatttttctaaaataacaaaaaattattaataaaataatcatacgaggcaataaaggggacacaaacagcaggaaaagcgttaatatcgcaatgtaatgacacaatattataagtaaatttttttatataaaattttggccaataaattaaaaaagttatctctaattaaatttattaaaactctttgattagagtttcatgtaaacgaacaaacaaattgtggtgttaatgatttagcacgtcattagaaaatgttggggtaattaaaatggactgtttactaagaaaccgaaaatccatttctgcgaattcatttgtttatttttttgtaataagaaatgtttttcattattttatcaacatactataattacctttttcattcatttaaattactaattctcatttaacggagctttcatttccttttacccgagaattaattaaagtgcttcagctttgtgggaccccaaaatgtaaaaaaatgagaaacacgcaatggaatatgcagtgccattaaaacaaaaaactgattaattcgcagaatcattagtgaaaaaatggaagttaattgaatggagtaaaattcaaaaactaaataacattctcctaaaagaggaattgataatgttaaataattctatttattatttaaattaccgagtcaatggtttcataaataaaacaacaattaagccgaaatttttaattattgtagtcgaaagctggcaaaaacgaaaaattttattataaacagtgaaagataccaaaatattgtatgggtacagtaacagtcaggtacagacagtacaatgtatacggttagcaaaggaatttcctgatgcacagttcctggtccacattgacgaagaacattcggaggaacaaatgcaatggcgcggcgcccgtgaacatgtcggtgtggaacagcgcaaaatgaccttggcgaaggatacggtcaaatgtacggtagaacatttggtgggtgtaattggccatcaaaaaataggggtcatgcacctgcaaaaaagcaaaactacaataattaaatggaagaaacaatttggcattagcaagaaaagaataacggaggaagaaaaaaaggagaaaatgaaaatttattcgcaaataaaaagagaaaatgcaaaaatgtgtgataatgaaattgctaaaattgtgaacacaatcatttgatgcaatatttggagaaaaatggaaagaaaaagaagaaaaacaacgaaatgagaagaaaaaaagagaaataattggaaaatattataaaataaaagacaaaataaagcaaaaaggaagaaaatacacagcaaaagaatggagtaaaattaattcgacnattgcattaaattttttctaaatctctttacattgtgaaattattttatttttattgaaanatatgttattattttcgaatgagctccagtagaaagtaaaataaattttatttaatcattaat

SEQ ID NO: 5469 - DNA, 3444 bp, Heterodera glycines
tttttattgaaaatatgtttattattttcgaatgagctctagtagaaagtaataaaattttatttaatcattaatttaccaattggcaattattttgtcattaagataaaattattattattattatttctttgaaattaaacaggatttccttattttattaagtaaaataatgatttattcagttttgtaatcagaaaaaaaatcatttaaatgcctcaaaaaatgaattgccatttaattgaagaaaaataaaataaaatcatttcgagacgacaaaaatgaaattatttccgctacttttattaattatattatttttaattgtaaaaattggatcggaaaagaaaaaattgcaacaacaaaagtcatttggcgaaatatttggagaaaaatgggaagaaaaagaagaagaaaaacgaaatgaactcaaaaaaagagaaataattggaaaattcaacaaaataaaagagaaaataaagcaaaaaggaagaaaatactcaacaaaagaatggcataaaattgatggaaaaatagcgaaaaaattggggacaaatcgaaataaaatttataaatggattaaagaattatgcctatataaatacaaaacaaaaactgatgatgataaattagaaattatacaaaaatacattacaatgacaaatgaatacaaacaaataagaaaatattcgccaaatgaatggaacaaaaattatgccgaaatttgtaagaaaattggagttggctatggaacaatttgcagatggaagaaacaatttggcattagaaagacggagaaagaaaaaatggaaaaaatgaaaatttatccaaaaatgagtgatgaaacaattgcaaaaacaatgaaaataaatcgaaataattttttaaaatggaaaaaacaatttgaagaataaatgattcgaagaacaattcgcttttttaaaattattatttaaaattgtaattcttttgtttacctttattttaaatattttatgcaaatttaaatgatctgggcaattttttgttaattttgagatttttaaacaaattattacatacaaaaatttttttccaatttatggaaacaaaggtttacacagaaaacattttttacaataatatatttgcttgactgatcacagatgccaataaaatggtgaatgacggaaaatcgaaaatattaagcagaaaagctatcatgaaatatttatgattgggattcggtattccacagtcctaatttaaaaaaaaattcttgggattttgaatactcaaattaattgaatttggttgactaaattctgtacacaaacgacgccccgacttcattgtcaaatctttttcgttgccaatttcaaggcggattatctgccgataattagtagaaatgtaatttaaagttgctaaaaattgtcaaaatggttattttttaggttataaacagccaaaataggtgctaaaaatgggaaaagaggtgccaaaaagttccaaatttaggggtgtaaaattgtaaaaatttaacctaaaaagcaacaaaattaagccaacttagtattgagatatataatttttaaaaaccaaattcaaaaaaataaaaaataaattttggagacgaaaaaaattttttcctttattatgcatgtctttagaaatttttgggtcgattcttaggtccttattttccggaatttttggggtcgattgtttgggagtatttgtcactttattgcatttttgttaataaatttttgggcaaagctccaaatagttgaaaatagcttttttcaaatttttttttaggttttttatgttctaaaaaataaaaacctaggaaaagtgataacgccaaataaatacagaaaaccgcaggatttagacgaaaaaagattactattttgcggagctcgagactttattcgagttaccgagaatcttcaaatggctcgatactgaaagactctcgaccgccattagtgcctaataattaccttttccccaaaaattcactggctgtcccgtggccgtttcaccgccaaccgccgcctgcacaaaagtgccgccaatttggcgcgtcaaattggcgttgatttcagctgccggatcagcagtgaccaggcggcattctgggaacatttgggtcaaattgcgttccgcgtttaccgcatgtccaacacataatggtaatttgtacaaaaattactcatgtaattagtacaaaaaattaattaaattgattttctttgaaatttaataaagaattttgtggcattttgtgcccaattaaacttaacaagggtgattaatgtgcagtgtctctctacttttttcgatgagaaggcgataaaatatttgtactcttcaccgtccgattgaagtttaagcacgttaagcttgttgaacagattgccccaaatttgctataaaaaaaatgccaaattagtagaaaaatcaataaaaaattcacattaattttccatttaatctctaatgtcctttttttggtcgtctacggctaattttatgtgctgcattagaaatttgcagattaaatgaaaaattgggagctaaaagcccgaattaaattcttatatgccaaattttttcgttcacagtcaaagaagtaagtattattaacagaaaagggcttttttagaaaactgaagtcccgtcacgacctattgattactgtatatgcatagttgggttctgtaatggtgagaaaatattgcaaattctaattggccgcacattataatgttgtggaatcaatgtccatgtgccattcacgtcgagctgaccattagcgagaaatagctggatcaacccgcatttttggtgttcaattgcgctttgaaatgccgatgagttaattagtggacacgtttctttcgtgaaaaactgaaatttgtctgggatggcttggagtaatttaaaaattgtcgtggagaaaattttcattaaaactcactcgtaaaaaaagataaaatatttttttaataaaaaaaagtctttgaaattcatttaaacacactctcatccgatttcgattgcaacagaatacattggaaattcgccgaattgggtcgagaatgcgtatccggacatttggacagtgaattcatttggaaagaaacggacaattggacatttggacagtgagtttatttataaatggcttgcacaattactaaaaattatttttcttgagacatttggcaatttctccggtctaattaggcaattcataagcgcctggctttttaataaatagcgataaatttgaacttgtttattttttcaacaacattctttatcttggctttagaaggaatcacttaactactttaatgccggatcagacttcagaaaattcaatataacttgataatctaaaaaaatatattttactgtcgtaatattcactatccaattgtccttttc

SEQ ID NO: 5470 - DNA, 3376 bp, Heterodera glycines
  misc_feature (3359)..(3359): n is a, c, g, or t
agaaacaaggggggggggacaccatctaatagtatcaaaattacaaagcaaaattgaagcataagaaaaaaagaatctctgtacaacatggcttaggacaagtcgtaaaactcctaagggaagattatcattaccttgccagatatctacaggaatcgaatgtcaaggtcaatcgcagttaattccccacgttcatttggcacaaatcttcggtcggacatgtcgcatatgtttccaagtaacttttaggtaggtaccttagaggcctcctcccccaccccccccccctctaatcattaattctttttgtttttaaccctttccctaatttacaggctttcaaaatggcaattgtggcgcggcgtctgctcaaaaaccgggccattcaaaaacagttggagcgccgccaaaaaagtcggttgaattttgggcaaaaaattaaaaaacaaattttttttttttgtttgaagacatgaaaacgcttcgccgtcaacaggcggcagcagttggtcagtcgcccattgttgtgcattcggtggggaccggtttgccaaggaaccaaccgattcatcaggtaaaaagttttttgcacattaccgaaaaacgccaaaatttcagcgccagcaagtctgcaccgtgccctcccatgaggtcatctacgacgtcccatgcaccggagaggaccagcaagaaggatcggaggacagcttttgagaaacactgaggatccgacaatctgagctttaaattcacacacacacacatatatcattttgcattttcatataatcatttttaattgcattttcatataaccatttttaaattgcattttcatttatcattttcaaattgaaatttccatatacgcattgaaataaaaatttgaactcaatataatgccaaataattatataagattatggtatgattaatgaattttgtccaatggtagaccagaaagggtccatatttaatcattaaaagtgaaattttgaattttgggctttgtgtaaatgattcataaataagcagtttgcacacgatgggatgttttgcatattaaaatgggtcagttttcgggatctcacccaaaaatttgaattttgagcttcacatttgggcttagtgaataactaatcgcgcaaatattggtgggcatcaaagaaacggggtgaaaatctgggtcatcaatcggcacgcgagaacatattgtcaacatataaaggcgcaaatccccgcagtcatcctcatttttaaatgtaattcgtccaacattgttcataatttatttttatttaatttaatttaataattcaaattttatttccatttctttaataattaaattccaattaaaataattaaccactttttataattttaattccattttccctaaatctcaatttatcccatcattttcaaaaatgtccaactcttctttaaaaaatggtaaaaaagacaattcctcactttacaattaacaatctgtcaccttcagtaccggacgaagtcgactgcgaaatgcccgatgaacgtgttctacacctcgaatgttttgaaagcggcgattatggtgtaagtaactgtgatgaatcctatgtttaaatattttattctcaattttaatccattttagatgatggaattgtacgggccggaccgtgctaaagagatgctgatcgacctgcgcgactatgccgaggcgaatggaatgccatgtcaacatgtgaagatgctgctctacaaactggacaaggggctgatcaaatggaaggggacaaagccctgagaatgaatgaatgatgtgtgatgatcattgtgttggggagcgggaaaaattggtgatggtgtttattttaaaaattgaaataaaaagttttgggaaaattggaaaataattttgtttgctcatccgctgatcggtcagacgggggctcatttatgagcgcccatcccgcccgctttgctgttaacattataaaagtgggcgtggcgtggcaccacacaacttttgtggcccaactttttgcgtataaatacgggcgcatcgggtggcacatttttcatttggcatcccattttcactcattcccatggcaatcaacatctccgacaaaaaatcgttgtgcaaccaaatcctcggccaaaccgatatcacagtgacctcgagtggcataaccatcagcggtccccgcctctcgacacctcgcttcatcccatttgatgaagccggccgttgtagatgctgtaagggcactgagtccgaaattgacactgtgatcacgaaagaaggcatcacgctttggtgcacccgcatagagaaggcccaattcatcccgtttgatgttgtgtacgatttgcctggtcattgctttttccgtttgaaaaataagtctcgtgtgttcaacataccctacggcgacataccctcttctgacacgcacaccactaaacggcgcaccaatgaccaacagcatgagctgaagcgcaaagcaaaggtagctcttgacttagtggaggccggactaatggccgatgccatgcaggacggcgcacgctggaagaaggcgaaaacagcaatcaatgtgctcggcaacctccttttggcggaatcgctggacaacacctccgctaatgtaaaaaatgatgtcgcggacatcaaaaaagaagaagaagcaactgtggcggaagaacacaaagaagatgatgatgaccaacaaaaagaggacctcggagacattgacaaaacgcttgacgatttcttcaacagtattaaagcatccacagcaaacatgtagaccctcattttgtgtaaaaaatgttaaacagccaagcattcagcgataaagacatttgctttaaattaccatttggtctaatcatttcggggccttcgtcgtcgggaaaaactcaatttctgctaaaattcattgccgaatcagaccacttaatcactccaaagcctgtgtccatactgtattgttttggtgaaatgaatgcggcggtgcctgtgcttcaaaaggcgggagtcgatgtgtacgcgggagtcccatccgaggaattgattaagcgcctccctaagcctcttttgctcgtccttgacgacttgatgctgtccgttgatgagcgttatttgtcggatttgttcactaaaaaggctcaccaccatcagtttgcagtggtgtttgtcactcaaaatttgtttgagcgaaagataaaagtggcccgcctgtccgcccagtacttggtactgatgcgtgccccaaattcactgctgtccatccgcaacattggcgtgcagctcttttcgcgtcagcttgacttttttcttgacggctaccgtaaggcgacgncccgggcctatggttat

SEQ ID NO: 5471 - DNA, 2397 bp, Heterodera glycines
aaaggtgtaattgggggtttgatattgatttctttcctttaaaggtggtttgttttgagagaaattttgatatggttgtctctgtatcctgtttgagtttggtcgattagaaggaaagttccggatttgacgatttgagtcttccattcgttccatgtcttcacgcgcttgtgtgtgagcatttaaaaagtccattaactgctttgttgaataaattttaaatttttctctcaatttaagtcttagattatatggaagttttgtttctatagactgcttaatttggggatgatttatgtcttcgccttgggattttaattgcaaaattattcgatcaattagtaaaataaattttcttaattcaatcgtggattcaataggccttctcaagttacgtaattcactatggagattttctctgattaattcggggttaccgtaccgtgatttcagcaattttattattattgggtaatttttgcttgtgaggggatatggggacacaatccggtagggttcatcatgtaaaagtccacgaaggtacttaagtttttgtatgttttccatgttagaatcgttatgcactgatgatttataatcgtcccaaaaacttggccattgggaaaattttcccgaaaagtgagttagagtttgtgccggaagctttattcttgatcgttgatgaacaaatggtatgcgattacgatgtgtttgatcacttgaatgcatttcttgtgattcgtcctcttgatcactatcatattctttttcatcttcatcttcttcttctccggcttcttcatcatcgttttcttgctcttcatcaattgattcattctcttggtcggattctgaagaggaatttggtttgagcgctttcagccttctttttacctccaaatttatatccttaattgtgtcaaggatttcgtcaatttccttaattgtttttaaataattatgcttttcccggaatattttttgtagtttccattcactgttccattctgttttattcattcgcctcattaaattttgccatttttggtgcaaaatttttaatttttcaaaatttggttcaattctttgaatgatttctttagttttattaaaaattcgagaacagtcatcaaaattatttttatcatactcgaaattcccttcttctaattttgacttaattttctgtatttcttttattaacactcggttaagtaacggtatttttgctctgatttgacccgacatatttaaaaaatatacttatgagttgaaagtacaagaattggatgatagcaatatggaccccactgttttttaatctggttagatgttcgaatttctattctcttgagaaattttgttaatttaatttttctttggtctgtttcgattgagccaattaagattggttatgtaaaaaatctgataaaatactgctagttatttcttcagaaattgtctgacaaaaattttttatattacggtgagacaaatttctgtgtgaatgtactgtgagggcaatagtaattttaaatgtatatttagaaggattaagtttaaattttttgactttaataataaaatcttgattaatggtaaaataatttgacaatggttcagtgattaaagccccgtagaaattttcaaagattaaatcgtcttggtttattatttcttcagtttcgttaggttcaaagatttcgatattttgattttcgttctcaattattattggttcttcaaattctggtaatatttcaaaattctcgatcggatttaactgatcgggttgatttaacgagtcaattgaatttaaatcgattatatttttaggacacagtttgaaattttgcttagaaaagcgaatttaaaataattaagtgaactattgttgtaaatttaacttgaaattcaattgattacaggtgaattattagtttatcacaggttaaatatcaagttattatcacaattaaatagaattaacaaatattatcacaatttattttttgatcacagattagtgcttgatgattgggttgtagtgtctgattcgttgtttgtttttgccttctgttcagttggtaaaccaaaggttttttttaaatactgtgccgttctttcttgtgctgttaagtagcgtctttgatgcttcagattgttttcgattttgcggaggctgaccagtgcttggtcttgaccggctctggttgagtaggctgttgactgaaccaggcgaactaatttttcaatcaaaattctattgaactcttcccctttcactgctttggtagtggcttccaatatgttgtttgtttgagtctccacgctatcaattcttttttgttcaaccttctttgcgtggataagtgcttgatcccaaatctctttgtg

SEQ ID NO: 5472 - DNA, 2221 bp, Heterodera glycines
cgggttactcgtttcacttaattgtttgggttttttgtttgtttaaattgggcttgttgacccgtgtggtttgggttttggcaaacccttaagtgtttgttttttaactgtttctcactcgttctttgctgttcagtcgctttggacttttggccggattttgatgagcaattggtcccggcgggtgtggcaccaatttgtcgtttgtggcgacgacaaagttttgggttgggtggtggaaaagggagaaaagccacgaagtgatcgagtcgtgagtccggactgagtgattcgaaccgatcgggagtgctgtacacggccttgattttggccaagtactttgcaagcagggttgacgtattcagagcgagttgatgaccgaagaaatgcaaaagagcgccggaattcaatttatttgtaccctcaaacttgggtaattaaaccgagccctcaaacttggcgacacaatacaaaaaatgatcaatacaaaaacataaaaaataaaaaatgggcaaaattgaacggtatatgggaatggcataatggggatgcgagagggcacttcggaaaaggacgggcggagagaggcacaggacctttcgagatggggcgacacgggggaaggcgtagggcacttcgggatggtgcggcacgggggaaggcgcagggcacttcgggatggtgtggcacgggggaaggcgcagggcacttcgggatggtgtggcacgggggaagacggaaacttcggagggaaccaatgtcgaactgaaaatcactgaaaagcccagccgcttttatacggcttttttgcatcatagtacgctccaatttctaattttaattaaaatttgtttttatgtttatccctttggattttgccatttttcccattaattgttgtttttccattttttccctttacaatttcaatttctttaatatatcaaattaatcattaataatttgtttacgaacgtattttaacagaatttgccaattacatattaatcatttaatatttaattaatttccgttcctttcaatccaaggaaaagcactattattccgatcacattttttaatttattgttctaaaggttttttcccatttttatattaatatattttaatagtttttaatgtgttttttctaaattaaatgtagaaataattttaaattatttttcccatttttatttctaatgttttttattttttacattttttgttttgggttttatcttaggatttcgcgtcgtcgcgacactcccgcgcgaaagaggaaggcagcgacacataaatttatatagaatagatagtagacatggaattaggaaaattataatgagtatgaatatgataataataaatatattgaaaaaatttgttttaataagggaatagacaaaatttaatatatcagttacttggtccaatgaagttccgctaataggtttttcattagtattgttagcaggaataattttattatcttgttgggatatatattccaaattagctttcaaaataatttcagtcttaccatcggggcagataacttcacaattttctataatattttgcttattatatgtaagttggatttgttgttcttttccttctttatcacaattcacttggaccttttgacttggacatttaacattggctaatgcggtaccaaaatttgttttacatgataaagtccaattagcaccactagtacaggaataacatccttccaatgatattgtaacaatattacaaatatttttatcataaatagctttaaccttatgtcctttaagtgtgacttgcatttgaagagaagttgtttgctgtattttagctttaatttgggaatcgaagtatacgtaacttccctgtgttttaatgggtaaaaggttctcttgcctagcaaatatttcggtaagtggacttttttcgcattcacaatgtacaacggaatcacctccgtggcattgacatgcttctggtggaaaagtgcaactaaaactttgcgcttcttctttgttttacaccgtaatatatttttgagtaaattatcattcgcaactattgctgcttttaattcttcgcgaactataataatgccgaccaggtaacggcgtcggaggaattgagtcgaagtcaggtgacagatatagaactattagactcgtcaccaatgtgtggtaaaattccgggtttcaagtcaaca

SEQ ID NO: 5473 - DNA, 1147 bp, Heterodera glycines
ttttttctgcatattttggccccttttcagttttttttttagtgagcagatatttgggttttaagaagcgaaattattttttgtaattaattttttcactgattccttttttgattttaattataaagatgcaaaactacaaaaatttgaaatccctctggaccaattacattttttaccacaataaggtgggcgtcgtttaataatatgtttgtctttgcataccaattgtttatagcaaaattcttttgttattttattttgtctgattgtaaaaccgttttcgatacatagagttgtatatctcgttttccatattttaggttcctttggacattcgtatgaataagatgaacataatgaaattaatgttaataatgatataattgttaacgagttttgaaacagtctattcatttttatagggactaagggattatccatcttcctttttctgttgaaataattgggtttttgattaattattagattagagagagtttcttgctctttatcatcatttgaattaatttctaacgggtaaattaattttaagggtcgatttagtactgttttatttggaagttcgatattagcgcctcttacgataccatctgatccagttatgacatttttgacaatgccagttttccacattgctctgggagtttgatcatgtattattacaatttcattcaattctggaaaagatttcatacaatttcgtggatttttgttttcgattttataacgttctcttagacttggtatatattcatcagtccaaattttccaataatcatccaataattttgtggttttcttccataattcaattgtttggtcgtatgaagtcttttttgggtaataagttgggtctttggtttcctcattttccaaaataggaggaatacataaatttttatgtggaagtatgaagtcgattggtctaagaatctgataagagttaatttcatcatatataaaggtaattggtcgtgaatttaccagggcttcaatttcacaagtcagagtttgaaaagaatcaaactcaataaatctttttccgattacttttctcattgctgttttgacattctgattaaggcgttcaattgctccgttttgccaaggggctaattctata

SEQ ID NO: 5474 - DNA, 1450 bp, Heterodera glycines
ttcccttcttcctcagcgtccaatggtctgaatccgctattacaggaacgctttgtgttccatgtgcggcacccggagctgtcactgctgcgctttcatgtggaagacggcgatttcgtcggtccgaagacggatccgttcattggacaggccgtgtttccgctcgactccgtccgctgcggcttccgctccgttccgcttcggaatcagttcagcgaaccgttggaactttcggcacttctcgtccatgtggaaattcggtgagccattctaaattaaattttgaaatgtattttaattgaagcccccctcctccgccttttggcataattttgagtgttttaaatgcgcaactttttcaagtgcttgggaccctcctccaatgcattgccgcctcggattggccgcgtctttgggccgtcggcacaacgccaacactttgccaacgaattcttcttcagcggccgattttggcaccaccaatttcggcaatcacaagtaagtcagaacacgtgtggagcaagggataaaccaaattctggaatattttttgggattttctggggtggttaaaacgcagtttcgagacccaaattggcctcgagaatgggtcggcacccatagtttttatttgtcggcactaattttcagttcagttttatcgcaataaccaaaaacagagattcgcacatgtgagaagcacgactagcaccattgtctcaacttgaatccgattcaatgtttcttccccatttttagcactttaaatgccggcaaatccgccgcctctgacaaagccctgcatcagtgcgccgtcggcccactcattcaaaatccgcacaaaatgcttcaggccggccgttctattttggcccagcagccggatgccgtcaccgatggcattttctccgccgcggcggcgccgtttggcactgccaatggcactgatctctcttttggccaaaattggacttcgctgcccgggccgctgaatcgacgaaatgcgtcgattgaccaaatacgactggggagcagcaccagccaaactgcagcagcacatcagcagcagaacattgctttgagcacgcggtcaattagcgtggagtcgggcgagtgagtgcatttattttttcaatgcctcgtacaattcgcccccaacattggacattttggcatttcttttttacttttgtttgggtttcggtacaaaatggcaaagaataagcccattgttattcttaagcaatgtcaagtcgtccgtcccatcgtcgggacagcgaaaggccggcaccaaaactctccgccgcatcttccgactcggcggcggaaagcacaattgaaaaatgcattacaaatattgatcagaggaggatgaaaagaaacatatttatttatttttatcttttgttcccatttttttttgatctgttgtgaaaattgtgtactcttt

SEQ ID NO: 5475 - DNA, 1519 bp, Heterodera glycines
  misc_feature (28)..(28): n is a, c, g, or t
agttctccaaggagtttttcatacacanttttgaagaatataattagcaggccaatcagttagtgtatactggggtagacctaactcatccatatccaagtcattcatactcaaactcatcaatgcaaaaaaaatgccataacgcaggcgccacgatgcaagaaatgccaggacgacgacccgcatcatgctgtggatgaattatgtatggatgagttcggcatgactcatttgtactacataattcaataaaccctaatttttaaaaattaaaatgcaattatggccagcaattaaaaatggggagaaaatacctaaaaggcaacaattgcctcactaaaattagatgtaccaaattgttaggtctccatatataaagctgattcctttgagaacatttctcatttcctttctcttcataaatcataaacttttttatttgttcgacccttttcattttttcatcttttattttccattaattctaagaaacaaaacaaatattttttatcttttaaacaaatgcatcgaactaaaaagcgatcgcgcggcggaagaggtagaaacgcgggacaaaaactgctggcagcagcagcgcacgcagcttttcccgggggaaaaaatggtcagcattgggcacgatttgatggcattggcattatgttactatttttagtttcgattttaaattaaaaaaaacaaattttcttttctcacttattcctatccaacccaattcttacgtattcccttttttgtttttgtacttcaaattcactgctaatttcttagaattgcttcacacaatgtcggcgatcgaaaatgacgagacaaagagcagaatttggcagcaactgaagaccaaactccactcgacgatggtcgccttcggaagcgggtcggtgcagttgcccaagctgatggacacgttcaggtgcgtctccgatggactcaaaaaagggcactttcactttttaaatccggcatcaaaaacatggagataggaaaaacaaaaagttatgcaattttcatcgcattcaaagatacatgcaaaattgttgaatgctttggattttttaactttaatttcttccgtttttttgttacgtttcaatttttaggcatgattggggctccgaattgacttcgtacgcggtccaactcggcttcggctgcaacgacgcggcggtgtacaaaatgttgctgacgatgcccgacgaaattgaaagcggcttcatatcggccactggcaccttcgcgttcaaagtgattccgaaggcggagaccagcgaaaacttgacgaagatcgaccagagcaaccaataccaagagtttgttgggtgtggggggagtgactttgagagaacactgacaaatggtcaaccaaattggcggttttcgcttttgaaaattaatttgggttttttagtgaaatgcgaagaatatttgcacggcgtcgctcctcaatgtcgagcggcttccatcgtaaagtccctttcaaccagtctttccatgtgcg

SEQ ID NO: 5476 - DNA, 920 bp, Heterodera glycines
  misc_feature (895)..(895): n is a, c, g, or t
cagcccttcgctatgagcagtcacaacccgaaacccgcgcgtggccctcctccttcaatgctgtacgtattcagctgtagttacgcacccatttagcccaaaaaatcaaaatgctataattttgctgtgcccatatcctttttgaatccaattcatcaatttgatttaggcacaaacaaattgaaaacattctgcgcagttcacgcggtcgactgcctcccaacggacatcctcccatcgtgcggaaaatcagcatccgttcgcaggtccaacaggtcgtacaaaaggagcagcaggtccaagtcgtacaagaggttgtttgataagaaattgcttattgtattcgagatttgaatttgtaattttaggacgagcaaagtcacgatcttcagaagccgaaacaatcatcgaatgctaaggacgagtcggaggacatcatcggacaactgatcgaacaatttaagagattgaaagtgagtgattgaagtgatcaattttgttgtttttggctgtttgccagttgtgcactacatatttttctcattatgtgttttggttggcaataaatgatcctattcaacagagacaatccattcgagaaaacagaggatttattaaagtaaatgtagaaatgggtactccatcggttaattgtaagtaagaaaaattgaaatcttatggcgtttcaagcagactatgatttgatatcggttaaagttctttaggaaatatccttcaaatcgatacaaaaaaacaaattaggtagataattaaaattaatttcttttttggcattatatttcaaaaaaaaaaaagttttttctcgatgaaaaaatctttcattcatttacagcaaaaaatctttcgactatttcctcaatggttaatttccctnatatttaattgttttaagtaactaa

SEQ ID NO: 5477 - DNA, 3228 bp, Heterodera glycines
tcatcaaaattttagcaatttttttagtgcacagctttgccaagttttcgacgaccacacgaaagtgattcatttcttctcctctcgccatgacttctttttatgctggtttaggtcaatgtccttgacagtgcggatgcggagaacctggccttgatcaatcgtcccgatttgggggtgaccttcaccaaattgcattgctggcgactcactcaatactcaaagtgtgtgttccttgacgccgacacttttgtgagttgatcagtccctcaatacttgtaaatttggcatttcttttttgtaaaggtggtcaaaaattgcgacgaactctttgaacgacccgaattctctgcggcaccagacgttggatggcccgacattttcaacacaggcattttgcagttggtccatccatttacatgcctttttcttcatttcaggcgtctttgtctttgtcccctcggagcaaacatatcgcaatttgcttgattttgcactcgtttatgggtccttcgacggcggtgaccagggacttctgaacgcatatttcaggtttgattgttttttgccatgtcgcacaaacatccactaattttcaggtcatttacattttttctctttcagcacatggcgtgaatcagatgctacccaccgtctcccgttcacttacaatgtcacgaccgttgccatttatggctatgccgccgctttgaagcggtaatttgtttgctgaacagcagcgacaatgcaattgtttgttgcttttagtttcgcgccgaacatcaaaataatccattttcttggcaagcaaaagccttgggctctgctctacggggacggcgctgcggggatggcattcgtttcggactatcacaaggtgaaggggatgccttatattgaacgcattcttttcaaaaagggtgcacttcacttacaccccgccggttccccaccttcccgaaatttgaaaaaaggttatacaaaaaggtttagattttttcttgaaaaatttgtttgaatattttttcaaatttttcggccgggtaacgacgtgtaagactccgtttcaaaaatacgacatatttggtgtttgttcgcatgcttttcaatgttttaacccatttcagcaatggtaccaactctacgcaaacattgtccagcaacttctgcctccgtcctcttcggtaatttcttcttccaccccttcttctcttccgtcctcttccttctctattattcaacatccgttgacttcgttcgaaaaccgtcccattgtcgtaagctgtgcagtgttttatgtgttcttttttaactattattagggaattttttgctgcttaaaattgcagttttagtgcagcatgtgtgtccctttttgcgtcccgttcaattttatttacggtattattcgtaagcggatcgccactagtaaacgcgtacagatttatgggacaggtcaaaatcatgggacgggttaaaattctatgggacgcataaatgggcattttgactgtaatactaacaatttcatgtcttattgctgtgttaacagtttccattttttcttttattttctaaatccgttaaaccgatttcagtcgcacggtgctaccgcaatcccggggcgtgcgcctgctggcggtggttacgaggcttgggaagcggggtcaccggattatttgggtaataacaactcttttattttacaaattatttctgttccatatattcgaatttttaaggtgctgactcctttgccaacattcagaaggctattgaaaaagcactcaaaggcgaatgagcttaatggacttaattttgttgatttgttcccttaccacttttgacctagtctcttttctcaccatctttcatttctcagcggccttcgcttcaattcgtgttaacactaaaaaatattctttgacattaatctaatcaaatgaaaataaaggacttattatttatttctgaattaagcttcttcggctgggcaaaggtgtagaattgtggtcccgatgggaaaaaagtaaaattttaaaaagcattttttctggggtagaaaaatacgctgatcacgaatctgaactcagattttgaaaaatcattgattttatctagagtgcagcgggaccgggaaatttgggcaagaccgggacttttttggttgaattttcactaaaatccacttttattgtccaaaaatgattcaattagacttaaatgaaaagtgtttttcctactaattaggctatggagaatccagaaaaaaatgtatttacataaaaaaggaatccctgatgattgaggttatagcaataatttatagtttttttagaatttagaaacctaaaaaaaatttattgacataactaatttggccttttgccataattaccgtatttgctctttttatatgccagtctccattaatctgccggtctccatttatgtgccttgggggataaatagaattttttaataatttatttggccggcttcttcgtgatcgtttcgtccatctttaaccgtttcagttgccctaaactcgcgcaaaaaagcccagaaggctgtttctatgcctcaaaacataaaaaattacaaaaaaaaaaacttcattttgatcacgttaaaaatttcgacattttgaccgacttgtcgacactttgtcccactactcccaaacattgttagacctgtcaaaacattgtttaacccatttaaaaacaaatatcaagctctacacactcaattacccccaaaatcccccactcactgcgaaaagccgacttttttgaccaaatttttagacaaatgaccaactcaactttgggctagggactcaactctttctaaccaaaatgctaaatttattcttttttctattgattctaaatgttcaaagtgattttgtacccttataaccaaaattattagaattttcgaatttggtgttttttcatgtgttagagacatgaaaatagtacgccaaaaggagaggaaaagaaatgcatttttactttttgaactctactacaaaaacgggatgtctaacctaaaaaaatatttgataggttcgatgcagaatttttttctctatcgatatacgaaatttggagtggacttaacgtgcaggaaaaaagttaaacgtcacgaagtaaatgttgttctttacattattaagaatgaagagatagtacgtaaaagtgagagaaataaagataaaaa

SEQ ID NO: 5478 - DNA, 1513 bp, Heterodera glycines
ggatcatttgttatgcgtttgccattgccattttattttttttttactttttttttgtctttttgccataatttttccattttccactgttcagctccaattcatcgctgaccatgaacgttcgcatataaccaggaccagaaaatggtcggccaattcaaccaattaattggccgttaattttttcgatttcaggccaaaaaaggaagagctgtcccctccgcccgtttcttctccgtcctcctcctcctcttcttcggtcgcacgggcgcgaaaacgaatgccaaaagcatcgccgttggacggaactttggacaattcgccactttcactggtccaacaactgacggaagccgcacaaagtgcacgggaactgatcaaagcaagcatttgatgggagattcaattgaaaggggcgggggagtgacgtcactttcttaataatacaaaattaaataagtaatgggagagggattaatcggtcgatcaaaatttgaaatttacagtccgaagacaacgccaaagaatcggcgccaccggcggatcaaagcaatgggattaaaatggaaaatgacaacagcagagaagaaaacggcggggacgaagtcggggacggggaggaggaggacaacttcggggagacactgggccaaattttcatgctgaggtcattgggaaacaaaaatggaatgacaaagacaacaaacagtatatccgacattttacagtaagcaaatcgctgagaatggcgtcggatgcgcacccgcaaaaaacaatggcaaaagtcaccaaaatgccattgggacggaacaacaaatgacggaaaagtcggcacaattagctttttgtaataactaataatttaattgcagcgatttgccaattcgatttctgctgaacgaatggatgctgaagggagggccgagcatgatgacgaatggcgaagggacagccgaagcgaacgcagcgaacaacgcaattggcattggcaccgacggcaatgcttttcggcaccatccgtcgccgccggcgccgaaacgcatgcgttggacggaagagaatggcaccgcaacagccgcttctcaacaaaacggcggcggcgaccaatttgacattttcggtgggaaagcatttaacaatataaaaaaacatttccgatcactccttccactgatcatttcattctgatcgctctgtttcaccaatcattttatttattctatccactgatcatttcgtttccccccccccccaggcatgttcatcgcttcccaagtgcgcactttgtcccttcactcgtctcagtcagcccttcggcttaaacgcgcactcaccgaactttgctttcaatttgaagcgcaagagaacggcacgcggagacggacgacggcacattcgggcagaaactgagcagcgataattaatgaaaacctgtcgagttgttattttaattttattttatttcaatctgagatttaacaaatgataaaatctatttattttatgggattcg

SEQ ID NO: 5479 - DNA, 1231 bp, Heterodera glycines
tccttttatcaccaagtcattttgcttcgttttgctgtttttgtcccgctaatttaatgctcaaaaaccaattttcggcttgtgcaatcgcgacgcataaaatcttaaaaatttatattattattaaataataatttcattttcattttccactgactctcaaagtgttcgcgggcaccgtctgattgaccttcaattcaccctcaatgttcacgttgttggaagagctcaagtcgagcatgtaatgcatttgactttgctgcaaaagtcaaatgcttttcataaaaaggacaaaaaacaaattaaaataattaattaatgggtccattggtacgggaattccatgccgaaatgaccattcgttattcaaatttgccttttcattaaaactgtccaatttttcggcaccccatcccctcccattttggcattcttttccattttcttcactacctttggcattcctttccatttttgattattatttttctcccctcttttcccccaccgttctgcccgccaccagcaccgcataataatccgttttgaattggcgtagtgtttgaatctcgcgaaggtatggcaacggtttgccgtgctcccaaaagtgttctgccaaaagtgggtccaactcgtcccggtggaaacaatcgacacggaacggctccatcagcaggggaccctcggagcagaataactccagccgaacgggacacatcttacaataaggggaggggggggggaagtttagggattatgccgaaattccagggacggatcagaaccgaattcgaacaaatttaaatattctttcattttagtttgaacttgctagttcaacagattataccaatatatgcttgatcatcgttcttaaactattttaattttatttgggattgcaataataggaataattaaactcttagaattgatttaaaagatttaattattttaatggattaaaatattaacgaagaaaccccccactaattgtatttcgcgtgccatgctcagcccattaattaccgtgctgacgatgaaccgtcggatatggcccagtgaccgcaccgccttccacatttcctccatattcccccggaggacgtacgtctccaactctttctgatgcatttcaatgaatgttttcattgtgacatgttgctgtcgtagctcaaaatttccgcaaattttgctccattccttcaccgagtaattaatgaattaattg

SEQ ID NO: 5480 - DNA, 1488 bp, Heterodera glycines
aatcatttaaaatgtagcaaatgcagcatatttattcccgactatttccaaacccaccgaacatgtcaaacagattcatgagcatgcatttgaacggtttggtcagtcgtcccttatgatcgatgatttggtctgaccgttctggctcaattatttttagtgctcggcagaaacggactctgatcaaatggtttccggccggcaccgacacccaatccgtggtgcatttctgtgatcagccgacggtcacaatatttatcattttaatgatgctgccttccactcactccgttttcctttcgccgcgccaccgcgtggacgcgcgcgttcgactccaattcggaggacatgagaatgccgaggacggagttgtggaagcggctcagagagtgatcgactgaccagcccgggggagggacggacaattgggcacggcacccgacaaaacaacaactcactggcttcgttgacgcaaatggacagacgcattttgcggggcctttccaaagagaaggcatacgcaatgcaattggtctcgctgagttccctttggatgaccattcccttggaaatccgatcattccatttttgcccgatcaatcattcttccctcccccgccccttttctctgatcagttattagctaatcaccaccaccttcaattggattcgttcttctcccctctgctgatctgctgttcctcctcctttgtccccttggccatttttcgttttttctcctcccgcggccgatgtcccagcaaatttttcgtcggccccttgggaagtcattgtacgactgtttctgttcgagaaaagcgatgaaagcgattcagccgactcggaacgggccatcataaaatgggagtggtggaggagacgagagccggacgaaacattggacactgtgaaaatggtaaaggtaattaattaattaatgacaaattggtcaaattgtgcgaatgaaagcatagaattattcatttcaacttatcccaactaattttacaaattatcatgaccatttcgggaagctcccccccccccgctcccccggcggggggacgacccttccctaagtccgtccatctgttcgttcgtttctatgccaccaataattggcaatttattaattaaatgctttgtcgaccaaattactggccaaagctaatgagtgtttaactgtttatctttttgcagaatgaatgaagaaaaatgaaaggtgcgcgggtggacggacttcgcctttcattttctgcgaattccccggcaacggacggacgaataaattaattaaccttccccaccttcgccaccctcacaaaatgctcattgatgtataaatgaacaaggaaatgggagatgcaaaggcagacaatgaattaataattgaattaattagtggcagaaaattgggagacaattcgacggaaaatcaatggcattttgaaatggcattttgcaatttttcgtcgcttgtgcctttcg

SEQ ID NO: 5481 - DNA, 2469 bp, Heterodera glycines
agtttttgatcaaaagggtccaaccaattggcacttgcattttcaatgtccgttcgtcgatggaaatgccgacgaagccatttgaccaattcggcacggccttccttacgtttccaaaaatgtcatttaaaaaatactcttccaatggcacagagagaccctttccatcgtttaccctttcaaatctatcgatcagagtaccgtagtccaactcaatgccaccgtattccgctgctcccccttcgcccggcggggggtcatcattttcaatggaaaatgcatcaaaaacatcgtacaaatcctcaacacttgtggatggcagactttggtatatcttggccaaaagtgttagtttaaaggggaatttggcatttgcaattatttggccaaatttaaaattgaaagccgtaaaaaatgatttaaaattataaaaaatacttgaaagaattcatcgaatgtgaatatttcgtctaaacaaaaacataaataaacaattgtcattttcgcccttttctcaatgcctttttccgttgcgtatggcctaagtcgacaaaggtcctaacaaaaatatttattattttttggcattttcccatttccccgttggcattctctcccccctttcccccctggcgttgtgccatcactcacattggtcctaccgcttcacctgaatggtgcagtctttgcctgcgcaaatgatcacgtccagcagttcgcgcagcgacgcaaggcggcggccctcggcgaattcggcgcccaattcggtgacaaaggcatcgtggaaaatgcgaagggcgtcggcaccgccacgcgcatactccgcgggcaaaagacagtccatttttccggtactttggagcaaaggcgatggcacacgccgaagggggcgaaaggtgaaaaagtgccgggattgccaagccgaaggaaattcgcactgacaattatttaatgacccctcggggaaaatccccaccccccccccgccaatcattcatcatttgtttcccattcttcaccatcttccttttttggcgtggcgttcatttcctcgccatttttcagctcgtcgtcgtccgggcaacccccgccctttttggcgatgctttacaataacaccaaaagatgaacggtgatttttggcaatttgttgttgaatttgcgtacaattcgtagggcaaaagtctattggaagaaaagataaaaggacaaacggacgaatgggagaagcgaagaacggattatcagagtatgcaacatttgaaaatggtaaaaaaacaattgaaaaaagtgataaacggagaaagggaagaaaagcagcggataattgggcggcttttgcctttaaagcggctgatcagtgattaatccgatttgttaatttgccattgtgcctatgctatttaatctcgttttgtgctccttttcatctcttattcctcggcctccatctttgttcgcgtcatttcacctccactttcccacttccttctcatttccccttcaaaagtcgtctcaaatttcggaatgcccccgggggataaaagggcaaaaaacagacggacaaagtgagcagctgttgccgatcaccgaatgatgatgggtcagtcgccttttgttcttcctttttcacttttgtttttctttttacttttctcattttgaataaatttaatggaagtcctttttttgattttccgtttcacttttcaaatagaaaaacaaacagtgaattggccaaatttgtctaatgggtggcgtcggtgcgattggccgaggcattgcccccggggaggggcccatctggcacattgtttttctgccctccgcttcataaatttggtccaaattaccaccattttctcactttgtgtggccctttggccgctctgtcatttattttccaaaaattccattaaatgtgccaatgcccgcgaaatgagtgaatttggattgggttcagtccaaggcgtgctgggtcgtttcttaaaaactgccaagttgtaggaaaataaaaaatgtaagacatataaattcgtatcttggcttaaattcaaccaaataaattttcatggtattatgttttataccagaatataattttattaaatttttacttaagtataaaaaaagttatggttatttaattccacaaaaacttaagccggaattttttgtataaattttttggaaattttcaacctaaaactgtccataattaattaaatattattcatatcattccatagccctaacatttctctattagctcacctaaatttcaaaaaatttggtcaaggttgagcaaagttatggccaaaagtacccaaagtgccgggttttcaaacatttttagctataacttttttgaaacctaacgaaatttgttgaaattttgcaggttaatagaggactcataggggtagcgaatgatagtaaaatatctttattttgttcgttcaaagaatg

SEQ ID NO: 5482 - DNA, 2133 bp, Heterodera glycines
aaaattaaaaattttttcttaaaatttttttactaggcctggccaaaattttttttcccttatggaaattgttacccgtaatttcagaactcaaaacgtctttatttccacaacacgatccgtaatttcgctcccaaaaaagacccataatttctttaacgcgtaattggtccagccatgctccaaacaacggatcaattacgttttgcgattccattcggtcaacagccgttaaattgttgtcatcaataaaaacattcatcgtattggcccaaaagcgtaaaatctgttcgatcgaaatgccaaattcagacatttggaactaaaaattcaatttcaaatatataagcgaaaatcagtaataaataaataaattaattgttaattcattacatgtagtgaaaccaattctgaagcacttagtgttcgcaaaaatggtgttggattaggctcatttgcttcaccgagccttaaatttcgtcggacagcgttactaagccaattaacacattttgaagcgacatgcccagtaaaagcagtcagtgtgaaataataaatgcaattttatttaataatgaataatccaccatatatttaatatttaaggttaattccttacgatatatttgaaattttacagtttatatggatggacccataaggagtagagatgtgatatacaacatcagtgtattttcttcgttttgagcatgttaaggtcggaattttagatgatcaaaattagagtattgatgaataataaattttagttagtaagtattttcgctttttatttttttgttattagtcgataaccctatgtgtcctcaaatttatttggtagaatttaagccaagatacgaatttatatgtcttacattttttattttcctacaacttggcagtttttaagaaacgacccagcaccagtccaaagggtggtcagtttggcatttggcaatgctcctttcctttgcttcgttttttccgtcattaatttgctatgtttttcgtcgtcattttcatttacttttttagcatttccttaaaataatcaaatcacgtcaaatttaatcaaaaaattggcttaaatttacccaaaaagagcaaatatttgcctttttggctttcccatcggccgaattttgatgttaatgagtaaaaagtgccgtcgtcccacttaaaaaatgttccgtcgtcagtcgttccgtcctttctcattttatttgctgatggcaaagttgtgcccattatcgccgacttttagttccccgcggggtcaatttacacgaaacatctcccgaggggggggggggaggacggcattggcttggctttatctttggatggcatttgcattcctttggcaacttttcctcgtcatttgcgataagttctcgaaggaatttttctttttttatttcctcaaagttttttcattttatataaggaattataacataaaataaataaatttgtggctttaataaaattccgccgcccccccccgcccattggcattatttgcataattaaaatttgtaaagcctctcactcattcacttacctattatgtatttcctcttcaaaatttgccttttttcgtccaagttttccccgccatttgttttttcccgtcagccgtccccgcttctctcatcgaatattccattttgccaagtgtttttttactttacgctgccttttcgatttaatttccgaatctgctctttttgccaaattcgtatacttttcaatggggcggatgacttttgtcctatgacatggcacactttctatttatcggttgcccccaaatgccattctctccgattttttgtgtaatttttgcctttttgctatttcccccaatttgcaattaaaaagggaagtcttttcgtttgtcctcttctgctggcttttccattcgttcattcatcaatttgtcccattctctcccacttttcttgcactaatttgtcttcgttcgttctcccaataatattttgtgctccttttgacatttcgcctctttcccacttttccgcttaaatgactttcggcactttcccattttaattgtcaacattgtcattttttatttattttttgatttaaacattaaaataaaaa

SEQ ID NO: 5483 - DNA, 2850 bp, Heterodera glycines
attggcaatcgcttttgccaaaagtcggcttttatcctactcactaatcccttattccaacattgtccaacttttcccccctcccatttccttttttctttttcccaaagtttgcttttctctctttcaatcgctgcgcttttcttttgccgcttttagacacgaaaagtcattttcggccatcgcttaatctcgcctcacttcttcgcctcatccgtcatcgtcatcattccctttttaaaattgtccttcatttatcgttgttcatccttcgcaacaaacatttggcacttattttaatcattatccatccatcatttatcagtaattatttaaaccgttgcctatcaattggcacttttccatttgtctgatgaactttttttgttgtgctgctgaaatgctgtgcatcttctaattttgggtgtcgtcatttgtcatttttttactccttttgcaattttcgattttccacttaattgggctcattatgtgctttttcatgccaatttatgtggtttttcatgccaattaaattcaaataaagcaacaatccccataattttgctttctctcgcgcacaaatccgcaattagcattctttgagaagaccctcggctaatttgttccccatgctgcgcttaattagtgaagaaattgtgccgcattgtctgaagcaatcattttgacccggacgaaatttggcattggcactcacttttgagtatggacaattgcgcaccgttccaatatgccgtggagaacatcagtcgatacgtttatgacaagcttggcgaacgctgcgcaatggtggtgaagggcaaaaaaaaatttttcaatgggtttaaaaaacaatttttaatttgatttgataaaaattaatcatttgcccccccccccccccctcttaagccttccattgttttgccaacggtggtcatttatggactgatccttctgcttggcattctcggcaatctttgcacttgtttggtgattctgcgcaacaaatgcatgcaggtcgaacaattggcgatttatggagggaaaagggggaaaggggtcgaacggaaaagcgaccgattgattcgaccgatcatttgatcgaatgaccaaaatgcttgtttgtttgcccaaaaatgccaattcgattcagaacccaaccaattattacctcttctcgctggccatctccgacctgcttctgcttgtgcttggccttcccatggaattacacggcgttttcggtgccgtttacccatataaatttggcgaattcatctgcaaaggtcgcgcatttctaatcgaagtctgtggtcgagaaaatgataaaaaataattcgacctcccctctttcccctaaagttcacaagttatgcctccattttgaccatcacttgcttttcagtggagcgatggctcgcaatttggtattaaatttgagaatgttctttttgttgtgttaaatatgtaattggttttatttaagaattagtcattaaaatgccaatttttcttggccgtgtatcatttgtctatttgtcattgtgccaattgtccatttacaatttctcagttttccgttgcgcatcaaaattttctcaactttggaccgtgccgtcaaagtgatcgtcgccgtttggctttgtgcttttctggccgcttcgcccgtcctctcaattgtcgtggtcaacaaattgcctgttcccgactgggccactgatcagccttggctgcccctcgtcagtcatttttgattacttttggcaaattagtcttgtcaggtctcctccgacggccaacttttgatcggcaccgaaacatgcgcgatggattttatgagaccattcgtaaaaatgggggaggcaaatcaaaagaaccctggggcattttttgatcgaattaaggcacagcgcaacttcatcttcattgccttcaccattttcttcctcctgcccgcccttctgatcactcttgtctattttcacatcgtttaccgattgtgcgcctcgggcgaccgttcgctgacggccgagtcggccaagcaaaagacgcgttcccggaagagtttgctcaaaatccttggtgaattttgttggcatttggcagtgccaacaatgggttctcattttcatcccccttcagttcccgtggtggttatgtttttcctctgctggttgccttttcacgtccagcgtttgctcagcgtttatctgaatgagtcgtcgatggaatccgtcgaggacgagcagtacaattccgccattcacactctgttcagcatcgtcttttacatttccggtcggtgcattttcagtgccatttggtgccacttttccttgctcaatttgccattttctgttaaggttattgctactactccaactccgcttgcaatccgatcctttacaacattttgtctgccaaatatcgaattgccttttgcaaaacggtcagttaattttgcttcttttcttctcatggctttcacttataaattttccgcttagattctcggcgagcgtttcgcccacaaaatattgtcgggtcgaaaccgcgccagagactccgccatcgctggcggcaatggactgaatagcaatttgaactccaaagtgtccaccggtggctcgtcagtgcaatggcggacactctctccaaaaaactcttcaatggccaaaatccacaacaatcggccaacaatttccctcaccaacagcccattactgctcaaaattgatcaaaatgcctcccatgtatttagaatttggcttttctttgcacaaaattggcttttaagcttaacagtgcgccatcgatcgcaaaatgccattccgtcgtgccattgcg

SEQ ID NO: 5484 - DNA, 3618 bp, Heterodera glycines
  misc_feature (3565)..(3565): n is a, c, g, or t
actggccatggatacgcccaagttacatgaaaaaattcatttttgatttttagaaattatgaaccaattttggtacttttgttaccattcgaaagctcatcgaaagctattagctaataaaattaaacaaaatcgattagacaaactgaaaaaaggttaaaaaacatgaaactacattttccccctcaagacatacataacctttttagagttctgaatcctgaaaataaaaaaaatccgtcggaaataggcaagataaacagaccgcttcttgttcttctgctgatagggcaattttaaaaaaaccagaaaatgagtgctacccgggcggtttcacggaaaaaatccacttttacaccgtttttcataataaagtttgggtacgaaaaccctcccaaaaaatggataaaaatataaatatcgaacacacacacctcctcgtccatgtccagcgggaacagcatcttttcattggtctcgacgtccaacagttcaatgaatgacggcgttggcggaggtggtggcatttccccctcctctccaggctggtgctggtggtgttcatcattttccgacgtgtccatcatcatgtcctgcggcgtatcaccatcggcggcaacattgggctgctgctgctgttggttttgagcatcgtcctgcatcaaaacaaataaataaatgaaaattcgggtatacatcaaaaggtagccggaacaaaatgtcgcaaaaaatgaaattttttcaaataaatctttttcaaaacctaagttttaccgacaaataaaacgaaatttgctgaatttccagaaaaaaacacaaaaaaatttgaatttttttccatttccttgagttttctcaataaacaattttttcgaattaggataggcaccaaaaattttttgaattttttaaataaaaaaattttgcagcgacattttgtcccagtgacaattcgtccggcgtctttttgtcccactcccaattaattgtagtcccacaattatctcctcacacactttgatgatggcatcgtttgaggaggccgccggagtgagcggtgacggcacaacatcatccagcgcatcgtcaccggttgcggaagtgaccacaatgtgaccagccgcgttcgacgacgacggtgaggacagcgacgaagacgagggcaaatcggctgccgatgccaccgctgctccagcgcccatggtcggactgccgccaccggcaccgctgaggcgtgtgccgctcggcgcccgtcgtgccgttcccccactgccaggctgctgcggcgacgactgcgtgcctccgccggtcaacgacaggtacgaggaggaggaagaggtgccggaggagggcacgatgacgggcggttgtgccatggttggcggcgtcatggtggtggtggacgacgacgacatggacagggaagaggagggcgacgagaaggaggcgggcagtgccgggatcaaagcggtgcagtaggaggaggagggcgcggcggaagaagtgcccgcgtcaccacagtcttcaactgcagtcgtcgtcgtcggcgacaaggacaggcacagctcgcgcacccgtggcaccagttcggcaagcagcgcacgacgcgtcagtttggtgggacgtggaaagaacaacggcggagaggtggccatgaacagattttccacctgacaattgggagatgagatgggaaattaattagtggagctcgtcgtgcctcccccccccccccttccgatttttttttaaattgggaaatttaattttaatttcttatggggtttaatatataaaaattgaatattattttaattggattattgtgcaagttgccctttctttgtacgagttggcatcgatgcatctcaaaattttaaatgggcaattttatgaaaccaatttacatacaacaaatttggatgcccaaaaaattgtcagaactgttggcactttttgggccaaaaaaatatggcctgacaatgaaatcaataaaaatctaatgaatgcaatttaataaaaatggatggatatgattcatggaagagagagactgaccaaaatgacggggcccggcttcacagcgtaggcatacagtttcatactgtaattgtacatgtaggtggaggacaatgtgctgtcgtccttcaatattcggttactgtaggtcgaataaatgatcatctgtcaaaattgaatggaaaaattattcatttttttttgggggggggtcgaactcggaccggtgaacattttttcaaaaaaacgagtttttttttgctagggttctaaccgatgaagaaatctgaccatgcactgcttgcccacctgtgtgttggaaggcaactgcaactcttcacgcagcatttgcttcagctggccagccgtcgttttgctggtgtgtgtgacgtgaaactgtgcagggaaaagagaatgaatgccatttaaaaaaaaaaatacgtcatgtatttcttcccgaaaattttcgaccgtctcaacctaaatcgcattttcgaccacccaatcccgactgttttctcgtcacgcgatcaaccctatgtttgtttaacagattttgccgcccccaccagagacggtcccaggatttcggcttgggggggggggggggggggggggtatctccccccgggcgacgaccgacctttttttttgcttttcacaccacttttttttgcggcggtttttccaaaaaactttttgtggaacaggggatccccggccggtgccaataagcgccgccggaaaaaaatttcattttataatgcgctttattaacgaattttgtccaaaaaatgacaaattttgtatgccatggcaatgcaccgtacctttgcccatttctcggcccgcataaaaacgatcgtcgattgggccttgtgctccttggtcggcaccggcacggacaggaagcagaacggctcgaacttgatgctgattttgctgcacactttaccatggaaaatggggggggggggagaaaaatgttagacgaaatattttttttaccaaataaaattctcaccattgcatgtgagcgtcgatttgtgctggaattcggggggagggggaagaatggtgaaaaataaataaataatcgttagttttaaacacacctgtccatggagcaggtcaacaatgatgctgtcatttcgcttccgatagtcctcccaagactgcttggcagcctgaacatgaaacttggtttacaaaaaaacttgaataatcggtacatataaccataaaaaacacacaaaaaataatatgttgaaaataatgaaaaaattttttttcccattcaattaaattactaaaccagaaattttcaaaaaaaaactctcgcaataatttgcttggcgaatgtcatccgcgaacaaatattgttttcacaaagtttgatttgaaattgcttagacaattaaatttactgacggaaaaacatgctcgttccggcgagttttttcctctttttttttgaattggtcaatttgtcaaccaatttcgttgtaaatttttgaaattttggggcctccgtccgctgacctgngcttcgtcctgtccgctcagctccttctcctccacgtacggcttctgcttgat

SEQ ID NO: 5485 - DNA, 1548 bp, Heterodera glycines
  misc_feature (15)..(15): n is a, c, g, or t
aaattgggaatttcncggggctctaaaaataaataaataaaaatccatgccgatggacttggatagaaaagcccaaattttgccaggacttctaccgggtcatttttccgccccgaaaggggggtgacccaaccaaagccgccctgaacccgtccagactccgcaaattggaatttccggggctctaaaaaaaccatgccgatgaacttggatgaaaaagcaaattttgccaggacttccgccgggtcattccctcgacccccaaaaacggggaccaagccgaattcccggaacccgtccgaactcaaaaaaacaacacaaaaattttttccgcgctcacagcattgcttgcgagtagcgagtggagtagggccgtggcgcgctgtttctgctggtggacgacgacgacgccatgcccgcggcggcgttgttgttgtcctccatccgcatatagacattctcgcgatcgtacgttttcacccgtttgccgccgtcaaacgacaatctgttttcctccccttcgtacgcctccttcggccatggcccgtacatgttcccttcctcatcgagcggggcgccgacaaaatcgtcgccgcctccaccggcgccgccgccactgtcccggctgaactcgtcgtcgccgccgccgccatggttgctgaccatctcgttgctgctgccgctgctgctgccaacggtggccatggtggtgccattgtcgtcgccaatgtcactggtgtcggccaacaactcgctgctgttgccaccgacagtgccggcggcggtggtggtgccaccattgtcatcaatgccaccgtcgtcgttgttattgttgttgtacacaggagaggatggtggtggcgttgttgttgttgctgtttgttggtgttcttggctttgacaattttcaaaattttcctccgaattcatcacttttaagagtctctgtaaaataacttttttttttgaaaataaattacaaacggttaatttaaaaaaatgtatagtaaatggtatcataatacaaaggtttagaacacgttaagtgcaaaaaaattaataaaatagttaaacattgtattcatacggcggcacttctgctaatttttgttttcctatttagctttttggcattaaatttttggtgctagttgtaaaataggctaggtaattcttttttaaattaagtgaaaaaaaaatttttgaacgtcaaagcttaagaaaacaaaggaaacgaccctacaaagcctcattttaggttattatgtcaaaaatgatttgtttaaaaagtaaacctgaaattgcaaagtgccggatgagtgcaatgttgtttctacaattctcggtgcaggcgaatattttcggcgatttcaacaaattctgtctttttttatactcgaaagttcatagagattggttttaaaatcctattttagtttggcacaaatttcagcaaccagacttgcttggaactgtttatattttctggacaaaaatccagacgcagaaaaagccagatctggctggacacagactacagactcttag

SEQ ID NO: 5486 - DNA, 3622 bp, Heterodera glycines
  misc_feature (103)..(103): n is a, c, g, or t
  misc_feature (138)..(138): n is a, c, g, or t
ccaaaattgcatgctgtattaaatataagcgtaaattggaaaattaatgacgaaacaaagggaaaaacaaaaacgacacgaccgtaaatgattttgagagctntaatgcatcgtaattttttctagaagcattcaatntaaacatgcttggtatcatttgataactccaagagtcctctattattctatgaagattgaaaaaaatgcacccattattttaaacattggaaggattttaataaaataaatttctctatttttgatttgattttttagataactgtgggcactaaagttttcatttttactgctattcattcaaaatggctcaaaatggaatgacaacagccagcaatgagttcaacgagctcaacgatttcctgtcaactcgtgcctatcttcacgggttctgtcttttgcatattgttgaaaatgtggtttcttagggcaggccaaactccaaaaaaaaaggatttgccacaatttcatagcaaatttttaaatcccaaagtttccttgctgcaaaattgtcggactttcagaaaagcaccaattctgagacttttataccatttatatttttgtgctctaactctaaccaatttcttggaatttataggccaataaagcttttgaagcaagatgaatgctcttttttaaatcaacatttgcaaatacctatataaattgtacaaaattatgagtaatttttggcattattttgtattaccgactctttgtttagttttctgccgtcccaagaagaccaatatgtgttcaaatgcattgcggctgctccctccgtcagcgaatatccgcacattgcgcgttggtacaagcacatcaaaagctacgaggatgctgaacgtgccacgtaacttttcttctccattgtcccttcggaaacaatttttaccggtggaaaaatcgaaattttttttttttttggatttttgaggcgggcttggtatttgaaaagtgaaaacaccgctcatgttgttgtaacaaatgcttttaagttggccaaagaaggctggacagccgccgcagaaagtcgtttcgaaagacagtgcaccaccggcaaagaaagccgacgccgaggtatgaaatttgcccattttccaaacaatggcatttctttaatcggttttataccaaatagtggttcgatgaacacgaaaattggaaatcgcaccggtttcacccatcctgattaaaacaatccaaaattcgaatacatttcgagtaaatgaaaatactcggagaaggctcatattttcaaaatatgcacacacaattgaatacattttgttacatgttcattaattaaatcgcaatgaaagagttccccaattctcaaaatcgaattaattttggcagttttgcattgaaatgccgaaaaagtgttggtgccatgtcatgccaaaacgctgcattttaggaagacttcgacctgttcggcgacgaggacagcgatgatgaggagaagaagcgcatcaccgaggaacgtctgaaggcgtacgcggagaaaaaggcgaagaagccgggcccggtggccaagtcgaacgtcatctacgacgtgaagccatgggacgacaccattgacatcaaggacattgaggccaatgtgcgctccatcgaatgcgaagggctcgtgtggggcacgtcccgaattttgccggtcgcattcggcgtgcagaagttgcaggtatatatatggcctgcccgcccgtttaactatgtgtagttgtacaagaattgctaattttcggttttggagtgcaaatattccccccccccccgaaaaataaaattttaacggttttttttaatttttagggagtcggggtaattgtacaacctcctcccattttgattggttaacagaaatcagacacttttaacatggagggtgtgtttaagtttgttcaatgtaattgtgcaactgcagaatttgtccatccataaatgtatgcctagaatttatttattttttgtctgagccacgggtgtatcggaagtggctcagttaaacggagtaattaattttcttcccatttcttagattggatgctgtgtcgtggacgagaaggtgtcgacggattggctcgaggaacaaatcacaggcaaacattataactaaatactagagctcgacctggacctggatccaggcctggatttttcctggatccaggtccaggcaaaacacgaaaaacctggattttcctggacaaaattttagaatttattatttcaagtgaccgatgttttttttaattttcaaaaaaagatttaattaatttaaaaacacattattattattaagtagatatttttagaggtttctaagcaattaattaattttttcaaacctttttttgatttttaagatgagtttcaaaaaatccaggtctcgaagagcctggattttttgtccaggtccaggtccaacatggaatccaggtccaggcttttttcaaaataccgagctctactaaataccccaccaaattcatttaaattgggtctaaaccctttattaatgagatgggtggactcatttttggcccccatttacggtgtttttaaccaagttcccatccaagtaatggaaatttggtctacccctctactgatgagatggatggacccaattttatcccattttcggtgtttacaacattttccaatccgtttttttcaggcttcgaagacctggtccagtcggttgacgtggtcgcctttaacaaagtttgaaatgatgacagacgaatatattgacaatgactatttcacacacacacaaatattattattattatgatgatgcccattgttattttgttggtggtggctgttttgtccattgttgttgatgttgtatagtaagtaaaaatggttgacactctttctcacaatcggaattgcctatttcaatggtatttggccattttaaaatgaaaaaaaagattttttttaaattggtggtttgcttgctgtccaagcaatctcatatcattttgcggcaaatttcagtcaaatttcatgtagatgcaaaacaattggtcaatttttattcgattttcgggttgaatcaatgtaaaaggcaattgaatgttgtcgtacttgttgccgctgattgtgagcaaatggatgtggcgcaaaagcgttgccaaatgtcatccacgcgcgcctccaggcgcatgatgaaattggcggtcttggccaactccgtctctgcactttacagcactggcgccggtcatcatccgccttaatgccaagctcgaacttgaacaacagtgtgtgtggccagcaaatctgacgagagaaaaagttaggatgggataaagagacaatttatttagccaccaattcggtgcatgaatttgatggaataaaaagaatgtagcccattctgaattggccggttttgttgacacccgcttcaacagtttaaatgtgatgcaaaagaagtggtaaattttactttgctttttgttgaatcaatgtgacaggcaatgaatatggtgaattttttgtgtaaaatgtaaatgagaaggtgaacaataagtaaaaaacatttgaggatgaaatgaatgaaaaataaagaggaata

SEQ ID NO: 5487 - DNA, 3348 bp, Heterodera glycines
aaagtaccagaactttattttaaacataagtttcaccgactctttttgtgggagtcatcgctatcgccggaccaaccaatctcgcatcttcagattcattaatgaaaatgaatgaaaatgtttttttattaatattttttcttcataaaaaataattttgaaatacaattctctttttttttgtccaattggccctttttgccggtatttcccgtttttatgccaaaatagaactgtttatggcactaatgaacattttgtttcatgccaatcgccacaaaaatttatttttttttataatatgtaaaaataattaagtctcattttggcaaataaaaaatataaaatttccctgctgtaattttaaattttatcttgttcatcgatttaattgattaaaaaaaatagtaatcaaaaataatttattatttacagaaagtgattttataatttatttctcattatatttataatgagtttcttaatgcatttccgattaatattatttacaatttttgtaataattgaaaatatccatgaaaatatgttgagcaacgcgcaattatcagacgacgaattggatttgagtattttatgggaaagtgaaaaagcaccgacaattgacgagttgacaatgaaaaatgaagtaattaggctttttaattaaatgcttgtctatatttctatacattaaagattaaataaattcaattggttttcttttatttttttagtcagaagacaaaaaagaaaaagccactgaaaaagaaagtaatggtgccaaaatgcacaacgcatttcaaaatgtaactgtcaaacaagaagcaaacaattatttgggttgctttcgcattttaaattaaattaaattaattttaatttcattttgaaactaagagaatggcaaaaacggacgacggcaccaaacattcggagacgaagaagattttgacggccaatttttacacaaagtggagcgagaacgaggcaaaagacagaaagttccactggaaacttctgattacggtaagagaaaaaagacatacggtacgggacgaaagttcgcgagttttaaaaatggaaagtgtaaaatttggaaattaattttagttgtaacggtggaaagcaaacctttggacttacgcaaaatcgaccgaattctcgacaatttcgaagcgtaccaaaagaaaaggaaacaaattaccaatgatttgttacggcaaattgcagtgctcgaaaatgccaaccccaacaacgaagccaaagtttggttcagccgtctcagaattcaaacgttggccaatgcaaatgccatcgacacggcgatgattggcatcgaaatttcgttgataccattcaaaaatttgtggcaaaatgggaaaagtttgctgctcgagtcaaacgaatatttgaggttttgttttgccgtggttttttttatctcttccgaaaattttgacatattatcaaaagattaactcacaagcaaaaaaaaagggggaaagaatcatcggaatttaataaaatttaacatcaagaattatgaaaaatgcattttctttttttgttactttttgtttttttttattaagagaaaaaaaatgggaaaaagaggtggactaagattttatccgaaaaaaaatttgaaaccaaataattaaggaaacggagggccagaggtagaaaattattcccaattttcaaactcccttccctactagccctcccctcttttacagccccccctcttcctttcctcgctacgaaaggtccttccttaatttgaggtgcattgacgttcctttttcatttataagccaaatttacgcgaaaaacttccgaaaaatgaaaaacttagtcagaaattgagagaaatggtcaaagcattggtccaaatgaaggaagacataagcattgttatgaagcaatggattggggcgatgaagcgacaaatgttggcaaacggtggtgctaaatacgacatatcagtggacaatttgcttaacattgtcgaggtattaaaatgaacgattcgcattaagctcggcacatttgtcatccgagcaaaaaaaaatattatttttttaattttcattaaaatgccgtctaaaatggacgcggggtggtggtgattttcctaaaattattattttttaatcaaattacacacattgaagcgcaaattactgttcattataagcgtaatcaccataatttagagtttggtcgacattattgaagccaaacataagaatgtttctcgccatcgtcacatttccaatttgactttttccgttgcgtttttccgccaagtgattggccattgttcgccaccgctgactttggaaaatattccgatacgttcgaaacgtttgcaaataatttgcgaggcaattcgaaacttttgcaactcggcaatttacgaattgagccaatttttgtgtctctacggaagacgaaagtaaaaataaattaaatcaaaagtttttcataattattttttattattgttttctatggctagaattttcttttagttaaagcttttcacattaaatttatctgtgcatttgaaggaataaacaagggtagagttatgaaaaatgagagaaaacaaaagaaaacaaaataattgcaattgtttaagcgtggaacggcttcttctctgttgggagctaaaatatgcaaaaatgttttatctttcctttatcctttggtttccctattaaattattttaattatttatttcttttttataagtcccccctctctcatcccttccctctctctctctcttttttaagatgcgctgcgctccctttttgggtacttgaagccaatttttgtaataataatggtaattgcgcacatttaggcaattgacttatttattttaagtgttgattcgtcataatccgcacataattatcccattttgtagcaataattagagcacttatagtattaatatcaatccatctctgaaattccctcattctgtccctcgccttccctttaatatcatctcagatcaacctgatcaattcccctgatcactctatatacagttctccattcttctcccatctctctctcctgcgatcactatgatgagtcctcgctcaaccttcctcttcaaatcactctgatcactccttcccctccggcgcgtcatttcgttcttttccaatccgtttatgcataatttaaaccgcctggcgggtcggaatgtgattgatcaggcgaagaatggatgggaaagtgctcacagctgagtgggtgctgttggggctgctgttttgtgtttgcttgggatggaccgtctcggggaatggtccccactcccc

SEQ ID NO: 5488 - DNA, 2610 bp, Heterodera glycines
ccccccgaagacgacggtcgactgtgcccgtagtagttgttggcaattctttgtgatggtttttgttgttgattgcgtgcaaatgccaaaaaaatcaaccgccgttggtcaagtgcattccgtgggtgagaaagtgctccagcttggcattcagttgctgaactgctgtacatctcggtgcaccatttgagcccgtcagcaacggtttttcctgaggaggggggggggattgacaggatccgcctcccccggtcttttgctttaaaaatcaactaactcacagccaactcgtgcaggtcgacccgctttctgttcatcctcgccctccgcttcctctccctcctctttccggtgccattccttcatcaattgtcgatgactgttcttccacaatcccttccgcattttggtcgtcctcccgtttttggtgtcctcttttgacgccccctcccccccccccccccccccaacgccatacggacggacccgcgagggatgagcaaccggtttgaagcgtcgaagcgtattgaagcgtcggtcgtttggcagtggcaccgccataattccattccaactccgccgcatttgctgggaaaggaagacatcgaaactttgtgcaagtgatcccccaccggggcatggggcgtttcagtcaaatgcccccgggggcaaaagataaagcgaatgaaatcctcctcattgtcagttttggcacgccattaatcgctttcggatcaatgagaacaaaacggaagggcagaagaagggattattagccacatgtaaaaaaaatgggccagctcaaagcttatgcaaagattaagattttaacccataatcttttctttttgtttatttttcctaattgcaaaataaaattgaaatttctattatttttttataaaaaatttagtaaatctcggagtttaataaaaattttgacccaaaacgctcaaattatatttttggcaaatcaaaatctgttaataaattgtgaaaatttttaacaaaaatgtgaaaacaagttttaaaatgtctcatcccaataaaggagtgaaatttatatgaaaattttttattttctataaaaactggaaaacagggacccccgttccccggtttacaactcttatgaatgctctttacccgatttgaccagctcccccgccctccctattttcttaccataatttatttctttgatccgcataaatttgtacaaataaaaatgaaattaatcaaagctttccgcagttatgcaaatatcgcttttcttcttttgaaaattaattttaattcttttttataatttaatgcgttaaaaagaaaaaaaattctttcgttttcattggtttttcattaagcttttttcacaatttgtatcattaaaaagccaaaaatgtgttgttgcgggcgctgtgattgtgggcaattatttgctgctgcccttcgtcggtgtcttttcgtttgttcccaacggcagaagaagaagatcacttggcgctctcataaataatcccgttggaattagccaacaaattttgaaacaacgcaaaaagcgtgcgaaaagcccaaaaaatggtcaaattgaaatgactaaagattttttaaataaatttgttttttaattttattttttcctttaaagttgtcactattgcgtgaaatgtttccaattcttccgttcacttcgcttcacaatctctgtctgacccatccaaatttcaattccaatctgagcaaaccaaataaaatcaaatactaatttcaatacgatttcgattccctctgatgcttctcactttcccttcacatccgtcgatgcgtccatcccaaccgaaacgaaaacattcaaactttttgaggggaggcggcggtgggtcactcattcgcttccccccggggggtcattctccccccccccccccccgctgtgatccagcggagggagaggaggagaagaagcaataatcggtatctcactccttctttgcccatcggcaaataaccaaatgaccctttaaattgtcagtttgatggcatcattttttttacaaattaaatccacattttgtcggtataaaagctgtacctttgcccatcaaaataaaaaaaaatgaaatataaaattaccttctaaatatttagtgaaaatgtgactaattattttataaaatatgttcttacatttattttagttgttattttatttctttcattttatcgacaaaattaatttcaaaatgctaaatcaacaaaatgtaagaagaagaaatgttttttaatattcacaaaagttgcttcttttcagaaggaagtcaaagtggcgatggttttgttcagcttaattcatttattcgcagctgcttttgactctcctcaatgcaatttgggcctcaaattattcagcatcgaaggcggaaaggtaaattagggatgctccccgacccctcggggggcaaataattaagcaattcattattagttagttgatcattaatagcttttgaataggtaattagctttctcgggattaacagctcgttttaacggtgacacttcttttccaattgcaagccagagattgattaacccggcggattcccttct

SEQ ID NO: 5489 - DNA, 1317 bp, Heterodera glycines
tgcgagcacaggcatggacaaaaagcaacaataaaggacagattgttgaaatttgagaatgcatttttcccctttcagctcccatttcatcgcttttcgcgggcgccgcacttttctgtcggggattgtcctatcggaacagagcattcttctccaatgctgcgcttcgttggccacctccgtggaattaggcaaattagcacaataaattaattacataaaaataatgattaatcgaagcaaacccattaaaattcgagcgataattaattatgataaatatttcaggcgatgaaaaggaaacgaagtgccattggagtgaggaaattgagactgtcgtcgaccggccgaatatgcgctttgagagagtgctgggcaaaacagaatattacagaagtgagtaaaattaaatttgcaaactacttattaataaaatgcaattacaatggaattaaattaatttttaaagatttgggcgcagtacgaaacggacggagttcgattaaactgcgcgtcgaagtgtgccgttacacttctgaaaggacattttgcgagagaaatgtgtgccaaaattagtcattttaaacagaaatatttatttaaatggtaatagaaaatgtctggagatgatttcaacaaatattcgctgcttttaatgcgtcttcaaagaacgaaagaatttatgcaaatgcgaagcaatgttttggagcaaaaggagtttaagtgaaaattgaaattattaattaattactatcaatcaatgcagaagcatgcttaatgagaacggcttttccccgtcgccgttttcaaattcagctggcggcggagaagaaaaagaaatcgaaagcaaccaaagcgaattagccaacagcaggtgaaagcattaaagcgattcactaattacctaagtgttcaatttaaggaaagaaagtggcagagcaatttttaaaaatcggacaaatccaatcggagcattgctaagggaagcgaaaacaaagcgaattaataacaaaggcaaaaataattaagtgctgaaaaccctttaaaatggcatttccattggaaataataataacaaatatgtaatttaagatgagcaaattttgttgaacggcgaagtggcggatgacacattaaaaggaccaaaattgggcgcaaaatttgttgaagggtttggaaggcgtttttggggcgaaagggaggaaataattggtaagacaagaaaaataattaactaactctcttttaaaaataataatttttattaatttgataattttgaaaaatcatcgaatttatcagctgaattattatgcc

SEQ ID NO: 5490 - DNA, 1404 bp, Heterodera glycines
  misc_feature (12)..(12): n is a, c, g, or t
gaacgaattatnttcaacgacccgcgaagacaaatgaaaaagcacaacagcagcagagaaatggggaaaagcgatgccaaaacatcggaaaaagaagacaaaagagagggaggagaaggcgaacaaagcgcgaaaaagtaattaaataattaaattaacagttatatttaaaaaataaaaaaataattaaggatgaaacaaacggaaccaattcaaccgacactcaaccatgaagcaacgattggcccacaacatttggccattcggcgaattcgctacccccaaatgatggagcagagaacgggcaaattcaattaattaattttataaaaattaaatagcttttcctattttgcctttttcaatttatcattccctttctcagctctttttcgtccctccgccgcttcgccgatgggtcggccgaagggaccgaagcgacacctttggcccgttttggccacaaattcgacaaaggtattttttgtatatttttggcattcctttaaatgagacaggaatttttaaggaactgattccagcaaatattgaccaaaaatggaacaatgccaaagaaaattggcgaggcgcctaccaaattcggagcggaaatgtggggaaaaattggcaaaatttgcgccaaacgaattactcatttatggacacaaaactaattcgacaacaaaaggtgaaaaatgcattaaaactaaagcaattaaaggttcaattttatcagcaaaatcccatcgcaattcgggcgctttccccgcgcagtcaaaacattcctccgacaactcgtcacgaattgcgcatcaaaaaattaagccgaaaagcaaattcgaatggaatacagacaaattcggcagttatgaaacagcagttgaaagctgaagaaagtcgagaaaaagtgaataaattgaaatattaaaatacattcaatttaagtatgtaatttaataaatatttatgaaattatcattaatgaattaattaattaagcaattattctcttcggtcggaagtgcctcaggcgctggtggttcgtttgcttctgccgaaccgcttgaagaagctggtcaaagcttcccaactttgtccaccattcttccccaggcgttgcctcaaatttcgacgcatccgttggaaaaagcgccgcaatttaaggcaaattttacacttcatattggattgacctattcagaatggaactaatttttgataattttctctccgttctaattttttgaccattttgcaattttgtttttttaagtttctttcgcttatcgatcggccaacggacgcggcaatccatcgccaaagtctgttcggcacggaaagcgttgggaatggtgccgaggaaaacgcaccgaagttgggcgatcggctgatggagtgttgcca

SEQ ID NO: 5491 - DNA, 939 bp, Heterodera glycines
  misc_feature (889)..(890): n is a, c, g, or t
ttgcttcttcttctgctgctgcttcttctgctcctctcgttgcttcttcttcctccgtttcttcggttgtgtacaccgcgagacagaaacaacaccacggcaaaaaagagcgcgaagcaaaagtaagtttttttcatttaaattaatattactattatttaaaaataataggggcgtatgtttgtggatgcgccagaggggtcgttcggaaaaagggttgcaaaaaacccgaaaaagggtaaatatgaagttgctaaaattttggcaacttcaacatatcggtgccggggagaacaaaggagaatgttctatgttgattggttaggtaataaataaataaatttcaaaattttttcataattccctttttcccaggatatactaatcaggagagctgggtcctctcggagtggatggacgcccaagagatcactgttgactttacagtcgacaatgtcatctcttgggtgtttgcttcactccggggggagcctgtgccggaggaggtagcggaaaagctgcgcaataacagtgaatatttagaaagtcggtttcatagaaattataatatctatacacaattccaaaacttttaagtgatgcgggagctcggacggaaccccgcgctcttttcaactcgaattggttttgcaaagggtgtaaagttggacgaaaaattggtgggttttaaaaatattatctataaattttcaaatctttttcatactcatttttatctgaatgattcggtgtgtccacagtctcgaattgtgggccccatttcattcctgttttggggacgaggcagacaaactgcacagtcttgaattgtgtggtctctgtcctcttaccctttctattctttcataaattgaactacattttttannatttgacaaaatgtatttaatttcaggtgacaacgaaattggatgcatt

SEQ ID NO: 5492 - DNA, 2042 bp, Heterodera glycines
aattcaattgctggatcagtgtatgccttttgggtggccatttccactatcatttatataataacaatcttattttcaattttttatttgtcctataaataaattaaatttttcgataattatacagagcgaaaattttccctccctcattccctactgtaccattggtacggtagggagtcccttgctcctttttttggtatttgttttgcttgggcttctcgtcgtcctccaggtacaattgagggttcaaatcctctaaatttttgatagctcttcaacatgggattgattatgagtcgctctcgttcccgttatcgttctcgtccgtctgctccgctcgccaaaccggcaatcgagatggtaagaaatatctttttattttattttttttatttactcctaaggtggaattttcgaacaaaagagatgttgttcgtcatcgtcgcaattttccggtaaaagatttgtgtgattttatctgattaaaattttaaccagccactggctattccccctcttcccaaaaaggaccataaaaccagcactgaagctggaaatagtgctggttttatcgaggacagttggatggctgaagttgtcaccaactgtgagcagcgtgctgctgatggtcaggtaaaccccaatttaaattaaatataaattttctttaataaaatttaagttcaaggctaatgcgaccatcgaaaaagaggtcgtcgatgacttgccggtgacgccgaatgacaatggaaaatacctcgacaaagaggtcgtcgatgacttgccggttaaaccgaaggataatggtaaatcccattatggtaagtgcctcccatttcatttatataataaagaatataaaatttttcagttttgaccaccatccctgaggaggaggaaaaggaaaaagaatgaggggcggacggacggatgaaagaatgagtgaatgaaaggattaagcaatgttgtaagcgataatataattcatcgatcaatttttgatttaaaataaggtattggtgaatataaatgaaaaattataatgaattggaaaatcccttcaccagttaattaggccaaactccttcacctcccctttcaaaatattgttccatgcgtagccacgagttttagttgaatcccttctttattgcgtcgcctcaaatatttcatttattttgtcaataaaaaattaatcaccaaaattagtgtccccgtaaggaattcccaggagcgaagcggcagaagtcgacatttcttcagctcccatttgatggttaatgtcgaaaaaattaataattattgaaaaaaaattattaaaatacgacaaaataccacatcagtcctccgtctgcgtttacagccatttgagagaaggcttcgccaagctcctccgtcgtggtgaacgaatgctcgtgaaactgttgctgcttctgctgatgttctgcacatacgcgtaggtgttgatgtagggcttcaatgtagagtttccccaaatgcttcactttttgaagcgattcgatttgcttctgttgcataatttccatctcttttttatggatttgttgttgctgctgcaacagcataatttgacgcttttggtgctgtttctggtggtgtttgataaaaaaggtccgagagtctgatcggtgatgggctaagataattgtgattaatgaaaagaataaaggtgagactaaaaggtttgaccttgactctattccttacctgcggaccagtgcgcgactcctcctatttggtgtcttttcttcggaatacccttgaagcgacggttatttggaggcatttttgtaaaataaatttaatagccaaataaacagaaatttaatgaacggaggaattgaagaattaaaaagccaacatgttgattaaattaggaaaatgggttatgaaccatctgcgcagagaactgctaccaatcgccattgcgtgacttaagtctttcaccacttcccgccttcatcactcagttgggacaaaagattaatgtttggaatatttaaaaataatttaatggg

SEQ ID NO: 5493 - DNA, 1880 bp, Heterodera glycines
atggatcaaatttggcctcatccttccttcgttttttggcatcgttcatttgtgatccagttaatcttgcaccatttttcgcacatcttgaaaccaacccccactcttccaatatccagccggcgtaccttctccttgttgtgaaataatttgtcccagtcatctgaaaaacattaataaattaagctaaaattttttttaacctgagcagagtcgaatcgccaacataaattgacccctcgtaattttccaaaggaaacggtcatcaactcgtggtttcttagcttctttcactccgtcctcgggtctttggtgttgcacaaattgctctgacatttttgatgatgtttcgcaagactgatttgattgctcgtgaaaaatcggcttaaatacctttgcaaagtgggcgtggcctaattttccgggagtataaaagaccctgcaatttgtcagctatgtctcattcgttctgctacaatggtcctcgtcatcgaattttgtgcccaaattctcggctgttccccgaaatcactccgcgacaagctgaatcatccggaggaccgggtgaaggcactgaaggagctgattggaaagaaggtccggacgacatacaaggatcggaatggaatgcagaaaacattttttatcgacggaatatcggaccaaggagcggctttgaccccgacgtatggcagactcagacaaccatacaacatcaacatagctgctcatttctacgctcgccaccgaatcaagctgcatctcccatacgtgccgtgtgttgttgagaaattttccggaagtggcgaagacagatactacccaatggaactaattgaaattgtggatgacgactacaaagagcgatggcttggcaaattgtttacggaaattgaggacgactcaattcatgtcaaacgatttggccgaattgaggaagccgaagaaattgacgacaacaatgatggtcgagatgaatgcagtcagtcagcatacatttattggtaagagacataaaattttactgtccttaattatgcacttttctacctaaaaatgacaagttcgtgcacataataaaaattgtatctttcactccttaattttaaacaaattgtaacttctttcgcttaattatgcatttttctacctaaaaatgacgttcccaaatgcttaataatttacaaaattgtaacttccattgcttaattctgcatgcatgttaatgtccttaattatgcatttttctacctaaaaatgacaagttcgtgcacataataaaaattgtatcttccactccttaataatttacaaattgtaacttctttctcttaattctgcatttttctacctaaaaatgacgttcccaaatgcttaataatttacaaattgtgtcttccattgcttaattatgcatgtatttttattaaaaacgcaaaaaaatgacaaaataacacaatttgaggtataaaatagagaaaataaaggggtacatgtgtggatacgtgtgtgtgtgtgtgagagagatacaatgaatggttaacaaataattacaaagtgtgaccgaaattaagcacattatagttggggcccactatccctttacctacatatcgtcgataacatttttggagggggcctgaagtgacgtgtccgccacccctaatgtcgggtctcaaaaagttagggtaaatcacatttattggctcatactctcctgtttcggcgtaccgcaacacttcttctttgaatgtgtcatagcagagggattggttctgcatcacgtcgtagttcagtgtgatgcccctcagcttcagcacaaattcttcctgtccatttcgccgaagtttaaagcccatactgaatcataaattgcaatt

SEQ ID NO: 5494 - DNA, 2754 bp, Heterodera glycines
  misc_feature (21)..(21): n is a, c, g, or t
aatgagcttctgcattattgntgccacggacgacttggacgaaatttgttcgagatttatttcgtgatgacccaagccaggaaagtaagcgaaaatttttaaatttttaatgacaacacaaaatttttagtcaattgccattgggaatttgtttgggcttctgcttgattttgcaaccagctcgccaactccttgggtgatgaaacggccaatatgctgcggaatattctaccgtcaacacatgccgctttctgctatttgataaaaaactaaaaaaaaatgatgcagacattaccatagattaaaaatttctcgctaaattgattttttgttttaaatattatgacaaacatttcttgtaatataatttttttttaatttccaaatatcaacattacttattttcaatttttctatgtttatttctttttcattgataaacaatctttttcggaaaaattcaataaataggtttttagttttattaaaattatttatttattaactaaaacaattttaaaatagcatattaaaattttattttcggtaaatatttttgtttttaacaattatttattcaaaatgatcagtttcgaaagtcggcttctgcaagtttatgaaataagttttttctaaattatactttaaaagtaaacaaacatttataagcattattcatcataatttattaatacaattcgaaaaattcaaagataacccgcgtgatttgaaatgatacaacgaaaaaatacaactctatctaacacatttaaaaaccttaatataaatcattattgcaattgagtacaactgagtaccgaagtcccggttttgaacagttttgaccggtaccgggaaattcccgggttttttccggttttcccagccaaaaagacccggtttttcaatccgaaaagtcccggtcctggttttgcccaagattcccggtcccgaccaaccctagctaaaaaggataaatggtctaccataaagttgaaagtctcagcccgagtagtttgaacaccaaacaaatgtgcctccactgaaagtcgcgctttcttttctgtgcttttccacaaactcaaaacatactgatcgttgaaactgtccagtagttggctttatatccattcttttattcctttaaaatatgtatacccaaagattatagaaattatgcttatattagttctcttttttataattttgatgttagaaataagatgcaattattaaatatttgcaattttcatctatttatttatttattacaatattttatcatctcgttgactcgctgtcatcgtttttagcataatcgagctcctttttagcccatagtgtcacatgaatttttgatattttatttcatttcattattttaattaaagtaaaataaattgtaatgggaaccgaaaaaacaaaaaccaactttaaattggaacattcattaaatttcaaaaattattaaaatattttgaggttttgtttaaattattctgatattatttatcattttttcaaattttagaataatatttctaatttattttactgaataatcgtttttttcagctgtgttctcttccaacaggttgattataataatgtgggtttcgacctcgataactgattttaccatactataaatagtcagtaatttactaataatttaattaacacaacattttattatatttattgcttaataaattaattactttaatttttaatcatttttcatatttacattatttattaaacatttcgaaattttagttacaatattcttttctaaaacataacaatcgaatatgcgaactcgttgcaagcgctgctggttctccctacaactttagagcccttcatttggtcctatttgaggtcaaacaactctccccagaatttcgatgaatccatcacatatttatttaaatttttaaatttattattttattatgtttattatttaagctattaatcacttcttgttagttttttaagattttaaaatttatcattgttattaaattgtttctaagaaaaatttcaaaatttttgttttttacaaatctttttaattggcagtttaaattgtggaaatttcataattgagttctataatgttacaatcacagatgatgtgttgcttatcaattttttcagctttcgcattcataggtttcatattcatacagaaaatgctcaatgtcaatttttatgttatattaattcgattattttataagaacaggtcagaggtcaagaatatttccttatatttttatttcgaatttttttatgtgaaataaataatttataataaatatcatttaactttaaattggacaaatttttattatggtatttaattttaaaaaatattttaagatttttgaatatgtttagttgtaatacaaatattatttatatagaattgtattcttattctgtatatccttatttagtttaattgacaagcttccattttattacatatcttcatttattagttttttaaaggcttgctccgatttaaatgaatatggtaaattcttttaaatactttattattttgtttctgttttttatacaaattatttcttttaaatataatatttttgttaaaaactctaaattttattaaatttcttggattttatttattaaaaaagtgagaatcgcattgtccggatcctcatttacttacttatgttcttttttagaaattttatattcatatattttttaaat

SEQ ID NO: 5495 - DNA, 830 bp, Heterodera glycines
tcactgacgaaatcatccactgtcgaatgtatttgaaagtaaataggcatttaaatatttaagttttttgcggtgagaaatagttaaattttatatactagtattatggtgcttaagccaatttttgaataaaataaattctcagctattaaaagtacccaaagaaaattgagcctgaaatatatgtagtcactgacgaaaatcactgacgaaaatattaaccacgttcaaatcacttattttctttagaaatatttctgtttttcaaataatccaacgaaaatccgcgtaaaatgtctaataagcaacaaaaggttggttttgagtttaaatgttgccatcggtgccttcttaacacaaattctttcagaacgcaaactttggacagagatggcaacttgaatcgaatacgtccggaagtgattcgaagacctttctttgggggcagccacctgattttggatttactgccaagactcggaatgatttggtcgggcctcttccgccctcacaaggcgtcagtccgtcgaaaaaaaagccgagttcaaagagtcgtgtagacgcattccgtcccccgtgggaggacagttcggaggaagaaaaggagggcaccgcgacagagggaaagggcacggaggaaaagcgctgggacatggaagagagtgggtgggggcagcgcacgacggaacaggtttttttacacagggttgaataattggagacttttgtaggcccaatttcaatcaaaccccccccccccccaaaatacaagaaagtaaaaatttttggctctagtgcactttatgagtccaattgagttttatgagtcc

SEQ ID NO: 5496 - DNA, 1015 bp, Heterodera glycines
tggtttcgtttctctcattctcttcgatgcttaggtcggaagttcgtccgttccgaatgctgaagtcacaaatgtcgcaagtacttccgtcgatgttgaccaaaacaaagacaaaaaccgagtggcccagcagcctttcttcggtcggcggcgacgtgtcgtcagcgcttttgagaagatcgttttccgctcggctaattccggcctcaccattctcatgcccagggtcacttaaataccaaatatgaattatttgtatggtgtttaaacacagactactgaaaacagaaaaagcaacggggacagtcttatgaaaacccctttttctggcattgtatcattctgtgttcctttcttaggaccaccccgatttggcggcggcctttcgaattgcttccgagacgtactcccacgggtacaacactgccaacgcgtcaaaggcgttggaccgattcgtcaagcgcaaattgctttgcgtcgagcaaatgcaatgtttggcgaaggaggcgcctacggcttggaattcgacggtgcaaatttgcagaaaattcatcacagtgccgtcaatcggcgtacaaaacaccaaattcgaagggcacggggcgacgctcaaagaagcggtggacaattgcgacttggccattctgtacgaactgttcgactttgacgtgatcaaggaggccaacgtggagataaacaacatgcaacgaaaggtgaacgaatgggggaggcaaaacaaaaacaatggcaggaggggggaatcggggactgaaaatgccaaaaagaaattcgtttatttattggcatttcggtgcgtttctattgtcttctttaagttagaatctgttggatacggcgcgaaaattggacttgaagacgcaggcctggctcgactgttctacggaaaaattcgccaaaaaactaaaagaaatttccgagcgcaaagaactcttctattgatatttctttaccgagttggcatcgtttcagtttgcatgtgatatgatattccttt

SEQ ID NO: 5497 - DNA, 2484 bp, Heterodera glycines
cattcatccgtttgtttttgctcacttcgccaatttggtgcacacggtatcgtccatgcaatagaagtaagtgccggagagattctcggccctatcggacagcagcagttgcatcgactcgaccattatggaggcaaaattgccggcataaatctggcattgtgtgccttagtttggccaaatgccctcgcgaatggcattctgtccccctttttagtgatcccgtccctctcacatattgcaacattccatttgatggcccggcaatttcgttgatctgtccgtgccgttccgcaacttttttaagtgccattggcaatctcttctccccttcgccgtacacaaaagtcggacggaggaaaagtgcgtggaagggctgtccttaacaaattggcaatttgtcataattaataatttgccatatttattttcacttcgcaccgtttggaaggattttcccgcatttttctcgcccggccaattcggcctttatccgcgtctctccgtaatggccaagcaaaaatttggagggcaatccgcgatggatgtgctcagcgcttccaaagttgtcgcccgggggaatgttggcaaaggcatcggaaagggagagaaaaaatgtgaaaaaggaggaaggaatttggaattaattaggaagaaagtgccaatggacggacatagacaaatttggcaaaattcgatttgagttccgtttttcattttgcaaatgattatttacgttaggtccactatttttattttgtttattttattcacctccgacatggaccaatcgcggaacggagcatttgaaaatggtgttgagaagcgaatgagtggcttaagtattattaaaatggcaaagtgtgccaattcaatcgaaaaccttccaaattgtctctgctgtagcgatcattcagtgctttttgatcagcgaagaaaatatattcgaaagcctttctggccaaatggaataacacgtcgacaccatccaatgccttttcaagtttggcaatatccagcaaatcgcattggaaatgaatgagtgagggaaaaccgacggaggaaggagggcaatcatctgaagaagaacaaactgaaattaggaggggggaaggtaaaaacgacattaaaagggccgtccctgtccttacatcctgccaaattacccaccaattgttccgagctgtctgaacggctttctgtcgatggttctgatttcgtccacatttgcgtctgccctcaggcgtttgatgagatgagcggcgagaaagccactgccaccggtgatggcaactttgacgcccatttgtgaacagtttggagaaatgaagaacacttcacggtcgaatggcccgttgaatgaggggaaaggcgagcgaagtttaaggaatatttaaaatgaaaaagtgacgttcgccaaaaaggggagggggcgggggaaatgagggagaacaaagatggaagaatgggggcggggaaaggacaaagatggaaaaagagggggggggggagatggagcagatgagatcctaatctgtctgtcgcttctgtcgttcttgccctgccccactcgcaaaactcgcgcagcaaattggaggagtcgaagtcactccgccgccacgccaattgctccccatcggtcgtcgacgtccgatcgatgcaatttgagaggcattgggggaagagcagcagccgatccaacagcagcaaaatgcgcagttgcaaatgacggggaaattttgaatttggaggcatttgccaccaaaacgatcggaccgaccgaaagctcaaaattgacaccaacaggcaataatttatttgatggcttcatagaagcaaataaatgcggaaatgcaagcaaaataaatgataaagcgagtggcaaatccgatcaatcaatccaatgccaatgatcaatcatcttcagatcgcttcttccgccgatcaattccctttgaccagagtcaaaagtccgtctttgtacggcccggaacagttgctttcgatggccttctccagcggagtgttgaacatttgcatgaactgctcctaaaccaggccaattagcagaggatcgattaaatccatcgtttgtccttttcactcactttgatctcgaccatatcgcactcggcacgagtgacaatcagtcggatcaagtccgagtcgcgcctgccaatgccgaggaagcttttggtcgagttttggagcactttggcgaagaaggcgtgccgattgtgcacacattccaccaccgccaaataactgaagcaaggcaaatcgtttgaatttgccattgtccactgcctccccttccttcttttcctctttttgccattatccgcctccccccccccccttttccccccaaataaaccgacccgtccctcgtgtctccgctgaactgttgctgaattgcctgctcaatgggatgaccgatgacccttctgatactccccaaaaatcaaatgcaactgaacaaaa

SEQ ID NO: 5498 - DNA, 702 bp, Heterodera glycines
gagagggagagaggggagagaggtaatagggaaaggaaaagccaaagagagtgagagaggggagagagataataggaaaggaaaagccaaagagagtgagagaggggagagagataatagggaaaggaaaacccaaagagagtgagagaggggagagagataatagggaaaggaaaagccaaagagagtgagagaggggagagaggtaatagggaaaggaaaagccaaagagagtgagagaggggagagagataatagggaaaggaaaagccaaagagagtgagagaggggagagagataatagggaaaggaaaagccaaagagagtgagagaggggagagagataatagggaaaggaaaagccaaagagagtgagagaggggagagaggtaatagggaaaggaaaagccaaagagagggagagaggggagagaggtaatagggaaaggaaaagccaaagagagtgagagaggggagagagataatagggaaaggaaaagccaaagagagtgagagaggggagagaggtaatagggaaaggaaaagccaaagagagtgagagaggggagagagataatagggaaaggaaaagccaaagagagtgagagaggggagagagataatagggaaaggaaaagccaaagagagtgagagaggggagagaggtaatagggaaaggaaaagccaaagagagtgagagag

SEQ ID NO: 5499 - DNA, 2082 bp, Heterodera glycines
ttaagcccggtggaaaaatctgcgcataatcttgctgttctcatttgcctttttgaccaccaaaatgggtgctgaccaatcggtatgatcaaccggggtgataacttttaatttctccaatcgatccatttcggcatttattgtcggcagagttgcgtaaggaacaggacgggcgcgtttaaaaataggatttgcgccggatttgagcatcaattggcccttcattttggtgcagagtccaaggccctcagagaaaatttgcttatatttgttctcaaaatttgcaattgtgtcccgaatttttgttgaatcagtggaccaaatctgattaatatttttggtgccgatcagccgcttcatttcttccagaaatccaaaacggtccaaagcagtcaggcccaaaagattaattgttccacttttggccacataatatggtagctccgttcggattccgttgaattggaagttggcaacaccgcggccaaggaatttgcagcgcgtgccgtcaaaaaatctcccttcttcctgacacgcctgaattggtggtcgtccaatatcattgtacgtctgattggtgacgacaattatttctgtgccgctgtccaaaacgaaatcgattgatttgtcgttcattaaaattggtgcattcattagacccgccgattgaacggaattgatgaaagtgtcgggcaacatcacaatattcacttttggattttggctcctcttatttttgtgatatgcctgaattttgtcacactgtcgctcgatgtgcccgctcctctggcattttctgcacacattattcttctttgggcaattttgggcccagtgaagctctccgcaacggaagcaattgttcggaggatttttgcgttttgatgtgcttgaaattttgtgtgatcgactgaaatttgtttgattttgttgttttgtcggtgatgatttagtgtgctgcactgcatttattttaagcttcggctgttccaaaaattttgcctccgcttcagttttaagcactgtattcaaatcatcaacaaccgaatcaaacaacttggccgttttgttgaccttcgcatcttcgacagttagacgggcaagaatgtgttgtcgtaatttggcatcactcgaggatttgagtgaagtcagaagaaccaggcacttaaattgctcctcatttaattctgagtagcgaaattttcgaagcagcgcctttaaacggttcacaaacgcgccaaattcttcgccatcgtctctgcatgccttaagacattcgtatcggtcgattgccaatgatggcggatgcgagaataattttagcagtcgggattttgtgtccgcaaaattgaatttcgtgatttcgtccggtagacaaaagcgcttgtactcgctgaacgccgtcggagacaatttggtcatcaacaatttgaccttctgttcatcgtccaaatttgaggcagcacaatccaaagcaaattggaaacgttccagccactcctcgaattcttcagcactgttcggagaaaatgtctgaatgtcaggtaatgtgatgttctgtgctgtttgtgttgtggagggcgccttttgttgctttattgcctgggtgagtttttccaaaatatcggcgagagttttgtccatcttgattgacgatttgaaattgtgacgaattaaaaccacagatagtggaaccgcaaccgcataggtatcttggttttttgatgattccgcgaaatttaaaaatcagcacgagatttttaaatttcccaaaacaagcaattcaacacgagaattgcttgaaaattgatgagttcgggcgtcgccaatgttgtgcctttagggtcacaaacaaatgttgttgaatacaaaatatttattaaaacaacaacaaaataaaaagcagaatttggagaataatttggggtcaatatttagcggagcacaatatttaagcgagtccaaaggagaaccaaaaagagaatgaattggggaaaagaggggaagagacttaatgagcagaatgggcaaaatcaatagtacaaaggacatggaaaagaggaatgataaacaaacatcatt

SEQ ID NO: 5500 - DNA, 6758 bp, Heterodera glycines
  misc_feature (6672)..(6672): n is a, c, g, or t
ccgaaattttcaaagaaacatagtattttgctgcgccggcggacccactgtccccaaagttttttggaagcgcgccacaaaaatgtagaaaagcaaaaaaaaaaaaagggtcatcgcccggggttacccccccccccaagccgaaatcctgggaccgtccctgagttcagggcctactggacaactaataataatagaacttaaattattccgactttcaactttaggattcctacaattaaaatgtttttagctggacttatgaaaatttttccgtataaaaatgatccccgcttgacttcttttaatcccttaaattttgagcaaaatccttttttttgtcagaaactgacaacagacactacgcccacgtggattgtccgggccatgcggactacatcaagaacatgatcaccggcgcagcacaaatggagggcaccattttggtggtggccatcactgatggaccaatgccacaggtaaaagagggaaaaggggacggacagaacggaacgagtggcaaattggcaaggaatggataacatggggagagagaggtgttgtgacgggagcagtaggttcggttcccccccccccgcccgtatcagtccgcccccaagaaatttttgtttttttctttattaacttggtaatttaaaaaaaaattgttgaaatttttttcttggaatttccgtataagaaaacattaaatttttataagttaattaattttaaaaaaataaaattttctcggatgtgtgggggaaattgcggtggtttttatgtcaatacacgtccggctcgtttccataattgtaagaggatggatcctcccgtttcgtttcggctttcaggggcataacaaattccacacccacccaccctacccacattcaaaattattttgacacagaatttttaatgttttggcggcatattaaaatgcaaaaacatttctcttctattttgtagacccgtgaacatttgctgttggcacgtcagtgtggcattccgcaggagaacatttgcgtgtttctgaacaaagtggacgaagtcagcgacgccgagacgcgcgaattggtcgaaatggaggtttgacgtatttgttacaaaacttgtacattcaatcactcccatttgtcaggtgcgcgaactgctcaacgagttcggctacccgggtgacacggctccgatcattgcaggttcggcactgtgcgccttggagggcacaaagccggagcttggggaggagtcggtgaagcaactgttggacacaatagacaacttttcgatcccaaagcgaacaaaagaggacgagccatggatgccggcggagaaagtatacacaatcaaaggtgaaaatcggggggaaagtggggaggagagagcaattttccattttaaaataaaaaggattgaaatgcccgtccatctttcgcattttaggccgtggtacggtgatcaccggcaaattggagcagggcactctgaaaaagaacgacaaagtgaccattgttggactgggcaaaaaattggacaccacaatcgccggtaaacccaatggtttactctcgtattttaaattcataattttgtttataggcttggaaacattccgcaaaacagttgatcaggcggagcccggagaccaattgggtgagtgatttaacgaacaattgacacatttaagtaattaatttaaaaaaaactgaaataccggagtaggtcgtttccaaaaaattttattgaaatttcaaagatttggaaaaaattttaaatctccaatatttttgcccgttccttccacccgtttttgttcaggagttctcctcaagggccttggtccgaaggacgtgcgcaggggaagtgtgctgctcaaacagggccaagacgcacattttacggacaaagttcgagcgcaggtgagcgaaatacaatggccgtttttctagaccacggtttcttaaacatttttttagtttaactgctaacaataagttctttatcggcaccgccgggcttctcccccccccccctcaattccccaaaattttttttgtgaaaaaccgcgccgaaaaagtctgaatagcaaaaaaaaaacagcagaagaaaaaattagaccttcgtatgaaaatcggccccgaggtttttatgtttttttaaattacgaaattttcaaaagctgattttcctgtcatcaaaaaatttcatgtcattctgttaatgattaagaaaatcagcatttttaaatattttaactcattgggttttcattgtttgctaacaataaacaaaacacacgctttcacagatttacttgctgaaaccggaggagggcggctccaaaatgccgttggcccacatgttcaaggagcacatgttttcattgacatgggactcggcggccaccgttatgttgcagggccgtgacttcgtcatgccgggcgaggtgggaattgtctggcaaattggtcaccgcatttaaaagaggggctatttaaaaaaattttcttcaattgcttattatagtaatattattttcattgtttcccttccccctttagactgttgagctcgagtttctgttcaagtactgtttggcggagtgttcaaatgcacccatttcctcttccaccccctttttaaagcactccccaatttgttcgtccccaacagcgtttcactctccgccatgacaaaaccacaagttggttttgtatatttgttatgaaatgggcagttgcctcgaaaaaacgaaaattcaattccaattgccgattaattaatataattaattgattgaattctttgtgtgtgtattgtgtagcacttttccgttttcagtcgcctgcggcgtctttttggaggctcttcccgagtcggagggcgaaattcgcgacaaaaagtggaggaaaatgcaaatgcgaggagtgatggaaagtaaggccttttgaaaatcaaaaattgtttatttgtgttcggtcctttccttttcatcgtatttctgttttctcatttttcaggggttggtttcaatccgttcggcaaccgatcgtttgagcgagcgtgcaaagtgagttttattcgctgcccaatttcattcattttaaccaggcacataagcagagggatatggcagttctcctcccccacaaattttttcggaaatgtttaattttaattttcagcaattttaccctacattttccctggcgttgcctaacatcactgccggatcccaattttcttatatttgtgtcatacattaacaaggggtgcgtcggcgcacccccccccccccacgtgcgtcgtaagggggcggctgtaaaggaggggaggaggtcgtaacgaagggggaaaaagttaaaatttgaacaatttccgtagtgaaacccatagaaaattcaacaaaattttcccggcggcgcctatcggcaccgccggaccgccccaccccttcccacgaagttttttggaaaaaacgcgccgcaaaaaggtttgaatagcaacaacaacaaaaaaaggtcgccggggaaaaatagggaccgacgtaagaaaaagttggtcctggcgcacccccctgcgccaaacgtccgacgtatgggggtctgactggcgcaccccttgttactgtatgatttgtgttaaaattttgtttcgaaatggctacaaatttcccctttctcacaaagccagaaacttttgaaattaatccctccccctttcgctttcagcctgactataccaattcgccgaaggacaacccggccgaggcattgttcaaagccgaggcaaaagcctagaaagaactttagcgaggggatgactttagatgaaggatttgttttttcattaattaaatcactcatttccgtttcatttatttggcgttctgtttttattccatgataaattcctctttaccaatcattgcttttgctgattccctctatagtaagattctcccccccccccctaactcacttctgagcaaatttaagactttttagagagtgttacgggcgacagttgggtctatcgacgcataatcttaagtgctataaaggaaaaacacgggttttcctaaatgtttagaactgttcgaaaaactaaccaaaaatcgcactttttttgtatgacctatttttgaacggtttttcataccttaaaaaattcaaatcaaaaatcgaaacaatttcgcatgctatacaaagtgttggctttcagatgataccacatctttttaaatttcttttttccctttttcgggattatcgtgccttaaatgccttttttggcatttttccattttggtgttatttttggcgtttttacgaaaaatccattaaaaatgcaataaaatcgggaaaatgcaccctaagaaatgacccgaaatttttttagaaaacacacccccttagaattgaagatttttttttcaatagacctctaagaaatgagaaatttctcaaaaattaatctccaaaataatatattttttgataaaaattttggtttaattatcaccaaaattatctgcgataagggcggagggaatggaatataaaagggacgaatgaatgaccaatgaaacgaaatgaattcgcctttttggcgcttatctccgcgccgacgaataaacgcggaaaatgaatgaatgttttgattttgtgcatttatttactctcctttttcacctctgtgtgcattaaattaaattgcccaaagtttaattagtaatttttaaatgcaaaaatatttttgttttaaaaattgttttgggaacaaatagaaaataaggggaaatgcaaacaaaatcatctttgcatatttaagttaagcctgtaatttataaaacaatttaattcattaaccaaaatgaatattaaattaaaccaaaaaagtaaaaattgcagaaaataatgatagattattaataaaccaaacgcttttctcattaactaaatgcactcattaaaaaggacaaattttgcaatattattttttatgcggcatttttttttaattcgagaaaaattttttaaaaaatttctttccatgcctttggttttgccaataattatttcatttttaataaataaatttcccagaaattcctcccacttttaaatgaaattgcttatttttgatgattacgaggcgatgagcgctttcggcgcccaattggtcgctcgaaggataaacaacgctttggaacaacgaaaagtcactgccggcgcagcgaatgtgccaaatgggcgctctctgtactcagttggccttcccaccggtgggaaaaaatttggctttctgagaggccattagcgctactgcaatgcataataatcagaaatttctgactatgaaaagcctaaaattgtcattttttggacaaccgccgagaaatccaaaaagatgcattttttctggctgttcttttgtgtaattggtctttttaatcacttcctgattactttttcaatctgatcatttgctctcaatagaaatcatctctgattatttgtcggtcttgtgccattgttgaccgatttttgccatttcgttttcgactaaaccgtcacacgaattgctactctttctgatcagtttttccgatcatttttcaggtggcacccctctgggcttgtactgtaagctgacagagatgcacaaggctggccaagtgtcgtttgccaatgttgtcaccttcaacatggacgagtaggaaaaaacgggcgcattattagtgccactttgcgtgatctaattcaaaccgaaccagcagcagcagttaaatctgctgatcggttttcgaggcgccatttgattttttgatcagagtccaaatccggcactattccaacagttgaaatatattaaccgattttaaatgaattctttagtcatgaattgatagaaaatgtcttttttgcttatcctaagatatgttggcattccgcgcaaccatccgcacagttaccacacattcatgttctccaatttcttccggtgagtacatattttgaaaggatagaaacattttgaagggaaaaatggatgaaaaatccttctaaaaagtgccaaagttgaagaattaccttatttgcctctgatcaattattcactgatcgcccccaattttccctttaggcacattgacatcgatccgtccaatgtttggtttttgtccctccgccactaattttgtgcccccccctcccctcaaaaggtgcatattccgaatggaaacgccgccgatctgaccgcggaatgcgcaaactacgagtaagaaaggcgacacgatttgctgttcaataaattgacgccttttcactattttaggcgttcaatcgccgccgccggaggcattgatttgtttgtgtccggtgagtgattgaaaaagcatggaacattgtgttgaggttttgatctgtctgtttggtccaacttaagctctgatcagttggcctggcaatttgacacaaatgtcattctttctgccaattttaggatggcataatacgcacaaaaatgcttttttagcttggtttttgatgcttataggacactttttatgtcctccctttgtgcccttttcttgtgccattctcaaactgacaacttagtgatcagttcttgtttgtctttcctgatcaactttttgtctgatcnaccttaattgtatctctgttatcactcggccttgtctgttttatctaattttcggatcagtcatctgctgatctcgtctgattttc

SEQ ID NO: 5501 - DNA, 1541 bp, Heterodera glycines
ggcaatgttttgcctgtttctgttcgtcctgtcgccctccctttttccccaccgtccgccgtcgtccgtccgttcgctttcttccacgccgttgcgacctttgactctttctttgtcaactcattcgctcgcgacattaatcactctgttaatatttggaaatctgtcggcggaagggtcgctcaaaaaagcgacccccggcctttgctgataaaatcgtatctgtttgatcattgatcggtgcttgcatgagctttaataatctgattggactgggatctggtcccccggtcgttttacttcataggaaggcaggtaaaaattggtaaattcggcttttctcttgaaagttaaatgccgtgatttgccacaacaaatgccggtggattctgttcgttttgtattgcccaacaaaatgacgaggtccgtccaattttcggctttctttcgattctcgagaagagtgggatgacgacaatcactcgacaatattagcttttctgtttgtttagcagcagcagcaaagtgcactcggatgaacgaaaaaaagcactgacaaaaaatgaattgaatgataaatcatgacaaggcggcgccattctttggaattcgtatcattatttaattacctatgtaattaattacattcattgctttttgttttcatatgcccggacgtgtcaaaaattaaatttattatttttaggatttattaaatttttccttttatttaaattttttaaaattattatattactatgtgttattttatcccggtcaattagctaaattagtaaattaattagactttcgcattcctttaaggtgtgataattacctaattaaaattaaattaattaaattctctctcctctgccttcttttttcctttctctctctctctctctttctccttcactttttctctcttctttgctttttttctgttgttcaagtattacactatgggtcaactccactgtgcagaaaaaagcttagtactatctcgtcgtttctctttttctttgtaatttctctcacttaaccgtactatctcttcaatttttaatggaaaaaataacatttacttcatcatgtttaactttttttctgcttgttaaattcacaacatagagaaaaaaattctgaattgatttatgcaaacattactttaaagttataaaataaaacataaaaatgtatttattttcctctgattttggcgtactattttcatgtctaacacattaaatataaaattctaataattttgcttatacggatagaaaatcactttggacctttagaatcaatagaaaaatcattttgtttagcattttggtcaaaaactgcggcctaagacttgagttataacgtaatgaaaattgaaagacgcataacctttctcttatgcgccaaattgcttagcattcgcttagaaaaagattcttattttcaaatactttttttagatatcgaatttgttcagtttaattgggaatgaagcgagttacggctgatcaaaataaacaatacaaaaa

SEQ ID NO: 5502 - DNA, 4279 bp, Heterodera glycines
ccaaaatttgctaacaaaaatgcaataaaacagaaaaatacacccctaagaaccgacccaaaatttttttcaaaaaatacatccctaagaatcgaccagaaaattttcaaaaatgcgcccctaagaaatgaaaaatttctcaaaaatttatctccaaaatttatttattttattttcttgacgataatttttgattttgaaaattatgtatatccttaatgacttggcaaaatatttttgctttttgatgaaaattttcgattttacaccccctaaattcggaactttttggcacctattttcccatttttagcacctattttgggggttttttagaacctaaaacctacttattttggcagtttttagcacctaaaaatcgaagccctaataattagggttcggaccccgtgggcgggggtggcttttcacgggggcgggggatggcgggggtcagagtcgcgggggcggggacgggggcacgataattccgcccccgcgggggcgggggcgggggtttgatttgaattaactccaaaaaattttacaaaaaattaattttttatgaatgatgtgatggctccacattcctttagtcaatgtatcgcctcaattcaattccttttggcataaattacacagattttgtctaaagaattaccaaattttagagatttttggctaattttttaagaaaaaataggtttttggggggccggcggtgccgataggccgcctggcgaattttgaaatttaagctcgatttctaacagatgtttacaaaaaaaaataagatttttacgataaatttttgtttttttaatatattaaattatcatgatttactcaagcaaaattggaactcagatttgtaacatattttcttgaggcacatttttccaaaaaaaaaaaaaaaacttggtgaatgtgcgagcgtagaggtccggcggtgccgataggcgccgccgggaatgttaatagattttgtccaaaaaatgataggtttttgcaatttttagagaatttttttaataagatttacgaatttttgggccctgcgatgccgataggcagcgccaggcgaattttaaaattaaaaaaataaattaaaaaagaaacggtcaacctgaatcgaactcacgacagaaagtaatgtcaaggttgattcactaaccactacaccacactacactccaatgaccaataataaaattaactttaattcataaaaaaattgtcaaaatggttaaaaaaatcaaaattgtataaattttttgccttttatcaatgaatatgtcattcttaggggtgcattttcacccccgcgcccccgcgggggtgaaggtcgtgggggcgggggatggcgggggtcagagtcgcgggggcgggggtgaggccaaaaaacctgtcccgcccccgtcgggggcgggggtgacgggggcggggtccgaaccctacaaaaaagcatttagcagtgtaaattttgaattagcgcgcaaaaaattacgccaattacatggcgaaatgtataattcctttttttcatttaaatttttaaaatgatgacaaaattactttgaaagtttagctgtttatttaaaattccctttcaattaaaattcttattctttgacaattcacaattttttgttttttcaagcttcagcaaaatgacctcgcaaggagttgaaaattatttaaaggaccaaacgatctctgacattccgacgatcgcggaaggctttcaaaacttgatgaatctttacatcaacaagtaagcaaaagttaggtgcaagtttatgcgtccaataatgactagagctgggaatttaagtcaaatgacttttttttttgctgactctaaatggccttaaaatgacttaaaaagtgtttctaaactttttttttgaagcttctaacatgcattttttgtgactttttttgacttttttaaactttgggatttttatgactttcgagtttttgcgacttttttcgtgatttttttgaagcaaaatttgaattttagcgaagaaaattccgaaaaataaaatttcgatcgataaaaaggcaatgaaacctggatgaattttttcttaattgttggaagaatcttttttatgcctattttaggacctatttataaaattaagtgcctaaaaatacgatcaaaatggtattttataaattattaaaatggaatttttttaacgttggcctaatttttcaggacttttttgcatttttacgtgtttttttggatttttttgtgctttttggctattttttctggacttttttttatgacttttttagtcgactttttgaagatttttaatgacttaaattcccagccctaataatgacatcctcagtttcttagactataactttttattacatctctaaatattttgtttattttaatgcttttccaggctttggaaccaactctccgccgaggccagtcagctcgtacgtaacaaattgtttgtgtcgacagtgaatcttttccaattttacgaggttaatgcatttatttttgaaaaatataaaataaaaaaatgaaaattttgctcgttgacaattgaacgttttctttccattttaaggaatttgtcagagacttcgagcggcgcattgagccattgcaattaattgagctgattacgccaattgccgaggacatttttgaaaggggtgagcgacaatgatatttccataaaaaattaacaatttgcagacagacaatcggcctacacttttctggacaacttcgataaagtgatcaagcaggacaaaagggccatcgttcggctggaggccagcaaaattcagctccgtctcagagacaaaccgacggccgaggcgaaatgttgcaatgacccggcattggttcgggtaaaatattagcgaatgttcccgaaatgacaactaattattgtggtagaaaatgttggaagaagcgaagacaatggtcgaccaactcgtcgaagtcggctcggtccacgccgcttactacggatgttcggcggagtaccaattccaaatgggcgaccacgaccgttactatgaagaggttggagttttgttcatttttaattgaaaatgcttcaaaaacccattaggcccttcattatctcggctgtgaagacattaacgtgaaattgagcacggaacagaagcgacaacaagccgagaaaatcagcatttcggcactccttggcgaaaacgtgtacaactttggcgagctggtcagttgttcataaactaatccgttttgccattccctctgcttcatttgtaaaattcgggttttttttattgaaataatttttaatggatagaaaatgatttaaaaacggaggagtagcaaaattatgcaaattattacaattttatgctaactaattcctcagtgatttttcttttttgagttggcccatccaattttgaacgatttgtccgacacgccaaacgcttggcttaacgaacttttgcacgcggtgaacgccggcgattgggacggttttttgaaggtttgtcaatggaatagcaaagcccagctattttctactattttcttttaagcacaaagagaaattggtcgccgcttattcggaggcagggcaaaaaattgaggcattggaacggaaattgcgcctccaatgtttgatcgaggtaagtgttgttttgggagattgtcgaatattgtatttattattcatttctgccaaattaaaattgcctcaattttcagttggcgcaccgattgccggcccaacgacgtgacctcaatttcggggacattgctcgtgttgtccgagcggatgaggacgcggtggaactgttggtcatgaaggcggttgccaacaaactcatcgatgccaaaattgacgatccttcgcgcgtggtcaacgtcagctgggtgcagccgcgggtgctttccattgaacaggtgaaaaacgatgctgggaatgaagtcaaaggggtggaataggcttttcctcactttagggacaattaaaatttcgtataataataaattttatttgttgttcactcattaaacaaaaccccaattaacagctcaaagctttggcgggtcggacgggcaattggtgcaaaaacgttggcgggctgaaggaagagctccaattgaacactaaggacttgatcatttaaacaattatcatttgtgtgtgtatttgaaacaacccaaatatgttgtctgcttgaataaactccgaaattaaattatataaatggccgatcaaat

SEQ ID NO: 5503 - DNA, 1059 bp, Heterodera glycines
  misc_feature (20)..(20): n is a, c, g, or t
tgcggttttcatgatatttntggatgaattaatttagtcatttttaaattaccttcaattgattcgcgcatgttcctgtcgattaacaatcgcacgcgaaatttttttattcataatttctaccaattcatttaatattttaaaattaaaggatattaggtcaacccgtaaaaatataccacagattatgatattatattttgttttctattcaaaaatttaaaaatgaatattagcttagtcatatgtataaattggtgaaattggttgggttctaaaattgtttaaattctaattcataataacaatttaacttttttgcatattcatgtcagtcagtaataaatgatttttattctttcgtttgggatgcagtggattttctggaattaaaacatttacgataaaaggtaactttaaaactcgacaaatgaaatatgattaaatttctatttgaaaattattttcaatatcgcgggttatttgttttgtaattatttttttattcaatttaattttaatttacgcattcatatttaattatatcatttttcttatctgctgccatactggagaaaatttatgcattatttagtaatttatagactttaaatttatattaccaggatacacttatttttacaaaaatattaatactattaaacttttttttgtttagagtaaagaatttgattacagctttcgtaataacatcattaactttttttatgaatttcgtttagtatgcgtaatatatataaatagcatttacttcattttacaaaattatgtatcaaatttaaaaaaaaatacttttagttttatttattttgcatttagttagatctatagaaggcgataatatatagttacattaattaatttatatgatatcatgtgtgtgaccaaatttaagattccgtgtaccatgggatgaactttcgtcgacatccgcattctaataatttcattttaatgtataactaaaatacccatttatattacgaatctttacattttgtctaataattatatttttaatttttattaatattatat

SEQ ID NO: 5504 - DNA, 4224 bp, Heterodera glycines
aaacaattagtaaatttaattaaaatataaaatgatatggttataatttattgaagtgcatttcttttaccggctaactgtgatgaattttgaagaattttatttattctgcgttttgaaatgtaaaatttgggaaagaacaacggatttttcgatatattaatgaatatcaactctttatttagtgaagtataattgggcaagagtaaaacttttaaattaaaatttttcattattttattaatattataatatttattgacttattagttgtaaattattttatcaatattatgctgctaataaaatatttacataaaatttagtttgaatatcagtagtcattttaatttttaaaaataatgctttaaaaatttaatatacaaagtatgaaatattcaaaagtaaacataaaaagtgaaagaaaattctcatacaaattaagaataatttaaatacattttgactgaaataaaaagaggaatactttttatattactcctaataaattacaattttatagataaaaaatattacattataatattttttagttatcaattatttatgaagtttcttctattttacgagttttctttttatcacaaagtaatcaatgacttaagtgacttcagatcagtttcctagactcaattggtcgcgcctcgacattcaaattaaaataaaaaattttactattaaagtaatatattgttaaaaagctattaaagcataaatcattgaatttttcttaatgttttaagttattttcatttatataaaattattttaatcaaaacaataaaaaataataaaatagaaattttttttaataaattaaatttcaaaataaattattcttgtttaaaattacattaaataacaataattagctataaaaatgaacataaagaataagaaatataaaatcaaaaaagaaactgaattaaataaaaaataggcaactttttcggcaatctcattcgataatataataaaataatttaactcaatcctagtttaaaactaaactaaattaatgttgaccaaaattattattttaaagaatcaaatcttccctgatatcagctaattgcactacattaagaacaaataaatgagaacgcttaaacaaaattaaaataaaactattaattgctataattaaattatttttcaaattgaggaatttatggataataaaggagtttttatatacgcagaatggcttgtgtgcatgatcatggacacacacctggaaaacttataaatttaaagaaaaaatttatttctgaaaaaataggaataaaattaaacaaaaaaatgaattcaaatgaattggtaaaacaagtaatttgaggacgaattaccaactaattaatcccaaaaaagggaatataaaaacacaaatcacgataagattccaacaattctatgcaacttgcatgaacaaattatgtttagactacccttaaaaaaattttttttagaacacaagtagtataaggttacatttacacgtgtccaaattccctcccccgcccaaaaaacacccatttttttaccaatgttttttaatgtcgagaccacccagggtgatcccaacggccggggtccatacccatgagaggatttaattcacccacaagtcagggggcccgaacccaagagccaaatccagagtacaaccaacagaccatggatagtgttaacagaaaaaggataagtgtcatatatgtatgattaaaataaccaatgattttttgtcccaagggccggggtccatacccatgagaggatttaattcaattaattcacccacaagtcagaggacccgaacccaagagccaaatccagagcacaaccaacagaacaaggatagtgttggcagaaaaaggataaatgtcttatatgtgtgatttaaaatcacccaatcccgggtgccggggtccataacccatgagacaatttaattcgattaattcgaccacaaacaaaagggcccgaaccagagagtcgaatccaaaacactaccactcggacagcggtacagttatccgaaaaaggaaaatgtcagctatgtatgattaaattaaaaataattcaccacaaacaaccgaaccccagggtttttgtcccagagaccggggtctaaacccacgagaggattcatttaattaattcaccaaaaaacaattcttttaatttaaattaatctccagctaacatgggataccccaattccaaaacactaccattggccaaggatatacttatccaaaaaaaaaggataatcgttttaatataattttgattggtccatccaaagatggaattaatcaattgaaattcggtgaaggggtgggggtggggtgggggaagaaagatgtgtaaaatgcactcacatgggggggggggagaattgcactcgcgatggatggaggagaaaagaaaaaaaaagggaatgcacccacagggagagaaagaggggagggaaatgcactcacggggcgagggaaagaaaggagaaaagggaaaaggaggaaaaaatagggaaaaaggaggaaaaaatcagagaaaaaacggaaaagaggaaatagggaaaggaaatagggaaagaaaaagtggaaaagggaggaaaaaaaggagggaaaaaaaaggatgagaaagggagaaaaaaaaggaaaagaggaaaaagtgagagaaaaaaggaaaggaggaaaacgggagagaaaaagggagaaaaggaggaaaaagagaaaaaaaaagtggaaaaatagagaaaaaagaaatagaggaaaagcgagagaaaaaaatagaggagaggggaaaaggcagagaaaaaggaaaagtgtagaaaaataggtaaaaacaggagagaaaaggaaaaatatgggtggaggtggggagaaaaaaagatgtcccaaatgtttgcattcccgacccatgattttacctcatgaagcgcgccaagttgtcgccaaaaagagatgaaatatttttgagtcaagagcataaagtaaaatacaaaataaagcggtgattggctattgaattaaagatagtggcgggagaagtgaagcgaggagaagcaaaggattagcggacaaaatcgcaagtgttcgttcgctcaacactcggagattgatttcggagataagaggaggaggggaaggcaggcgagaagcaatgagggaaatttgcgcaatgtttaggggagaagctcccaattgtccgcgtaaaaatccggaaattcatttcggagataaggatgaaattttagctgggggcgcgtggaagagggggacagtgggaaaaatccgcgaaatgtctacagatagtcaatcgttcacgcaaaacagaagattgaaaaaaatagttagagggagaaagagaaaagaaagaaaaaagattgggcaattcgaagaaagtttcttgagagaacaacgaatgagcagaacgaagtttgttgatcaaagaaaaacgcatttaaaatgtgagaatgtttgaatgtgtgccaagggacagtggtcgatttggcaaattgaggttaatttgataaatattcatcgtttttcctctaaccaatctcaaaatgtctctaccaattctctctaaccgatctctaacgaatgttcacgagcgacgaacgggggacgttttaccaattgattggacaattgtcaaaatgtcaccgctcgcggagttcaacttcatccatataattaaagaattagggtaacggaagaaaaaatgctattttataaaataaagatgctaatattaaattagttaattaattatataattaaccattggcaacagagaacactcatggaaatctatggcggaagtgcaacaaataaaatccctccaaaacctttcgtagtacgttcagcgacagaaaaagtccctccgctagcattgccaataccattttgagtcatacaaaattgacaatgagatggtccaccaaatggactccgaatttgaccacactcggcatatttgccgttgggttgggggggaggggaggcaaaaaaaaacttttgtatctgaattgggtgtgtgtatcgattttccaaatgaaatgggtagaattccaataattctaaatttgtgccaaatctcaaaccaccgaccgaattgccattgacgcgttgttcgacgaactattacaagtcacgtgcgattagttcgtcgccctcccaatcgtccaaacgg

SEQ ID NO: 5505 - DNA, 1464 bp, Heterodera glycines
gggcggctgacatagcattccctagggcgacaccaatgtacagatgaaacgcactgcggaggacaggcgccgtcgacggaaagaatgcgacgcaaaagtcaatcgatagactcacagccacggaaccatgaaaaactataaagaaacaaattaaagtaattaagatagggtaaaaaagaaacaaactagagtaattaagatagggtccatttaaatggattgcttcgtatattttttctcattgttcgttcacctacttcgtccaaccaatcgacaaaaaccataagaagcggagcttccgaaacgaaagaatgccgacttttgttggctccatttgttgctgatcacattgaaaatccaaagaatgaatgacgtcgctgcgaatttgttatcataagcaccgccgttactaccgtagtctctgtttaacgaaaattgagacgagagagagaagagagtaaaagtgagaggagcaaaataataagaatagcgagagtgggttaatacgagagagagaaagagagaggagagagagaaaaataagagagagatagagagaccgagaataggaagaaaatagaaaaagaggagagagtacgaatgaatgaaataaagaaagagaaaactgagatagtgagagagatagaaagagcagataaaaagaagagagcaagagtggactcgctcagttcggccctcacggttcgtccccaacacactgaggccccaaataaatcaaaaaaaattttcaaacaaaattttcatgtaaaggttagcaatcaatgattttttaattaagtgttctttttatatttaggtttttaactattcgaacataaattctatacattttttatgtatagtatgcaacatcaaactgacagcatgatggccttctctatatatattccaagacaaatgccggtgggatgattaaaatttgacgatttgagttcaaagacagcggtgtggacaaatggaaaggaaggatttggacttcattttgagatgaattcaaccaatttgataaaccgagctgaagatgtgagagagaaaaagagagacatatatagatagggagattgatagagagagaggagagatatagatgcaaaataataacagataactagtgagaaattgaagagagagggtatgagatagagagagaaaaaacgagagagagagacgaagagatagagaaaagtaaaaagagagagcgagatggagagggagaggaactgacagagagagagagagaaagaaagagagataaacgaaaggaaaaaaagactcctagagaaggagagaaattaaaaactaaaagaaaaagagagaaaggaggaggggaaaagagacaggtaagaaaaaacaatacatatacggatcggggagaaaaaagtaaaatgcactccttcaacggaaaaaaagaggttaattctctccttggggtgattacggaga

SEQ ID NO: 5506 - DNA, 1734 bp, Heterodera glycines
  misc_feature (1671)..(1671): n is a, c, g, or t
  misc_feature (1708)..(1708): n is a, c, g, or t
tttctctattgaccgtctttctgagcttggtcattaatcgtttagctcctccgatacggtaatttcttaaatgaaagtaaattatttttttgtaatttttaaaattttcaatttttcagccctttgtcatccgacgttggcatttggaaattgtgcaatggcaaaaatggaacaattttggtggcaaatgactgcacaaagtaaagtatttcaaaaataaattttatttattttttaatcattttaggctccttctctgctaccaaagcgaaatggccacaaacagaaaaattggaaaacgttttggggtgggcaaaggaacaattggcaaactgaaatttgtggaatgtgccgaagagattgccgaagaccaatggcacggtctgatcattgccaagcaccaagacggagtgatcagctacgaatcgaggcaaatttcaaatgaaaaatattttaaaatttggatttaattaattaagccatggattcgacgacattttcggcaccgaacaaacgaaacaaacggaaaaatatttggaaattaatttgaccaaaagtaaagccaaattaataataatattttaatagtaattaccattttacagatgctgaaccacttggaaatgaacttcaagaagcgctttcttctgcagcattttttgacgattttatgccatttgttttggcatttgaatttggcgcaacattttgcgcagaaaacggcggtaccaccaaattgtgcaaagagaaagtgcaatttttatatttaaaattcgtaatttataaataatttcattttttagtgcctttcccaaacattggtcgccccaaaaacaaaggcaccgtttgttggcccaaccaaattccatcggacaacgccacgcgcagtgccaaaaaccacttttggcattgtgccaaaaactgaagaaacctttggctttgtgccatttgcacgaaatgtggaccattttggcacaaattgtacgaacattttcttcccggcggaagtggacaaattcttgctgaatatcaccgcgaggccatacgaaattgcatgcaatgactatgaaaaacgtgccaaaattgacgagccaataccgtccgattattggtcaggcggacgccttgtgaatgcttgcatggcggtgccaagtgaaaaatgcgaaaagtaatttttggaatttattttttgaaaaatttcaaagttgaaggctcgtcgaactttacgggtgctatgaaagcattggcaataagccaagtgtcaatgccatcggcgaattgtgccaaaaacatctgaacaatgccacaaatgccgctgggttttgctgttcaaatttgtgcacatcggcaccaaacggaggcgacgaatgagctcattgttgaatcgttcatcaacttttcgttcactaatggagccgtttgctaattaaataataattattaattttattaattaaggttccaaaaaacgcaaaatttgccgatttcaattgacaaaatttgggacacaaaaaagaaaatgccatattttcttatcgaatttggccaaaacgagcaaaaaagtgcaatccgagaaaagggcgacggagaaaattttggtggcaaatggaacatgaggcaaaaagtaatgttaattaattttaatggcatgccatttagaatgatggcatncgctccatctcaaaaacatgcgccgcaatgggtcacncactactttggcaaaatgattcattt

SEQ ID NO: 5507 - DNA, 2720 bp, Heterodera glycines
accatgtgatatatacggcgcagattgtgtgccgatcagaaatttgttgttgaaaattgaggcattggaaaactgtggaaagaacgaaagcgaaaacgatgcggtaaaataaaaataaaaatttaaaaatatatttaaaaattattttagattttcaaaattccgtcatgggccccaccacttccgccaccgatgaccatgaaaaagtcatccgaaacattgttatgtgaaggggatatgttttgtgacaaacgaaggcttcaacaacagtacaacagattgagggagagtgagtcattttaaaaattaaattaattaattaaaatacctaattaaaaattcaaattcacagtttgtgggcttaagcccgaagaaatggagaaccagcgcgaaaaacgacaatacgacccataccaaaaatggaccgaatccccgatcaaaatcgcattcaacaaaacagctcgtaataatcttgccacatcatacagtatttgaacaaatgttttaagtgcctgaaaattatgacctctggggcaatgccatcagagctggagcaaaattaattatgtatgaaatgatgggttgaattttttgtattctgagaatgatctttttaagtttggttgctttcggagcgtttgtcggggtttcagccgagttttttatacaaaaaaatgggggggggcgggtggaatggaaagccgggagttataaggaccagtgatgccgcgggttgagaaaaatttcgggtttcgggtcgggcactcgaaaaatttcgagttcgggtttcgggttgagaaaaacttcgggtttcgggttcgggttggcatcactgatgaggacgcaaacccgaaagctcaattaagcaaaagcgacaaaaagtgccagaataaagtggacagacagtgaatgctgcgaatttttaaaattttcattttccaaaaaagcaaaaaatgcatatttttaaaattcatctctctttctataaacagggaagtcacctgtgttcggtttgaaattgttgatgaaatggtgaagggacagaatggcattgcgattgcagatgatgagcttggcggtattatcgtattattcatatatttttcacttgtcccaattttcattcataaaatttggcacattttattttttcaaatttttattaattttacccatttttgtagcctgcggcgtgtccccagtgggccgtggcggaggatggcaattccttcacctggcaatgactaaccgacggtgcacggatgtaattttggcagcacttaaaatatttgcattcattttttgcctctgttctcccattttgtcaatgtttattttcaatttcactcccatcggggaaaagccgggatttaatttgaatttaatttgaaactgcttaaggtattcaatatgtccgtcgttgctggtcatgaattgatgcacgcgcttggctttgtgcatgagcaaagccgaagtgatacccggaattacgtcattttacggaaaaatgatggagtaattaacaaacatttcaatataatttttcatttgctcattataaagtattccaaaattgaccaatacacgcaaaactttggcttcccttacgatttcgggtcggtgatgcattatgaatctgggggcaatcataaaaagtatgaacggttggattttaattacctaaaattggaattaaagaggcttatacgacctgatcactttgccacgcttttaccaacaaacgattggccaacgcgaacgaatctctttcaaagacgcggccataattaaccaaatttattgcaaaggcaaaccaattaaacataattaagtaaattttccatttgttcagactcatgcaaaggccatgaggacaagtgccaaaacgggggctatttgaatccgaatgattgcacaaaatgccattgtccggacggatacggtggcaaatactgtaaagaactcgaagagagtgagcaattaatgaattcaacaattaaagcaattataaataaatttgaagatttgaattgcgaggatttgagtggaattccgagagaattggtggccaatcagtcagcagtgttattgaaaacgaaggccaaatgtgtggggaataagccgtgccgatgccattggcgaattaaggcaataaataatatttttgaaaattttaattattttgagtgttattaatgcaaattttaattgcttttagcctgaagcagggaaaaagatgcgaattcagttcaaaagtttgagcaatttgtttgagtgcacatacaactgctcatcgggctatgtcgaggtcaaataccgagccgacaaaagagcccaaggcaaaaagacaaacaattaactaattaatcattaattagcaaaatgatggctcattaaggtgccaaactttgttgtgccgcatcactcactgatctgcaagcaaatgaatacaaaaattggattgaggcggaaaacccggacatggacattgtcatttccgcgcacctttcaacaaaatggaccgtatcatctaccagggatcacacggaattacgacgatttccgatcgccattcttggggttggaattccgatttccgaaatttttgataaaaattcagaaatttttggaatttttttttaattagcaatttttatacaatttctgtatataaaatgcactgaaattttgaaaaaattttcccggcggcgcctttcggc

SEQ ID NO: 5508 - DNA, 3240 bp, Heterodera glycines
  misc_feature (13)..(13): n is a, c, g, or t
  misc_feature (20)..(20): n is a, c, g, or t
  misc_feature (25)..(25): n is a, c, g, or t
  misc_feature (38)..(38): n is a, c, g, or t
tttttacgtgttntaatacntaaanagcgttaataaanaattttgtttgcctattttagtgcctattcgaggatttttgtgcctattttgcgattttttaatgcctttttaggtgcctacgcgattttttctgcctaaaaaggaagccctagtcattacgacaaaaaattatgtcgtttggcgtttaaatatggcgtttttaaaaaatctaccgtaaatttgtcgtttggtcgtcacttttcttttggatattggatatgagtttttgaaaaaccgggatccgctccagaaaagccgggattttcggaactccgacctagtgcaaatattaatttcgaatataatttgaaactgcttaagactatgaacatgtccgtcgctgctggccatgaattgctgcacgcgctcggctttgatcatgagcaaagccgaagtgatgcccggaattacgtcattttacgggaagatgacggagtaattaacaaatattttcactaatttttcatatactcattataaaagcaatcgaaaattaatccaaacacgcaaaactttgacttcgcttacgatttcggatcagtgatgcattatccgtctgggggcgaccatgaaaagtaagaaacagttggattttaatgatcaaaaattggatttaaaggggcttatacgatcggatcactttgccacggttttaccaacaaacgattggccaaaccgaacgaatctctttcaaagacgcggccataattaaccgaatttattgcgcaggcaaaaatggtcgaaaatttcaggaaattttcatttgtttagactcatgcaaagaccatgataacaagtgccaaaacgggggctatttgaatccgaatgattgcacaaaatgccattgtccggacggatacggtggcgaatactgtaaagaactcgaagagagtgagcaattaattgattcaattaagaaagcaattataaataaatttgaagatttgaattgcgaggatttgagtggaattccgagagaattggtggccaatcagtcagcagtgttattgaaaacgaaggccaaatgtgtggggaataagccgtgccgatgccattggcgaattaaggcaataaataacatttttaaatttattttgagtgttattaatgcaaattttaattgcttttagcctgaagcagggaaaaaggtgcgaattcagttcaaaagtttgagcaatttgtttgaatgcacatacaactgctcatcggcgtatgtcgaggtcaaataccgagccgacaaaagagcccaaggcaaaaagacaaacaattaactaattaatcattaattagcaaaatgatggctcattaaggtgccaaactttgttgtgccgcatcactcactgatctgaacgcaaatgaatacaaaaattggattgaggcggaaaacccggacatggacattgtcatttccgcgcacctttcaacaaaatggaccgtatctaccagggatcacacggaattacgacgatttccgatcgccattcttggggttggaattccgatttccgatatttttgataaaaattcagaaatttttggaatttttttttaattagcaatttttatacaatttctgtatataaaatgcactgaaattttgaaaaaattttcccggcggcgcctttcggccttgaaataaccttttatttggttaagaacgtattcgaactgacgtatgaatcaggcaaggaaaattgaaaaataaataaattataccttttaaattttttaaaaattaatttattttaacttgctttcgttttaaatgcttttctaatcagaaccattacaaaatggaaaattaattgttcaaaaatctgttaaggcaacgccaaactcataaattcgaacaaatgcgtaaataccgataatttgtatgccgagaaaaggaaccccggcaccagcggtttgaagtgttatgacggggtcaaacaccaattttatgactgctcctgtcacggtgataagaaatgcctcgctgaagaaaaatgggcacacgacgcatttctttgtccaataataaaggtaattaattaattagttattcattaatgccaaaagacaccgccagatacatttcatataatattttggcaatttaatttttccgtactaaaaaattaccattttttgtataaaattagtgaaataaggataaatatggcaaatgataaaaacactctattttattaattaatttgtaaatccaaggtcaatggaattcaaatccaaggaagccgacaacaagtgtttacggacccaaaagattttcgatacgattggactcggattgagattgattgttatgtaagttgggtctgctatatcaaaaaaccctgtttgattgactaactttacagaaggccgaagcgagtaccgtaagcttttggggctacagtaagccgtacacaaaggaaatcattcgggtggacgaaatccactgtttgacttataaagctgctggagtaacaccaccgtcacagaaacggttcaagagtttgcaagttgaagaacagctgtcgatgaaattgaatccaagtacattattggacaatgcttcatcacttatccatgtgttcgtgccatttgttggccatccatgagagaaaaggggtgatcagtgatcagtgggtgatctgtctctgcagctgatcagttggccaattccaatcagcaaatttttattttatttttatttttttgaatgaatttggaaatgaacaaataattaatttaaaaacgatattgtcttaaatttaatttaaatgcgatatttttatttatatgcttgtgattttttataagattttttgttaaatgttataattgtaaaattaatttattttaacttgctttcgttttaaatgcttttctaatcagaaccattacaaaatgggaaattaattgttccaatatgttaaggcaacgtcaaactcatcaattcgaacaaatgcgtaaataccgataatttgtttgccgagaaaaggaaccccggcaccagcggtttgaagtgttatgacggggtcaaacaccaattttatgactgctcctgtcacggtgataagaaatgcctcgctgaagaaaaatgggcacacgacgcctttctttgtccaataataaaggtaattaattaattaattatttattccaaaagacgccgccacacaaacctttcatataatataggcaatttaatttttt

SEQ ID NO: 5509 - DNA, 1335 bp, Heterodera glycines
  misc_feature (1309)..(1309): n is a, c, g, or t
  misc_feature (1318)..(1318): n is a, c, g, or t
attgatatgaacaaatttgtgagcaaaaaagtacacacacatagcacatatagcatatacaataatagtgaaatgacaattttctggatcacaaacattaatatacaaatacaatacaattagtgacaatacaatatgtaaaggtcagtttatttcctcgccagaacatcgcatcgtttaaaggtatttgtcgataagcatgtttgcggagttgctcatcatcgacgatttgacggcctggctcatctgcgttttggctgccgcctggctcatctgggttttggcggtgcccttctgcttttttgccacggcgtccttaaaaaacggaaatcatggtgatcaaatagaaatttggtacaccaaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcaaatagagatttggtacatcaaacatacgcttagaagcagatgccgtgccggttgtttgagatccatgtccacgatgttggtgtttcggatgtgtcgaagtgcctgcaatggaagacgacgttccagcagtgcgcacagtgccacggcgtccttaaaaacgaatggtgaatgatcaaatagaaatttggtacatcaaacatacgcttagaagcagatgctgtgccggttgtttgagatccatgtccacgatgttggtgtttcggatgtgtcgaagcgccagcaatggaagacgacgttccagcagtgcgcacagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgcgcgcaatggaagacgacgttccagcagtgcgcacagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcaaatagagatttggtacatcaaacatacgcttagaagcagatgctgtgccagttgtttgagatccatgtccacgatgttggtgtttcggatngtgtcgaangtgcctagctaatggaa

SEQ ID NO: 5510 - DNA, 8495 bp, Heterodera glycines
  misc_feature (62)..(62): n is a, c, g, or t
  misc_feature (65)..(65): n is a, c, g, or t
  misc_feature (67)..(67): n is a, c, g, or t
  misc_feature (93)..(93): n is a, c, g, or t
  misc_feature (96)..(96): n is a, c, g, or t
  misc_feature (101)..(101): n is a, c, g, or t
  misc_feature (104)..(105): n is a, c, g, or t
  misc_feature (120)..(120): n is a, c, g, or t
  misc_feature (171)..(171): n is a, c, g, or t
  misc_feature (210)..(210): n is a, c, g, or t
  misc_feature (212)..(212): n is a, c, g, or t
  misc_feature (219)..(219): n is a, c, g, or t
  misc_feature (221)..(221): n is a, c, g, or t
  misc_feature (231)..(231): n is a, c, g, or t
  misc_feature (233)..(233): n is a, c, g, or t
  misc_feature (248)..(248): n is a, c, g, or t
  misc_feature (252)..(252): n is a, c, g, or t
  misc_feature (255)..(255): n is a, c, g, or t
  misc_feature (260)..(260): n is a, c, g, or t
  misc_feature (281)..(281): n is a, c, g, or t
  misc_feature (293)..(293): n is a, c, g, or t
  misc_feature (303)..(303): n is a, c, g, or t
  misc_feature (317)..(317): n is a, c, g, or t
  misc_feature (332)..(332): n is a, c, g, or t
  misc_feature (446)..(446): n is a, c, g, or t
  misc_feature (451)..(451): n is a, c, g, or t
gcaccagcctaatgatgaccctccgtggcacttcctcttcagaacagatccggcagaaaaancgnancggccaccggtctttaaaagcgactncancagcnggnngcggaggccggagcnggcgggcgccagggccaacggccgagcaaaggcaaggcagagaccgaccancagagcaaccgacagcacgaccagccagcagacgacaancncaagcgngnacaaggcccnanaggcggcgaccagangaancanaaaancggccgacggcagggcgagcncaagggcaaacncaacagagcngagcacgcacaagncccggacgaaaacgncggcgcgcaagccgcacaccgccagaaagcccgcgcgcaccgccaccgccgaagaccgacgagcgaaaacaacggccgggacacagccacggaaaaagcccgccacgccaaagnacgancccgcgccgttacagggtagctgagctcggtgtccaggaacaccttgtagctgtacagctggtttgagtcgtacacctcccgctggttgatgtgcactttcaggttccggatgaacgttgcgccgggcatttggataaggccgaccgctgcgtttgccggcacatcaaccacaaccccatcatctgccacttttttgagcttgaactctgtgcacacaaacaccttgctaaggtctacatagctggtgattgggtggatctgaaccaacggatttgtctgctactgcatgtgaaaaccacctgccttaaaatgaaagggcctagagcttattgggttcagcgtcaggtactccctgtagctggagttggacacagcgcagctcgttgggggtatggtgaagaagtccagccccgcatttgccacctcagcacttgacgcatccacttttttatacaacattttgctaataataaccgagtgagtcaaatcttttcttctttaacaaaactttttggggaacagtttgtccaacaacgtctgagggtttcaaaatgatttcagcttttttcccgcctcctcttctcttccttcttccgcgccccttttgtagtgatgaagaggccttgtccagcaattttttcgctccctcttttccttccgacaccagcgcgtctttgatgttgccgccctttgacacctcgttgaggaatcgtgcacccgtctcgaggccctctttgccaatctcggcagcaatgtttgctgcatagggtcgtgccgctgtgaccattggacgaaggtagcgccacaggttgcgcagcacagagccaactcctgctcccttctgtcgggggacacccaagaaataaccgtatccccgctgaaacgttggtgccccctcaaagacgctgatcggtccactgcctccactttgcggataaattttctcgagccgtaaatttgagccgtcaaaaatcacgcgaaccatctctctctcagaacgttaacacctttttaaactgaagagtcaaaacaacttggccaaactcaaatggcacctcccttaaataagtgattagaaataattgccctgctgaagagcctaacctcccggtcagagtgcgaatctcaacgtcaagcacatccacctcccttgctatgattttgtgaaacaacggcgcctggaagtccttctctaccacactacccgactttccctcaacggcaatcacttggagcagattggcaaaggtgttgccgacaatcatgctctcaatgacgccactgttcaggtaaatgcacaggtggctcacaccaccacccaaatcaaccgcatattttgcaagctcttcatttctgatctgctgctcttgttcatagcccaacacgtaggccagttgatcagtcagcgtaatgtgcgaaattttcccgttgaaaactttgagctcaaatctgccaatttgctcggtgaagtaaaagcggaaccctttgaccagctcgatcagctcctccttttcctctcgcgttttcaccgcatagttttcatcgtacacctcttgctcaaacagctcacggaactccccaatattctgttggatgtgcgcggatgggttaaactcgggcgcctcccaggggagctctgagtgccggacacggtatttgtgtacagcattcacaaagtggtaatcatccgtttcgtgcagctgttgctgtcgtttaagctcttccaactgcttttcctccgcttgctttttcttggtctcgttttccgctctctccgcttccgcctttgccgctctttcctcttctgcctttgttaccattgccactctctccgcttccgcttttgccactctctcttcctctgcctttctttcctttgctactctctcctcctcagcctttttatccttggtctctttctcgcctttcttttcctttgctattctctgctcttccttcttttcccgtgccagtttttcctcccttgccttcttttcacttgcctctttctcttcctttgccttcttttccttggctgctttctctgcagtcttccttctatctttttctgtcttacgacgcatctcctcttcttctcgccgtctacgttcattttctcgctgctttctctgctcctcttcccttcgctttctctcttcttgtgcccatttttcatgccgcaacgtttcttgttgagccgctgattgcttggtcaaatatgaaagtgggtttaagggcgcttcgcccatattgtcttcttcctcctcaacaaacgagacgtcaagaatctcgccctcctcctcatcgtcgtcgtcaatgttcccaaaacttgcatgcaccggtgcggacctttttcgagtcaacagccgttccacttcggcaatcatgccatgatgaatgcccctctcaagctgctgtggcgagagaaaacttccctttggcacacggaaacggtattttcggccgtcgtgcaggtgaacaatcacatattgtcggtctgatgtacccagctttgcccaacttaagccaaaaatcggacccaatagccatgatttttgcccacctgtttgggtaaattatgcctgacagtccaaccatccacccggccccatcgaacaccaacttctttggcaagtgcactttgaatttgtttgttttatttccaacaaagcctggcgtattgctcggcaaaattacaaagaaagagtttgtcatttgatcaacaagtataaattcttcaaaatgagatcgtccttatatcgtggtgtgccatctcggttcactttcccccatctttgatccagcggaaactctttgccatcgtcgtcgtcgtcgtcgttgccggttcatccttctttaggtgcttcatgatcagatcggtgcagtcaaagttcagctttgcacagtcttggcaaaacgattgggtgaactcaaggcgttgctgctcgccattctgattgataagtttgaatcggctgttcccctgccggaaattgtcatcacgacactctttgcacatgaacgtgaacactccgtacttaagaaattttcctattttttcaaattaaatattagccaaaacctttgggcgggccaatttccaaaatatggtcgggtactcaaacacattggtcggttgttttttgggcgattcatccactaaaatttggctaatttaaagaaatttgcagaaaaagccaaaccttcagcttccatggcttttgctttcttcattgcggaagcaatttcctcatggatttgtccaagcgaggcttgcgtcccctttttgagggccccggttgcaggtcaagcagtgtttgagtgttgttgttgtctccaattgtgatgacatcatcatcattttgaggggaaaaattttcccgtttcgactcatccatttctttaaatttaaaattattataaaaaacccaaaaaaaatgattacttttgttctcaaacaccaattgatcattgatttttctcggggccattacgattaagaaatagtttatgattataattgttaaaagcataaaatgaacctgcgaaaaaacacgtaattattgattgatagtgagaggggtgttagcgcgcagcgacctccagacgggctatcccttttaatcgataggccacgcccatccacaaacacatagacgagagagtagtggttagagaaagatacaaaagggcgccaattcaaacacacagtgaaacccaagccaatttattgattttttttacagattatggtactccctctgactgctgccctatccaaactgctaagctgtaaacccgaaaatttagcagaatatttgaacaaccccgaggcagtgaacaaagcgaacgcttacttggccggcaaaaaactcaaaacaacctaccagggtcgtgattccaagaccaaagaggtcaagttcggcacattttcggtgaaacccgctgcggaaacctacgcctttgagggatttcttggcaagtttccaaaaattcagtttcggtctaacacatatgcgttcagaggttaaagtccaccagtatttctacataaagcaccggatccgcctactgtacccacagctgaagtgcattgttgagtaccacaacaagggccactgcaaatactacccattgggtatacaattttgtccggaaaaaaaaaatcaataatcattttcagagttgttggccgttgaggaaggcggggagagtcaacccgtcgaaagacctgccgctgaaacggactacctggactacttgaactttcgcagtgggtggcaatcaacactctactgatcaatgaagcgtgtgcggcaatcggaaaagttgggcgaattcccggagattgagttcgccgtcaacacaatgggcgtcacggtgtactgcccgcggcacctgcaaacgcctcggtttgtgccatgggaccagcccgggcggtgctcgagctgtagaagcggaactgttgagctggactacatcatccagcccgagggggtgaccatcttttcgaatcggctaaagacagacggcgagaactttgtgccgtttgatgcaattggtaagctgcaggtgtatgtcagagtttgactcttttttcttaagtggactttgccgatcgtgcgaaattccgcattagggcccggaacaaggtgttcacgctgccgctgcgacacccggaggtgcacgccgccggcccaagcttggaagaaggcgtaaaagaacaaaaggaaatgactcagatggcataaacacttgtccatttttctattgttgatattctgatggaccacccaagaataaatgaaagtgagctcgcttttcccatcccttcggggattattgtcagcggtccgtcctcatcgggcaagacccagctggtccttcgcctgttacggcatgccaacgtgatgtttgacccgccgcccaaggcaataggtatgtgcaaagggcgtttctgtgcagtgggctgttgctatttagtatgggcatacggtgagtactcgacgcagattcccgatctggagcggcagggagttgccccccacgcaggtgccccgtctgacgagatgctgaaaaagctgccaaagccttgtctgattgtttacgatgacttgatgggtgacattgaggccaagaagttggccgatctgtacaccaaaaagtcccaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacaggcatgtgccctaccgtacggctacctattggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtcttaacgttttgaacgggagtttctgtctgagcaggaaacaaaagcagagacttgcgccatttgcaaaagacatcagacagttggcacgtgtgcgaagcgagagcggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaggggctggttgcagcgaaggagacaaagaatgacgacgacgacgacattgctgagcggacaaacttgggctttgtcaaacgacaggtgaccgctgcagtacagaagcggaaggaaaacgtcagcgaacggaacgcaatgtacaaccagtacctgcgccggtacctgaagatgcgcaaggaacataaagagcggcccgtccgggtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgatcacccaggaccaataagaaagcagcaaacagcaaaaattgatcgagaagaaggaccacctgttggccatcagtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaggaaactcgcacagaatccgcttgccagtagcctactcaatcgactgtttgttgggtctgggttcgtcggacaagtcaaacaaaacgggcgttttattccctcaaaatggacaagaaaataaacaaaatatacaccgacccggccaatccgggcgggtatgcgggggcgagtgccctgtacgcggcggtgaaggagaagcacccgaagttgaagcgtgccgagtttgaggactttttgcagaggaacaccacctacacgctgttcaagccaaagagggagaagttccaacgcctacgcacagtgcctacgggtttcatgaccggtaagttgtactggggcttattgtgcacaattcagggttcagatgttcaggcggacttggcagatttccaggcactttcgcgcaagaacagcggctaccggtacctgctgttggctgtggatgtgttgtcgaggcgaatgttcggcgcgcccgtaaagagtaagcgaccggcggacatgaaaagggcgtttgaggagctatttgagcaaatgccaagggtgccggacacactgtacaccgatcgcgggctggagtttgtggcaaaaccgctaaaggagttttacgcggagaagggcattcaaaagtttgagaccagttcaaagaaaaaggccgacgtggcggagcgtgccatacgcaccctaaagacccgtctgtacaaatacttttccgccaacaacacatcggtgtgggtggatgtggtgccaaagtttttgagtgccatcaacaactcagtgtgccgcgcgaccgtacttagacccaacgaaatcagcgacgccaatgcgagggaggtgtggaagagggtgtacggcgaagggctcgcacaattggacaagacaccaaaaatcagagccggggaaacggtcaggattcccgagcctaagcacattttcgagaagggtactgtatttcacacattttttcggtcaatttattttaattttaggttatatacccaattactctgatcacgtttacacagtagatgtggcccgctcaaccaacccccagcactatttgctcaaagactattatggcacaaagttcaagagaaaattttatttaccagaattaacaaaagtacaagttgatgaaaacacaatgtatcggattgaaaagaaatacaaagaacgagtgagagatggaaaaagtgaaatattggtgaaatttattggctttccggaaaaatattgggtgacaaatgaagaaataaatgaataaaaatattacaaaatgaagaaaatcaattgaaacaataaaaacagttatggcataatatcggggtcatttaactcctcttctgtgaacatgttcacattgaggtctgggttgaacagacaggtacaagcgcctgggcaattccacttacaccaccaacatttcaccataaatcagcacgtgatcatatcgagatccttcaatttattatgtttacaaaaattttattttcaaatataccggcgtgggcgtatgcgtacgttgtcaccgactcgggtttctccccggcttcttca

SEQ ID NO: 5511 - DNA, 1460 bp, Heterodera glycines
ctagtaaaacatgtaagaattcaaatttttcaggtggcgatagggcaaactgttccccctcttcaattgccattgaattcttatcagtcggagattggcacagtcgcgcagaacggagggcgacgagaggacagtgcggaattgtgccagaacttgtctggactggaggcacatgcggacaacggcagaagcgttggacgacgacgacggcaccgggacattcagcagaggccaaatggaagtggcaaaaatgtcgctcagcgtgtggtccgtgaaaaaagagcccagcgccaacgtgatgtccgattgcaaaaggcgtccaatgcggcggagaagagcgaccacaggggtggacatgaagctgtgacaaacaataagaaaaaacaggggagaggggtcgacataaatgttcaaacgcttttttggaacatgggagtacggcggtggcgatagatgccgcagcaaaattttttgaggtgaaaaaatcgggtgccccaaaaaaactgttagaacggctcccatcagctaaccaaagattggaaattttccgaaatctaccaaatttctcaagatcgaaccccgaatccgtattcgagcaaagtcgaaaatttaatatttttggtgtaaaacatgttaataatcctttctcgaaaaaaaattcaaaatgttttttttttgaaaaaggtggcttcaagtatcaattcatttttgctgtttctgatcaccactcggccgggcggaagaagcagtgttgagaagcctccaaataaaaaaaaaataattagcaccgaaactttcgaaatggttcacccatcgtcgactccgttgtctccgatggaaatctcaattttgttcatcgctttttcctcttcgcctgcttgagaacaaacaaaaaacaaaatcccaaaatagctattttgtaacagtttcaatttctccccagtcaattcgttggtcagttcaaatggcaaaatggagtcaaatgaaatgggcccaaattgagaagtcgaaaccaaatgaacaagaattgagaagtttaatggagcagaagcagaggaaaatgcctaaaaagaagataaaaaataaggaaaatgtttatctgagctcccattctcacaatgacccatgacatgcacaattgtattttcaggagtgatgctgtcgatttgggatagacacaaggcggactttacagcgcgcaatttcttaattaagaaatacattaggggggaggggcacttaagccaaattgaaccagatcgtagcatccgcttttgttgatcagcccatcacaattttgcacgcgggaagcggtcatttggaccattttcaacaatttgtcgcggtttggcgcgaaaaaaaaggcggcaaatttggggggccctataaagcgccgggtttcgccagctcctaaaaaataagcgtttgtttggccaaagtgtgagccacctgtccgcgag

SEQ ID NO: 5512 - DNA, 3202 bp, Heterodera glycines
  misc_feature (3122)..(3122): n is a, c, g, or t
ttttttacgtgatctcaatgaatccgaatccgatgactttttttggcagcggaatttgcggaattggcaattctttttcatcggaattgacaattttcatttcctttgtgccattcggtccaattttaaattttcccaatgtccatttgcgcgttttgaagtgttcatcgacgaagtagtcaaaacggcggctaatcatcgcaattcccagtccaagctgaaagggcggaagcaaacgaaacacctcaagccaacaatcggcggagatgaagcttaaaaatcaaaatgattagcatggaaaattgaaagattaattatttacatcgctttttccatttctttctttgcttctttcggattgtgcgacattttttgcgagtaattagacaaaatttccaaagaaatgaactgaaaaaagaatttttcaaacaaatgtgaatgggctgattggatatgactggaaggggatttggccggctttatatactcggattcacgtgaagagcaacaggggctgggatagtggaaaaatagggaaatattaatgctttctgataaaccacaacatgcttatgctgaaatgagcgctgacccacaaattgtctaagccacgagtccaaaagagtaaaaaaccacgtaagtgtccaatactcgaaaaagctcgtaaaaacccggaaaacgggtctattttagggttttcggggtcgctgaatacgaatatgacatttatacaacctaattcataaccctggacccacccgaataagaaaaaagctcaaaactttgttaaaacatgttctgtttttttacttcagattttctatccatcaatcgatcaaatgattggtttgaaagtttatggacaaaaaactgttaataaatcgcattagatcacaaaattcttcccggcggcacctatcggcgccgccggaccccccttgtctcccaaaattgttggaagaagcgcgccgcaaaaaaagcttttttaaaagcgaaaaaaagtcgtcacttggcttttaattgcaaaattggcattttttgtgaaaatctgttaacaaatctgaacgaaaattatgaaattttttgcggcggtgacattcggcaccgccgtacccactcccctcgcccattcaccaaaagttttttggaaaaatgcgccgcaaaaatttttaaaaaatcagcagattttttgatcccgaatgaactgaaatactctcccgtgctaagtatcaactttaaccaagcaattcctgctttgggcatggtaatttacaagaaaaattcgttggtttaaaaaaggcacctaaaaagcaaatttatatatttttagtaacttttaaagtttataaatgcttaaaaaatagacaaattggtaaattgacaccccaataaataattcaacaaaaagtcaatttccaacaattgaaattttgtggcaaaataatgaactaaaaaggagaagaaaaagagaacaaacattcttttgaacagcattagcaaatggacgaaaaacgcctgaaaacacgagaataagagacataataaattttcgtgaaaaggcgggactgttacaaaattacgtgcacagaaaatctcagaaatttctgttaacttagttggatatttaacaaaaactcaggggtccgggaatacatccagaggttatacaccccaagattatcggaaattctggaaaaaattaaaaaaaacccaaaagcaaaatttcttgaggaaaaacagagctagacctgggctttgatcgtaggttcccccccccccctaccaaaaatacgataaaatattttataaaaatataaaataattaaaaaggacacgaaatggagttgtacaaataatttataatgtattaataaaatgaaacataattaaaaattctgctgctgaacgtttacttatattatggggaaatggcacaactaaaattacggcaaatttatgacctaacaaataaaaggggagaaaagaacggagagataatttgaaattaattcctttttttcattcagcaaaattctgaccccaaaatatttttctcaaataagaagaggcaacaaaatgtaaattcacatgtaaagatttaatttcaggtgtaaagaagcatcctatagtactgggctccaagaaatgcttcaattaaaaactgttattatttttttattttataaatttttaatgagtttttaaaaaggaaaaaagaattctttaagccaagctatgttttttaatgttttggtaattttttttaaaaattaccagattagaatcacagccggaccttttcttcgtaatttacttgaaaaataagcatcatagagataatgatgaaaacatggaaaaccctatgcagaggctaatatttggtaattttttggcttgactttcgttcaaggggtaaactaaaaacatgtttaatggttttgaaatggcgtgtatttaataggcataaacgttttttggcgcaaaactgtcaatttcttggtgaaatcaaaattaaaaaaaaaaatttttactgtttttttcacaaatttttgttgtaataatggtgaacagcttgaaggagcagtgaaaatgggtccaattcattcttcttgagctcacgtcgccattgatactccaccagagtttctgcaaactggaacccagggattcgtctctcgcgaaaccagtctttcgcgggcctccaactcgcctcgatgcgctgagtatgtgttccatccacagctataatttacacaaataaatcataatttaatattaatttaaataccaacaaaacgattttccgggtctgaatgattcacgactttgtgcaagtagccaaacaattctttcaatttaaattttatctctctctctctctctctctctctgtgagaaaattttatcggataatttttgcacaaataaaaattataaaaaaaagataatttattctttcatcttttagatcattattttgccttaatttttgccctcccccactaatatttaaaagtgaacaattttgcatgagaaattctttcaaataacgaatcgctcaatgcaattttttaatggtttttcagtgggatctattagaaatctttttaactatgccgagntcataacatttaaaaaaatgttatgttaaaagtacaaccaaaacagtatcaacatttgaacatgcccatttttgatttga

SEQ ID NO: 5513 - DNA, 3255 bp, Heterodera glycines
gatcatcagtctgaagaatcccaaccacattttccgaatgatagcgccgaccctaattttttccgaatttctttctgggcgagtttgatgttgaaaattttggaaaaacgcctatctctttttctgatcatcagtctgaagaattccaaccacattttcggaatgatagcgccgaccctaattttttccgaatttttttctgggcgagtttgatgtcgaaaattttggaaaaacgcctatctctttttctgatcatcagtctgaagaattccaaccacattttccgaatgatagcgccgaccctaattttttccgaatttttttctgggcgagtttgatgtcgaaaattttggaaaaacgcctatctctttttctgatcatcagtctgaagaattccaacgacattttcggaatgatagcgccgaccctagttttttccgaatttctttctgggcgagtttgatgtcgaaaattttggaaaaacgcctatctctttttctgatcatcagtctgaagaattccaatgtcggaattttttattcctatcgccgatcaatgatcggcggaattaagagggaggaggcccttcaccaatcccccgtccgccgcgcgacatgttttcgccgttccattcctctatcccccatttcccttcaaattgtcaattgtttttgtgtgttcctcccccgccccgcgcacaaattaatgaccaatttgtcaaaccgcaacttttcgccgccgtccccaattcggcgaatgagactccaaagaacgatgaacccccaatttcccgttttcctcccaatttgttcattcgttcatttttgtgccctctttttcaattcatgcccaattttcggcccattttcgttctgctcaatttcgccactttttgttcaattttgctcgtatttaatgcgacaaatccccaccaattcctacaatcagaagcaccagcaaaggcaagcaatgcctcttccgtccctctctcagtccccctcatttcattgtccttttcccccggcccaattgtccgttccatttctgtcattcacccggtccctatcattgaattttgtgatttttccatttgccccatttctgaaatttctgtcccatcccggtgcccaattccatttgtgataattccccggtgatggcatttctgtgatcaatttgtgataattcgttcaccatttcaaaatttttgtttaattacccaagtttgaggtcatttcccggaataaattttttattaattccgtgtctcgtccctgcctgcccctgaaccccgcaccgtggaattcatttggcccgaccccagagcaagtcgggacaaattggcgctcctgggtggatttgctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtccgaacagagggttggaaggtgttgtgtagtggacgaagtacttgccctccgaggaagtacttcgtacaaaagggtgttcaagcgcgcacaaggccattgacaaataaggaaaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacagaaggtccaggaccaaggccagactgatctcggaaaaagacacaaaacaacaagcacacacacacacacgcacaatcaaacagcacaatgtctgggccaatacaaaaagggatcatcaatgcactcaaagctctggacaatgccaaaagcgccacctcactccttctacaccccgacccggacctgtcaaactgggaaaatgccgtcaacttggaggctcaatttgatcgcgtcgtcaaggaaatccgtacaatggaaatgcagatggacagtctacgagactcatccaacgcttggattgaacttctcgcccacctgaccggagacgacaaagacaacggcgaaaaagaatacatcaaattcgataaaaatgagaaaatcgccgagcgatacgacgcagcatcaaccaaacttcgggatttgcgagatctcgaagcaacactcagtgccgcagccaaactgcacagaggcagagccgacagagaagcaaaggcggatcaattggccaatccgcagcaacaaccgcccatgccaccagcaatggcagcaccaatgacaatgccaacattcacagcaccgctctaccaattccaaccaattcaactggagaaatttttcggccaaaagcgaaaatggcccgaattctacgaatccttcaaatcggcaatcggcagtcaatcaatcagtaaagcgcagaagctgaacttactccgcaatctgctgggtggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgaaggtcctcaagtgttcctcatgctggaaaagaagctgacgccagcattcctgcgaagcatcctcaacaagaaaggagaggatccggcaaattggacgacaaccaaatttcgggacgtgctaaacgaagccgtccgaaaagaagttcaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggccacagacatcaagggtatgtaagccaacagcacacacaacaagcaaagaaacactgccaacaaatgcgaaaccaagtacaaagcgtcaaaaagggtcggccatacccctgcattttctgcaacagcaatcattg

SEQ ID NO: 5514 - DNA, 1432 bp, Heterodera glycines
  misc_feature (47)..(47): n is a, c, g, or t
agacggagtgtcaggcttgattggcatcaagggtgaaaagggctacncaggattggctggtgccaagggcgacgccggaattcccggttttcctggaacaaagggcgattctggaatgccaggactgcctggttcgccagggctaactggtagaaaaaaatcgcggaaaattacaaaaaaaaaaattactgttgtcaagggccacctggtttgcctggttttcctggcataaatggagacaacggactgcccggcattggcctgcccggtctacctggcgagaagggcatttcaggcgtgccgggcaagcctgggaggcagggtacgccgggcgagcgcgggttggacggcgtgccgggagttcccggaatgaaaggggacgaggcaagaattaaaaaataataattttttaaatgctaattttcttgggacaattagccagaaaaatattggatgcaattatgtggggaggcctttcttactcttcgccaaaaaatgtttcagaaaacatattttttaaatgttgttagaattatcaacattttgctcctaaaagcatttataatttttaatattttgtaaattatttattaaaatacattgaataatctgaccaaatttttcaaagcgcttttaaattttagaaaaaaaccattttaacaacaatcgaaaacattaaaatgcctattataattgtacttcttaaaaatcatttaatgaagaaaatttctttttccacattttcagggtttcataggcaattgataatttcttagcaattattttgtcttttgtttttggatatttccccttgatttcaaaatattgcttcatctttttttgtttgtcctcattagaatatttatttttcactaaaaaaataataataatttaaatgaataaattacaaaatttcttactgtgactcttatggtaatttgccattaattcttttttccatttgaaaaatgtgtctttagaaatgcccaattccttcgcaaattctttctgtttacgttggccatataaactttttaattcatcaattcgttcaatgaattcttgctttttcgcctcataaaaactctttttcttcgttttatttaaatttaattcttttttccatttgtatattttgtcgcgatttacgcctaataattttgcaattttacattcaattttgacactgtttttccattcatattttcctttttgcttcaacttttctttgattgcttcaaatttttgaattgtttctcttttcttttgatcatttgcttcttctttcatattttggtcatttttgataattttttgatcattttgaatttgatcaattgtttcggtgccattttcttcttcgttttcgtctctttcatttttgtcccactcgttgccaaatatttcatcaaaatttgggcggattttgctg

SEQ ID NO: 5515 - DNA, 6130 bp, Heterodera glycines
  misc_feature (54)..(54): n is a, c, g, or t
  misc_feature (122)..(122): n is a, c, g, or t
  misc_feature (136)..(136): n is a, c, g, or t
agagcgcggcatcgatggatacgccggccaaaagggcgaccaaggcttccctgncctaccaggtggttaatttttaaaaattacaaataaaaatgcagacactatccagaaaaagggacctntgggaatgttaatntcagaaaaatacccaaattccaatttgttggttgctattttttcaaactttcgcaatgtaatgccaatttttcttgagatgcttgagactcagttgggccggggcccagtcgcccagttcaaaccctttgcctgagcataacgaaatcttattttccaggccaacctggcctccctggcaccaaaggagagcttggcatgcccggcttcccgggcacaaagggtgaaccaggagtgcctggacgagacggatttcctggcatggatggtgaaaagggcgatgccggatatccgggacagccgggccaatacggacctcaaggcctacctgggccaaaaggcaatgctggactgccaggaatccctggattatcaggtgaatgcatttgttgactattgtccattttgtttaaatttaaaattgactttttaaagtgtaacaattgttaattaccatgaagagctagttaattcttctgtaattttattaattttaaaaaactcgataaatacaacaaattgcatttgatagacattcgaaatttgcgacgttttaggccctaaatcaagattaattaaaaataatgtagtcaagaataattaagtaaaaaattattaaaatattttctcaaatattaattactaaaaacccattccattttcgtctaaaacccagggtttttggacaacttgctttttgtaacttcttttattcttttcagaatgacttggaactttgcataaaatattttttgatagagaataaccgaatataaaataatagaaggttttataattttttaaatcctaaaatttatgaattttgcctaattaactatccaattcaaggacaatcgcttgggggagtgaaaggcgagcctgggttgcccggactgcctggccgagacggtgtgccaggaccatcgggtgaaaagggcgactcgggtgtgccgggagtgcccggcttcgatggtgaaaagggatccgtcggagcgcctggatttccaggacaaaaggtcctgaaaacaacgcccagttcaaggacagattgataactgatcccataaaattttagggagaatcgggattgcccggcatacccggacaacgtggccaagacggaatgcctggatcgcccggatttcctgggcctgtcggagagcctggcccacttggtgaaccatgcttggctggcggaccaggcatgcctggacagcccggatttccggggaccaaaggtagacggcgtttttaaaattttaatttatttttttaaatttaggcgaacttggcatgcccggctttcccggcgagaaaggtgaaccaggctttgcgggccaacctggtgttcctggcctgcccggtgctaaaggcgatgccggattgcctggacatcctggacctcagggtcatccaggacaggacggtcctcaaggcccagcggtgagtgaaaaagaaaataaattaatatttaaaattaaatactaaaacagagcactatgaaaaacaccaaatcggattcatcgaattaaatctccgagttttgggattttcccaattccaacatgtcgtcactccgtgggtgtcccactacttccaacaaaatccggatccaatcaaaccatgaaaatcagcccagcttcagacttaatgtcgagctctattaatagccgaaacccaagcttaaaattaaccaatttttattagaaaacttgtaaatttcttgccagccgttgtatccgtatattttgatgaaatttttttgtcaaaaattgtggactttaggttagattaaaatagaatcaaatatttttttatttaaagggtatggccggacctgagccgttgactcagcatgggcagaaaggactgcccggggcgccaggtgttcctggactgcgcggtgaaaagggacagcccggattggacggaccacctggaccatcgggttggctaaaaatattgaatttttaaatatttttcttaaaatttttcaggaattcctggctatcggggcgaaaagggcgagtcgggctatcctggccaacccggattcccgggcgaaaaaggcgctgccggcttaccaggctttcccggcacggagggccagtctggacctcccggtctgacacattatctaattattatttttaattatttattatggatttttaagtaatttttcggattcgctaaattgagacggtgttatgagcgttacttcaaaaaaccatcaaataaaaaaaaaattttccataaaactttgctcaaaagcaattcaattttattctttatatcgttcgatagctttaattattttctattaccctgaaaaatatcgaatgttcttaagatttctctgcgaatttatgaataattttttgtctatttttttacaattcaataaaacttttttgatcgttgaaaggctaattcaattaatgaggcgcgagcgatctttgattcagagcaatttatatattcaaagttctttctgaactaatttttggacaacagttgaacaatatgccaaattaaaaaaattttaatgatttattttaaggtccatcaggccttcccggtggcccggggccagccggacccgctctcagagatggtaaaataaacaataattaaattttaaaaaatttatttaaatcaaggctttgttgtggtcacacattcgcagacgacgcaagtgccgaactgtccacaaggcactgaaaagctgtgggacggcttttcattgctgtacattgaaggcaacgaaagagcacacaaccaggaccttggtaatattatatatatttttcatattttttttaaattcacattttaataatatttaaatcggatttatattttacaaaaattttcaaaatattgacaaaaaatttataaaaattgaataagcatggacaaaaaactcaaatatgaacaaaaatggataaattttttgaaaatattgacaaaaaaaacgaaaagatggataaaaattggcattctcagaaaaatcatttgttatttttaaaaatttttaaatcttattatcaaaatgcaattcttgaataaaaacttatttttttaacattgataaaaatatttcaagcctgattccataaaaccgaaactgtgcattaacctttaattataatttatttaatttttttttactcaaattaaggcgatgccggctcatgtcttccccgcttctccacaatgccattcctgttctgtgattttaatgatgtttgcaagtaaaaaatatttgaattaattaaattttttaaattaaacgcattttatttttcttttccatttttaagttatgcttcacgcaatgacaaatcgtattggttatccaccggcgaagcagttgagctgattttatatatatatatatatatatatatacatatatatatatataatttattgcttttttaataaaaattagaagtgtttaaaagtaacaattaaatttccttaatttggaaattgcggggatttgcgatattaatctccttcgggatcccttcaaataatcccaaccctgtagcggattgcgcaaattgaaaattccaggtttctattataggcgcaaaaatttcgttggctaaattaaaaatgtatattatttaatgaataaatatatttttttctattattatttagcttccaatgatgccagtgaacgagcgcgaaattcagccatacatttcacggtgctcagtttgtgaaacgcctgcaaatgtaatgccactttggtttatgaactgttattacttaatcatacaaaatgcaaaaatattttaatttgaaattatgttaattttatttaattgcttttttattatttctgatcaggtgatcgctgtccattcccagtccatccaaattccaaattgtccaaacggttggagttctctgtggatcggctactcatttgccatgcacactggtgccggcgctgaaggcggtggacagtcattaaggtagaaaattggcattttcttagaaatagtccaaaaaatggcgtgaacaaaaaatgccaaaaatggcggtaattacccaccaaaagatggcatggattgcttgccgaaaaagagaaggatgattcgggaaattagcttttctatattaacgagatccttattgtttttggcgccttaatggacatgtcaaggctcaatagaatcggaatttggccaaaaaaaacacgggaaaggagcgattgagggcgggagctcccgataaatgctataaaaaaaataaatgtagatgctttattgtaagtttattatcatattaattagcgcttaatcacaatttggggaggggaagtcagcttttttttaatttatatgatttttttaatgaatttttagttcttcgggctcctgtcttgaggattttcgaacaacaccattcattgagtgcaatggcgcgaggggatcttggtaatatcataatttttgaaattttaatttcaattttttcaataatatttactatctcacatcaactttcagtcactttttcgccaacaaattcagcttctggctgactactgtggacgaaaaccaacaatttacggtacatttacatttgagaagactcatcataatatatattcatgaaaaaaataccaatttttgatttatgaccattttttgtagcaaaaataaataaaattttgaaaaaattgactaatttgtcggcgaggaccaaaaaatctgcgcatctcatcagatttttttgtttatcttttcagatacctcaaagtcaaacagtgaaggccggcgcacaacgatcaagaatttctcgttgccaagtgtgtatcagaaatgtgcgataaaaaagaaagaaaaattgttatggcaaaattttgatttattttatattattttatcactgccatttatttgttcattttcattaaacatttttagaaaataatataaaaacgaaatttatcagcaaatatgctaattaatattaattactttcattaatcactaattaaggggatttgtttgcctatattttaattagggtgttctttttgcagtagttcaaaaataagaaaatttttaaattaatttattatttaaccttgaattgggcttttataatgtgcgcgggcattaattaaagaccgcagaagttacgaaaatggaaaaaatgaattccataaccttactcaaaaacatcacaaattttatattaattggattatcgtaaattttctagacaaaactaattaaattttttaaattagatattttttttgaaatttaaataaatttttgaaattatatgttctatttatagagatatcgaatgattcgaattatttaaaatttgatgatttcaaaataaacttatgaatttatttttcgttttcaatatataaagttttaaaatcatatgttctatttaatcaaatttagatatatcgaatgtacaatgtacaaactatttaaaatttgatgatttcaaataaacttatgaatttttttccttttcactgtatttttttccggattttcaatgatttactttttttataattaatgataaaagatttttaaaattatctgtgggtgcttatttaaaaaaatcatctatgaattttgtttgcgaactaagaggctcgaagttcgacaagccctagtcccaaccttaagcctaaaaatttaataaaaaaaatacatattatttaataattttaatcataagatgaataaatagtaaaaaattgattatttatataatacaataaaattgattcattataatatgtaaaaaatatttgtgcatttatattcattatatgtatgtaaaaatcatttcataaaaaaatgaatttattgcattttatatttataatctttttccttatttctaacatcgaaagcggcaaactccgaccaaattttgatcaaattttcggcaaagaatgggacaaaaaagaaagtgaagggaaagtgat

SEQ ID NO: 5516 - DNA, 958 bp, Heterodera glycines
cccaaatcggaacatttcttagaaataagaacataaagcattcctgtattaatcagaaataaaataaattaaaggaaaacgttagccggagtcggtcacgggggcgggagtctgaatcgcggaggcgggggtgaggcaagaaaacctgtcccgcccccggcgggggcggggctcgaaccctagtattttaacatcctcaccttaacacaaaacacttttatttttcaaataggaaaagtcacctttcaaattctgattaccaagcaaatatacaaaactgaatatttctttatttaatacaaagacaaaacatatacaggaaattggagatcggacattcatttgttaaccagattatcacattcttccagaagcataagcgaactttgtcccttctttgggacttttaaatatgtaaatacataatatatataaaaattattgtgctggacagagaaacgagcggcaaggaaacaaaaaataagttgaaaagtacggacacccaaggcaaagaagttacacgtccacattggtcaagctcatgaacacttgctccagcgaattctgagtgagcgaaaagtccacaatttgggggagtccgtcggtctctttctcgagtttgacctgagacggaaatgaaaatcaaaaagggaagaaattcccgagacggaccgggaattggtcggccaatgcctgcgctcgttcgaacagcacgctccaagtggtgtccttttgacgtggcaattcccagcgcaatatggcagaattcagcgggtcttggcactgcggcgactgcggggatttcggattttgccaatgcatttatctgtattattcaactcacagccaacacatcacggaccattttgtccaatttggcaccgatggctttggacgggttggcaacggtgatggaaagcagaaaactggttgcaaatctaagaaaaagtaattgcac

SEQ ID NO: 5517 - DNA, 5467 bp, Heterodera glycines
  misc_feature (22)..(22): n is a, c, g, or t
  misc_feature (32)..(32): n is a, c, g, or t
  misc_feature (38)..(38): n is a, c, g, or t
tcacatttttccaaaagtatanagcgaacttntgtccntcttcttttgggaaataaacatacatatatatatatatatatataaataattattgtgctgaacagagccgcagggatacagaaaatcgcttgaatccaaggcgaaaaagttacacgtccacattggtcaagctcatgaacacttgctccagcgaattctgagtgagcgaaaagtccacaatttgggggagtccgtcggtcgctttcttgagtttgacctgagacggaaatgaaaatcaaaaagggaagaaatttccgagacggaccgggaattggtcggccaatgcctgcgctcgttcgaacagcacgctccaagtggtgtccttttgacgtggcaattcccagcgcaatatggcagaattcagcgggtcttggcactgcggcgactgcggggatttcggattttgtctatgtacttatccgtcatattcaacttacagccatcgcatcacggaccattttgtccaatttggcaccgatggctttggacgggttggcaacggtgatggaaagcagaaaactgttgccaaatctaagaaaaagtaattgcactaaaattatgaacagaaagacaagtaaatttgcaaaaattagcacatgaattttccataatttctcaaaagttctacagaattcgttcaactttttagtttttttttgccaattcaaaatggtttttttaaaataattagtttttgtatattctttctgctttgacttataatgaaactcaaaagaaaactcctaaatttttctaaaaattggtccaaaataaaaactgaaaaattttccgcttaattaattcagttctttctcatttatctatcataaactttatttaacaaataaataaaaaagcgttcaaagtcaaaaaatttaaaaataataatgggcgaaaacacgtagaaaaatgggacccgaacccaagcaaccactccatcactaaagacaggcacactttacctgcatccttccaggatttaaacaataatgttttttgttgcctttttccacattttctgccccttcccccgctgttcgattgttctacctgctcttcaagtgttgggcggtgccaatgccggccaatctgccgcggttcaaaactgcaattcgactgcacagcgcctcgcactcctccatcgaatgggaggcgagcagaacggcagtgccctgctggcgaattgcacggatgagatgccaaacatcgcgccgcgtgcccgggtcaatgcctgcggtcggttcgtccaagagcacaaaattggcacaagtgagcaacgcaacgccaagcgaaatacgacgacgctgtccaccgctaaatttgaagttggattagttacctctttattggggaattgatattcaattaaaaatttcggcaaactatttcgtattgttagattatcagtccaaattttgcgtatattttggcatttcatccattttaacacaaattctgttttttgcctgttgtgtttaatccgtttgtccgcttgtttgtccatttgaatgcatttcaaaatggtctccgtcttttgcgacacttcggaaaagccgtttaattgagcaatcaaatggagcacttcacgtccagtgagttccattgggagagcatcgaattggggacaataaccgatgggcggatgcttggagacgcaaacgccggaaattgctgcggtgcctgaggtggcgaatttaatgccggacagaatgtcgaaggtcgtcgtttttcccgcgccattaacgcctgaaatgaacgtgatcaacaattaatagggccaatccgaaggcgtctgtcggcacgatagcgcccaaacataaaccatttcaaactagaagatcgatttttgcgtgctttgacagtgatgagagccagggatggggatttctgccgaaaccagtcctgcaattttatgctttgagaaaactcacccagcaagccaaaacaatcatcgcgctgcactccgaatgttatgccatcgatggcgggcacgttcccgtaatatttgctcaactcattaatgtacaatacgaagttctcgacgccttcttgtttcacaaattcccgctcttcgggggacatctttgtcttcttcagcggaaaaatcccgggatcgaagctgaaacagaacagtttgaagtaccaccgatcgcaaattatcaaaatttcgtttgactcaataacccttagacattttcactcggtttttgttaaaaattttcaaattacggattttatgcgatttgtcaatattttgctaaaaatcagaaaaaagcatcttcgctaaacattcaaaaagccacaaaataaaagaaattctcggatatgccggaaaagaagtgaatgcctaccctttggtaaagtctgtgattgaaaatgcgacacttcaattggttcaattgtcggacaacgaaatgcgattggagacaaaaaaggagcagccagtgaaaagtgcccaaggcaaacatgctaaggatgtagtccgatgccgcgtggaggctttcttttcgataaaccaatctgtacagtccgttcactggggaaagatgctaattatttatgagaaattggaacaaaattttggacgacaacaaataccgtactctgcttctatgactcccttccccccgcctttctgttgtatgaccagggcggggggggggggggtaaagaggggcaaaacactgtaaaactaatttcatacggtaagcacttactgaagtcatacggtggcagcagcaaaaagaaaacaacgttcagagttgttggcacccaatccataacaggaaataaagattcgaatagcaacacaattccgataccaacaagactcagaacgatgaggaccaaaagtgcccttgtgacggactgcaccgttttgaacagaaacgacgcacagcaaagccatggatggtaaatccaaaagaagagggcaaaaaggagcggaagactgaaagaaagacgtaaaattaattagataattaggatgaacaaagctgttcaaggcatggaaaaaaactcaaaaattgacctttataagaccggaatcgggttgaagtcttatttgaaatcacggtttttgttaattttaaacaaacaaagaacttaccgaagtctgcccccttccaatattccgtaaacaaaaattggcaacgaaatgcaaaagcaaaacagagcgtaaatgttcaagtgcaacaggagaaatgaagcccaataaatgatgggatggagacgggtcagcagcaactggaaaagagaagcaaacaatcaattagttattatgagatttattgggtttttgcattttggtaattttttaaaatttttattggattatatgaaccaatggaaaaacttcgaagtcttgagcgatttcttatctttttactgatgttgtgtcaaaatattgtttttgatttgacattatttccatagtttacttggtgcttgaaacgggacgagcgctcttctaccatcagtttgagcagaaaggagggcatcaaagtgatcaaaatgcacatcacaataaggacagggactaatttattgaggagatccgtattccttgtagcagtgtaaatgccaaaatcggggcggtcggcaacaccgtacacttcaatcgcaggaacaatggcaactgttgtgaatgagtaaaatatatttaaaaatttagatgggaggccccggtactattgagccccatgaggcagtaacattcgtttcatgttgtcaaaatttaagagcccggagagcaaaaaacagggatttgtagcgattttgcgccaaacatgtcaaattcttgcaattttggggctaaaacctaaaatatatttttcatttcgtttcttattctatttaagattttttcttagctgcctgactaaaataacattactttagcttattgtttcacattattaaatgtagaatagattggtcatggttgaatttttggtaggcgttatcgaaatttaaaaattttggaataatttcaattttttttttgctttttttgagaatatgaaacgaaaaatgtgactggcccattcggcggagcccaattgaccctaatcggtcgtgtcggcgtaaaacttccaacttatttttggttaactcgtttgttatatgttaaatgtatatgaactttataatctctagctgtcagcactcccacacaatacttataaaaaaaaagttgttcaaaaacgggtggaatggccgaactatccgaaacattttgactgtccccatcccgactattttctcgtccagcggcatctcaaaaatttatgttgttactcagaaaggacattgtcagagagagataaaaggccatacgtctacgcattggatatataaaaaagcaaaaacctacacgaattgaggcccaacaacgcattggtcacaaaagacagagccaacggcggagaatgcaaagcaattccattgaacaaagcgttaacatccatgttcgaatcatttgggtacacagaagcgccaattaccaatggcaattcgtcattatcgtggccaaagaatgagtcacgcttttggcctaatgcagcgggctctatcaaaattttttttgcgtatggaattttgtcggcaaggtcattgaaacttcgaaacgattcattatctgaacggaaaaaaaatttgggacaatgtgatgaggctaacaatagaaaactgagttatgattatatataaaaaaaattgttgaaaatcaaatatcgtctctaacttttgaaaagaaaggccgtcaaattcagcgttggatccctttcatatttttgactaccaactcccctcataatgtatgtaatattgttaatttgggctggtaaaaattttctccttcatcccatccgaaatttcctccatctttacaagaaaatccaaacccaataaaaaaacagaccaaaggaaatatcaaattgcaatggcaccgaaaagcgttccgtgtttacgaagggcgacaatgaacgcgaaacagtggacgaatttaagccgaacgacatcgcaattaggaaggaaaaaacgcaaatttgactgataaggcccccgagagagctgaacggattgcgcaaaagccacaggcattgacgacggaacaaagcgaacatttgctggccattgagtcggagcttggcgaaggaacttttaagaaactaaaagggaaaagcaaaaatgaaagagaaacatgggaaggcaaagtggccggcggtgcctccgacaggcccttttccagaaaatcctgacaataagggagagggggggggggggagaggggcaatcaagtgaagactcttttttattcttggatccaaaaaatcttttcatttgcaattctcacaaaaaaaaaattaatgaaaataaaatgtttaaacttacaattagtcattaagcaattctgacaaaaaaaaga

SEQ ID NO: 5518 - DNA, 1686 bp, Heterodera glycines
gaaacttttgagaaactaaaagagaaattgcaaaatttaaaatggggaaatttttaatattacgcccatatatacagcaaaaaactaaataagtatagcgcctcaaaaaatcgaaattttatgcctaagcgtatttccaggctttttcactttctattaattcccaacccaacctttacatttataattttttacttatttccatcaaagaaaaattattatacattttaagcctaaaaatgatttttaaattgtttacttttattatacaataattaaaacttatttattttcatgttggatttaaccctaacctccaaaaataggaatttaaccaaatgagccaccaattttgctattttactaacttgcgcaccatcgctgacaaatgaagggaaatacagtcaaaattaaattttgaggtattattcattttctgtgtttacctgctgttgtcgaagcccgaataagtcttgagcaagttttgtcgcgccgtccaccgaatcatcgccatcactctgtacaatggacccgtcaagttcgttcactctgtaacgaataaaagggtggttaaagaccaagaaaagcgggaaggtggcggattaattttgcctagctacacagcccacggaccatggcgaggcgtgggttcgcccccacccggggccgcacattttacccaattattacaaatgtaacaataggacaataacaaatccgttatttcacctgagaaagacttgctcaagcgaattcagagaaagtccgaacgattttattggccgctgatcgcccacaatttgttcaagttctttgaaaagaccggcaaagctaaaaaaattaaatgtcaataaaatgagcagagaccgattttggaaagagcctaattatttttttttgtaaaaaatatataagcagattttttaatttgacaaaaaaaacaaatatttcttacagttttttgtcttggactggcaaaattattgtaaattcgggcggattttgtgcgttttcaatgtatgcttggggcgaatgcttccgaattatggccaaaaccgttgcaattgcaccaccaaagcgtttctgctggccatcctccacaacccttccagcattgacaacctaaaagaaaaaataattagattttgaggaataacttgccaaattaagaaaaacaaaaaagtattatcgagtacatacatgggcagtgaggagttgtttccactcccccctcccccgtatcgtattccaccggaattatttaaaaaatatataaatctttttaatgtccgagggttggacccgaggaggaggagctgatacgagggggggggggggggggtccgtccttcaggtttcaaatgtttagcactcagaaaattgagcaaaaaatgaataaaccaaataaaataaatgtaaaacagtcaaaaaggctctgctgcctttgacccgacaattaaagaattaatgaccacattagcctgtctggtctgatggatttgaaacatttgggtgcatggatttacgaaattcttcccttgccctaattacaatattcgtttaatatagtggttatgcatttcaatttgtggaaatacctaaaaatattatatttcaactaatttttaaaattatttgcgcctatgtccaaaattgggttcaaacttacattttttcaatcttaga

SEQ ID NO: 5519 - DNA, 1121 bp, Heterodera glycines
ataaatacctttttagcataaaaattgtttttcgcttaaaatggaaggcaaattccaaaagtatgaaataaaattaacgtttcaatttaaaaatgatgcaaaaaaattttggggcaaatttaaaatggtgcaaaaactttttgtggccctcccccggggggtagggagagtaaattattgaccgactctgagccgattatttcattcattgggcgaggggcggagaatggatgaaaaaataataaatgtgttataaattcgcgcattaataaatctcataaatgtgtgtgtgtgtgtgtgtgtgtgtgttgcgcgtgagcacagaatgtgagtgagcgagtggtgaaaaatgcacttggaaaataattcaaaaagttttccccctccgccgcccgcgggggaaaccgccgggggaggagaagaaagtgaagaaaatttttgttgcatcatccgcgcccaaatacaacgcaacgcaactagcgggcaacgtgggatggattttgagcgcaaataacaacagcctttcaatgtgcgggttttattggaggtggtcatggtctcgaaaattgaaatttgtcgagactcgggaatcctgattggaaaatagtccgagaatttgagaccgagattctattaaaaaaatcgggaatttcttatcgataactgaatattgattcctgtcgataattgatactgagtgaggcccaaaaaacatggatttttcggtcaaaaatcaatgtgatcgaaaatctcgagcagagcatcacacattttatgggttttgttgccctaacttacaaattaacccaacttactaagacattggcactatgcatgaattttgagggctggaaaatttgcttttaaaaaaaaattgtagaggcaccaaatccttgcgaagcgtaattttaagaaaaaaattgtttttccaaaaattattttttattgaaaaaatatgccgtaagactaatctcctttaagattttacatcaaaaaattgcgaaaaacattgaaaaagccgtcgacgccaagccaaaacgcgagggaaccgcgggggaaatggttgagcaaataatacagcccaattttttatgtaacaatttatgaaggagggggggggg

SEQ ID NO: 5520 - DNA, 3813 bp, Heterodera glycines
ttcttaagaaagatgataataattatagcaaaaaaaaaagttatatattttttaagggaaattcaaaaatatttgtagttggcatgaccctcaaattgccaaatttctactaattagtcattttttgaaattgcaaggaccagaggaagccggaattttatgccaaagggcttactttcaggggtaaggtcccttaatggatcggggactcgatttcgcagaatcccaaaaaagtcgagaattagggaccaggggggacccgcattttatgaccctgttgggagcgcgcgtgataaaaagtcgaatttctatcccttggcccatacaaaaatgattagcaacattggcctttttagtgccgtatttttgtgacttctgccgcgccgatcaatttatttctaatttgtaaaatgccatcatatcatctcatagatatacacttttgcaatgctgataaatgtccaatcatcgacaaaaataatttccccccccctaagggaatgaatttgtagtgggagagggagggggggggaggcgttattttcatcgatgaacacattttgcccgttatctgccccaggggcaaaaaagggggcggggggcaaattggcaaaacaatcttcccaatgagcggaccaaagcaatttttgcatcccattttagggactgctattattgactgatatttgaacagctgacacattcataaattgtataatgagctcaatgtgccgaaaaatatgatctaatgttatgaatttattcaaaaaatatattttaattattatgaaaaaattttaaaattttttataatgttaaaaccaaatttacagtaataaataatccattaaaatttgtaaaaaaaaatgtttaaaaacaagcatccttcttttttatttttttaccgccgccaaaacaatcatcacaccaaaacaaatttggcttgcgaatttattaaaaaatatattttaatttaatttaggaaaaattttaaattatttttataatgttaaaattaaaatagtaaaaaatttagctttcttttttattgttttaccgccggcggcaaaacaatcatcacatcaaaacaaatttggcgtaatgatttttgaattgttgaagggcaagcgcatgagcatagccattcacagacacacagagagagaagggatgcctgcctaattgccttgcccaaatagggggtggtgggggcgataattttaggcacagcgcgccgcgcccatttttgccccgaggcgcgttgccactaattttgggcgatggttagctgaattggaaggagctcttccaatcgacacacataaaaggcaatgaatgggtggaaatgacgtggcgcgagatggtggtgttggcttgatgactctggaataaattttggggcgatggttttggtgatggtgaaataatggggagaaatggacgagacgatgtgcggtggtgaaaatttgcgccaacgacgattttgggatgatggaaagcgggagacaaagattgagggggataatgatttggatgatggatgtgtgtaaacagggcgaaatgaaatcgaaatttaattgggggaggaaaagcgactgagggatatttaaattggggtgaacatggacgattaaaaatgaattggctaattaagtgtgggagaggatgccatgatgctttttttattgaatgtggatggccaaagactggaaataaatcggaaacataaatggggctaatataaagcgtaaaaaactgttttgaaagcacaaaatattgaattttatcaaaaatgtatcaataaatttaatattttaacaatgttaaaacaattaatattttcatgtttttcatagttttgcaaaaataaaattctaatttccaaactcgatgcctaaaggcagaaaaacgaaatttacgggtcaataaaaatttcttaaaaaatcactacataaaaaaaatctcatacataatatatatgtaaatgagtcgattaacggacataattaatgccaaattgatctggatatggcttatctatattagtctaaaaatttaatcataattaatgccaaattgatctggatatggcttatctatattagtctaaaaatttaatcattatccacggacaactgatcaagggcaccaataaattttgatttttttttttttgctgatcagtgatcacttagagctgataaaccgcaatttttgttcggttagagcagcagaaaacggtgaaactggaaaacaaaaacagcgaatgaatttgaaagcgtaaggagcgaaaaaagggcggtatttttggtaaagtggacgaaatagcattagcagaagtagcagcaggtggtcgttgtcgtcgttggattgtacaaccacaaaaagaggaatttttgtgagtgcactttcgccgccccggtgagcacaccaaaatttgtgttgtttggaggcgtcgcaacatttttttgcacagaaaatttgtgcgcgagcgcctaattcgatcagcagtgagtgagtgaatcggtcaataaataaatagtttttttttgttgccaaatggcgtaattcacaaaaaaaacaggcctaatttagaacaaaaaaaaaacactgaaatgaaaataaaactatttttgtgtaaataaatgaagataaaaaaatgaatttcaatgaatcaatcggtcaatcaaacagcatttgtgtccatgaaaatgtacggaaagaaaaatttaaattcgagtgaatcaatcggtcaatcaaattaaataaataaaaattaattaattaatggaaaagaaaaagttaaattgaaggaataaaaataaatgtgaataaaatgtgtctaattaatgaatttaagaaatctactgacgtcctcctctttggggtgtttgaaggataaaaataatacactcgaatacagtaattatttataaacggtatatatgttaagttatatggtcaaataaatatggtagaattgttggaggttgaggtcatgcaaatactaatttagaacataaccatttgttctaattaacgtgttctaatgaatatggatggcatcattttagagagcaaaattttctctatcgaattatgttatttttacgcggaaaaaattatgatcacaattttttctatacataaaatagcgttgtcccgaaaaccaaattttcgaaaattgtttcgataagcggagcatatcctcccaggttccgcctattcattcaaattacaaaaaaacaatcaaaaattttttcaaatttcagcatgagttggctctagatggatagcatttgcttccattttccctttcgctcactcccttttgttttgcggcgtgttaaaagccgtgccgcccgcccgccgctcgtccgcaacaaggccccgaggggaaatgaatttgatgagtgagaaagtggtgtggtggtgaaaagcatggtcagctcagtagggagggggataaaattggggagcggatgatggcgagatggattagcccccgcggtcatccaccaccaacgccagcacccgccgccatggtgcgagattagcccctcccgccgcttcacagatcctcccaatcctcaatctcaaccgcgccaaatacaacaccattcacaacccaagaatagtcatcattatcatcattgtcggtccggcttttcccgcacattgggagcggcatggcgcgcgggtcctccgcttcaatgtgcggtggtagcgcttggattggaaatgcagaaaagcgaatttgtgtatgcacgcgcgagttaaaacaatatatgataaaaagcgcaaaatgattaa

SEQ ID NO: 5521 - DNA, 1416 bp, Heterodera glycines
  misc_feature (27)..(27): n is a, c, g, or t
attagttcgattcgttttttggtttgntgataattcagatcaaattgataataatttaacactttatctctttttgttagcctaattaaatgaaaattcaatgtcagaataaattcacaacttgccgttctcctcgcagttccgtcctccatgaaaattccaattaaatttggttgttataaactcttaattgagtagcatttttcttaaattcttaagacatccctcccgcctgtccttctgatgatgactgatgtgaataataataatggccttgactttccctttcccttctgctgacggtcacaaaaagcggctcattttctgcacttttacttttcagtgtatggaaatatacggctcaatattcatgcttttacataaatgtttttggaaaaatcaaatgcatttttattgttttatgccaaaaaataaatgaattaaatatattttaattatataattttgaagaacagagagactccagaaaagtccggacgaagaataaagctccagggtaaatcagcacgaaaagtgtctaattctcttaattggccaacacggataaaatcgcttcaattaattttctttcaatgggtgcgctaaccgcgccacatttcagataacaaatgcttattcacaatttccattctctcgattacatttacaagctaataatgtttccaaggcaacgaagctgggaaccggatttttaggcacttaggtaatattttaggtcctaaaaacaacgaaataggcgctaaaatgcgaaaatataggttctaattgacaaaaagttttttgttcaacaatgtctcaaaaaatcaattattttcatagtttcaaattttctgttcttttggaactttgattgataaaatccggatcacaaaataagactgaatgtttatataggaaaaaagaaaatatcgttgatatatttttctttgttttaaaataatataaaagcataacataagctgtatatttatttatttattttacatttttgacttggatgggataaaagttgaggaataaatgcgacgtgacagaagaggaaaattggggagacgttgtggggggggggggggggggaggaattgattcgcaaattttcaccttacaaaatgagtgagtgtcgcggaaaatattgaaaacttagggctaaaaataaaatgcccaacaacatttttatcattttctctaaattcaatccattctttaataatatttaaaatattacttaattgcactatcttttgattggtttcattaccgcccattttcaatttaaactcattttaaggcatttctctccttaattgcgccgtctttaggggctgccggggagggaaaagcgcaaataataaaaatggagcataatttaaataattatttgccgggggggggggg

SEQ ID NO: 5522 - DNA, 4732 bp, Heterodera glycines
cataaaagaacccaatgtttggttttaaaaaatatctatttctatgtttaatcgccgttttttttgtatttattaaaataaaaaccaaaatttatttatttaatggtttgttaaaaaataattggtaaataataaggatagaccaaaatagaatttacgtattaaaggaaatgcgacgaattccaaaaagcctttctttcgttccccaggaaagtgtctgctttgataagcattaaaatgttcttttcttcaacaatttgactttgaccacttttgataatcgcaatttatttttcagttcgtgactcatccatttaaaaaaacaaaaataaataaattgaaataaataaaaataaataacattttcaacattttcaattccttccccccccccccccctcctcagagaatgaccatttcctacactttggacgtgtccaagtccacttggggcggctttttccgtattctctcgcgctggcgcggcagcgtttggaaggcggtgatgggccaattgatcgtttggaccatcatttacatgctcatttcgttggtctaccgacgcctgctgaacacacgaagccaagaggcatttgggaaaaacgaaaattaattaaaaatattttcatttattttaagacatttgaacacctcgtgcactatctgaactatggacttgactcaacaattccgctgacttttatgctcggtttcttcgtcacacaagtggtcagccgatggcaatctgttctgaacggactcggctggattgacaagcaaattttaaatttaattattattaatttaaaatgctctgtcatttgcctgccttaagtcataattaagttggcaaatgccattttaatttcgagtcttgtaaatcgcccagctgctgctgtgtcttggcagctaataattatttaattggcttttagttgtttggctaataattttaattaattggcctttagttcggcaatgaattttgccaattatatccgcgggacggacaccgaaacacgaatcactcgtcgcacgctcatccgctacatggtgttgtgccaagcactcgttctgcgtgacatcagtgtgcaagtgcgcaaacgattcccaactttggacactctcgtcgcagctggtgaataagagcatttgaattaaatttcatgaaaattcgttttaatttcactaattaggcttaatctccaagccggaattggagcaattggacagggaagtccacgacaaatactcgcgttactggacacccattcactggtgcaactcaattttgtatgaagcgcgactccacggcaaaattgccagcgactttttgttggactcaattataaatgtaatcaattaaaaacaaatttcaatgcctaaatattatgcaacaaaaggacattcaacactttcgccatgggttggcttcgctgatgaaatacgattgggtgccaattccgcttctttaccctcaggtcagtcagtcgatgtccgtccatcgctaatggcacaaaaatttggcccctcctttttggcatcatttccgccattatatttatcgtcatttacatcaccggtgttcctcttgaatttctgaacgagctggggaagcttttgagggaaaaactatgggacgggccggctttgaaccggcgtctctggctttccggaccattgttctaccagcgccgaactaccgaccctgccctctccagatccccattttttctcgatcatataggatcaattgccgcctcaattgatccattaatcttcctctcggggaagcttcttctctatctccctctcattttcatttgcacagatcgttttcctcgctgtgcgcctttactttctgatctgtctgatcagtcgccagtttatttaccgaaaagaggctaagcaccacgcggagattgacctgttcgtgcccatcggcacaatgattcaattcattgtgtacgtcgggtggatgaaagtggccgaggcgttgctgaaccccctgggggaggacgacgacgatttggagtgcaattacgtgattgacaaaaacctgatcacgggtccgaattaaatggggcacctttcattcaaaaatcaccagcccattctgcgccatttttaggcttttcactggtggatttggccacaaagcgaacgccggagcagagtcgcgacgtgttctgggacaacgatcacattgcgccgttgtattcgatggaagcggcgcaacgcaccgtccacccactgatcggatcagcgtcaaaaataaagtgcggaacaaaatgaaggaggacataaaagatcaattaccgtatttacgtatttactgaattagaacccccggaggttctatttttcaacccctctcgaaaggggggggggttctaatacagtaaatacggtacactgatttggcatttctttttggcagcatggcaaagggcaaaaaaaccattacgatggcgcctcataagagcaaactgagcaaaatggacgaacggacgcggctggcacacattcggctggtggacaccatggaacataacgtaaagcatgcggaggagctgaaggcggacaaggcgaacaacgaaaacaaagcgttgggcgaactgcgcaagagacagtcagtggggcgaagggaacgccggcggaaaccaaattttataggcactactgataagctttacccccggaaaactaaaaaattgaaaatttgcacaaaaaattatatatccaaaacctaaaaaaaaattgacgcctcactccgtaactttggattaccgttaatgccaaaattgacttatttaccactttggagtattatggggattaattgcgcaaataacgcagaaaaagcgggaaaatccgcgacggtcggcacatggaagggatgccgtcgacgcgaagtgcacccgatttggaacgcgacgggttccatcgccttcgcgagagcagagacggcgaacattcgccgtcgcaccatcggccgaacggcacgagtctcacgtcgccacaccggacgaggagaggtaaagaaggggaattggcaataaaaaaggaaaagccggcggaaggcattttaatccatgaatttccgctgaagggtccccttttggcgccggcgccttgcgtcagcccgacccattgagccaaggccattacattggcgaggagatgccgcagcgcgacttgaacccgtacatgggccacattcagcgtgggacggacggtaatagaatcccggatttaaaaatagccggacctgggccaagactcggattccgagttggacctggacaggatcccggacaaaagtcctgttttaacaggactacaccggtgtgtaccgcgttcctctcccctcccccgattgtttcccgcattaaattcgtgaaaatttagatgaatcaatgaaaatgttttggacttaaaatcgaataaaataatgttcattggaaggtttcggcattgtcgataggcgccatgggagaaattttaaaactaatgagcgattagttaacagattttaaaagtaaatgacacaaaacggcctgagaaaattcaatttaatgaattaaattaaaaatataaaaaataatagtaaaataaattgtcttaaaaacattcttttggtttatattgtaaatcaaataattaatttaagatatgaatggctcgcgcggaaatggaacgggcggactccgccgattctaagacaacaaaaaatgaatttaatggaataaaattaaaaaaaagagaaatggaagtactcacacttctattattttgttttgatttgattaaccatttctgttaattaaaatataattataattttttcaaaaatatttcttaaattcgtcacaaaattcgtcctaaaatacttttttcccaatttaattcataaatttaaagatgcattttacagcatttatcccctaaaacaatttttatgcaattttcaagcacaacaaataacaaatagtcaatgaatttgtgccaatttcttgcctcattggccgtcttcgcatttctcgattttggccctgtttagtccgatttctcttgccttctccacaaatcctctcataagctcaattataatgcgcacaaatgccttcgttttttgcaaaaaaatgccaattcccggcactttctcgaaacttgtgggaattgcgttgagcaaattgctcgacactttgtacagtccgttgtacagcttaaaattgagattgatcaatctttgtgccgaactttgtacggaactttctgctccgcttgtaaagtcagccatctaaatttaaaaatttaaaatttaaaatgctaatgctaatgctgctagcctctaatttggtgaggaattccatgggacgaatgaacgaagcgcctgccgatgccaacaaaatgttctgcggcaatgctcgttggagctgtttgatgtatgttttcaaaaagtcctcccgcacatcaattggctcgatcagtgcacaaatcatttgttcggcgatttgtgtggcaatttgtttcatttcatttacatttatggcgccataaaactgttccaattgggcggacagatcggcggcgaacggcagcaacgacagttcgatgctgatcagtgccgagtcaatgcttcgtccggcatggaccaccgccagttttttctgcttaatttcttgctccattcttcgtttttcggcccctataaaaggtttgagcggtg

SEQ ID NO: 5523 - DNA, 2898 bp, Heterodera glycines
tcaaaatatgtacataaaatatggacaaaaatgccaatatatgcaaaattatggaaagtatggatatagaaatccatcctagaagcttcattcaacgaagctaaaaccatgtttttcgtgcgtttcagacctcccacagtccaggaaaaaatatggatttccatataattggaagccctactaataattcaaatttatttattaccaaaacggattttgaggtctattagttcattttcttccgatgaattcgcttcgtttgcaaatgaatttttatttttttccaattttttggtcggcttttgctttttctaaacccaattttattagagaccaattccaattattctcacttgattcgggtcattattatttattgcttctgccccttcaatttgccgtttttgcggcttttcctccgtttttaattggcccatcggaattccgttcgctttctgttcaattttaatgcctttgtttgtgtccagcaaaatttttgcaacggttttctctttttcaccggtacataaaacggaaacaaaaataaaaaataataaaatgcaaattttaaaaaacattttctttcgaaaattgccaaaatgaaaattaaagcagcctttttacgtttgattattatgttttatgaaaaataggtaagaatttaatcattattatgtaaatttgaaataattatgttaatttttgttttgtcaatattgatttgcttattgaatttttccaacataaaaaatttataataataataataataaataaaaataataaaagcaaaattgttcattgaaatatcaaaaatgtaaaaatgaaattgacgcacaaaaagagttaaaaaataaaaataaaaataaataataataataattgtgattacaattataacttttcacagggatgagaaaggcccttctttgcctattgttggatatacagtgagtgttacacaaaatgatacgttgacccccgtatttcagttttttgaatgttctaattaacgaaattgtttcagcggaggccattttgtagagcaattaaccaaaggccattttgtagagcattttgtgctctttcagattggcttaataattttttcaagaaaaattttctaaccccttaggaatttttttcgtaaattttcccgatttcaagccattttaaagttttcagattaccatgaagcagtgatctgatgaacatggtttaattaacttttttgatgagcttaaagatttttcttacataaattatatcagattttttgggcgacattttccgatattatgatttttttttgaaagtgaacgtatcattttgtgtcacctattttataaaaaattgctggatattgaagacccttttatcaattaaatcttattattcgtgcatttttattgctttgcacaatttcaaaacaatttcgttaattagaacattctaaaaaactgaaattcaaggatgatgtatgattttgtgtcacactgtataagacagtattcctttgtgacggtcacttctttggctcatcattctcttcaacgttcatccgatcattttcttattcatcatcatcatcatcttcatctcttttttcttcctcctcctcctcctccgtcgttcttcgtcccctcttttccgccgccccttttgatgagtgccgtttcagcaaaatgtccgcataacggaagcggctttgaatttgtgccaagaaggagtcgccgtagcacaggcccaagcagtccatcgtacgacagcaaaacgactcaatgtcatcgacggagcataggcggggggaggcacagcactcggcagccaacacgtccaactgatggacggaatctgtgatcaggtgatcagtgaatgggaccaaatcattttgggacaaaacatgggatccatcgcaatcgaaaaagcgaatttgagtgccaaagtcgtcacaccttcagcattttcgcgcagacaaggcttgtccatgttcgggaattggcaatggaattcgatccgttcccggtaccccgtcacacattccgacagaaagtcgcgtggccgatttcgcagccgtctttccttgggctgactttggctttttaaagcgccgttttggccattttcggcaaattcatcagccaaaacgagcagcgaaaagcagaggaaaaggaagaagcaaaaaagggaaagagaaaaaggacaatggccgaaaagaaaggacattttgaagaatgggaaaattaaaaggagaaattaattagtcactaaattaacacttcaattaatgaaataattaagggaatactaaaatgataataatacaaatggtaattataccaataataattataataaatgataataatagaaatggtaattataccaataataattataataaatgacaattatacaaatggcaattgttgtactcgtcggctggccaattgctccaaaattataaggccaaaaggggaagtttcccgccaggcaaattattattatatttgtgtaattttgtcgccttttctcacactttcccaccattggcaccgcattacccctttttcataacaaagtttcaaaaatgagaaaaataaaaatgcgattaaattttgaaaaaattgttattattaaattgagagacgagacgagacgaacaaacatttatttagacgcaacttaaattggcactttttaaaaaaggtaaaaatggccaaatgcgacgaaacgctttttgccggtgccgtcgaaggaaataaaattaatttgaatttcccatttattcgtactctttttacacattgtctcatgaccaacaaacaaacataggtaagtgagttccaatttccataaaagtgcaccttttacgtcaatcgaaaaacaatggcattc

SEQ ID NO: 5524 - DNA, 6105 bp, Heterodera glycines
  misc_feature (5035)..(5035): n is a, c, g, or t
  misc_feature (5045)..(5045): n is a, c, g, or t
ctaaactctttacgcgctgtcactttcacatttatttctctgttctcctctattaatctctttgtctctctctttctctccgtctcgctctccactctctctctctctcttccatacacacatacacacactctcttttcaactctctttctttctttttttgaattttttttatatttctctaaactctttacgcgctgtcactttcacatttatttctctgttctcctctattaatctctttgtctctctctttctccgtctcgctctccactctctctctctctcttccatacacacatacacacactctcttttcaactctctttctttctttttttgaattttttttatatttctctaaactctttacgcgctgtcactttcacatttatttctctgttctcctctattaatctctttgtctctctctttctctccgtctcgctctccactctctctctctctcttccatacacacatacacacactctcttttcaactctctttctttctttttttgaatttttttatatttctctaaactctttacgcgctgtcactttcacatttatttctctgttctcctttctctctttattttctcacccatctagagcagctcggcatatgctcacctcttctcacattgaacaccacatacatcttctctgtctttgcgctctgtgtctgatcttttcctttttttcttttccttaatttccttagctttcttactttctctattttctctgcctatttcttctatttttctatattttattcattattttgtcattcttttttttcactcactctttctctgttttcatttctcttccattccttgcaagcgatgcacacaaaaattgataataatctacaaatgcgacagtgcccagcctacacatttgtccatttttcatttggcatttttgtttgtgttggcactttctgctgacgctttttatgcactttctctaagtttgtcattttcattttttaataaaaatttaattttattttttgaaattcaattagttaattatattgtaaaatgtttgcaactgttgtcaccgcattggagcaccaaaagttgaaaagtgcgcacaacgcactgcagcaaaaagttgaacaaatggaagaaaagttttcgcagaaaatccaagaaaaggaaaatgaggtggaatctttcatttttacttttttaaactctatatttaatttattattttatttttatgggaacatttaagtgacctctctaatcacattaaaatacaatttaaaatttcgtcaatttttcatttttaataccctttaaatttctgctgaagttttttacaatctttggaaactaaaagagaaaaaaaacaaataattatattcatatttgaaatgaagagaggaaaggttcataaaggactgatcagtataaaataacagtcagcaaaaatcagagcttttttaaaaatttaattaagcaattttttggaatgaaatttgccaaaattgaccaaaaactaaatacaaagtttttactcaatttttttatttgtatgcctaattttcacagattgctcaagtgaaaagggcaaatgagagaatgcaaaagaaaatggacgaggcattggaaagaattggacgattaaacgaattggtgaggaaaaggggaaaaattaaaattttataataatttaaaaaagctaattttcatggcaatttttcgatcagatggaaagtcaaatgatacatttttatgagcaacaacagcaaaggttggacaatgatggcacatttattgccggcattgatgaggtgggaaatggaaaatggactataaaaaataaataataattaattgataaaatgatagcacgacaaataataaataaacaattcgataggcaccgtaaaaagccaaattccgaaaaatcactcattttttgtaaaaatggcttaatgctaatttgcaggaaaggcaattggatttacgctatcaatttgagaagtttaaaaaacaatcaatacttattttaaataatttaacggtcatatggcccaaaaccaaaaatgctcaaaaaatggcggaattggtttaaaacagctcaaatgaaaaaattgcgcattttccatttttccatggaataaaaattgggtactgaagtgacaactttgaatagaaactcaattatcagcccgttgctcacaaatcagttgaacctttaagactgagttacgcgccagacgattcagtcccttttgaaagtggacacttcagtacctctttttttaaacattaaacatgccaatcggtccctaatttgcatttaaacatctttatgggcagccattacttttgagtttgggccctatgaccgatattttccaatttttgtaaaaatcggcaagcaaatttaatttaattgtctcgtctgtttttatttttaattttaaaattgaacagaattcacttcaaactcaaaatggaattatgcagcacacaatggaggacaacaaccatcacttgctttttgcgcaaaagatcaatgaggtgggaaatgaaagaaaaggtcgaaaatattctcttctgtaaaatatttcagtaaatttttcattttttttataaatttgcaaatttttctaaattttttttaaaaacgaaaacaaggaaattcaattgcttaaaccccaaattctcgaaatttgcgaaatgaattttcatttcgcccgcccttttccatccgacatgctttaattgaaagcaatcatttaaaatattgggacattaataaataggatattaatttaatacattttacactttcagtgtgtcactgttgagcaaaaagaagtgagaaaattgggaggggaagaagaaaatgagagaataaaggaagaattggaacaagaggaaaaggaagtgaatgaagaggaggaggaagaatgggaagaaaataatggaagaggggaggaggaagagcaagaggaggagaacaatggaagagaggaggaggaggaagaaggggaacgggtgaaagatgaaggaataatggcggaagggcacgacaattacgggatggaaaatggcactgaatcgacacttggcactcaatttcaggcacatacaaaattttggcacaatgagaatttggaaattaaaaaaacaaatttcctcagaataagaatttttgaagacctattttttagaattttttattaagttatgagttttagtccaagttaattgctcaaacgatcggtttgtcagttttatggcaattttgaaataaatctttgggaatcgtgatctggcggtgccatgccacacgggaaataaatgaacacaataaaaattgcgattaaataccgtttcttttttacagtatgccaacaatcctaaaacaattacgcaaaagtattcattagctgcaaaattgaatggtcgtgccaagcgaatgtggtataaatgcgcgcactgtccggaggcttttcgctggctgtcagcgctaatacgacacgaacgaacgcacacgggggaaaagccgtttaaagtgaaaaatttaaaattttaatttcgttattgccgttttagtcaatttttccttattattgcacaatttttattaaactgattttttatttcatgaaattttcgtgttttttttacttattatagtcgcagaaatagaaaattaaaaaaaacaattaccgtaaatgctctaattatcacccatgggggattatttttcaagctccccagaaaaggggggataattagagactgggggataaatggagactgggggattatttttcgactaatttgtttagtgaaaattttttattttttcatggttaataaacatttaaacaagcttcaatttagaattaaataatttttatttaaatttaaaaaaatttagaaaaattccaatttatccccctgggggataaatggagactgggggattatttttcaaacgcctcgtagactgggggataattagagactgcgggattaatagagactgggcgataattagagcatttacggtaaggacaattctttaaaataagacaaatcaagaatcccattttacagcaatttttcagtgcgaccaatgcggcaaagattttgcacgggccaacacattgaacattcaccagcgcattcacaccggagaaaagccataccaagtggcaatatataaacaattaatcaattaattactccctaattaaaattaattaattgctctcccgagtcagtgtcacttatgtgacgctcgttttacgcaggatggccaactgaaaacgcacattttgattcacacgggtgaaaagccgtacaaagtgagattaaaagaatgtaactaaatcatgattagccgatttccaaaaataattcaattaattgccctagaaactgcaatgatcatccaacttcaaaactaattaattaactgagtacctattaactgtataattaacatacctaattctctttttttacattaatttagtgcacttattgtccccaaaaatttacacgtgctggcaatttgacaacccatcttcgtcgccacaccgaaaagaagccgtttatggtgtgtagatctggaaatacaaaaaagttaaaattatttaaaatagatgaatttccatttttttttaaatcgatgaatttccattttttaagtgttcccattgtggcaaacaatttgcagagtcaagcaatctgcaaattcatctgcttacacactacagaaaacgtaaagcaaacggacaattgagcaacagaatgaatgaattagtgccacaaaaaattgtccttttttgaattatttaatttatattttttgtcaatattattattgggattacagaaatattcattcagcacgataaaatgaaaaatattataaacgacgcaaataaaaacttttgagggtatgttattataacagagagcgtatcgcaaattttttttaaataggcactatttgtaaaacaataccaaatgcggaaattnaagttacttnaacaaaaaagaagcaaatgttaaatattttaatcatttttcaatatttttaattaattggtttccaactatttaaatatttatttagtctttcgattattaacaaatttagcagtagtgcataatttttttcggaattgatgcctaaaataaataaattttagggccgctgggctctatttgttaacagattaacttacccaaaaataacaattttatggattttttaaacatttaattttcatttttcaaaatttcaaaaaaaaacaaatcaatattttggggtacaattgtcacgctagcgcataaattaatagtatttagtgggggttgcaccacagccccgactttttcaacctcgacggtcgtgggtgcaacccaagtatttagttctaatgaactattttgcgaactctcttttccattaaattttcttatttatttgatttttgtacataaattttgtgaattgttttccttatgaatttctgaataaatatttgaacaaaattttcgcttattattagtcaaagcacgaataaaaacaaagaaattttttcaataaaaatggataattttaactttttctttaaaaattctcaaaaatttttaattattttaaatttaaccaaaattctcagctttacttcagcatatcaaaaaacactttgggttttctggcagaactgctgcagtttgttgctatagtaagccaatataggagcagagatgaatgttaaaaacacactaaatctgcagccaaatttgaaaatgccaacatcaccagcatcatcatcatcattggcaggttttttttccttcggccaacaaaaaaatttgggtattggaaaacaaacaagtttgtgaacattttttggccagtttaattttaatacaaagttgaaaccaatattcgatagttgtttgataacgcgattttttgaaaatttgcaggctaacactacacatttaaagctaccgaatgatattaagaatttctaatttggtgaacaatgaaaaaagttatgccccaaaaatattacttttcgactggcgacgtt

SEQ ID NO: 5525 - DNA, 1238 bp, Heterodera glycines
aaaaacattccacatggtttgtatggctccggtcaaagggatccacgaagtggattgtatgatttacagaatggtggacataaggtgggatgacagggatggctggaattgcgccacccatgtaggctgcccactgatcggaatgtatgctggaccccggcaccacaaattcttcaattatcggcaagagtgtggcgcgagatctgtctggcacgatgcggacaactccaatattggtgtgcacgtcatacatcccaaacaaccaaatctcgcgcactctgtgcccccggtgatactttcgacgcgcaataagcgcctcgtcaatttggacaacatgaccagcccctcccaacctaaaccaaaaataatctaattttaaaaaagaacaaccgaatggggttgtcaagcaaccaacggctgcaaatccctctgtaaaagtttgaccaatcgatcaatgtgtgaaatgccaatctgatcatttgtttttgcgtatgcaacggcaaacctagatattggtcctacatatattatgaaaattttgtttttactaagagcccagcaatacatcaagaacatgccctttcgaagcggaaaatgcgcttcctcgaaaaatgatcccgccctgacactttctgccctttgtgtgttgggcaacgccattggcatccgtcaaatgtaaaggttggatttttgacttgagtcatacgccgtgcgcatctattccggccacagatgggggcaatttgccgtaagaggccaaggtttcgcatataggctattgtatgctcatttgtttgaaattgtgaacaaaaatcaaaaatgtccatggctaaaaagttaataagctaatattaaaagtagtttaaattattctcattgtcgcctttgatctgctggtcattattattgaccgggtactatgcattcaaatgtttgcctggtttcataattttttgtttacactttcatccaccaacctactccatccttgttattcgaaattattgatctaagtagagaccggcgcgggacgggatcccgcgcgggattttgcgggatcccagtccgcaatcccgcattttttggaaaatgcgggatttgcgggattaatcccgcgggatcccgtcccgcaaagaattttgagttccaatcccgcagcgggatccgcaaatttgattttttgtgcgggattatgcgggattttattaattttttgaaaatttttctaagacagaatg

SEQ ID NO: 5526 - DNA, 6691 bp, Heterodera glycines
aggccaaactgacagagtggtttcagaaacgaagcatttcaacaggaaaaccaaaactttccttctaatcgaaattttgattttcaaaacagaaattatattcccacaagtcaaaacactcaaaatttcgaagccacgggtgcaaacagaacccctctgtttcagtcaaacaaaagagctcaaaacaaggaatcgaatatgatcatggtgaaagaagtaatacctgaaaattcggattcgaaaaccgtttcccttaatcacgtgggacacggagaaattccaacatatgaaaaattttttaattctttgattttacattcaaacgaatttccatctcaaaatcccgccaacgctgaatgttccgaaagtccaacgacggaagtgaatattgtcggaatgaaggcgatcggtctaatcgattcggcagcagaaataaatgcagcaaaccccaaatttttacacaaaatcgccaacgaaaaaggcgtggatttgctaaaatggggtttttgcccaaacaaaggaaattcaaaattgtcttttgaagttgcttcttttaatggtggaaaaatcccaataattggagtgcttaatgttccaatgagaaggggaaatttcgaatgtgaaataaattgtgttgtcacgaataattcctttccttacgatttcgtttttagcctgaaagcattaaactcactaggctattacatcggaaacacacttacaaatgaaatcttaaatttcaacgaaactccgaaaaattacaacaccactttactgaattctgttcgcatttcattctgtaaaattattccacctttttcatcatcttttgtcgattcatttattgaaaatgtgtcgcatttgcccgaaaaacccgaattcattatagaaaaccaaatggcctttgatcaaatggactgcgacgatgaaaaacttttggacttcgaggaggagacaccggtgaacgaaagtgtgaaatcgttaacaaaagaggaggaggagaaagtactgaaagagctgggcattgtgtctgaaaagcccaaaatttgccgatcattttcatcgccaaataatttttgtgccgatcgggtctcagtgctgaaaacggcgctgattgaaaggtcaatcgtcggttcggaaagaggtaatgtgaaagttttgatccataataaaggaccggaaccattaattttggaaaaaggtatgaaggtggcatatgcagaaaagttggacgaaatttttaatccaaatgtcgaattgtttccattagaatttgatagaatgttcgtgtctcaaaaattcataaggtcaactgcaaaattcgaacggaatttgagaaataaagaacttatttcaattctgaacaacaaaattggtgctctctcagacagtgaaaaggataaaatgcaacaattttggctgggattttctgatgtttttgcactaaatgaatttgaactcactcaaaccgatttatttccccatgaaataaaaactgaaaacgcaaccccaattaaaactgctcctcgtccaattccattcggtgtccgaacaaaagtcacagaaatgataaatgattatttgaaacgggaaataattcgaccatcaaactctccgtgggcatctccaattgttttagtagccaaaaaagatggctcaatccgattttgcctggactaccgaaaacttaatagtgtgacaatcaaagattcatacccaataccgaacattgaccaaattttgatgtatttgggaaacaaacactattttactgtgttggatctaatgtcgggttattggcaagttcgagttaaagaagaagacattgaaaaaacggcgtttacagtacctggtggtctttatgaatttttggtccttccttttggtctaggtaacgccccagccacatttcaaagactcatgaacaaaattttgtccgaatatattaacgaatttgttttcgtttatctcgacgacattttaattgcctctgaaacatttgaagatcatatgctccatctcagaaaggttttcgaaaaactgaatgaaaacggaatgaaagtcaaggcagaaaaatgtggttttgctttagaccaaaccccatatttaggacatattcttacacgagaaggactcgcaaaagatccggaaaaatacaaacccatcaaagaatttccgatgccaaaaacaatcaaagaattacaaagatttttgggaatggtcaattggcaccgaaaatttattatgaattttgcaaaaattgcggcacctttaacaaaaatgttgaaaaaacaggatgctaaggtgttaatttggtcggacggagcaaaaaagagttttgaatcattaaaatcgctaattgttcaggaagttgtacttaaatacccggattttaatttggcacaaaatgatccaaaatttaaatttcatattttttcggatgcgtcgaaagatgggttaggtgcagtgctttgtcaacgggatcaatctgggaaaatgagaacaatttgttacgcatcaagacgctgtaaacaaaccgagtcaaattatgggccaacagttttagaatgtttaggcataaaatttgtcgtaatttaagcattttatcgcatggcttccaacaatcgtatataccgaccataaggcccttccccaaatgttcaaaagcaaaaattcggtcggaaattcaaaagtagacagatggatcatggaattaggtgctccattccaattagaggtaatttataagcctggaaaagagaatcacgttgctgacgcactttcacgagcctttaactcaaaaactcttactttggaagaaaagggaagcgaaaattgcgcatacatttctgccgtcttaacacccgaaattccgaaattgccaattagtgtttctaaggaagaatgggtcgaggaaatcaaaaattctgaattggcttttatttggaactttttggtcaaaaaagaattgccacacgagttaaaaactcatcagaaacttttggaatcgcttggaaagtttacagttgatgaaaaaatcctttactatttgaattccgacagtgaatcagagctttttgtccccaataaatttgcgattcgttgataaacgaacaccattcagggccatgcgcagggcaccagagtggaaaaaagatttataaaaggctaaaatttctcaaatacttttggccaaacatgttttcggactgccaacattttgctaggtcatgtcgaatttgcgcacataaccgaattccccgaaaaaaccatccgggtctgaaaccaattaatactcaaaaaccaaacgaacttttgtgcatggatattttgaaacttggaccaacccgaaacggaaacaaatactgtttggtcatgatcgatcatttcacgagattttcagaagtgatcccaattccaaacaaaaaagcggaaacagtttcacaggaatttgttgagaaatgggttctgaaatttggagcaccagaggcaatccattctgatttgggaggcgaatttgtgaactcaattttgaaggaaataactgaaaaacttttggtttcaagatcaaccacttctggttatgatccaaacgcaaatggtctcgcagaaagattaaaccgtacaattattgaaatggtcagaaaaacgagtacaagtccatgggagtgggaccttcgcattccatatgtcacattttcacataacatcaccccaaacgaaagtaccggattttccccatcaactttatttttcgggcgagctctaaattttccaaccaatgtaacggccccaaaacgaccaaatcctctttacaccatagatttggatgaatatttgcaatttttcagagaaaattatgaacttttggttaaagaggcttcaaaaaacattgcaaaagcccaatttatccaaaagaaacaatttgactcgaaaccgaacgttcaaccaggaaaatataaattgggagatagagtaatggttttctttcgaccgtcagcacaaattaagcactcaaaattatcttggaattattttggcccatacaaaattaaggccttaagtccaaccgcagcatgggttgtgcctgtgaataaagaagaaagtgaacaaatcaaagtcccaatcgaacacttagtccatacaccaatcgaacttcccaatgaaacttttctcccaaaacaaagacgcggaaaaattttcaaaaatatgccaccttctgaaaatggaaaagaaaccagccagaagaaaattaattctgttttgacaaaatgcatcttttcagaaaatgtcgccccggcgaaattggcactcagcgcacactgctcaggcattgagcaacattcaaattgttcttgcattttgctggaagaagtgtttccgaacttgccggccatggaccctcttcgacgcgtccaattgtcatcacttggagaattaatcccaatttcaatcgccaaacagaaagggattttgctgggccatattcgcagttgggccaattcggatgaagaatcagcttcactccttcgccacattccaaatttcagtcccgacattcaaaatttcattcctccaattttaatgtgggtggaccgttgtgccgtcgcatttcaaaccctcaaaaatacgggaatgaaagttgtacagcaagagatttgctcaaaaaatccgctccaccggttcggggagttgatcagcgaagcattcgaagaagtgaaggcaaaaaatataatcggcttttcatcaatggaatccgaaaaattcctttgttacggcgactcatcggttcgagagtttgctagtaaattggaaacaaaaaccatcatttttaaaaacacactggaaatggccgaagcattcaaaaatacttattttacgactaaagtccaagaaattctgatcctgatcggaaatgacgatttggaccaaggccttgtgttaaatgatgtcgaagaggccattcgcaaaataattgttcatgcaaataaattctcaatcaaaactattttcattccacctccttttcactattcaaaaagaattttgcatggaaaattgttaaatttgttggccaaaatgttgccaaacgatggaaaaattgtgttggcaatgaaaagaggcaaccggagtttggcagaggtaacccggttcgggaacctcgaaaatcgccgaacagtgaatgaaaatggcaagttgaaaccgcctggcattcattttacaatcagttttttaactgatgtgtttggaatgaccacgccggtgaaaatgtcgtcagaatcagggagttcaggaattcgaaccccagccacttccaattcgcgtgctccgagtttgctcaatgtgcaaattccatcgccaatcattcctcacccccgtcaagagcaaaatgcttacaggcgtttcaatcgtggtcgaggaagcggccaaaatttccaaaatcggggggcttaccgcaattaccgttggcaaaatcatggggattatccccctccccctaaacgtggaaggttctgaacggatcgtcattaccttaattgtgccggataaattttatttttgattgtatttccctgcctcagacctacttataaatgacctcattattgtttcattttgttgtttatttatttgttttttttttctctcatttaataaattttcatcgcttaaaatattcgtccaaaaagagtagtccctcctatccaccctttccccctttatttcatttcagctctcgccttttcgcttcatcaaatccgctgtttgagcgtcgacgtcaaaactcgcaagcgctcgtctttcgctgatccgggggaggtgtgcggcgatcagaccgtgagcacactggtcttcaaacggcgggggacgtaggataaataatgatttatccttattatattgttttttgcaacgattgtttttcgcgttaatttaaaatattttgatgcttcatttaatttttcctttttattgttgtcttcgtgttctctcaagttttttatatattttttgtgtttttgaatcattgtaataaaactacaaaaatttggtgcttttctccgtggactgtcatccaacaacaacaaacgcccaaaggcttaattggtactgttgtttgagtttctaattgcaattcaccttattctctaattccttgccagtaaagtggtgttgaaaattaagtaaatctttccttgaccccaaaatctcaacccgaaccccagcaaatcccaaagtccctccccgaatatacgactattctccaacgtagcttagtatgaattttttcagaattttctgccgacatggaactgagtttttgttgattaaatttttgagtcttcacttttgctctaggtatggcacggaattccactttccgacttcggacgtttttggggttggaattccgatttccggaaaattttcgggcctcggaatgtcatccctgttttacacctgactgtaagtgaatagtgcattttataaactaaattattttttcaactcaactaatgtttcaaatggacgacacccaactcgtactgtttttcgacaaaaaaaatcgtcataacttttgataaagtcgaccaaattaaacatacttgatatcattcgtttggtcatgatcgatcatttcacgagattttcagaagtgatcccaattcccaacaaaaagcggaaacag

SEQ ID NO: 5527 - DNA, 1088 bp, Heterodera glycines
  misc_feature (1022)..(1023): n is a, c, g, or t
tcttttcagtttcgtcaatttgctggtcgaccgttccgtcaatttcgacgccgacgcgatgcagctcaaatacgcgctcatttgtcgcttggttgaggccgcgccgtccgcgctgaacgacggacagatggaaatgctgcgcgactattgcacgaaagggcctttttggggggcgccggtggtggaagtcgcgacggaagaggcggcataaatgaaaaggaacgaatggatggacaaagaggcggagatgatttcacaaataaaatgatgtgttaattggaaaccatagttatatttcgattttttctctttaaattttccaaatttttttttaaattttgcggcaaaattttggggtgcacccttttggttatcgtgtgggcgcaaccccatcccatcgattaattttaccattttttggccgaaactccatttatgctggtcgcttatggaatggagttaagcaattcaatcgaaccaatggcaccagaaaagaatccatcctttcccaatttttgctgtacgagtggaaattcagggcgaatcacacaatctgacaattgtgtagagattctccgggcattcagtagcttattcgagagccctttttcagttctacaacactttgcttataattttttatacaactaatattcttaaatacttgatggaacgttatagacaaaatcaatttcgtaatcagcgcattttttcaccacaggaaaaattttaaaaaaaattataagttaatttttcttcgggaccacaatctacacaattgcccacaatccatcgacagaggacataaatgaacttgacaagctcaatagagcagcaacaaattttattcaaaaataaataaagaaaaaataaatgttggatgagattcttcagctcgttatttggccacattcggagatgtaaacctgaaaaacattgccttaatggcaatccccagtcccgcactcacctgcatggtcgttttccctgacggtgtcccctgctgttcgacttgtcgtacnnatgtcattccctcaccacatgacccaaaacactgaatttcagaacgctttttgcccgattttttt

SEQ ID NO: 5528 - DNA, 1705 bp, Heterodera glycines
aaatgagagagaaaacacatcatacggaatcactattctttacgcggctctattgtaatgcatgacataaaaaattgaattttcgaacagcatccgaaaaaaacattcttggtgtcatttgatcgccacaagagtcctatattagtctacgaaggatgaaaaaaaaccaccaaaattcaaaaacatacgatcaaaaatttcagaaaagtaattttttggagttttttggtcataaattttgaaacacaacgaattttttgaaatttaacattttaatagaggattcttgagactatcgaatgataccaagaatgtttaattcggatgcttctagaagaaagttatgatgcattaaatttatcaattattttatgattggtgtaaactgctgcaatagagtcaaaatgccaaccttattccaattttgatgcccaaataaacttttggcagtttctgttggctgctgtctcttccctcttcctcctcatcgccctcttctcccgccatcctttccgtttcattaagtttttctcctccattttctcctggttcgccctgtccactcccctggccgtactgcttcaaccactcgtcatccgcccaaattggtcgttgacttcgctcattcacttttggagggcgtgcaaaattcactctgattgttttcccataaatctccgagtcgttcatattgtcaattgccgccgctgcatcctccggaagttcaaattcgacaaatctcaaaaagcaaagactaacattcaacttaaaatgaatcaacttacccaaaacttctgtgtttgcccgtttcattgtccaacggaatgcttatgccgactaaaccaaatttaaatttgatttattaaatttgtaaaaagcatctaaccgatgtctccgaatggtatgaacgcaagtgtgagaaccttttcattgacctcttctccgaaacctccaacataaactgtacgtttccgactgtgcgggaaatttgttgtgtatgacatgtgcacggattatataattctaaataaaacagatttaacaaagagccgtccgtcaggttcaaaatcactacagctcggtctgcacctggatccaacggatcatggacagtaaaaaacgagaaaaaatcgccaataaatttttggcataaaaacaaaatgccaattattactagggccgcgacttttagtgacgaaaaatcccgaaatagttaactaaaatagtgtcgaaaaagtgccacaaaagtgacaaaaattttatgcataaaatccttgattttcaaactttgatttttgattatttaaaaattagtaggaaactttccaaaattttgccgcttaaatagcagtgctcaaactaacaaaaaggcggtcggtcgaactgttgagtgaattgaaaatatgaggtgtatataaagggcaaaatttttgttttcatatcattcaccacacaattattttctttgtcttttgtcgtgcacaatgggacgagctgcgcccgatgcccaacagcgagaggacgacgaacgagtgactgatcgggattcatccgaagacgaaaacagtgaaggatgcgaatcatccgacgacgacgaacgagtgactgatcgcgattcatccgaagacgaaaacagtgaaggatgcgaatcatccgacgacgacgaaggagtgactgatcgcgattcatccgaagaggaaaacag

SEQ ID NO: 5529 - DNA, 2516 bp, Heterodera glycines
atgcgaatcatcgaccgacgacgaacgagtgactgatcgcgatcatcccgaagacgaaaacagtgaaggatgcgaatcatccgacgacgacgaacgagtgactgatcgcgattcatccgaatcatagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgagtcatccgacgacgacgaacgagtgactgatcgggattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgggattcatccgaagacgaaaaaggcttcgcgcaagtcgacatcgagaagggtgggaatgcctttaaaatttaattgtgccattttcgtaattgacttaccaccccctctcccgcatcgttcagcgaactcaccggaggacttgtggagcagggtcatcgcagcgtcgcagtcattcaagaaagtcgcgttccgtgagcaagtcgccgatgaagaaggatgctcgtccgcccggaagccgtcgtccgaccagccgtgctacgatcaaccgtcgttccgaggcggaggcgaccaacaccggtgggacagcagcggatggagctcatgccgcggagaagcaaaagaagaccagcaatggatagatgacgacaaatcggatgaaaagcgattatccaacagaaattaaccatattttttgtccgtcataaatgtgttaagagcgcccctctttctccccgtgtttgtgttgtataatattcatttcctataatcccgtgagatgcctgacacacacacatccgttgtatgaatgtccccttaatattgtcagtgaaggcatcctggtgttgtattgtcgatttaatcgctatgtgtgtctctcaattatgtttttgctctaccatgataaacgaacgatagtctcttgcgaaaaaacaatggaaaatgaattggcataagatttgtcattatatcctttgtaattattcccaagaaatgaattgccgataggcaccgccgggaaaaattttgagaatttgaatgcaatttgttaacagatggttgttaaaaatgacaaaattttcatcaaatttaaaaatttaagcgcacgcatttttagctttcataaggtttatcgtttctgaatccctcctaattatatggtcgaagcaaatttcaaaaatgcgcgaaaacacggcatatttatgcgggagatgcgatgtcaagctttacactagggctgggaatttaagccaaatgacttttttttgctgactctaaatggcctttaaatgacttaaaaagtgttctaaacttgtttgaagcttctgacatgcattttttgtgatttttttaaacttttttacactttttgggatttttatgactatttgagtttttgcgactttttcgtgattttttttactttttgagtctaaatttgaattttaatgaagaaaatgccgaaaaatacaaagaaaattccgaaaaataaaatttcggccgataaaaggcaatgaaacttggatgaatttttttaatcaattgttggaagaatctattttatgcacattttaggtacctatttataaaattaagtgtctaaaaatacgatcaaaatgttattctacaaattattaaatgggaattttttaactttcgcataatttttcaggacttttgtattttttacgtgttttttggattttttgtgacttttt

SEQ ID NO: 5530 - DNA, 1677 bp, Heterodera glycines
  misc_feature (1626)..(1626): n is a, c, g, or t
ccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgcgattcatccgagacgaaaacagtgaaggatgcgaatcatccgacgacgacgaacgagtgactgatcgcgattcatccgaagacgaaaacagtgaaggatgcgaatcatccgacaacgatgaacgagtgactgatcgcgattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgggattcatccgaagacgaaaaaggcttcgcgcaagtcgacatcgagaagggtgggaatgcctttaaaatttaattgtgccattttcgtaattgacttaccaccccctctcccgcatcgttcagcgaactcaccggaggacttgtggagcagggtcatcgcagcgtcgctcattcaagaaagtcgcgttccgtgagcaagtcgccgatgaagaaggatgctcgtccgcccggaagccgtcgtccgaccagccgtgctacgatcaaccgtcgttccgaggcggaggcgaccaacaccggtgggacagcagcggatggagctcatgccgcggagaagcaaaagaagaccagcaatggatagatgacgacaaatcggatgaaaagcgattatccaacagaaattaaccatattttttgtccgtcataaatgtgttaagagcgcccctctttctccccgtgtttgtgttgtataatattcatttcctataatcccgtgagatgcctgacacacacacatccgttgtatgaatgtccccttaatattgtcagtgaaggcatcctggtgttgtattgtcgatttaatcgctatatgtgtctctcaattatgtttttgctctaccatgataaatagggatggtaattatatgcacataaaatcgcaaaatatgcgcataaaatatgcaccaaaaattgcaaaatatgcacataaaaagtgaaaaatatgcacataaatttttccaaattgagggcaaattttcaaatttttatatttatttattttgaagaaaattgagcaaaaaaaggagaattttctattttctgactatttttggcataaaattccaattttttaaaaagttacttttttaccagaaaatatactcaaaaatgtgatttttttgaaaaattttcggtcattagagcccaaatggccgcttcaatagagggggccgttttaatagaggatttattgaaaaaatgcccaaaaaggcacataaaatatgcatgaaatgccanaaatatgcccaggagtgcacataaatcgcgaaatatcacaaatatgcaaaa

SEQ ID NO: 5531 - DNA, 1230 bp, Heterodera glycines
ttttttttttttggttgtttttgggatttttttggatcttttggtttattttttcaaagctttttgaaaaattttcgtggcctttttttttttttttaaagctttttttgtttttttggggattttttatgcctttttatagtcggctttttgaaagattttttgtggacttaaattcccaacccttttttttactttccctttgtttactttggtctatgtgaactacggggacaacagctgagaataaaacgacccccaagccccgaggcgcaaatgtggggtaaccatttattgtgcaacaaaaattacgtcaaagaaaatcgaaacattacattggtttaatggttttaaactcttaaagcattctcaattttcgttaattcactttcacttttgaacatcgggcggagaacggcgtcgaaaagattgaaacttttaaaactcagaaaatgataattttttttacatcactcacttatcgctgtgttcactgtcattcaatgtttatggtaattttgttccactgttgacagaagttcatttaatcgcttccttctcacaatttttccatttgttctcatctcgcgaaattggacaacgaatcagtaaaaatgatctatacaatttggcacatttcaacaccaatcgctccccgtcaattcattgatcagatcgaacggtacaacggaattactcaaaagaaaaatgacaatgatgaaattggcacgagaagaagcattggaaaatgcctaaaaggcggaaaacatgtgaattttaaatgaaaagaatttgatcaccgccattaggccttctgcttttgatagccaatcatccacttcataatagcaatagcatctgagcactttcggtacaccgtccggacgaggcgaaaaaagccattttgccattgcttgtccactcgtcgcattggcacagaaatcgggcggaaaccaggaggaaatgtcataataggaaaaggtaaagtgcagagatggacaatcggaaagaatggacaaattgccgaacatcgaaaaaggtggaggttgaatgggtagtcgaatttcagtccacgaatgccgtctttgagcagaggccaaagttgcgcataaataactccaaaatgggatcattgtttatgtaaacggccaaattaattctgcaattagcgaaaagggaagaaaaatggcgcagaaattcgatgacatttcggtcgatgtaacttaaaaa

SEQ ID NO: 5532 - DNA, 7039 bp, Heterodera glycines
ttttaccggtctctttcgttttcctgcaattttgtgtgtctgggtttgggcgggttcaatgagcttaacgggactgagctcaatttcgttaccaaattctacagatgcattcagatccatcatgttgaggtgtgctggagatttcacaattttctgcgttttatttccaccaaaagtcatgcgtcgtgttgttcctctgccaacgtattcgtctctaatcattaatccaaatcggatcaaaaagtctgcaaaaacaataattatcatcatggacatgacaatttttccaatttgttcccaattcccaaccattttgttgcgaatggactcactcacctgctcccattgttcagacagagtctttgttataaccgtgtcctcacttttaagttggaatgtgagttcactttctcttgcgaaattggcgtcgtaaaactggccaataaagtcagacacattcacaagggcaagatgaagaaaagaatggcgagcataagtcggtgccaatgatagatttaggctaaaaccgtcaatgcgattggcattcacctgcttgacctgagcatcaatttgatcaacttcataaagagaaccacgcacaaaaatgagctgtttgcggtattctgagcatggtgccagtctcgcatcagagctcaaaatcattgttcttgggtcaataaatgccattcttttgttgtccttcactcggaatttaattggaattttgtcaaagcattcgaattcggagtccactgagttcccaattttggcaaattcgtaatcgtgcgcttgcaattcgatgcatggccacactttaatcaattcaggcccagccacttttgccaccagtttaccggattggaataattttctggcaaaagttgttgggtctgagagaagtgccgtcgctgcccatcttctcgtctccaacatataatcacaaatcgatttaattgtctgagaaaaggaaagagtcagcatttctcttacttgttcatccaaatagcccaatttggagttcatttccgattcggtgacccaactttcaagtgatctcgtctttctgcttctctttgaggattcgttgctatcgtcggattgcaagtcttgtacagcaaatccttcctccgattttatcaaattcagaccacatgagttgactttctttgtgctgtcaagaaagttaaacgaaaactgacctcctcagaaatccaaatattgtcaagttgtagtcctttccatgtgacaattttcgaaaaatcacaggcacgggtagtgttggtatcccacatgagcaatgtcttgtcttccatctcacattggcctgccttgaattggcaattgttcactgacccgaggggactttgcataactgtgctaccgtgttgtgacataattttagtcttaaaaagataacaattttcagttgagacagtcgaccagctaaatgagccaattaaccacattcggggtgacaaatccaatttcttatcagtgtgcaagagtcccgagtcattaatgagtaggcctaagctacactttccattttcggccatttctttgcattcactcggagttatttgcaacaaaagcggctcaagagtctcttggatcggaacattggtgattgaattgtacttacgtacggattttcttacttttcggcaagcccaagcatcagccgagtgctcaaataaatttggcgaaaagacatcgaaagttcgaacaacaggtgcttttgaatgatcaattgacagctttgaacagccagtaactgccggcaattgccaaatttttcctccgttttgggtttgacagacaaggggatgcattggcagatggggcatattaccagtagtaaagggcagagtcattccaacaagcattaatgtaatgaacattaaagaagcgagtttcgatcgtacgcttggccgttcccaatttgacgttttgggaatgtttatctttgtttccggcccacaggctggggattcactagaggatccttttgctaattcattttcgacctgacaatccattgctgttgtttcgggtttgatgtgtgtgagcgcattcattgctcccgatctcggctcttcgtttttgtaattgcgattgtcctgaattttgaggtcaagtaacgactgggccaagttctcgaaaattcctggtgaagcgttggaagaacttgtagcatccatcacgttaacaggattctgccgattttgccattgtccctgagattggcgtggttgctgatttgaccatcttccttgacggaacgattggttggaatttcctctaaaattggcgcggcgttgatggcaattgtacgcaaaatgtccagcacggtcacaataatggcatcgagggttgcttgaccagtttctttggttcctggcggcctcctccccaattgcgagagcggcctcgtcctcctcttcctctttgttgttgtctcgtcgcatttgatccagaaaaaggtctaaaccctcgtacattgttgcttgacgaccactgtccagcacgatcattattctggtttgcttctgtagaccactgggactgggatgactgattgttcagcgcattgactgcctgaaaggcgtgatgcttcatcgcccttgttcatcaatagtaaagcctccaactcctctgcttgtgctcttaccaagtccaagtcttttgctcgtgatagacccaccagacggataagaaaactaatgtttggcttcaatctatccaaaaattcttcgcaaattttctcttttcgagttacaccggttaatgacgaatttgtcgcatccaccaaaggagttaagcgtctcagaaattgcgccaccgtctcatcctccctctgtttgcacagcgataaagttcgttttgcaatttcccgacgctgaggggagtccaatttctgtcgaagttcactcaatgctgagtcaagagtgtccgtttgtgctggtaataactccttaaacagtgcccgaggagtgtccctcagagccaatttgagtctcgtgactttttcttgttcagtgtaagccttgcctgacacggaaaggtagtccttgaaacgttctgcccaatcatcaaatgcaaaaacagactcctcacagaacatttccaaacctgcccccactgtgggtccgctcgagagcatgttcaggccaaaaagagtcggcctgtcatcttcgtcttcgcttgataattgatgaattggcacttggttcggtacgacttggttgggctgtgcattgcccattgggtcacaaacggcgcagtaatactaacagccccacctgaattcgtccaatcactgtcttgttccaacatatcaactctttcggttaaggtctcgaattggactttcagagtctcaaaattggcatttgtattggccacgacatctttcacccaattgactttttggttcaaggaacgattcaggcagcgaaaagctctgttcactccatcttctaatttccccatatcattttgagcttttttaaatcagagatttttatcgtggtctttccttgccaaagtttcctatcaatagccgaaatcgaggactcatcatcctttccactcaacaacatctttgtttcctgcccgaaggcttgggatgtaccaaaggggaactcatttgacgagccccctgatgtagacattcgaagtcgttcagttgtaataagattttgttttattttgctaaaaaaaattatttggtaatcccattatgcattaattgagagaaaaaaaataatgaatgacagcgggtaatcgaatgaatgcgagtgccttccaggaatgactttatctgctccatctccgtttaaacttcgcctaacaagaacaattaacaattctcaggcgccgcaaaaatgtttaaagtgaatgatctcgcccaatgaaaaaatgcggcggcacgtgattacgtgaatgttcttatggcgtgaaaactgagagaaaacaaagagataaaatgaactttggaatttgtaaaaactgtaacttgatagggcctaattttcattttttataattggtccctttttagttagctaaaatagcgcccctttgattggttatcagcccgggccttttgctttgctcaaaaaaaaatgttctatttttttttgtttcacttcttctctctctctctctttttttttgcttcacattcgttcaaatatttttataaattagtccttgttcgtttgctaccaggacttttttttttggttattttttttgcttctttcactctcttttcttattctctctctctcttacaaataattgttagatttgtcaattttcggtgcagtcagcccctttagcatttagactagcccgggcaaatttcattcttctttttttgcatttttaaaatccctttagcttttcgctagcccggacaaatgttctcacctcttttctcttcgtctttaatgtccctttagttttcgactagcccggacagattttctcacctcttctctttttaatgtccctttagtcttcgactagcccggacagaaatttaaaatgtcagacttctttacttgcgtgtacacgtctttgtttcaggccctcaggccagggagatctcccacaaacttctgccggcttacccaattctcagcttcgtcgtcaatgatgggtcgtcgtttcccaaaatgggaaccatccggtgctaccagtgagggatgcgcactgtgcccccagaccaactatgcaccgtttatcccggatggagtttgggagggaatggggaaaagccaaggcgcctttgaccaagccccgaacccccaaacgactcattgactgttaagatgtatttattcattcgatgttggatttaaacgaagcgagaaatcggaataataattgaagtctgttccatcacaactgactgaccgatcactggggaaagagaaatacgaagagaatgggcggagaaacattacaatgagaaaaggaaaaacgtgtgaaaatggataaatgtgattgaattgataatggccaatgggaaataattaaatgagggaaatgcgtcgaataatccttacaattctatgtaatttcattggttttgaaaaaaatcatttaaatcgttataaattgtctaattttaatttgttatatatttagtcaggttcaaaagagtatcgacaagttaaagaaaattacgatgataatttggtggaagtgatttttcggctcattatgcataggctaatgaacttctgtttttattttaactttttttatacaaaattaatttaacgtttttttatctattaattgatgaacacatcttcttgtatcgtcccgagatgggaccaacagattaaattattctacaccaattcgacgaaaaaacgcagttccaatgttggtttttttaaattttaaatgtatttgcatttaatataattaattgtttttaattttatgctttttatatgtttgttaatttcgaacatttgttctccgtatttttgctgattacatttagaatgccttgctgtagcggtggaaagccttgatgtaccggcagcaaattagctgtttacaaactgaatattctatacatatattataaaaggatatattcttttgtcactcgttaaattttaattattttatgacattttttttaattttaaggcatttatttttatcatatttttatatagattattttattgttatttttgatataatgtaaaatttattttttacatatcgtgccgacccacgcgtgtcaaaattcacttttttgacgtttaattataatcgaattattttaaatattaaaataattaattatactttaatggattttgattttttttcttgtattatttttttaactatttcatgttcgaaagatgttatttttttctttattttttattttattttctaattagatttaattatgattttttgttacgttacccaaattcttaaaattaattcaatttaattcttttgtcattttttcaggtatttgtttttttcctttcgaattgttattatttcgtttatttaaataaaaacattaattataaattgatttgtcatatgaattatttacatagaatgtgaatgtttcatttaaattaatgctaaaaccattttctcccggccgaaggccgggagcgccctgaaagtagtggaagggtcttacaactttttgaggcgcatctgggaaaactatagagaaaaattcagcacggacgactgagtcccggggaccgatttctcactttttcttgcagtttagagcccataactttttttctaaaactcggatcaaaaaattcccgctgtgagggccctaagttgaagtgttggctaaaagttaaaaaaaattctaggcctctagctctaaccccctggcctgggtgcttctagaacttttcagtaccaactttgtccagttcagtccccgttgaataactcattaggctttgacctgagcgcagggtggccagcagacttattgtagagctcaatgagctcgatttttgcaaattttaaaatttcgaaaatttttaaaaattttcgagttaggcctaaaaaacggttttcgggtttttgaattttaggaatttttaacgaattttcccagaaaaacggagaccactttcaagcaaccgtttttcaagctctatcgattggtgatatttttgaaaaaatttcgattttttcccggaaatagaaaaaatttttggcctgagcgggacatttgagtcccgggtccataactcgttaggggttggttttatcgaaaaaacgccttagggcaaaattgtagagcttttgaagctctatctaatggtgtgccatatggcgggaaattttcaaaaattttcgagctaggccccctagaaattttcaaaaattttttttgggttgaaaatgggggtcaaaaatatttttctggggtattttgatgtgctgagcacgaatatgatgtttatttttcgtttcaaaatttttggaattttttaaaaattct

SEQ ID NO: 5533 - DNA, 1350 bp, Heterodera glycines
taagtctgggattttgttagagagtgagcgagcatgaaaaagcaaacctttattttcatttataattttttgcggtttgctcgcgcacccctacgaagccttagtcctgagtcagcaatttgtttgaccacgtccttctcattgaggtgttccggcaggcgttcaacaactgctcacttcgacttttctttgatcagttccgagtcgacgatagcattgttgaacattcggacgatttgggatggaccaaattgcggaggacaaccccaaggaatttttggtgtaactgtgggagtactgttgttgtgtccattaatattttgaggatttgttgccgtttgtgcgagaagggttgccaccaaactttcaatttttctaagcgtaaatttagctgatccaaagaatttgcagcaaatttctcttttccatgggcttgcaaaagttgttgaagcaacttttcaaggttgtctattcggtaagagaaggccgcgaattgctgttcagacgagcttgccgaagtcgtgtcgtcgtttagattttcgcatttttggaattttttggacgagagaaaaggatttatcgattggtcaattttaaaatttattttttttttgagttcgaaatttaattctaattaataaacaaaaaaaatttaaaaatctttcttttgtaccttaattatattttttaagatatgttatcataatttttaatatttttctaaatatttaaattgatttaaaaatcaattcatcagttagcttttttgttgtttttaattagataaaattattcaattactttttcatgcattagtcttgtttgtaaaaatatggatttagttttgtcaaaaaattatttttatataatttattaacgataaaaaatttttacatttgtcttttagtatttttatttgtttgcaacttacaataaagtacttattccgctgttataataacgtattttaaatagagaaatttttgctactgttcaaaataccaaagttaaaaataatcgactcatattgaaaaaattgcataataagcgttataaatctcggcacgcaaagaaatgcttcatttaaattgtcccatttttgaagaagccctatcaattcttgccttatttagtccctttcggcgcattaaataaaaaggttttagtaacagaatttttaaagatatttcaattatgactgtttaattatttctgtagctctttgtggatgtgacttgattctttcattcttcataacagtaccgccgttcgaaaaatcagtttgccatatgtttttaattcattaaaagaaggattattttaattttttccccatttgatgtctatttt

SEQ ID NO: 5534 - DNA, 4551 bp, Heterodera glycines
  misc_feature (3177)..(3178): n is a, c, g, or t
tgcccgacagaattagaagcattagctgtgagattcggcgtcaaaaaatctttcacaatcacatcaacaatggattcccaccaaagttctaaccgatcataaagcgttggttccgacgtttaaaagcaaaagtgaaaccggaaacgcacgtgtcgataaacggataacggaattcgagtgcacgatttatcttcggaaattcgagtatcaacccaggaaaggcaaacataattcgcggatcgtgctttcacgttctcggcgcactcgaagccacgtgaattcggcggagaaaatttttagagttgagcaagtcgatcggaaatataagtgcttctcgtgccaaaaatcggaaatcgattgagtgggtcaacgcaattaaggaaagtgagctcggaaacctttaccaattcctcggaaaaaaggaaattgcctgaagataagcgggaatgtcagcgactttttgacaccattcataaattcacactgattgagggattactgtatttccatgattcgaattacggtaatcttcgacttttcgtgccacaaaaattccgcaataaactgatcgaagaaaggcacgaaggcaaatgtgcgggacatttaagcggcaaaaagattttcgggcaattagcagaaagatatttttggccaaacatgcgggcggattgtgtaaatgcggtgttgaaatgtcggatctgcgcacacacccgaaatccaagggcaaatgcgccagaattaagaccagtgattacggcggaaccttttgagctaatatgcatggacattttatcaattggaatgtcagaacggggaaatcgatatgttttagtaatggtggaccattttacaaaatatttgatcactgcagcaattcccgataagagcgttgaatcagtcgcaaaggcttttgtcgaacaattggtgcttgtatttggcaagccaaaacgtattcattccgacaagggcgctgaatttgtgaataaaacaatggaagaaatcagccaaattcttggagttgaaaagagtacaacggcagggtacgacccaaatgccaacggacaagcagaaagggccaatcaaactattttaaatatgcttaaaaggtcaactgattcaaattggtcctgggatgaccggctgccttttgtcacatttgcttttaacatcactccctctgaaaccaccggattttcgccttacaatttactttttggccggccagtaaattttccgtcgtctgataatgttaattttactgtaaatccttcatacacaatcgatgaagaaagttatctgcagctctttcgtgaaaatttgttaaaaattttggaaaatgcaaaaaataattcggacaaatcaagagaacgaatggagaaatggtttaattcgcagccaaaagtgactttgcagaagtaccaaaaaggcgaacgcgttatggttatttttccgggagctaacaaacgctcaacacataagaaattaaagtggaatatctttggaccctaccaaatcctcgaaatttccaaatcctcggcaaaagtaacgcctgctgataagaaaaatgctgatccaatttgcgtcccattagaacgtctgatcagagcaccggatggacttcctaatatttcaacaactccgcgcggcaaaaatgcttataaaaatgtgttaaatgtgatgactattttgatctttgaagaaaaaagcatggaatttgaacaggaaaattttttgggaaaaacaaaaacttcatcagggacgatgaatttttcagaggaggaggaaaaaatggacattgccgaagcggagattaagtggacgatgacatgtgaaggcggcggacatgtgttgtgcaaaaaattgttggccggcgatctcgaccccgtgctcagcaaaacacaaggaatcggtgctatggttgtgcagactccattacaaggactcatcacactattcattttgcggtccaatgtttcaatgtctgcgtcgaaagatttgctgaaggtcgcaaaccaattggaaaaactgggtggaattgctaaattgcaggccattttgacttcggaccctgatttcgaactattaaaatatgtcgaagaacgtggtgatgctgtgcgttcgggaagatgcccgggaatcgaagaagtcgaaatcatttggaaaaattgggtcagcagttgcgcatctgcacacgaagcattgaaacgcacgggatttggccaaatatgcttagaagcaccaatttcgctttctgagctgccggaagccgacagaattggatgggaaaaagtctttaatgctggcacatgggcattggagaaagtccgcgcaaccgttgtttttggcaaaacaacattggtccatcagccgagagtgatcattggagactcaagtgctgcgcaactttgtggcgaagcaaataaccaaattgttgctcacttcatcggcaccgtacaagggacattgggcgacgtgatccgcgcattggacaaatcagtactgacatcaaaagtcacgtcggcactgatcatccttggaagagatgcactgatcaaagggcagaccgtagcacaaattatggaagaatgtgaacgcatcaaatcaatttgcggacaatttgaacacgttcgatttgtgtggatcccgcctccgtatgtgcgtgaaaagcacgcacagtacaacgaattgattcctggattggagcgcattgccgcagaatggttcattgcgctgaccgagaatggcaggagtttgattgagatgtggagattcggagacactttcgacatgacacgggtgcgtgctgacggaaagattctgcctgaaggactgaaatgcctcagggcatggatattcactcaaatttctgtttttcccgatgacaatttccttggcattcgtcgttcttctcgctcactcccttctgtacccgctcaattttccgaattgtcaattcatcgtcctcatcaattttctcggggtcatcgggtccatccatattctctccagccaagctcaagccgcaacactcaaagccgcagtgatgggaaagcgtacagtagccgtagccgtcgccattaagccataaatgcctttgaccccacctttctgttctcaatttctcaattttcatatttattgttctaagacgaggggaccgtcttcttcagaggatgnnggatgtggtacttaattgaccttttgacttcttttatgttttgaattataattatttattggcgttttgttatctttttatggaccttaaaatattagtgagtcttttttactgttcgtttcttgtttggtttttttgtcttgtcttctcttgaattgctttgaatttcttttgatgctgacttcttctcaattgattgttgtggtctcgtctttttaattattattgttgcggtttaaaatttatcgccgtaaattattttgttttgtttatttattaaagtgtttgcgaattcgttttgaaacaggtgctgacaagccgacagataattgtgtttgatccatttctgaaaagagacaacccatccccatcaaccattttatgaccctatttaagtgcgttcgtttgtttaatttaatttttaaatgctaaaaaaaactagtgaaataatatataaatcaaatcacagcttttgaacatgaaatatgttcattccctgcaaataaccatgaacacagaattctaacaaattcaaatttttgcttaaaaaaacataatcacaaaaaaaaataataaaaattataatgaaaatcttaaaatgaattttgtaaatgtcactagcacaattcacttcgcactaaactaaagagaatttctttttccatcttctcagtgttacctttccaattccaaatttcttagtaattatttcttcactaatttttggatttcgttctttaattttgaaatattgtttcagcattgctaatttatcctcattagaatatttaatttgcgctaataaaaatactaaaattaaaaaaacaaataaactttcttacttttattgtaatttggcaacaattctcttttccatttccaaaatgtgtcattggaaatgcccaattccttcacaaattctttctgtttgccttggccatataaacttttaaattcatcaaatcgttcaatgaatttgcgctttttttcatcataaaaattctttttatttaaatttaattcttttttccatttgtatattttgttgcgatttgtgcctaataattttgcaattttaaactcaattttatttcttttttcgttttcatattttcctttttccctcaatttttctttaattgcctcaaatttatgaattatttctcttttttgttgatcatttgggtcatttcccatttctccacccatttgatcaactgctgagctttcattttcatcgttttgttcaatttttatcaagatttcttcatttttatttttatgccatccgttaccaaatatattggtcgaaattttgtcggattttgccgcatttaattctaaaaagtaagcaaaatataataaatattaaa

SEQ ID NO: 5535 - DNA, 2583 bp, Heterodera glycines
  misc_feature (181)..(181): n is a, c, g, or t
  misc_feature (190)..(190): n is a, c, g, or t
ccacgcgaaaacgaccccgaccgctactcatgagttgaaatagcgaggactgagttggcgacatttggcgttttgttttttctgtctaattctttgctggcttgtgtattcttttgttcactatttctctcgcatttaagctctgtgcttaagcttttctgtttgttgctgcttttccatntcatttatntagtagtcaatcaaaaaaaaaaatcactaaattacgcgtgtcccttttttaatgatccattattttttattttttggtttgcttcattgattttgcataaaatttattaatttttttttgatttttaaaggatgtgccgtaactcttctccgcttgtaaattccgaattgtttcggacaattttttcgctcagccttctcacttttgtcaattttttggggctttcatcggcccaacaagatgctattcgacgctttgaatataagcataggtatggatggattgcttgatggtgcttaaaccctttcaattgaattaattagtttccattttgggcgtattttacacatttaatttgactctatttcattttacacgacccaaaaaaaaacagaattggggttaaaaatttaaagttttttgttgcaaaaccaaaggggtgaccttttgatttacaaataaatcggttttaaacgacctaaaattatgaaaaaatgtaaatcatcaagggcgggaacttccgacacatactaagtttttttgccgttccttactctacataaatgctaaaaaaaattcggttttttagggctctattacagatcggcaccgccggaccgtaaaaatccttaatttacaagcaaaaatttgctcaaaatcgcaaaatttgtcatttttcggacaaaatctgttaacaaatcgcattgaaaattacaaaatttttcccggcggcgcctatcggcaccgccggacccccttgcgccccaaaagttttttggaaggcgccgcaaaaaaatcaacttcgtttttcatgttcagaattccaaaaaatgcttatttctaacaaaaaaaaatgctcaaattgatcatggacaatcaaaaatataacatttgaacattttaaacgtgttttgatacattttgtaaaaatgaggctttttgacccaaaatgaggtttttttgcatgccaaatgaggcttttgaaaattttaatctggcagccctgactatgtatgtgtattaatagaaaatattcatgaaaattttgaatttctttcatatataattatttttaacaaatttcaaaaaatctttttcctaataagattaattttctcaaaatttgtttataaaaatagctttttaaacatttcaggacttgatatcaaaggtgtgggaaatgggaaacatatttgtatttacactcttcttgaaggggatagtcctttggatctttttacgaaagatgggaaaagactatgtggtgaggattactcagaaatagaagaggaaaaagagttgatggaacagaagaatgacgaaatgggagggacaagcaaaaagaacgagaagggagaagaggaagcggagtcaaagaaagggaagaatgccaaaattggagagacaaatggtaaggaaaagaagaagacagacacgacggcatagagagagagggatggagagagagagagagagtgaaagacaggatggagagaagaagtgaaggaaggaagagaaggaaaaagataggaggagagttgacaagaaggaagagagtaagagataggaaatgaagagaaggaataggagaggagaaagagaaggagaagcagaggagagaagaagagaaagaaaggaaaaggaggaaggggaagacaagaaggaggagagaaagagaaaagagcaggaagaggagaggagagaagaagagaaggaatggagaggaaaagaggagggggaagacaagaaggaggagagaaagataaatgagcaggaagaggagaggagaaagagaaaggagtaggaagagagagagaagagaaagaagggaaaagaaaaagagaagagggaagacaataaggaagagagagaaagagaaggagaaggagggaagacaagaaggaagagagagaaaggagcaggaagagagagaagagagataatgccaataaaatttgaaagtttttaaaaaaattgtaattttcctcctcctttggggctgcttttaagagttttgtcattattttccatggatttttctctgtaattgttctgttatgtattttctttggttttccatttttaaattctgtcattttagtgtgatttccatttcgaagaagaaaaacttttgacaaagaaatcggaatttaacaaattttggatgcaaattcaattttaatttcattttttttcataatttgtcccattttttctcccagaatctgaggtcaaattgaaaatatttttgtgaatttttggccaaaatattgattttttccttaccatttaaagtagagttgcacgggaccgggaactttgacaaaaaccgagaccgggaattttcgggttgaaaaaccgggaatttttggctgggaaaaccgggaaaaaac

SEQ ID NO: 5536 - DNA, 1282 bp, Heterodera glycines
  misc_feature (31)..(31): n is a, c, g, or t
  misc_feature (60)..(60): n is a, c, g, or t
aaattttatacatttttttaactaaaatttntaatttatttcttggatatagaaatgccnccggttgctacggcctgtatctgttcaaaacccttagatcttatgatcatcatacactgatcactgatgacgaccaaccgcgtgccgttcattccattccatcgcctttcggcttccctctagttaaggatcgcatttctgttgctgtacccgtatgcttagatcaaggtcggatcctcggaccatgattaatttatccgatgaccaaaaaacctgctgtgaattgaaatccgtatgcacaaagatcgggtctatggtgatccgtaaattatgcacgatacgcgtgggtcatattccttttcttttccgtgtatttctcatcattagctatgctattttcttttcctctgactcgatccgctccgcggacatcattttcccccttataatatggatcgcgtgatccgaggaaatgatctttatcaacacggatactctggctggcgaaagtgtgccggatggagtgggcccatcgcatcgccccgccggaggggacggataataacgctatgtagttgctggtggtgattaaatctgtccctcgctctacaaattgacatatttattgggttggttgctcctcgacgggcagagtcagcaaaaccggatgacttttccaagtgcaaaattgaaaatgaaaattgcttacaaaaatatgcatttgggaaattgggctgctgccggctggcagtttagtgctaattgaggttcattaatactaattaattaattaataataaggttttataatgcagcatgcaattattggatttcttttcaaaggaaaacattatttgtgttaattaaattgataataaacaaggttggtattaattacaccgattggatcgttgtgtgacaagttgatataattttccattttaattataaatcaaaatttaatcataaattaattaaattccaatatactttttttctgctccaatttcgtccaaaattttgcatttttaataattattttccgatacttagttaaattcaagaaaatttacatgattacaaacaccaaatcagctgttaagatcaaataacaattggtaacttttaaaaatggattaataaaagatgattttgcagaaatgtgtcaataaatcaaattgcttaattcgaactctaataaaattatatatattataaaaataaaatttttgatttttttaatcatgttaattattttctaaaaaaattaaaaaaaaaaata

SEQ ID NO: 5537 - DNA, 6070 bp, Heterodera glycines
ccattttatctctttcccctttcgatcactttcggttttcttttctccccaattgatcactccctcttttgatcactttcccattttatctctttcccctttcgatcactttcggttttcttttctccccaattgatcactccctcttttggtcactttcccattttatctctttcccctttcgatcactttcggttttcttttctccccaattgatcactccctcttttggtcactttcccattttatctctttcccctttcgatcactttcggttttcttttctccccaattgatcactccctcttttggtcactttcccattttatctctttcccctttcgatcactttcggttttcttttctccccaattgatcactccctcttttggtcactttcccattttatctctttcccctttcgatcactttcggttttcttttctccccaattgatcactccctcttttggtcactttcccattttatctctttcccctttcgatcactttcggttttcttttctccccaattgatcactccctcttttgatcactttcccattttatctctttcccctttcgatcactttcggttttcttttctccccaattgatcactccctcttttggtcactttcccattttatctctttcccctttcgatcactttcggttttcttttctccccaattgatcactccctcttttggtcactttcccattttatctctttcccctttcgatcactttcggttttctcatcccccaattgatcacaccctcttttggtcactttccatctgatctttgatcactttccttctaatcccttcccatattttcctcccatctcttccccttccccctcagtaaccacgtgagccatgagcttctccaaatcggcacccctttggttcgcattttcgacatttaccgtccccaaattccgctcgacttcgagtccatctccaacttcatcaacgccgtcttcgttctccaagttcgcacttcgccgctgagtatgcagcaaaacaaccaaaggcaggggtaagcaaagaaaaaatattcggacgttaactctgacaaatttatgaagagagaagccgatcagcgaagaaaatgaaacggaaatgacagtgcattcacatcatttaaaactgaaaggtgagcgagaagaaaatgggggggggactgtcgatcagttgggtaactgatcagtgatggaggaatggacgagggggagaacgtcggtcagatcaaggacagatcagtaagggaggaataggggagggggcagtcgatcagttggagaactgatcagtgaaggaggaatgggggggggggagaacgggggaccatcagttgaggaactgatcagagtagtgatcggaaagatcgaacaattaattcggcacaatgatttgtattaaaacaaactggcaaggccaaatgatgctgttgagcagcggcaacgaattgctttatctgtgctcgccctacgtcacttccatccccgaactgcttaattatggcctccgtctctccgccattccgcttcatgacgtcactcgggacctcattctcctcaaccaacagcgattaagcgatgtggaggcaaatttgcaattggaagccaacaatgagcaagtaattaaacgcctaattaattggtgccaacaaactcattaaattatggcaaagggaaagcatagggattaggaaagacaaatgacccttaattacgcagttggaatttctggcgcgtgacttggagacggagaaggcgaagtcggacactcttttgagggaaatgttgccacaaacagtggccacaggtggcgaatgaaagaaagaaagaacgaaaataataaacaaatgtatggatgttttcttttccaaattcagctctgatcaatggccaaagtgtcgctgcgcgttcgttttgtccttttgttcttttgtccatttttccttttgtcctaatttgaccaatttcctccccccccccatttaaggagaatatcccgactcgaccgtgatgttctgcgacgtgcccgcctttcagtccatcgttcccttctgccaaccgatgggaattgtccgactgctcaacgatttgttcaccaaatttgaccgtctcgtcactttgcacagcgtttacaaagttgaaacggtgggaaacaaaaattcaaatcgttttaattttttttttccaaagattggcgattcgtttatgaccgtcggcggtgttccggaggcgatcaaagatcactgcgagagaatttgccttttggccattggaatggtgctttcttttcttaattgttttctgtcactattaaaattctttcgaagatttgggaggcacgttctgtgattgacccgatcagcaaaaaagggctcaaagtccgttgcggattgcactcggggaatattgtggccggagtggtaggcgtcagaatgccaaggtcgggaggcaatccggcacatttaagcgggagagaaatcggtttaaattttgaattttcaaagattttgtctttttggcgacaccgtaaacactgcgtcgcgaatgttaagtcattcgccacgtaagttgatcaaattcaaaaacgaactgattttggaaaggaatttcattttcagagggtttaattcactgcagcgaaacggcacttcggtagaaccattttaataattgaaaaatgatgacgaaaaaactcaaaagttcggcacaacggacgggacgattcgaatttatgtgccgagggaatgtgcaaataaaaggaaaagggccgatgaggacgttctttctgctcagatcgttcaaaaagtcactttgggaaattgtcgaaagggaaagaggtgaacagagaaaaggaaaagacgaaatagcatagggaaaagataaaagggaaaaaatagagaaaaaagacaaaatgaaacaaaagtgacattttgagatgaaagtacgaacagcattgacggatacgaagaactgacggcacaaatggaactgaaggggaccaaacaaggcgaaggcgtagccaaaatgatcgaaggactttttgacgacagaaggatggacagacggtcgacaacgtgcgcaatgatgtgacaagaaaggaaagaatgggggacaaatggacacgaaagggacaaatggacacgaaaagggacaaatggacacgaaagggacaaatggacacaaaagggggcaatggataaaggacatgcttttcaagaaatgtctcttgtcaaaaactctagcataattgaatttatgaattatatgtattaaaattttatacaaaaacattttttgatagaaacaaataaatgattatttttaaatgcaaaaactatgaatagacaaaatgtgtaagtaattctaacattttctgggcaattcacagggaatgtgagcgaaagaagcgaatggtcaaaggaaaagcattggcagtgcgatgttttcgtttctctgtcccccccctttttttggctaatttctgctgagtttggcctctcttctcctccttttgcgccgttcatagtccggcaaatcgcctcgtttggccactctgtccggatctgcgaatttcaaatggacattaaaacatttggcggaccatttgccgacctttcagctcattttggcacgtcgccccaaggtaccccggcgtgcattggcactttccgttctccgcgtcgcatcgtgcgccgttgtaacattcgcattgtctttggcattctttgccgaagaaaccctcggggcaaactgagcaaaaagtgtgccattgaatcgtgtgaaccgaggcaccactgatcgaacaaaccttcctcgcaattccttccgattcgtccgggagggcaatcgcaggcgccgctgacggagtcgcaaccgatggccgagggggaggacgaagcggacggaagatggccacactcgcaacggagaaggcaatgggcaccgaacgagcccaaggggcacaactgttcacacttgggggaggatgttcaaaaaagtatagttggcattccgtttgattattttaagcaacggaaagccacaaaaattcgtgtcaactcacgtggtcgccatggaagcccggaggacacagacattggcccgtcaccgggtcacagctggcaccgttctgacaatggcacgactcggcacattgcaagccgaattgacccggagggcattctaaggaaatttcaaatggaaaagggcataggaggccaaagtgaaacgtaccgaactgacaacgaaagccgtaccgccccttgggacaatgacagcagccgctggtcgggtcacacccggccgagccgtgacagtcgcattccatggagcagttgaagccgtacttcccctggggacactgctgctgacaggtgggcccaatccaaccggagctatagggaaagcgtggaatggcaatacataaacaattgacataaaataatcgcagtaatattctccgcttcggttttggcgctcacccgcatttgcattggcctgtctttgggtcacaatttgtcggatcttcgcattggcacttttccttgcagttttggccaaatcttccggccctgcacatttgcgtgcagtgcggccccgtgaagccgggcgcacaacggcactcgccgctgcgcgggtcgcagcgagcgccgttttggcagtcgcacaaattagcacagctgaatggtgagagaaaaaagtgacaggaaaaaagtttaaatgggtcgagcaatgatcaaattaattacgatgggccgtaacggttggcggggcacggcacttcgcaacgcgtgccaagaaagccggggggacaagcgcatctggagaggaacaaaatgaaactaactcccatgggccagaaaaactcactcgcccgtctcggaatggcattgggcgccgttttcacattggcattcctcgcaaccgacgccaaatttcccagtggggcaaccttaaaaccattcaattgcaaaaggatactgtagaaacaaacagtcggctactgtttgaacatttcaaagatttgtgaatttgctaaccgatttcacaatttttgcccatttgtcccgctttgcagaagcatttgcccgtttcggggtcgcactgttcgtttggcccgcaagtgcacttttgggaagacccaacgccaaatgtgcccggggggccccgcttaaaccaaacgaattaaaaagcattaattaatgataattaaaaagagttaatgggaaaacctctgaacatgcggaccccgtcagacctgaactatttgatgagagttcatatttaaaaaaatgaaagtgcctttcggacattcgcattgtccgctgatatggtcgcatgagccttttgacggacattggcaaatttgggcacagttttggccgaaaaatcccttcgagcatgcttcaaaatgttctctttagggatttttatcggattaattcgaaccccggctgcactttcgaccgcgccaccccgcgctgcattggcaatgtccgctgatgtgatggcatttggcgccgttttggcattggcactgttccgaacaatttaacccgaaagtgccctcggggcatggctgatcgcatctgatttatttgtttgcgaaattaccagcagcacaaagacgcacttttgtggcacctttttccctgccacccaggtaaacattggcattttccgtccgttctgttgcaatttgctccattagaacattcgcatttctccgagcaattcaaaccgaaaagaccaaagggacaaactgagagagagaggggaaaagccatatttgggtgcggattaagcgaaaacgaacggaattcgcagctttcgccggcccaaccggcggcacagcggcaaacgccgcgggaggcgtcgcattggccaccgttggcacagagacagtgggaaaggcaattgggaccgaacagcccgaggggacactctaaagatggaaagtggcaatagcaataagaaactattaagggcatcactttgggtgggtttgagggtcgagattctcgaccactcacatggacat

SEQ ID NO: 5538 - DNA, 1092 bp, Heterodera glycines
cagggaaaggcacaatctgtgccaaagaagcctaaagcaaacggaggtcacttatagttatttatttatttttctaattttctccacccgttggacagtcatcggcacattccgtcccattgggacaaaggcattctccgctgatggcactgcacaccccgccgtcgcattggcaacgctttgcgcacccgcggccaaaagtgccctcgaggcacggaaattggcacaattcgcctgagaaagtgccgaaatgatgattgccactgcattttcttatcattcactgttttaaactgaccatgccatcccggcgaacatacgcaacggctcttcgtccggtcgcatccgccgccattttggcaatgttcgcaagtgaattcgcacgacacgccgaagcggccataatcacaagctaaagcaacaattgtgaagcaaaggcaactaacagcagaacaattgaaaagttaaatggcggttaaatcaaaataaaaagcgttttttcggactttttttgttcgctttttgcgaattcgtccgatggttggcgacgccgcgaactttgagccgttcagaggtggggggattctgctgatggaagagcacatttgtggagaaaagctctaaagaaacaaacaataactgagaaaagcaaacggaggaaggaaaaaagggcaactgaaaaaggaaaaataaaaacggaaaataaaaaataaataaaaaatgagagaagaaagagttaatttgaggaatattaaacataacaaataagcaaataaaataatattactcccagcaatagaagggagaagcaagaagcaccctaccgtaacattccgctgtttttgacttaccgtttattttcgttcgtttttattttttcgctttgcttcacataccatttgacaagtcctccgacggttcgcagcttcgtccgtccgtggccaattgcattccctcggggcacaagcaacgaaatccgccgttggcattttcgcatgcgaattggcaatcggagccgccctcgcggcactcgtcgatgtctgtgcgattcgggtcatttgggaagaaggagcggcaccaaccgacacagct

SEQ ID NO: 5539 - DNA, 3109 bp, Heterodera glycines
aaaaggggtttttaaaattttcaaaatttttctgtacaagaaatcccacaaaaagggattgattaaagggcgatgccaatttaaaaaccttcaaatatccacaatttcgcataacagtattcgaaattgtttccagctttaaagcattcctcaacagtgtttcatttacagctgccagagttttagttggaactaaaaatttaatttcgttataaactccaacatttcattggtgaatgtctaagattcaattccatttgtgctcatttggctgtataattatgataattacgcttttttattactctttcccaccaagacccatttgaacagttttcttgaaaaattgttttaaccaacaaaatttgagaggctttttatttaatgtgtaagctattgatattttgaataaacaaaaaatgctttaaaaaataatttttataatgtgcagctaattttgagcaggaatgaactgattaattaattttttagaatatattaaataaaatttaaaaattactttcctacataacttttgcgcgcccatttgggaattagctttcttattctcagaaccctcaccaaaattttgaaggaattggttccaaaacaaagccattttacgtgcctattcctatttgccttaatatttcctaatcgttttgcctacgaaatgcacctacaaaaccattgcttttgagaggcttaaatttgtgaagaaaaaaagctcagaaaactcggttcttaataaaagtcaatctgaatcagaaaaattctctgtttttattaaagtttgcttcacatgtaaattttgaagttacttaaaagaattctcccatagctttgtagaagatgggtttattacaattacattccgtcagcatattatgttttgccttataatatattcatttgatcttatatagaatttaggctggaaattttttttacaataattcgacaattttccgcttcaaaaaggcgaataaaaaagaatttaacaaaaaaccaaaagaatttcaaaaaaaaaattgtcattcgaaaaacgggttacatacttttaatatgagaatttattagcagaaaacgcgccaaaactgccaaagaatcgaataaaataagacaatattcagccagcttatttttaaatataagttatactcattttagaaaacagctaaaaatgatagaaaaatgggtttttaaaatattcaaaatatttcatgtacaagaaatgcccacaaaaagggattgatttaaaggcgatgccaatttaaaaaccttcaaatatccacaaatttcgcataacagtattcgaaatttgttgccagctttaaagcattcctcaacagtgtttcatttacagctgccagagttttagttggaactaaaaatttaatttcgttataaactccaacatttcattggtgaatgtctaagattcaattccatttgtgctcatttggctgtataattatgataattacgcttttttattactctttcccaccaagacccatttgaacagttttcttgaaaaattgttttaaccaacaaaatttgagaggctttttatttaatgtgtaagctattgatattttgaataaacaaaaaatgctttaaaaataatttttataatgtgcagctaattttgagcaggaatgaactgattaattatcctgtttacgagtttttttgatatacaaccctcccacgttccctaattttgatgtttaacctttacaatttgtctcaattattattcattttagaaacttttctctgtgctatttacttttttaatgacaacttcatcatcatctgcttatccaatgcttttcttcacccaaaaatggagcggtgacggtgagttatgggcacataaaacagaaattatttgtagccggggtggttcaaagttccgattattaatttgactccttttttcgagtttagacagtctttgggtgttctaatggctccgcgatgagtcaaaattcggcatcgccagcatcgatgccgtgtacgagctggaagtggagaaagaaacgaggaagacattcctcggaagcagcattgccgatggcgatgtggaggagcaatgggagtaagtgaaaaattttttgttaaaacaaaataatttcctttaaattgatcgtttttttctttttgtttatgtcttgcctatcccaaacggccctctttagtagagatcggaccggtcggtttttttttcggtttttttcggtttcggtttttttcggttttttaaccgaaaccgttcgaccgaccctcttgtccggtctctactctttagggctgtaatcacccaaatggacggattgacatgcatttttttattttgtctttggtcttataaattgaatataaataataaatggcacacagcttgggtactgaccaggaaaaatttggaaaatacgttatgagatcaggcccctttacgataccgaaaattttaaaaatttcttattggagacgacaggcggccatcaatgtcacatcggtgaaaaacaatggcggaaattggaaccgaattttggaaccggcccaggggcgtagcagcgtcggggagggggttgttccccagaccacccgtactttttgtactctggtgcctaaacggcattaaatgaacatatgtatgacaaccatgcttttcgttcaatgacttaatggtttagaaaaataaaaaatatattcctgcagaatttcccaggaccacgcgcatctttgtcataccggtgattaaatggcattataatgacaaaatgtccgacagtcatgcttttcttgccatgatcgaataattaagaaaaaatcccatagttgttgagtaatttcccaagactatgcgaataaatgtcactctagcgccaaaaccaaatgagcatgttaatcatcaggatcttgatatttttccctatgtgatttacggatttaagaaaatcgcaaattaattattggagaatttcccaagaccacccgcacattttgtacgctggagcctaaacggcattaaatgaccatatgtatgacaaccatgcttttcgtttcatgaacttaatggattagaacataaaaaata

SEQ ID NO: 5540 - DNA, 1960 bp, Heterodera glycines
tagagtcaaattcttcaacaaattaaattcaattaataaaagcgcatttgcgtaagtgcattgacccatgtgcgcaattgaccccccccccctctccattgtccacttaaacaccaagttttgcttatattgtttaccctaccgctttttttcttttcctgcaccattgcttttttcttactttttttcgcggtaaaaaaatcacaaccaataacgaaaattttctcgttaccataaacgtacatattgtgcatgtcataatgcttgtagagttccgtcagtggcaaatttggtcaaacttgacgacatctcacacatcggtttcgccgaaaattcctccattggctgacgctaaatttttttaattaaatacagaagggaaacaaatgtgagagtgggcttcgtcagtacgaggtctctcttttctagaaaaaaagttctgtttcagccctgactcgtatacagaacaaagtaatcatcctggtgggtctcatgaagcccatgaggcattaacaaacaagaaccacgaagccaggctaaagccaccagcaaaccggatcaggacattttctcctgggcttcgctcaaatttgtttttaattatctaatttaaagccttaaaacatttaagaagtatttaaaaactcgaaaaattattcttgaattagtttttcaaaaaaaaattttgaaatttttcataaaaatttttaacgattttctttttgattaactaaatgtaagctagaaatttttcaaaaaaattagggagtcggggaagtaaagtgcaccccgagcaaaccaacaacggctggtgcttcctgccaaacacagagagaaacggcaacaagttgcgttacctgaaatggtcaattttgaaaaaagtgtatatgtagccaaaagcaaaagtatcatgtccaggtacgggccatgcatggacaaaggagtcatgcatttagcatttacaaagtaaagaaaatcacgccccccacccggttcctcaaaggacaaatttaaaccattgaaaaaaatacaaaattttcctacgaacttacaaaagaaatttttttaattttgtcaaataaattgaatatgcgcaaaattatataaaatttgtttgcaagccttttaaaattggggtaggtaagcaaaaaatgagataaattgtatgttttttttttgctaaattatagtcaatggcacctggagacaacggcatcatttatgatgttccgatggttggcgtgtccgtcggcctgtcaagaactggaagcaatggcggcatagtgttcttcgaagtggtgttagccgacccgttctacaccaactcgtcgaagggaacgacatttgtcactgccggtggcggctacctggacatacacgcaacggattcacttaaaaatgcgtacggcgccgccaaagtgatcatgcgcgaacagcgcaacaactacttggacaaagcgcatttgcatttgaatgttgtggcagcggcggttagtttaaattgctttttcaatttggaaattttaaaaaattggctgaccactcagacagggacggtcccagggggggtacgtacccccccccccccccaaggcccctccgcacccgaaatttttaaggaaaaattagtatttttgctgaaaattttaggttttccctgctggtacccccccaccacacttagcctcacccaaattttccaaaaaatttcgctaaaattttcaaaaaaatacacaatttttgatgaaaatctgctaaagatggctgaaaatcgcaaaatttgtcatttttgggacaaaattcgttaacaaatcggattataaattgcaaaaattttcctggcggcgtctatcggcaccgccggaccccctgttccacaaaaaattttttggaaaaaccgccgcaaaatgtggtgtcaaaatcaaaaaaaaaggtcgtcgcccggggggaggtacccccc

SEQ ID NO: 5541 - DNA, 4250 bp, Heterodera glycines
  misc_feature (4208)..(4208): n is a, c, g, or t
  misc_feature (4212)..(4212): n is a, c, g, or t
  misc_feature (4214)..(4217): n is a, c, g, or t
  misc_feature (4221)..(4221): n is a, c, g, or t
  misc_feature (4226)..(4228): n is a, c, g, or t
  misc_feature (4239)..(4239): n is a, c, g, or t
cccccccccccctactcatcaattccaactattttttgagccgtgggcggtccaaaacctgtgagtaggactaattcaaacagtgtcagtctgtttagttgttattcttgttcatttttcatatctttgatgaacctaatcaatgttaagatttttaatgatcaaaaataaaaaaattaatgtttatctttaagtagtgattttttgaaatttttcacttcgttatttttatcattggtttttagtaaatcgtatttatattagtgaaattgaaatgaaaaatattatttttgctaggcggcgcaaatgtcgcggcgcaaatgacgaggcgcaagtgtcgaccttgctgagcggcgcaaatgtccatttttgctaggcggcgcaaatgtcgcggcgcaaatgacgaggcgcaagtgtcgaccttgctgagcggcgcaaatgtccatttttgctgtgcggcgcaaatggcgcatcacgattcaaattaggaaaaggattttggaatatttttttattcattttagcactatttccctttactctgtgtctgtttttctttgtttgttttcatgggcagagattacaacaaataaatatttgttcaagcacatttcttctgccgattggtcatgtttcccccccccccctttgttcattgtcctaaatacaaaaatgtgttcaatcgcttttactctctccgttggttcactattaaatattcctccaacaatttcgcataaacacagcggcccaattttgggctccaagtacaattatgctggatttttcgtcttagtggtctgtgagttagtcaacaaaaagaggggctcaggttcaattcctccttgtgtttgtgtataaaattcaattttttaaagcaaacaaataaaagataattaattacagaacgccaaaagaaaaaaatttcaaatacaaagagttacactattttttactgctgattttattgaaattttttagcttataacttggtcaatactagaacaaataaaattattttatgctcattttgaagggaaaattctgaagaatatttctaagttagtcaaaagtttaaaaaaattgtttattggcaaataaatgattcatgtgttattttatatgttagagacaaggaaatagtacgcccaaatgagagaaaaagaaaaaactttgtccttgaaaaaaatttttcctattgaccaattttcttaaaattttgcataggcccatattttgaccccctctatcgaatcacggtttattttttagctgtctagtttttaactcgagatcggctcttatatttttacaagggaaaatccccaaaaaattttaagttttgcaaagttttggcgttctgattactaaataaataataaacctatttgcactgagagcccaaaattgggccgctgtgtaaaataccaaaaaaacaactcaattttccgacatgaatggcattgtgacggaaaatgcgccaatgtattcctggctttttgtgcttaaaatattgattggaacaataaatgcgaaatgaatgatgacggggaggtcagggacctattttgaaatgtcatttagcccgtgctcatttgtccacttttccttaaagtgctcgtttgtcccttttttgatgtgctcgtttgtccatttttctttgttaggtgttcatttacacctttgttcatttgtctcctctttttcagtgtgctcatttgtccacctttttttcatctttctctccgtttttatgtattctgttctcttttttgtttttttgttttccaaatccaacaaaaacaaattctcctccgaattctttcatcatctctagggatgggatttttaggggcgaaaaagtccaaaataggggcgaaaaaattttaaatgtaggggtgaaatttattaaaattgctgttttctctatgtaaatagttaaaattaagtcaaacacttttatttaatgattgcagttagaaataagtaaatttagaaattttcaagatttaagggtcgattcttaggagtgtattttttgaaaatttttaggtcaattcttaggggtgtatttttctgaaatttttttttgtcgattcttaggagtgtatttttattttttattgcatttttgttaataaatttcccaaaaatcgcgaaataggggcgaaaaacttattttagaggcgaacactcaaaatagggatttctagggtcggataggggcgttaaaacgaagggtttccgaacaaaaaggtgtttttcgtgcatttctcgtcgagttaaagccgcagaaaaaataagtaaaaacctaagaatactcaccctagtcattacttattgctgcctcatctttcttacattcctatcgctatccaaaggcttcataattttttccataaatgcccccggcggggtcgatttcaccgtctcccccccccccccatttaatcatcagcttctcatcgtcgtcatacccctgggcgattggggagggggctttgttggttcttttcctcccaaaaatgttaattactgttagtctcaaaaatattgtatcattttttttttgtaaaattcgttttctcaaaaatgaatggtggcaaaaaggtcttttttacgccaaaagaaaaaacatcaattagtagtgcactaattatagccaaaaattggcccgaaattttatatcgagataaaattctgaaaaaattccttctaagataacttttgatgccgatcaaaagtcttttggaccaacataaatcagatcactccttgatggtcatctctcatcttaacacccataaatacactaaaaattgggaaaattttcgaaaaaattcctagtgggttgggaaaattttctgtaaaatttgagtaggtctgtcagaaagagtgattgatgacaaaattatctaccgaattgcttttcatcgtttctttaaaatttttaacgaatcgaatttattggagtagccgattcgtaacatttttcaaaaattttccattccttcttaaaaaaccagaatttttattttttcgcttacaactaataatgtatgttatctatctgtcttcgaaattttcttactatgtccgtttcgttcggcgcaacaggaagcccaacagtttggcccaaattcgccggaaaatttccacccgtaacaacccgttgcaattcttaaatttaatacaaaatttttctggccttgcttcgggttcggccccatccaggacaagggacaaagcagtgttttttttacaacataaaataaaaaaactaacgctactttaaaagttaccgtttttgaatttatcaaaaaccaaagaggggggggagaccattatgctttgtaaattgtaataaaaaaatgtgaaaattgcttttcgggtttaaggatcgctcgctgcacaagaatctgacatccattttgaccaacttcgacttcctatagttgtaaatttgaaatgtcataatctcagtgaatcaccagcagaacaagcgctaatcacattaaaactcatttatttaggctgaggattggacaaatgatattagctaatgatacttatatatggaaaaacggcacgaaataaaaaagaataaaaaaataataagatccaattctcgaccattttactgtttgatgctgattgactgatcattgtgtgtaaatgttgtccaacaaaaactgtagtagcaaaggcgcatcgattatttaaacaaaatgaataaataaaattttttaaatattatttaccatgaataaatccgccggatatgttgaaattattcggtagtgatgcgtttttgtttacctggtactagaaagttgattatttccaaggtttattttaatcgaaaagtttctattaaattatcgcttgcaaaacttataaaaattaatataccaaactagcaaaaaaagaaaaaaagatatacaaaacaaataatttttaaaagtatgcaaagaaaatatctaatatacacatataccaaattcgtacacttcatatacacagataaattccccttcttgttgatctggggccaatcacaattacgaacgacaaacgacaaatttggcatttgtcttcgaatttgtcaaaacgacaaaaaattatgtcgtttgtcgtttgaataagccgatttgccgtttttccgtttgtcgtttgtctctgtcgtgtgaattgtcgtcctgtcccgnttgncnnnntctnccgtnnntttgtcgtttntcgtcggtttt

SEQ ID NO: 5542 - DNA, 1695 bp, Heterodera glycines
atgaatgaatcacaacttccatcgccagtgctatggaaaagaacattcattttagtgtgaatgcaaaaatgtcgttctttatacatacaacatatataaatttacccaatggacgaaacccaactcgtatccattgtcgaaaagtccggcgcccgccgaaagtacccaaacaactaggttttcaacaaacttgtaggaaacacttatcgaatgatggctaattaaaattttttaattaggataaaataattttgatcataaaaattatggctagagctttcctataaccaataaaataagtgatctttccatcattcgatagccctaagtattttctgctagctcgcaaaatttcacaaaaatgtgttgagttacaaaaaagttatggccaaaatttttgaaacctggttgcttgcgtacttatggcaataaatttgttcaaacttgactaaattatgtgaaattttgcaggctagtagagaactgtattgtctatcgtaagatattaagaattaaatgttaacctttttttgttttatttatcttttaaactgtaataatttgttaagaatataaatattatgctaaagtaaatgattactagggctggaatttttatgtgctaaaaatcctgaaatatgtaataaaatatgtgctaaaaaaacccaaaatatgtgctaaaaaccaaaaaaaggcctaaatatgtgttaaaaaaatgcaaaaatatgtgctaaaaattggaaaaaccaatggtatttttgcataaaaattccaaaaaactcattctttatcatttttgcccgcacaattgcaaataaaaaacatttggaggtgtttgggggtaaaattagtccttttttgataaattgtttttacagataatttttccatcagttgagtaagtgccagcaagaaacttcgatatccagtaacgaattaatgaagaattcgattttcggtacacgaaataaataaagaaaattttgaaagagcctataaaaatggcaagaaagttgatttttaggggtgcatttttgaattttttgtgtttttcttagatatttttttcaaaaatgccaaaatatgtgcaaaatatgtgccaaaccccgaaatatgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctagtcataaagcattaacaataattcggtgggctggaaattagctgccaaatttgtatttgggaaaattgcgaagcttatgaaacaatttttaatttaattcattctaattatctagcttgacaatttgaataattttataagaaaattgagattaattaaaaagtttggtataataagcccatgggattgggctaaggcgcataaaaccgttttttcgaggccgccctaaattcaatttccatatgggagttttagaattgctaaaataaatatttttaattgaatttgaggttctatgcttaaataaacgtaaatttttattggaattggtttaaaaattagcccgtgggccaaatttgtgtcaaaaatgaaatgcgagttttaagaaaatattactaattcatttttgcgctatac

SEQ ID NO: 5543 - DNA, 2147 bp, Heterodera glycines
ttcagctggcgtttggccagatgtgtttataacgcaaaacgctaattattatgaacaataataaggaaataaactaataaaataaatccgagaaaatgtgaccaaattgcgattaagataattaaagcaatttgttaatgatatcagactcagtaatttaattttcgcgttttacatgttattttctatcatgtgggtggagggcttttttgtcccatcagccacaaaaacagcaggaagcactttaaaccacagagattattatttaatttattaaaaaaaaaaataattgaaaattttttaaagttattccagtctattttttaaatgagatctgatgcccaattaaaatttattttttcaaatttccttcaattttctagaattatctatccgattaaagcttttagtgttttaagtactaactatcatctcccaagcttttaaatttttcattttttttttttggttttagggcctaaaaatttttaacacaacctaggactttttgaattgacatattgatttttaaatcaatttaaaaattttaatttttcaaaaacccttccgcggggagttttttaatccaatggttttcaaacggaaaaattgagaattaaaagcaaaggtataagattattatgagtatggtgtactaatttttcaagtgctttcgtatttggtaaaaaatggttgttataagaacagcaaaatgccaaaatttcaatgagtgccaaacggatgagcgccaaactcaaaaaaaaaaagaagcaaatttcggccctccatgtggaaaattgatacattgtcgtgatggtactcacaaatggcacacaaccatgccattcgcttaacgccaaatgccgtgtttttaaaggtgcgattaaattaatcacactcaaatggacattcgcgcaatgcgtataaaaaatgtgccgaaaagtgctcgccgagagagaaattgcgtaagttggcaaaacgtcaataaaaaaaaatcgagggtacttattagcttattgaagcatcccatcctctattgtcttttttttctttatttgcttcgtttttttttaaatttgtatagaaaaaaatagaattttttattaggtatctacgtcaaaaaaattgttgcctcacattaacgaaaaatacataaaaaattttttgtttatattggagtgatattgtcaattatgctgaattattgaagaaaaaactaaaacaaaagatgggaagaaaattgaaagaatttggctgataaaaaaataaaaattttcttaaatatttttaaataacaaacttttaagttaaattgaatatctttgtttaaaataaaaaaagcatatctttttgtagataatacatgaaaataaaaggaaattattttagataattatttattttttggaaatttagaattttattgtatataaattaaatatgattatattaatgtcattttaatgaaatatgattatattaatgtcattttaattaaatatgattatatttatgtaattttaataaatatgatatattaatgtaattttaattaaatgtgatatattaaggtaattttaattaaaatatggcatattaatgaattttatcagtgtttataaaagtgagatataattgagaaaattttaaattttcaaaatatttctttttatttcaacaaaatggcattgacactacaaatttgcaataaagaaaatgtttttggcattccaatttgtaaattgtttgccggaatttgtcatcacgaattacgggttgactctttactatttggaattaaaaaaacaaaggatgaaagataaaaaaagagatactcggagtggcaataaattatgcagaaaattaaacgaaaaatcagtttaatcattagggttataaattatatggactaaaaaacgccaaatatggacataaaatatggactaaaaactgccaaaatatatgctataaaccataaaaattacaaaatgtgtttatattcaatatttgcttaaacagacttaaaaataagctaaaaactgccaaaaaatagatttaaccctaaaaaatgtcaatttttattaaattctagctttacaattgcaaactaaatacgtctcaaaatttttgtaataatctcattctgt

SEQ ID NO: 5544 - DNA, 3465 bp, Heterodera glycines
ccccccccccccccccgaagccaagggtctggctaagcccttgaataagagataatttaaggtcgttttttaactaaaattgctaaatttgaaagcttggacttttgagttttttgttcaagttagggttccgagcttcggaattgcctaaatggatgccggattcgtgatcagcgacctcgaaacccccagggaacttaatattttttcactgacgcattttccgggagctaaaagtttacatgtcatcaaagaaaacaagtttcctccaaacttcttgacactggccagctttaaattgattttttgggaaatagttgcaaaaactttcaaattttggggtgttaaatcgttaaattttatccaaaaaggttacaacaaacttaagccaaatcaacattgagataaaataatttttaaaatgaaaattgtcaagaaaataaattaattaattttaaaggataatgaaaactaatctttacaatacttgtattataaatttttaatttgttatttgagaaggaaaaattatatttaaatgtaatgattattttatttattttttccaatatttgttcagtagaataaaatttaataaaatcttaaacattaattatttccgattaagtaggtttttatgatttctatgaaatcaatagagttgcgtttttgttatgtaaaaaaaaaacatattaattttaaaattattattatttttaaataaatacaatttttttatgagaatttttaaataaaatgaaactccacctattattcgttttatttatatttttgatcactcaaattaatcaaatcggaacagaaaagaaaaagttggaacaaaaatcatttgatgaaatatttggagaaaaatgggaagagaaagaagaagaaaaacgaaatgaactcaaaaaaagagaaattattggaaaattttataaaataaaagagaaaattaagcaaaagggaagaaaattctcaaaaaaagaatggaataaaatagaaataaaaatagcaaaaaaattagggacaaattgccaatatatttataaatggatcaaagaatttggcctatataaatacaaatcaaaaacaaatgaagaaaaatttaaaattgtgcaggaatttattgaactgacaaatgattataagcaaaaaagaaaatattcaccaaaagaatggcaacaaaattatgccgaaatttgtaagaaaattggcgtaaaccgagacataatttacaaatggaagaaacaatttggaattcgtgtaaaagaataacggaggaacaaaaaatggaaaaattgaaaatttataaataccggtaaaagcaaattgccttttgccgtttcttcatttaccgaaacaaaaatcgacgtaattggtgtggttaatgtacccattcagatgaaaagaattgaatgtcaaataccgtgtctcataacccgtgattcattttcttattgctaatttttataaattaaatccttacaatatttttattataaatgtttaatttgttattttcgaagaaaaataatatttaaatgtaatcattattttactgattcttgccaataatttgtttaatagaataaaatttaataaaatcttaaatattaattatttccgattgaataggtttttattatttgtaagaaatcagtagaattgcgattttttaatgtataaaaaatatatattaatgttaaaattatattttgagaaaaataaattccaatttattttgagaattttaaataaaatgaaatcattactattattttattcaattttaattgatgaatattcatcaaaataccattttaaaaattttttccaaatttttatcacgattaataatacaaaaaaagcgaataaaagatgtaaataaaacattttttttaaattctcaaaattaaatttatttattttttaaaatgtatgtattttatgttaattcatgtcagtgttgaaaggagttcaaaaaatttccatcttcgccaaatggaaataaatgatgacaaatatttattcacaaagtgtaatcaaatttctttaaaaggcaaaattttttacaaattttaatgtgcttcaatttagggtccataacttgtgaggaattgattttagcaaaaatcgtatttgatcatatttgtagagaatttcgagatctttctagtatgctttatgcccatgctctttttatactgtgatacgaaaaaatttataaaataaaaataaattttgaaattcaaaaccataaggggacaaaaaagagaactgaaatcattagcatattaatctagatttttttttattagccgtttctttggtttaccgtgcttactaattagtacctcccggggcttctatttttcaacccccctcgagggggctattctaatttagaggggggtgggttactaattcagtaaatacggtatattgattatgaacatggagcaccgcaacatgtagaaaccgtaattttgaaaaatacggactcggaccaggttctgaatatccgagttcgctggcaccggcctggcttagaacaaagcccggcgggcatatttcaacttcgagaaacaaattccgacaaagtcaattaaaaatggaatgagtttttcaaacttgttctgattttcacatttgtcctgagaaaaagaataaaatgtcgattttttttttgttattattagagttgagcggtaatcggtaattgcaaaaaaaccggtaccgatactgaccggtactgcaaaaaccggtaccggtaccggtaccaactttttcaaccggtaccggtaccggtaccggtaaaaaccggtaattttagaacataaaaatttttggacaaaattttccaaatacaaaatttttattcagttttcgcgcgagtacctgttttttagcattagaattgttcagaagtatatgtatattcaggttgaccaagttttttttttcaaattcaggacatagaacactaaaattcagatatagacctcaaaattcagattattgcaaaacaaggggtcagcagccaattttccaattttgcgaaggggtctccggccatgtaaattaatgtaaatcaatgaccttttttgctttcaacaccgctttttacgcggcacgttttttccaagacttttgggggacaaggagggcctgcggtgccgataggcgccgccgggaaaaattttgtattttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgtgtgtaattccatgactaaatg

SEQ ID NO: 5545 - DNA, 1659 bp, Heterodera glycines
ttagtaccccccggggcttctatttttcaacccccctcgagaggggtattctaatttagagggggggggggggttactaattcagtaaatacggtatattgattatgaacatttcaccgcaacatgtagaaaccgtaattttgaaaaatactgacttggaccaggttctgaatatccgagttcgctggcaccggcctggcttagaacaaagcccagcgggcatatttcaacttggagaaacaaattccgacaaagtcaattaaaaatggaatgagtttttcaaacttgttctgattttcacatttgtcctgagaaaatgaataaaatgacgatttttttttgttattataattaatgtaaaatatttctgttttggatgaaaaatttgttaataaatgtcctgattttttatgtttgtactgacttttttataatcgatccaagcaataaattctcatttcttcatttaataaataattcataaagataaaatttccttttttttttgaattgtaaattattactaatatttattgtcaattgaaaatgaaattctgtattttattatttttatttttgattgccctaattattccaatttttttctaaaatctctttacattgtgaatttattatatttttattgaaaatatgtttattattttcgaatgagctccagtagaaagtaataaaattttatttaatcattaatttaccaattggcaattattttgtcattaagataaaattattattattatttctttgcaattaaacaggatttccttattttattaagtaaaataatgatttattcagttttttaatcagaaaaaaatcatttaaatgcctcaaaaaatgaattgccatttaattgaagaaaaattaaattcttgaaaatgaaattctgtattttattatttttatttttgattgccctaattataccaattgaatcagctaatgaaaaattacaacagaaatcatttggcgaaatatttggagaaaaatggcaagaaaaagaagaagaagaacgaaatgaactcaaaaaaagagaaataattggaaaatattataaaataaaagagaaaattaagcaaaaaggaagaaaatgcacagcaaaagaatggaataaaattaatgcaaaaatagcgaagaaattggggacaaatcaaacatatattcaaaaatggattaaagaattaggacttaatcaacgcatgcaaaaaagctacaaatcaaaaactgatgaacaaaaaattgaaattgtgcaaaagtttattgcaatgaaaaatgaatttaaacaaaaaagaaaatattcaagaaaagaatggcaacaaaatcataaagaaatttgtaaggaaattggagttaacgaaagaacaattaacagatggaagaaacaatttggcattagcaagaaaagaataacggaggaagaaaaaatagaaaaaatgaaaatttattcgcaaataaaaagagaaaatgcaaaaatgagtgataatgaaattgctaaaattgtgaacacttcaaatgcgaataattgtaattggaagaaacaatttggagaagaaatgtttgagaattgaaacggatgattttttaagaaattgctttgagtccctccccgatcaccaccttcaaaaattggaatttttt

SEQ ID NO: 5546 - DNA, 1317 bp, Heterodera glycines
ttatttccgaaaaatataccctggatagtgtttcttttgatccattcacaaattaacaaatgaatgtctttgatgggatttcggcttcaaattactgatcaaatcgaaaagataaaatttcgaggaaaagatcgaaaaagaattcttgacaaaatgatttttgctgtgaacacatatatttcttacctgaactaaaagattgaagtggctttttgtttgtctcggtactgagtttgttgccggcagaaattttgaaaatttaagggagggctaaaaaccaaaattactttaacaaatatggatgggaacgaattctggttgcggattgcgttatcctttttgaacctttgaaattcctgatccctgaaattccgtcattggccccacccctggctcaaatacaatgtgtctcctccacatgcgtccattggccaatttgacccaccgcctttcaggtggacttccaaggcgagcgcaaggtgttccgtcctgaagaaatttcttcaatggtgttgaccaaaatgaagcagacggccgaggcgtacatgggccacacggtgcgcgacgcggtggtcacagtgcccgcctatttcaacgatggacaacgacaggcgacaaaggcacatttttgggaatccgggaattttggacaaaaccgggacttgccgggaccgggacttcgatttttgttcgggaccgggaaccgggaccaaccgggaaattttaaaaattcaaaaaaatttaatttaattttaattgaaaataatacaaaattaaattttaagtttgttttttatttaataaaatccaaaagtaaagctaaattaaattaatgaaaattttcaaatcaaattttcttcaatcatttcaaacaattaatcatttttggactaaatgatcgaatattatagaaattcagatttcataacttttttcggcgcgcttttccaaaaaacttttggggaagaaaggggtccggcggtgccgataggcgccgccgggggaaattttgaaaatattcactgtgatttgttaacagattttcaacaaaaaaggctggtttttgggattactaagctcaatttgtacgagttttctttaaaaaaatgataaaatatgagacaattaaaaaaatatgaagaatcatattttgtcgatagaaaacctatgattatacaaaaaaattaaaacattttaattactgtagaggaaattgaactatgtgaaagcagaagggaaagtcaaggagaaagccagtaggccatttgcgcacaaattggcactggtactttttaagatattaattaatattttttt

SEQ ID NO: 5547 - DNA, 2859 bp, Heterodera glycines
ttgaatttacatactgaaagtgatacagaaaattcttataatatactcaattcacgaatttagcatgatatgtgtatgaatttgttgcattttattattgtattccattgctttccgccactgtctctccttctcattcaacatgttggataatacccctgcctatttccccaattaattcttataactttaattgtcacatttcttcttaataaaagaatgctaataaaatatatttttatgattgaaagctaataattaaattaatttaaaattttcaaatcgaatttacttcaattatttcaaacaattaatcatttttggaccaaatgatcgaatattaatagaaattcagatttgcttttaacatcactttttttaggcgcgctttttccaaaaaatttagggaggaaagaagaggggtccggcggtgccgttaggcgccgccggggaaaattttgaaaatttgagtgagatttgttaacagattttcaacaaaaaaaaggctggtttttaagattactaggctcaatttgtacggttttctttaaaaaatgataaaatacaattaaaaaaaattaagaatcatattttgtcgataggaaagccatgagtatacaaaaagacgattcaaaatattttaatttctgtagaaggattgaaccaggggaaagaagggaaaaggcacggagactagccactaggctatttgacaattggtatagttgctttgaaagaatatatttatgattatttctcaattttttccctttaactccaattttcatctctaatttttcactcagacccccattcttaccagtgcttgtttttcccggttcccggttgccctaccgggatcgggacctgagcttttcaaaatccgggacctcggatgaccgggaattcccggcccggtcccgctctactctagttgaaaaccattagacaaatttttaataattcgtttcttgagagacaaaatattaaatttgttctgattcccattttttcaattttaaatacaatattaaaatatgttacacatttatttcataagaataaaaaaaaattgatttttaaaatattattattagaaaaaaaattgaattatttctttaatgcattttctttattttttaggatgccggtgccatcgctggactgaacgttttgcgtattataaatgagccaactgcggctgcacttgcttatgggttggacaagaagctgaccggagacaaaaatgtaggttccttctctccattttgaatacaatttgcctaaatttccttgaaaattcttattactaaataaaataaaatttgttatttatacaatttttagatattgattttcgatttgggcggtggcacttttgatgtgtcaattctgtcaattgcggaaggctcactgtttgaggtgaacgtaaaatctaacgtttttatgcctgaagcaattcatgtttaatgtttttttcctgaaagtggatgcttaaacaaacgcctcgggaatctttttcaatccttagaatcaaatcctcacaattaagccttgggaccgaaagttttttttaaggctttgaaaccaaagattttttctttgtgttcttttaatgcctttttataggttcggtcaactgccggtgacacgcatttgggtggcgaagactttgacgcgttgctggtggaccatctgaaagcggagtttaagcgcaagaatggcggacgcgacatcggtgcaaatccgcgcgcgatccgtcgtttgcgcaccgccgcggaacgcgcaaagcgaacgttgagcagctccaccgaggcgacggtcgattaaagatttatttgcattaaattaatgaaaataagttggatttaatggggtccaactgttttttgaagaaaatattttaaacaaatgcctttcgttgcagattgaggtcgattcgctctttgatggcatggattttcacaccaaaatcagccgagctcgtttcgaggagctttgcatgccgtaaggcatttaaaaaatttaaaaaaaaatttaatccaattttaagtctgttccgcaaaactctcgaacccgtggagcaggcattgaagtgagtgactgacagacaaatgggagggtgctgaatcaacatgacttgcagtttatggcaaaaagaagggcttgaaagatacaaaattaaaaaagactgctgcttttagagaaatgattgccaattgctgtatatttagggatgccaagttagacaagcgttccatcaacgaaattgtgatggttggcggatcgacgcgcattccgaaggtgcagaagctgctcaaagagttcttcaacgaccgggagctgaacctgtccatcaacccggacgaggcggtccgtaaaataacttaactcctctcggctttgatgactggcagtcccgataggccgtcggggaaattttgaaattattatctgacatcaatcaaatttgccaaaatattatttatcgctgtcgatcatttgatgtgaatttagtttattttcaggtggcttatggcgctgctgttcaagccgcaattttgtctggagtaaaggatgagaccacaaaagtgtgtgagaaaataatgaaattaattgggttcgaatttaaattagaaataattgaatttataagagaaatgggtacttgttaattatctgtactcagattttcaaaaaagtttgtttctggctataacttttttctttggcatccaaatccaacattgttggtatcattggaaagcttaacatgtttcgaagctatttctcgctatcgcttcgcgatcaaacaattatgaagaaagttatacgtgacaattgcgaaaagtcgaaatt

SEQ ID NO: 5548 - DNA, 3666 bp, Heterodera glycines
tgttgaaatggtccagtgtcgaaaatgtagtgtcgaaaatacccagtgtcgaaattaccagccacgatttcactgattcactttttcactatttatttttatttaaaaataaatgctcgggatttaaatgaactgatgatatattataccaaattaaagaacgattaatttgtaaacagctcacaaaaaagaaagcattgaaaagtaaaaaaaaataggtagaatttggccatttttcatttgtaacccttttatgtgacctgaccattttgaaggttaaatatatttcaccaagatctttgggctgatctcgatattgttggatttaattgatgaaaattttgtttttttggttagaattttcctcaagaatctactaatttgtaagcaggattttggcatatttagattatttcacctttaggcattttctcaaattagatttttcttacattaaatttacatccctaaatggtcaacaattctctgttggcctacttccacccctaacaaacaaccaaaaaacttggtgtcattcagtagcgataaattttctttagatttataccaagaatatttaaattttggatattttaagcaaattatcataattatttggtaagcaatgccaaatggacgctttttacgaaacgatcagcttgggtcgctatgattattaatagaattgcgttttccccacttttaattgaataccatgaaacctcttaattttatgggatggagttagggcatagattggaaagggactccacgctaattgtttttccctaaaaaccaaatgctaatgaatgcaattttaaatgctcgagctttgttttcataaactcaaatgctttttttctccattcagaagacgaaaacaaaaattttttcaaaatgtttcacttctctcttatccattccttctgctggcgtgtctctcctcagttcatttctgtacaaattataaattctttaggaaataaaatattcggaaaagtcttttcagggaatgtaactaattcattaattgatggataaattttttaggatcctgacgcgcttacacccatttcacttttgtcagaaaattaataatattgtaagtgtattactatcgatgcattccttaaatttgaatgcttattaccgtatctttttaattaacaattccaaaaatatgtgtaaaattcatgaaagttttttgtcctcccatttaaaaagcaggccttggtcttaaatttttgtaaatcgaaaatgagatttaaaataaatgcaagaaaattgctcgattttttcaaactttcacttaactggttgtacccaacttttctaatttcaaactgtgaacaaatttaaaattcggtattttattttgcggttttccagatgaatttgtacttggctaaatctgtgtttaggctaaaaatcacgaatacagtccctattaaatatgtaaccggaaaatgcgtcagtgatacaaatactttaaaataaagtgcttttagcattaagtattgtagaacaaaaggtcaaaatattatattataaaaacctcgttctgaattggtaatactatagcctcccttattcgaaatttttttttcaaaagtttatgtcataaaacaagttagcctgtgggtttttcgagtcgctgacatgaatccggcatccatttaggccaattccgaaccacggatccgaattcgaacaacttttgtattactacaacacataatgctactttatttttaaagaattatatcactgacgcattttctgtgagccgttaaatacctgttccacgctgtggtcgctttcactccccgaattggcaccggcgccgccgtgtcgtgccgccgctgggcgatgttcaccagcagaaggggagccaatttcaatgtcacgactttggtcaccatcactatcactattgtcgtgtcctttgtggtcattatcatcaccacgagggtcacacagacagtggttcatcttggcgagcacaaagattagaaagattacaaataaagctcctagcagtaagccgaaaattgttttcttcgaccatccactcccatcgtcgcgtcgtcgtcggcgttctgtgaaaatgaaaaaatgtagaaaacaaattcaaatttgatttctgacgggaagaacaaattatggtttcgtgatctttcgatttttaaaaatgccatgaaaaaaaattttatataaatttttaaattttccaaaggctttaaagccgccttccttatgaatttgttactgcttttttttgctttggttggtgtcgacggaaagagctgaactaatgacatcaagagcccgaaaagaattagggtctctgtaatatctaaattttaatctcggttattccgtcctggcacgatttcaaatcccgactttttcaaattccgagctctaatagcaccacagcagggcatttttgcttttctggcgttgccctaagtaaggtaaaaaaaaatagagaaactgaatttaatcatattttaactctcataggtgataagggaattcttttcaagaaatcatcttgagaagtgaacaattgataaagaaaatgactaactttttccactttttggcttatcaaatccattcaaacaaacagagtaatccgccatcagcttcagtagacgcttttcataatggctttcgtgttgcttttcttccgcttaaaatttcaaaagttttgaaaaatttctcgtaaattttttaataatttttcataatttttctttagagatttcggcatttttataaaatattaatcctggcccattctttaacactacagtacatttgtctccatgggcgcccttttggccattaaattggtgccaaaaactttttaattccttcagcaattctttcggctcttttttgttcggcacaatttcattcaatgaaatttgccaatgaaatgctaaactttttatcgcttcatcaatttctttctttaaaccatgcattatggaattttgaatggaagcatctgcaaacgaattaaaaactttaatattgttgctagcataatcaattgtaatttttgacattttttaattcgctatgagatttattatttatttacttttttatacaaaatataaatttatttttactaattaaatgcattgctgattatggatattattagaaacatttctcccttttcggctttttatcaaaatttcctttcgattgtgtttctcctcagcctttttaagacttctccagccacaccagacaaatttgtcgggaattttctcagaaccccgacttttttttggtttatgtttaaattcataaaaaaattttggcgattacattagtacaagtgtctgttttatcgcttatagaatgaattttcgaaaaactaaactaaatcgcattttaaatacattccatgcgatgcctctaagcaccactaggttcaaacgaaataattcaaaatattttttcagtgccaatgccgttaactcttttgtaagaataccttatttaaaaaaatttttgcctgtaatgtcccggacattcaattattcattgaacagaaaaaataaaatgaaatcttgattagttaaacgaattttgggcaacaaaaaaacattttaaataattccggaatttcgggacctccgg

SEQ ID NO: 5549 - DNA, 1467 bp, Heterodera glycines
aaatttataaatcaacatttttcagacgatggtttgcgactccgttgtggcgacactccgttacggttctacaatttaaattgaacgtttgagatctgacactcactgtttcccagacgatcacatcggtgtaagcggccgcggcctttgtcactttatttttttttgaataaataaattattgtttgtttatttatatgtatttgttatttgattgacgaatgaattgaattttattgcctatttcaacagcgtgttatttatttacatacctatctaaatttgatctttgattgacttggttttggtgagaaaattttgaagttagttaattttcattgtacagtacaatacagagccgctgaatgagtccacgccccccccctttgtttaatttaccacaataaaaatgcccacatatcagtgcgccatgatttgtttgatttgattttaaaaaaagtacttttcaatcaatcaagttaagagacaaaatttttgagtacttgactgtttcgagagcacacctaaaaaaacaaaaaatcaacaaaaggacgcgccaaaaaataaacaaggcgcgcgtaacattagtgggtagggacggtcccaggattaaataagaattgaatttttaggtgtggcctcataacaggcaaatgcctattattgttttgatcatttcgtggaaacgcattaaaatttaaaatttcttgcaggatggacattggcaactgttgcatttgtctaggtgggtttggcgttgcgcagaaatgggcgtgttgttgtgcctgcacacattccaccactcgtgcattgagcgcgcgctgggccaaaatgcgcagtgtccgctgggccgtcggcgcgcaaattgtgcggccgaaaagcgaaaggagcggctgccgcgaggagggcgatttgccgaaaaaaggttttcgtggcttagttggggcgaatggatgtcaatgaattacaaacactcacaattcacaatagctattttattttatggtaaaaatcatgtgccaaacaaagtctctacacgcccaatgattttggtaatactgactattactggtcccataaaaaaaagaataaaaggcggttttttacgattatacgttttactggggggcctattatcccttcttttttgattgcttttcttccgtaggtggtcgactccgtctccaacatgttattcgggcgaaacgccttcaaagtggagggaccgacaaaaagaccatcttcgagtgccgtgggtgaaatgttcgccggcgcatcggtcggtgctgcaaacacttcggaagattcgctttccatcggagaattgccggtactgtgggcaaaacaactgtcaaaagacgaccaaaaatgactgttcattgtcagtcagttcgtcacctccgactcattgaccttgacaggacatttggttgatccgttatagttattccgcaatataaaaaagag

SEQ ID NO: 5550 - DNA, 7030 bp, Heterodera glycines
ttccaccagtgacagcagctgatcagtgttcgcctttctgatcagtctcccgcatcgtttcacacattttgccttcgacagtgcgcaaagccagttggcattatcttttattagttgactaactttagcttgttgttgttgttgttgttgccgtttataccgctctatttttggggatgaacacaactgttccctcgtcctcctactgctcctctttaaatatgttggtgcggaggcgaagcgccggatcagatgatgcgtgcatatcgattagcaaatagccataggggcgggcggtcgccttgcggtaggcgtcaaggaaaaaatcgagttgacgtggaaaaagctgaactccaatatttcgaatggacagcagcgagttgggcgcgcggattagcaccaaatactgcgccgaaaggcgagccaccttgatcttccgctcaaacagattcggagtgatgaacactaccgcaaattgatggtgatgggattttttggtgaacaaatcggacagatagcgctcctctattgacagcatcagatcgtcgagaatgagcagcatcggtttgggaaggcgcctaatcagctcctccgaaggtacgcccgaatacacctcaactcccgccttttgtagtagcggcaccgccgaattcatctcaccaaaacagtacagaattgagatgggactgggtgcgatcagttcattgcactcagcaataaattttagtaggaattccgttttgtccgacgaggatggcccggaaataattataccgcaaggcaatttgaaacaaatatctttattactgaacgattgagaatttaacattttttaaattagagcttgaaataattaggagaataacaatcaatcgagcaatcaacttttatatatagggcagagcgagttttgcgctttttttgctattgcatattgcttgtcgccgcttgaatgctattgacgaaatcgtccattacttcaccatcgggagcagattcagttgttgctgcagcactgctgttgttgctatttgtgcattcctccttctcctcctcttttgacgatagctgatgctgtaagtgttgttgttgttgatcaaaagttggtgagacatctgttaatgattccggcaaaagcaaattggccagcacattgatcgcggttttggctttcttccagcacgtcccatcctgtattgcgtctgccgctagaccagcttccactaagcaaacgccacttttgccttacgcctcaaattcttctcctcctcgtcgtccggtgtccgttgatgttttgctgttgtcattgctgatggtggtagttggtagtggctgcgcgtacttgtctgaggacggcagttcgctgtacggaacgctgaacacacttgacttattcttcacgcgaaagaaacaatggccgggaagctcgtagacaatgtcatactctaaatccttacttagaattttaatggaatgggatcgaatttctggatttggtttgcatgacgggttacaacggcatgcaattgtggcgactcaattcgccaaactacaccttttcctgacacaattgtccctcgcagccacgtttttgaagggccgcgataattgataaattggacaatgtcaccaatggaaaagttccgatttcgtgctccatggtgtttgttgaattgtttcgccattttgctgttctgctcgtttaacacgggtccctgtttttgtttttgggaatttggtttaattaacgatagaacagttcgaacgggccgccctaagaacaattcggcaggcgtacgaccatttaaacttgcgttcggcgtggtgcggtacgcgagcagtgaattttgtacccaatgtggatcgtcgcgcgcacatttcttcatttgcctcttcagtgtgtcgacgaatcgttcggcacggccattgctttgtgggtgaaacggtggtgcgaatgtttgctgaatgccatgcgaactgcaaaacgtgaaaatttcgtgcgatttgaatggggggccattgtctgtgacaatttcttttgggtaaccataccgcgaaaataaccaaacaaactgttcgatcaaaaggtgtgcggttgttgacttcattttaatgatttccggccatttgctgaatgaatccaccactaccagatatttgttaccatctgcacatggaccagcgaaatccatgtgaagcctttcatagacttgagtggatgctggccatggttgaagcggcactttgggtggcgctttggctgctaaggcacactcttcacaatttctaacccacctatcaatgtcgagatcaattttgggccctcttcggcagtgatcggcagttgatcaagtgttgtttggaacaaatcgacggctgccacttcgagttcactgctttcttccatgtccatttgggcgatgactttgtcctcattttgctgtgactctcggtgttggctgatcaaccgagaaagtacgtcaacctgaccaaaatttttcgtggaaatgtatttgatattaaaatcataattcgacagagtcaacgcccatctttgcaatggaatttttgaacggcgaaaatgatcgccaggccttccttctcgatctgtgagtagttgcgttccgctgaggtcagcgctcgagaagcgtgctccacaactttctcagtgccattgtcgaaagtgtggctgatcgtagcgccaaggcctttgttgctcgcatcagcggcgacgatgatcggcctcgttgggtcgtagtgcgtcaacagcaaatctgagttgataatttgtttggccttttcgaatgccatttgctgttcgtcccaatgccattgaacgtccttcttaaggagctcatccaacggtgctctgatttcacgcatttgactgacaaaacgggagtaatagttaatcgcccccaaaaatgatctgagtgtttgatcatcagtcggagccggcatgtccttgattgtacgtgagcgttcggggtccggtcgaattccatctgaggtgatgatgtggcccaaaaatttcagctcattgcagaggaatttgcatttgttgagcttaacacggagtccccattcatgtaaacgcttgaaagattttgaaagaattttatgatgattttctgctgtgtcggtggccacgatgaagtcgtccaggtagacgaacatgccctgaagaccagctgtcaattcgtccatcaatttctggaaaatagacggggctgatttgattccaaaaggaagcctttgatattggaacagcccacggtgggtgttcaatccgaccaactgcttcgactcttcgtccagcacgatctgcaaataggcgtctttgaagtcgatctgactgaaaaccgatgtgccacggactgcgttgaaaatgtcgtcaggtcgcggaagcgggtgcctgttcagctctaaacattcgttcagacgtgtggaaaagtcaatacagacgcgaatgtcgccagatttctttttgactgcgactattggagccgcccaacgactaaaatcaaccggtttgatcgccccaatggttaacaaacggtccaattcggcattgacagtttcgacggcaccatgcggaacaggacgtgcgcggcagaaaatcggtctcgaatccgatttcagatacagatgagcaagcatttttgtgcagtgcccaagttcgggactgaaaactgaagggaatttgcttttaagttcattagccaaatcagttgaatgtgtaatggccaaaaatgctggttcaggacgaatgatcggcagggttgtggccacggacagttgagtgcgtattcgaatgcgcgaatccatggcagaccgaagagattaagctcgcctttcggtgctacaaaacattcgagacttaatttgatacccatgaactcaaccaaacaatcgaatgaacccatgagtgaaaaattgtggcctgtctataatttgccatatgttttgcctgttttgaattttgggtttcccagggattcccatgtggccaattgaatgattgtttttcgggccgccgtatccgccacaagtgaaactggcttgtcgttgaccttacaattaaccataatccaatcgctgttgcaatcgtcgacggccatcacaatcattgaatcgtttttggtgtttgatgacttcttgattcgagcatcctcaaacagcgctctctcagatctcggtcgccggtgttcagccctgtaataaaaattagcgatttgatttcctccttggtgagcttcatttgtgcccgttcgcagttggcgctgacttgggccgcgaactcgagtgggctttgtgtcggtcctttctgcaactgaaaacattcgaaacgtttgacaaaaattgacttcgtcccgcaaaacagacttttgagtttgcttactgtcacctggtacgcaaaatcggttagtttttgtggaaggacactctcggaataacgcgagtattcctgtgtaccaagcttaccgaccaaaaggcgtgttttcatgtcgtcgggaagtgattgaccgtctgactcgagaaaaggcccaaagcgttcgtaccataattcaaaagtcgaatccgtttccggattgtaaacaaattcagacaattgggaatttattgtggcgaataagtccgaattttgtttattgggattattttggggctgattgttcgcaatgttttgcaatgtgtccgttaattggcggaataagtttgccatatccgcctgatttgccatgatgaatgaaaatgaggcgctgatgaatgaatgtgtgtgaaagtgatgaaaatgcagagtcatcaggccttttttatagcaaaaattgattgaattgatttggcaagtccgcgggcagagaatgatgaacggagtgtggatggaataacggcgtttaaccctcaagggggctttgggttttgccgattgatgaatggaattgagaattgaaacaataaagcctttggactgccctaattttatgaaaatgaaattgaattggccgctgactgcgccaaaatgttgtgttctttggttgtgaaacacaaacaccaatatttattgaacacaataaaataagtcagaagcgataaatataataataaaatagacagagaaagaagaatggcaaaaaccgactgaatttggaaaatactgggagacggaccaaaagggaagggaacggttgctatttatgcgcctcaggcaagagagagagagtgtggaaaaataagagagaaatgactaaagggaagagagcgagagaaaataataatggctgacaacatcccaacaattctagctttttattattttcataattggctgacataaattgtttaattcgtacttgagattaaatttaattaaatttttaatattatattattcgcatttgattagaattgattttaaatttttccattttatgattttgtcttgctacttactataatgagccgtgtaatttgttttatattccatattgaattcatttttttatctttgccaaattattcaattagcaaaatttatatttaatacttttttatgattataaattaactaaatttcatgcatcaattaaagtgtatctaatctgtacacttttgcaattattatgtgtgtaattggtatttgattaaaatgttcaatgcttcatatatcgaacacgtaatgtcctttgaaaaatatattttttttgtattgtgttttagattctcttttaaatgtttgatttattgcattatattttatatttttagtttttgtatttttttcaacaaacattcccatgtagtgctcgaacaatgaatatatacgtgacattaaacaaaaattcacaaatttttttaagaatcaatagattattcagcttaaataatcaagtgttcgaatgaattaatgattgatcttttggaatcagtggtgtttaattttaattattgacggaattcagatatatttattttaatttgttgctattttttccctaataacgatttttcagtttcacaaaattgtgaagcaaaaacaattttttccttttttgttccaatatcttactgtgctcgttacattttcctcatttaattaaattgatgtgggatactttataatgttgtcattatttaatttacagacttctttatttgattacttaattacttttttgattttaattgtatatctaaataggtttcattattattaaataacatatatttattattgattttatttattaaataaaaagttttttttatttaaaatttttttttattactctttaaaatacttttagttgattttatatttttaaaaataaattcaaatttaaaattctcattttcaatcagatttttatttatagtttaaatttatcataactgtattttacatgacgaccacctcttccaaattgtgggtcatttagtgtgacaaaagcgtaggatgagcatatattggacagtgagcgacgatcaaaagctgaaattaaataggaatatcatataaaatatttaaatcacaaacttttcaaattattccaattaaccacaacttaatttctctttcatttctcttccattttctctctctttttctatgatcatttatcttcttcatttcttctctttttctccaatttctctcatgacttcgacggttttccgacatgtttattgctttaatgtttcttaaaatttatatttatttaaattggtatggtataactacgcagatttgcttcttatttactcgtttatcttatagatatagtcggtttttgtgtttgttttttatttctataattaaaatatttatttattttgtttttaaaataataaaaattttgcattaagttcataataactataatatcttttgtatacaattatagctagagttttttttttgtaatattttcaaaagtttgtcatttgtattttgttttttcacaaaatagggataacgtgtaatttattgtgagacttttctaggttagtcattgagaaattttttgag

SEQ ID NO: 5551 - DNA, 1576 bp, Heterodera glycines
  misc_feature (27)..(27): n is a, c, g, or t
  misc_feature (72)..(72): n is a, c, g, or t
  misc_feature (1428)..(1428): n is a, c, g, or t
gattatgattattttcgcatattattntaatatttaatatataaaaatcttcaattagtaaaagtcattttntggcagatttcagagatattaagaatctttttataaaaatatatttttcaggatttgttgtcaaatttcaaattcgtgtttctaaattttgatataaaatcaatgaaacgtctcagattccttgcccttcattttcacatattttgaacctccattgtgtaaatatttattttatttgtatcattaaaccgcaaaaataaataaaatttggttttattgtttttctattcaattattttaataattatttcttaatctcattatttactaatgttttttttgtggaaaaattgaaaaagcttctacgtaattttgtttatgaatagtgaattcgctatttttgaattagtaatgttttaaatataaatttttatgaatttttttatgaacttataacaaaatattccatatcatcctttaattttatcccattagtgcatttgagattttgataaagtgaacattgtgacaaaacattatttgggttttttaaatgattaatgctagatttttaattttaatattttaaatgcaaagaaagtttgccttcattatttgactatatgtcactttgctcagttttgttattttgtacatttttttctgacgaaatataatctgctcaactaataaattactaaaattttattgttgattaattattaaaaaatattttttattgttatattttaatctaacaaaataaatttttgttgtgaaaataacattaactaaataaatctcaaggttgaataaatgaatttataattaaattatttttaactactatttcctagttctagaaattgaaaaaggctatatgtcaaaaaatgaagagctttaaaactaattcataatgcattaatttcttgttttttcgttattaattttttcattttcagcatttataaattatatttatttaagtaatgatatacatactttggagctgtttatttgtttatttattttgataattacaaaaaaattttcggtctagtttgtccaattgcgttgctggtagacttgtaattgggcaaggataaattgaatttttgattagataaaattgattttgattttaatattattctaattaaataaattattaaattttattgactcccttttcagatagtctatagaattactttaatttattaaattttatttatattaaatttattttattgatttttaaatacttcaatttattttcacaatttattagtgaaagcaaagcggaaaataaatattaataaaaaatctcaaatttaaaattcgtcgccgcgttcgatcaaattcgctacactccgacgcagacgcttaaaagtggttcgctgccattgaaatccngttgttttcccgatcttcaccattctaacacgattgtggatttgttttattcaatgtatcaattggcaaatgtttatgttattaaaaacttctttttcctcaaaatgaaatctatcctttaatttttcaaccaaaccccccccccccc

SEQ ID NO: 5552 - DNA, 6220 bp, Heterodera glycines
ataagaatgttgtttactttttagtttttcatcgtaaaacaattttatgtccaatttaattttcacgcactattcgattatagacaaacataaagtacaaggcgaaaatgaaaaatgaaaagcacttgctgcgtttcataactgttcttggccacagaactaatgagcggcaaattcgctttaaaaatcggtaattacattttaggtgtaaacaaaaaattgtggcccccattcttttatggccaaacgtatcgctttttaacagatattcatttagtaaaaaattagaatattatttaattattgttgctaattttaaagattgataaaaatgagttcttttggcaatgattcccaaaatacgacctctttttctcccaattggtcaacggcagacactaattctactgtaattacagtagcctattttttggtcagcggtatgtcgcttattcacgtcgccacactaacaatttcatcctttaatctgattgtgttgggctcgaccaagctgcttcacccgaatttgaaatttgttttgatgtgccaaagtggggccgtttttttgtttgaaatctttcgcctaattacgatcttccaaaaatttttgtcaaacgacattttcaatccatgcttcgtgttttttcaggtgaaaaagatttcaaatgttttttaattcaattaaggacggatatttaattaccaaattgacagggaatggtctccgatcggagattaggaattttttaacactcaaatataatgtgccatttggtccttttttggtcaaaatttaattaattgataaaattttcaaaaaaaaatttcagacggcgcctatctgcatagacggacccctttgttcctagtttttgaaaaaattgcgccgaaaaaagcatttttaaaaagcaaaaaatagtcaaatttattgaccattaacagatttgatttccgatctctttttaccgtctgacccattcgaaaaatcttagtcgcccttttaatgcatcccgccagcccctaaaatttcttctcgtatttttttttggaaatttcattgaaattttttcaaaatttctaagaatccgcaatcctgcgcgtgatcctgcaaatttaaaatgcaggattaatccggccggatccggtcctgcaaaaatttttgaattccaatcctgcaaaaggatccgcaaatttgaaatttccgagctctagtcacaccgtttcaaaaaatgagatgtgtaccaataaatagagaatgcagagaaaaaaacatctctcattttggtgtactatttatttatctctgttaatagagaaaacccgaatttacttcggcacatataactttttttctactcatacaatttacaccaaattttgcatatcgattgagaaaaaaattcttcatttttctatgctgaatttattattattgtctatgctcaagttcaaaagttacaagtttagaacacccatatattttttctaactcaccaaactgttcaacatttgcttagaaaaagcttctcctcatcaagagcttttgaatgataccaagatctttcaatttagttggcaaaaagcttccaaaataatttccgaaaatctatttttaaattttttggacaaaaataaataaaaatattcatgttgcacaacggactcgaacctccgccctcctcctcccttgtccttttactatcttacaaaaaccacttcgccacacatgcaaatctttttgaaactgggaggcaaaaattgaaacggtgtgtagtgttttaaagttcaagcaatgcatccacatgactttgtatcaataaaaaatttttgttttttgtttaaaatacctagaaatagtgtaaacatgttaaggctcttatgcagtttatcctgatcacgaatatgacattcattttgaccaatttcgaatcccggacccggatttcaacaaaaactcgaaaaatcaaaatttacaaaattcatttttatgttcattctgtacagaatgaccttttttgatcttgcaaatctttgtgactaaacctagcttgtttgaatcaatttagaaacaaaagtgagaatttttaggtttcaaatttttgttcaagcccgggtccgcgattcgaaattgctcaaaattaatgtcatattcgtgataagcaaccctaaaacccccgtaagcatgttttcacgagttttagaacaaaaaaaaatttcaaaaagggcgggggagggggggggggaccatcggcagtgttactgaattttcgtttgttgtactgtttcacaactcttcggttttgcttgaccgtttcagtgatagttagcgtgtatcacactcaaattttagctaatttcactttaacgccaaaacaatgaccatcctcagcttcttttgcaagagaaattttttaaaaattcccgagataaatggacactcctaagtcgttggattgcctaaagtgcgacagagtcaaaattgtcaacacaatgaaatgtgtccaacggtcaaatggaaattttttgagctttagattttttaaaactaaatggagggatttttagcgggacattctcaaaaaaaaaattttaccaatgcaacctagccagaaattaccttcaaaaaaaaatttttgttttttttcactttttctgcaaattgctttggaaacaatctgagtgatcgttgccgtttttggtcactgtcgatcagccttttgataattttcatttaacttggaaagttcaatgagtgttcctttaaattcctatgttatacggagtacaagcagtgaattctgatcagtgttccattgaaaataggtagctaaatgtcacggtcaagttcgccatcgctgtcggattcttctggctcgttgaagccgaatacggctattcactctggctggaataattgctacccatgccagcatttctcatcattcaaagctttcaaaattaagcgcatgtcacacaaaatgatggagttcgaggtagctccaattttacggcatcatgccgtacgcatttcgttcaaatgtgcagaatgtggtgacacaacctttaaaacattcgacttcaattcacgtggaagatggggcatgtatttttttaagcattaatcaattagttggaaaggattggaatgactttttgaaaaattttgttgtcaaaaaagaaggggtgaaaattaatattaattgggcttcgtttttaggcaaaaaactcgcaaaatggcattaaataggcacaaaaatagacaaataaatttttttttattaacgctttttaggtagtaaaagacgtaaaaattgaacaaaaagattaattttgttttattacaataaaaacgaagccctaattttaccgaatttttatttcgtttgggaaattgatgagggacaaaaaggcctacaaaaacattaaattttccaggtttggccgttatggagaacacaagagcatccttgacaaaaaaacattcatctgtcacacgaaatgataaatgatgtgttcaaaacaatgccggacagaggctatgccttgttaagccttaattgccagatatgggccaaaagtttttatagtaaaggtttattttgtttgtttttttgggggtttaagggattagccaatggtatcgcccagagggccctatttataaatgcatatggattaattaatgtgcctacgttatttcgactttgaacacacgaggattcgaactgcatttttgattcaggaatatgacacgaccattttcagaattccccctccccccgtgcaaccatttttgaaaaagtttaagatttttgaataaaactgttgcaattaggggaaggaaaaatgccgaaacactgccaacactccagcaaatttggcccaaggaccgagaacaaaattgaaatattatttatattagttcaaaaaattaagagaaaaacaaggtcaaaccatggtcgaaataaatagattattttaataaatgtgggccttactccctctgaatttcctcctcaaccaatttgggttatgttcagttgttaaattgaatatgatcgacactgctctttgcccttgtccgcttacaaatatgaaggtgcagaacgtggagcatattgaagtcataaaagaccatgaagaggagaagttgaatgaatgcccgcggaattgcgtcgttctttcaatccgttgcaagtgcaatgcagagatgcgcaggacttatgaattaacaaaatatggcacacgcaaaaagtaagcaacagctaatagagcccgtacccagaaaataaattgtagggaacttcagaaatttaatcatgggatgccaaacggcgggacggtaacggatgggcgctttccaagggaattccaaaaaaaaggggcggacgattttgtatcgacccgtttttgtctacatatttatttattttttaaaactcaggagacatttttgttgcctccttaccaaaaattgacagccccccccctcaaagttcacattatagtcgggaaaaaatggccagtgacaagcaaaaggatcatcacaaagggtggacccctagggcaaaatgtaatttttttttgagtacaaatgaaaaaagcttttgtggttaacgctctaaagtcagagggagggggagggagcacaatctgacgagctttttttctctgcccagaaatttttatttgccagtgatattgggtaaattaggagtcgtttaagaagaaaaaaacttttttttgctgttaaataatttttgttttttttgaccaaatttagcccaagagctgtaatttttgaagaaaataaaaataaatttgcctggtacggaggtacctaaagaaattttagtttcgaggtgggagactacggatccatttcttgtttctcccctcctcatcaaaattattagattttgtgacaattttctgggtacgggcctaattaataaactcaatctcctccaacatcatgacaaattttagcatcgggcggcctgaacgagaacggagtgtacacagtctcaagacgggaatcggaatggaattggttaaggtggagataatttttgcaacaatgccagccaaattcgatgaaatacatttcaaccagcgacattgggctcgtcgttttttttacgcgagtaagcagttttggaaatgttttgcattaaggggaattatcccatgggcgtcgtggtcacacagaaagtaggatttgcatttacagcccacccaaacccgaaaacatataaatgccaatttttatttcgaataaaaaaaatttcaaaaattaaaaatgaatttcaaatgcgatcgctagggataaattataggcaagaaaagtggcataaatatgtaaatggaagtccaaatcagacgaatttttattatttcccacttagtcatttccggaggacaagaaacaacagcatgaaaggggacaaaacacaagacaaatgctgccgaattttgccatcaacgccgatcatttttgttatttttttccgaccgttggcctattacgtgaaactttgctgccgaattttgccatttaattactacaaatcaatccgatcatttttgtcatttttccgattgttggcataatattattttttgctcaccaaatttatatgtttgtttttaaattaaaatatcaaaacatttgaaaaaattcgttccttttatgtgtgtttctctttttactctttctctctcgtatgtttgttgatccaatatttcacctttactcattcgttttgtgaaaaatgccgttatgcatatccaattccatgtcatgtgcccaaatatacttgaaaaaatacgaaaattaaattccctaagacaagcaaattgtttttttacgagtgaattcgacaattattgattcgacagttcctataatttttaaaaaacttacaaattaaacggctatttttggggatggagcaaaaattgacattttaatttatttacatatttggaaggaaattttgttcgtcgcgcgtttgttgacctttttaatttaaaaatgatggcacagaacaggatgatactatagatggtgcccccccccccttttttgaagaaaattttttttattctgtaaagtcttggaaacatatatgtgcgggagggtcgctgatcaagaatctgacattcatttggaccaattccgaatcccggacccgaattcggacaaaaatagaaaatt

SEQ ID NO: 5553 - DNA, 5534 bp, Heterodera glycines
ttcgtgcctttttgagttttttgagactttttgaccttctttcaggacttaaattctcagccctagtaatgagtaatgtttttcctttttgaagcacaaacaatgcgagcagctcttcattgtccaacccacttaatggcaacagagttggaagccaaccattcggccaacaaaattcggaaattctgtcaacttctggcataaaccaatttgaaagctctggcccatttgtgttggaaagctcaaacccgaatggatatcgtagctcgtatgaacaaaactatgtgtccaacaaaaacagacgctcttgatcataccagtgttcatcatttctcatgattgttgcttttattcatttgctgactcttcaaataattaaatttcccgaaaaattctcattctttatcgatttagctccacaattacggaaatcagatttccgaaaattttgataaaaagtcggaaattttcggaaatttttttaaagtttttttcaaattattagcaattttttactgttaataaattgcactgaaattttcaaaattttcctggcgttgcctatcggcaccacgaagaaccctaaaaattcttaattttcttaaaaaatttgctcaaaaacgacaaatttggtcatattttggacaaaactgttaacaaatctcattaaaaatacaagattttctccggcaccgcctttcgataccgccggacgccccttctccttccccccccccaatttttgaaaaaaacgaaccgcaaaaaaagctgtaatagtacctttcccaaaaatgttctaaaacaatgtaaaacgacacaaaaaaagattttgatgaacatcattgaataattttttaaaacaaatatagaaatataccaaaaacttttttgaaatcaccttttacttggtttagaagcttcttctttcatccatagttcaacacatctaataccatttattcgtgctgggtcattttaaatccaccaagtgctaggaaaacaaaaaatataaattcacaaaataacttggctctgtctctatcaaattaatatttctttgtatcattcaatagctctagatgttctctacctgaaaatctgagtcagaattttttgtctataacattttgaaactcaattaattcttttcaattttaatgtttaatggttttataaagaggacttcgaattctaaaaagaaaatttaatttgttcttctgaaaaaagttgtaaagcattgaacatgctatatatttttccattttcatatataaatattatagccgctaaaaattttatgagcctaaccttaatgatattcagttataagtattttatatttgacttttgaatttcaaataaattatcgtttcaaaaaagttatggacaatgacttaagacaaattgaaattttataaccgaaccttttttatattattttaccattttgaaactaccttttactggctaagaattttaaaatttagcctattaaaatatttaaaaattttattatattttaaattttttcaaaatttccgagttccgaagtcgttttccgaaaaatttttgaccctcggaacattacgaaatttcagcgcttctcctcccattatcgtccccctttagcaccaattggaccgatcagcaacattagaacaattagagcgggcggcaaaaagtgtgcacaattctctttacggcaaatattatcctaatctcgaatcgacccttaacatgtaaattttcattttttattaaaaatattattttattctttttatttttttggtgttttaacgatttgccatttgttaatcaattattatttttgcgtttagcacacctaggcttaggccttttctatgcttattactaaagaaagacattgccgcaataaatgagaacaatgcctttcatcttccaaactggcaaaaaaaaatcaatcccaacctaacatttctttttccattattttaatgggcaaacgtcataatagctttacctttacgtgaagaaagatttggccatcataaatagtcgcgccattaagggcattcgacaaaaaagaaaattccacccatttcacttcattttgccgctcctatcattatgaaacaaatttccaccagtgcgctgctcttggcattgaatactttggcattgtgtgccaatttctgtgaagcaagcaattcgtcgttcaacacatttaatagcaacttttctggtagaactcagccattcaatccaccaaattcagtgaccaactcaaacaaatttgggacgcaagcattgcatggatttacttctatttttaaatcgaacaaatgtgaatttcaatagaattttgattaattaacactcctgcaggtcattaggaaatttcttattctaattaatcgcaaatatttttccattttttccaaaaatggaaagggctttctgtgcgataatttttttcattaaaaaatattacaaacacgtaaattttttgtcttttccggttatattaaatcattttttaattcaaaaatattttaataattaagtataaatatataacggagcactgggacggaaaaacattgagcatttaataaaatggatataactaaactcaaaaatatttgcgaattttcaacgcaattcatccgattttcttacttttttaataattttaacatatcaattctttctttttgttcaatttaatttaaaatatttagttacaatcgaagattggaaaactttttgttcgggtttcacaacaaaagacaaatgtgaaggtgaaaaagcaaagaaaaaaatttcaaaaggagagaacgctggtaaatacacttgtcactggatcaccaatacggaagaatgctgtcattatataatattataaaccgtaactgttgcatgatttgcacggatttttgcattttttttcttcggttttcgattttcgtttctgatgctttttggctttctgtttcacttttttacaaaaaaaaaactttcacttgctttgtatttttatatgtattgtataaacaattctttacaatttcaacttagtgtcaacttctggccccctcctttttaaggtagcaaatataaaaagtgactcataaaaattaaaagttaaatttaattaccaaatttaaaaaaatacaaactaattagtaattactattacacatgtacaaagtcctgatttatatataattaaatgactccaatttttcaaaataagctggcaataatcatggtatctgggaataataagcaccgtaataattagagctacgatttttaggtgctaaaaaacccccaaataggtgctaaaaatgggaaagtaggtgccaaaaagtttcaattttaggggggggggggggtgtaaaatcataaaatcaggaatatatgcggctggaggttgtgcgcgagcgaggcggacggatgacgaaagactatccgacgagcctgttcgaagaagaccgccaatatttcgggatcctcgacaatgaagttatgcagcagaaggatatcacggaacaggcacttcttttccgttcggtttttcctcgccgtgtccacccgttattaacgattcatttcggcacctgaaattcaccatgaataagggttgattgatcttcacgatttctccaatttcagatgatcaaagccctccatcatcacattctcgtcgaaaaggaggcggcagcagctgggatttaccgcgagattgatgtgctggtcaggaaccaccgtgtcgtcccagcaaatgaaattgcgaatgccatgtctgaattctgcatttggttcaacaccacgcaagaaaataacgacacggacgcagctacatttgcagccaattcacataaccgcttcgaaagaccacattaatttatttaataaaaaaaatttgcgttaatcaattcttttgaaatatcaatttttgctttgggtgtagcccacttggcaaagtaggctacaacccgaattcgaacaaaatgtctaaaaatggtggtgaacgcataaacaacagacaattgatgtgaatttgtgtgaaaccgttagcgcgcaaataaattatcaattcactattcattcaaccattatcatatatatgtatttaaattaacgaataaacaagtaaaatttaaatatcctgtgatacctgaaagtgccggtgccattggaaaaatattgagtgtattatatcggtttcttaagtggttgtttatgtgcatttaatttttgatcattttgagtcaattctgtatctgaaaatttcaccaaaatttcaaaaattcccccggcagcgccacaacatttatttcaaaaaattaataaacactagataccggagattttaaatttgcggcatttgaactcaaaattttctgtgggacggaaccgcctaatctcccacttaaaaatgcgggattccgcgcggaagtaagtgtgatttttaaataaaattttatataaaaaattttattaataaaaagaaaataaaaggttctatgtcgatcgacgaaaagtgcaaattgggcgaccgacgaaaaagtgcaaaaattaaactcttgatttatgcagttgatttttaacctaattattagatattaaagtcaagaaatcgttagaaaacttaaaatcacaattttaattcaaaagttaatatagtaaatttttttgctaattttcaaatgaaataaaaacaaaaaatattttatggaattcctttttaatgaaactttattgataacatttttttattattgacaagcggcaaattgtttcgacattttttgtagcatcctatgggtttactaatgatatcttcgctacactggtggaaaaaagtctttactcaagccgatcaaatttgaaaaaattaaaatttcgactagaaaatttaattgattattttttgtttatgtgtttttatttacccctatttatgtgctttttatgcaccacataattattttgatccactcattcattctgagcatgagtcgtttgatcactctttactcaaaaaaagggcggaaaaaagtctttactcagaacatttatcatcgaatttcttaatatttagtcggtccgccctttgcccagattggataaaagcattcaaaattggaataaatcatcaatttgtgtgccatcttccgaacaagcaacagtcgtttttatttccatccactttttcgaatttttcatttgcttccattggcaaaatgtcactgtattggactcggctcattcgtaatggaaagggtggcacctaacaataaaaaataaatattgaaatgaaaattactaatttttaaacatataataccattgggaacaatcttttagctttttcaaaaaactagtaagttttgtacaatttctgttaataaattgaactgaaatttttaaaaatttcccggcggcgcctattggcaccgcgtaatctcctccaagttcccaaaaaagttttgaaaaaatcgcgctgctaaaaaagtgcaaatagtcactccttttcccaa

SEQ ID NO: 5554 - DNA, 2551 bp, Heterodera glycines
tagacatttatcaaaatagttatacatgaaaattttgcaaagtcgtaatttttgaagtgttttcttattataatttttttcaggcttgaaaagcttttcgtttttaataaggctaatagagcatgttaagagctctcgaatgataccaagattgttggatttggatgccaaagaaaaaagcttaagtggaaaaccgagctggcgccgaaacgccagcgccgaaacgcgtgggtcccttactcagaacatgaaaaaccaccttaaaattcatttaaaaacctgaaataattcatgctagtttatcttttgatactgatcaaaaaagtctcttacatcaacttgatctgagcacttcttcatgatgatcttgaccctccaatgtatactaaaactgggaattttttgataaaaatgttgtttttaattaaatattattatttaacaaaatttttatcttttgcttcgtttacaaaatagcagaaattaattttactatataatatttaggttattttaatttttgaactaaataatcaaataattagattaaaaatcaagtgctaaatcaagtgcttgtatcactcaaatcaaaatcatcaatattagcatttttcggcaaaaattaagaaattggctaaattctttaaaattttgtccgcgcggtatcccctgggctcaaacccatattcactccaaaaatccacacaacaattagaaaaataatttatcaaaatacattaattttcattgtttttatttggcagagaagtgctgtatccaaaaaataaaaatttatttcctttatcattttaattggcgtatttagcgttaattgttctcactcgcactcccaattatcggttaattgcccctcttccgactaattagacagacactctttcagtttgacgacgacagcttcttggtattaatggaccactaaacactgctgggtggcacagttgttttatagcattgtcagtttgccgaagcactctttctttcttgtgataacagctaaaagtgccggtgccatttggacgataaaaatggattccgaaatttttgtaattaaaatatttctttttgaagttttttgtctccaaattcttcaataggataatacgcgaattcctcaaaatctccaagcatagcttcttgtgaatggtttcagcttggttaatctgttgtcatatgcatataattttcaaaaattttttaaaattaatttaaagaaaaatatttaaaaaagatggaattgctgcttttccgttatgccgaatttgaacggctgtacaattgcacttggttggacattgactacgtcccgttggaacgccggacgcaatttaagccggaatcgatcacaatttgcgtattatgtgccatttattatgtaaataaaattttaaatagttccggcatttccaattaatgcactcaaacaataaaaaaggttctgtacgtgccctgcatgtactccatttggaagcatttgcacgacaattcctgctacaaattgctcttttacatcggtgtcaccgatctcggcattttgtggattctcggctttttcagcggatggcttaacctgcgcggcgatgtgttctgctcgcaccccattctgatttatgtgatgggaattgtggccacatgtaaaataatattgcaaaacaattccttctttcttttattcgctattttattttatagccatttggatggccgaaagcactgctgatctggtaataaattaattaattagccaaatgattaatcaatcaactaatttcctgtgattgaattttttggcaaaaatggcgaaaaattttgtaaaatacaccgcataattcgggatttcaaaaaaccaaaaatacacccctaaaaagcgaaagaaaaaagaaaaatacactcctaaaaattgaattttggacttcagccccccccaaaagccaagggtctggctacgcccttgttctttggccatttttgacagattcttttcaaacccaaggtgttggcattcaatcgctgtctcgagctcacctcgccacatttctcgcgcgttttctttgaagggtaccgtacctccctttggatcgtcggctgctccctctacgccctctattgggccatgttcatcaaaccggtgctgtacagtagcatttatttcggctggttcttctacccttttgtcggctacagtaacgatgaccatcatcaggtgggggatttagcattcgctgatcaaaaaaatgcgttttcaattttaaaatgtaccgtaaaaatattttctttgctacagtatgaacattggctgcatgtcgttcataatatcgccgtcgcatttctgagtccggccatttaccttttctttgccagcaaattgtttttcaacgtccaaagcaatcggcgacagtttgccgttgtcgcctccgaattaaactcaatgcaaaaaagggtttggtaatttggaaatttaaagcaagcatatgtaaacaatttgcttaataaattggctaggacacagttttttttcggttttcttgca

SEQ ID NO: 5555 - DNA, 7525 bp, Heterodera glycines
  misc_feature (39)..(39): n is a, c, g, or t
  misc_feature (7490)..(7490): n is a, c, g, or t
ttaaattagcaaaaatgttcacttactcccagtactctnccaccaaactcttggcaatgtgccgaggaatgccctcctcgtgtttctgtccgcgtccatttcgtacactgtgtcggggaagctggcgatgccgaatttggactcatcgctgagccagtagaacacccaaagtttgtctaaattcggggagaaaaaaaattaaaaatgaatgaaagtgttcgtatgaaattcaaaagggtcgaaaattccaaaatttcggaccgcccggcgacaaatatttttgttttatgtgccaataactcaccatcgcccgcccgtttttgcgtgaaaaacagcacggggtaagcagcagatgaggaagctgccattagtaaattagaaaaaaagtgatttttctaaataaaataaatttaagagtcaattttaattaggaaatgcctatgtttttggtaacaaatgaaaattgcggactgaaatcccgcaaaatctcggcgcgtggctccatactttgagcaaatttgaataaaaatcttttttgaaatggtactgtttttgatttggcgatatatcagttttcgtctgccatctaactacaacactatttcccttttcctctgtgtctgttttacattgtttgtttcgtgggcagagagtacaacaaataaattattttacgcattttcgcccccggcgaatactaaaattttcaaacaccgaaaaagcactgctgttctgccgattagtcattttcttccacttttgttcattgacataatacaaaaaaactgttcaatcactttattcgctccgctagttcacttattaaatattttctcaacaattcgcgtaaaattgccaaattttgatacaaaaaaagttgtaaaactggcacaaaaagaaattcggttgacccaacgctgccaaaaatcaagattcttaatgagtcattaataatgacagatgtttaactttatcgtttttgactgtgaaaaattatacggtcaaaaattggatgattcaaggaattgacaatgttacgacatacctattcctgtttggggaaacaaacccttgtgttatttatttatttcacgtacatgtgtcttttttgagctatcctttgcttctttttttgctctgtcatcattttttcgtacaaatttaaatggttttcttgccaaaaaaatcatttttcaggaaatgttcatttattactgttgccgaacaactgaaaaatgtacatagcaacttcgcagtcttacaatggaatatcgggcgagcccagtgagttatattttccacttccaaaatccacgacattaaattgtgatggccatggatttgacatttcatgaacctgtaaaaatttttcaattggtatgacggtcctgccactacggatgccaatccatggccacagagacccaaaaatgccacaaagttacgaatttttaaaacagaatttcctcaaaaaatgtgtcgggatgaatggcatcaaatgttggcacattccttatctttttcaccccattttcccaggttcgtcctctccgccggtcaattggcgttccggcgcattgcgcggtggtcgaaaagtgaccaaggagccggtctacgccttcattttgcccaacttggagcagtacccggccgacttccgccactttttggagcgggacatcatcgaaatcagcacactgagggtcaaacttctgcatttatttgccatttgagtgtccgcccatgcttcagacaatttttttcagaaaactgcccaacttaattgcactttctggggctgtctgttttcactggttcagttcacccccaggaattttaatcaccaatttttaatttaaaatcccacaaaactggccctatttttggcgtaaatatgaaatttgattgccacaattgtcactcttttttccttacagtcaaagccatggcggggtcacccgtcaattttccccataattaattgcccccctttttttgctttttcagtgattccgatgaccgacaaaaaccgcaatttgccgcccgtccatttctcagtcaattctggcgccgatttcacttggttcaacgcttctaatacggatgattgtcgatgatggaaatgatgtcattttgtccgcaattttctttttattcatttgtttccatttattacgtatttatcaataatggttttctactcgcttctccacccccataagcataagtgtgcctcggcattttacgtaattccgacatgcttcttcttttttacatattggtcaaaccgttaatttcaatttcttgttttgtgatgtgtttttgtctgaatttgtccgtaatatttgcgaattcaatgcgtgtgttagacacggtgtgtcatcgctctctgtcatttttagtgcgcctttaaggcaacaacaaataatcgatagtcttctgtttctcttctgtgctttgtgttggttctattaggtcattttctgtctgctctgctctgacccctcctcctttgttcagaatctgtccgccctcactcattcattcacttcatttgttagtcattcattcatttatccgtccaatttttctcatttcttttctgcaaatttctttcgaactgttgaagcaaaaaccacatcaagcaatgatttgagaattcgttctaaatccgaaaatatattgttttttcgaatcactcactttcaatgatcccttcatattaaatatctaacgaatactttttgcgactgttttacgattgtgtcatgccaactcgtacaattgcttaggccgaatctttggctacgtctaggcttggtcttgcttcggcctaggcttaagcttaggctttgttttgtaaaaatacgagttgacttttgacccgaatagtaataacattcattgttctaaatcaacatttttttgttaactttgttctgctggtcgatctgattttttcactttagccatcactatttttaatacactttaaacatcaccaatttgttccaaatggccgtcccattgcccttctctgtgaatgtgtccaccatcggagtatgtttaaaaattgatatattcacaaatttacaaaatatttttaactgattattttgtcgttttcaaagtttgatttgtatcaccttatattttcccctttttcgggccaatttttatgtgaatttgacctaaaatcgctttttagaaaatccaactgattgatcccttttccgacgttttgtcggaaaccctttccccttgttaaccctttggccctttactaatgaaacctaaaattatccgcaaacttcccgcagaattaaacaacgaattgcttcaatttgcccccgagtttttgtgtcgaagcgttttggctaactctaattttttgttttatgatttgattcggaggagtgaaagaggcaaaaaatggaaaaccaaagtatggaaaactgaaacaccatcactcaatggacatgattttgggtccacttgggcaaatttaattgtggtttcaaatagcgataaacatatccaagaaattttcgctttcctacgcatttagcacaattttcttttaagtctgtggaagaaagtgaagcacggaccacgtacacgtacggcaatgtcacagtccggcctttcatcctacgaaaccgacgccaccacaacttcaatttcattgttgaagacctggtcgaccccaatttatttctccgctcggaccaaaacaacggacgcattggcctagtgtcaattcgtgtcggtaacgctgcacaggtgaacgaccataaaaataagtgcaaattaagtcatttttcacccatttgatatgtcttttttaatgtcgttggattttgtgttcggatattttggttcccaccttacgattagcttgtttttgttttgagttttaattacaaaatctaattatgaatttttacctaatccaagacctggtttcattcggaatccttttttattgctcatatgaaaaaaacgcccaagtgcgaaatggattttgtttatagaataaatttcaacacagagacaagaactccgacagttcttcctcaactcttctcaaaatataatggaaacgtttgaatgcatcattatgttcttctccctcgtccacgtaatgtttactctaacggtcgtaaattatttaagtaggagtaataatacgacgattttggacaatttaacagattatgcccaatttgaattgttgagattttagtctattaaaaaatatctaatatatttttatccaaatgctaagaaccaaaaactttcatttggaaatagcgcgggaatattgaaatttaataattaaaggcgtgggatgtagtccaagtacgatttttgtcggacaacttggaaacgtggactgaagtcatggaacgttttgagagggccgtaacggcagtgagtttccattaatcacctcttctgcaagcttgggatttttaacagattgaggatggcaggccgccaacgccggtgaatagtccaagtccagtgcaagaagttgtttcggctaacaattccggcgagaaattgccatcgctcaatggaagcaacgaggaagaggaggcgaattgaacggacaattcattgttgtgtttaaatatcatttgttgatttcacaatttcaaaattttacataattgaataaatttccacaaagtggaaaaatttgattcaaaaagggatagtttagtaattttgcgttttttgctgtggttaggtcgcaatgattttctaccaaaaattgtgtgagcaaattaaaaaaatatattttcttttgcgttttatctattttcgtctacaatctgacaacaacactattccccatttcctctgtgtctgttttacattgtttgttcctaatggcagagagtaccaacaaataaaataaatattttacgcgttttcccaccggcggagacgaaaaatttgcacaccccgaaaaaagcactgctgcttctgccgattagtcatgtttcttcaccctttgttcgtcgtccaatttcagttttggatactgtaaatcagaaaaagaaattttaaaaaaatgaaaattaaattgaaaatccgtccaaaatttcacggtaattaatataaaacaattagcgaatgaatatgtgtttttttcttgatttctattttatccaattcataagcattggacattttacaaataaaaatgtaatttgcacaattattcactctcaaattcaatcatttttcttttttattattttaattaattgtgacacacatacaatgtgtaaaaatgtttggggtatggaaaaaataaatatatcaattaaaatgcaaatccaaaaatggataaaaaaaacaattttttaaattttcaaaaacagcggaagaaaagggaaataaatgctgagaaatgagttggtgggcatcaatcaaaaaacaccacagattcattcattcgttcttcaacggagaaaagaaattcagggcaaaggctccgtgtcaatctgtgaaaagctaaaaaatcagcaaaaataaattggagaaaaaagcccccgaaatctcaaatctctccgagtaaaaggaaaccaaaggtttaaaatgccattgattggccaaagattggaaaagggaattcaattaaaatttaaaaatgagaggaatttattaggtcgcatttcatggacaaatcggaaaccgcgtcatatttttggttcatttcattctccacctcccggaatttttttcaaactttgaaatttttcaaaaaatcaaatttttaaataaatttaatgaaaaaatttttgaaaaatttttagctaatctttggaaagtttttcagaaaaacttagtaaacaatcataaagttttgaaaaagtcactcaaaaaatttcataaatttacttttcttcgagatttccttataaaaaattacatgatttttgggtttgcaaaattttttcttaaataatttccgggggaggcgggaaacgatttgctccccattttttcaagtttttttcactattaatttatttatattttccgacccaaccgggtgcatgtcgcgcaaccgttgctgatcctcctcaattacgtcgtcaaagttcaggcccatggtcggcaacttgcggagtgccttgcgcgagtttgccggcaattttcgctgaaaatatttcacatttgttaggctaattattttgcatttcgcatggttttgttgggcctaaatccctctcccgatgaacaccatattcccgtttttctgaaaaaatccaaatttgaaaataaaaaccaaataacaaccaaaaaaaacattttttttaatttctaaaagttttcgattaatttttatgtttaaaaaaatttccggtaaatggatgggctgtccattacattgcttggttgccaatcaaaacttattttacaaaattcatacaattttgtgacccggccggaggctattagccccatttaattaggcctccccctctgggaaaaactgacccccccccccaaaaaaaaaattttttttttttgtttaaacaaacaaaccttgatcggactctttttgttttgtggtagtccatttgttgaccaattgttggacacggacacctgctgctgtttgccctgctgaaaagataaaaaaaatggacagacgacaaaaagtagtgattttcaaaaagtttatcttggccggaataaatcaaattcagaacaaacttgtagccagaaactttcggattagcggaacccgaaggccttttcctgtttactgttcggagcaaaattacaaaaaaaaaaaaaaaaaatttctcaatggttttataaattttcagcccccagggagagtaaaagaaggaatttgtagcggtttttcccaaaaaataggtctaatttttgccattttttaccgttgcatgtgtttgaaatttcctagtggaaaattcaagattttttaagaaagattcaatttttagttttaaaacagaccaaaaaatttttttaaaaattcctttgaatttttgctcgcagaaaattacgcatatttttttagaaaaattttgttgattacacgaattcagacattttccatcaaatttgaattcaatttttacctccatgcgcttcttctccagcgcttcgtcgatgaaaaatttgacgagtcggtcaatgcgttggcgccgtgccgtcgcgtcgtccacgcgcggaaactccaggaagtgtttgaaggcgtagcaaacggtggcggactcgtcgttgacctgcttgatcttggtccggccctcctcgaacattgtcctaatccggggaagggattgcataatgtagggaaaatttggtaaaaacaaattatatttttaaattcgctaaatgtccaaaacctgagattttgacaaaacgtaactttttttctaatttgttggtaacggaaggcggtaaaatacataaattttcaaaaatctgaacctaanttcaatctatactactttttaggcatatatttttt

SEQ ID NO: 5556 - DNA, 2532 bp, Heterodera glycines
attaccggccaaataatgatcactgatcaggctaatttgcatgtgtccatctcttccccatgcttaacctgttacgtatcgaacgtgaagatgctctcccgtcgaaaaaatgctactcggtgcttcgtttttgcagtaacggccaaccaacggcgaagcttcggagggaccgtctcgaacctccaaaaagtcccccgcacaactgaaatggtcaaaaaatggcatctttcaatccgttcctttttcttgttgctcctttcctctctctctctctctctatcccttcattttcccctttttccttccattatttcttttctcccttttgcgcactttccatcgtcgtctcgggtgcccataagcaaaaaggtctttgggtccacggtaaatttgagccgtctgcctggcggtgcactcaaaatccattggcaatcgagtgaattgggcgacaaatggggaaattcgggcgaagaaagtaatcttaggggcgtaagctgatccaatcggatgagggaagaggcacaatcgtggacactttcgacgagtgccaatttgaatcccttcaggggaaaaagcattggaaaggctttgctcttcgactgacccttcccctggaaaaagtgctgcggaagcgaatgaaaacgtaaccaccgctgatggtcagattgaactgctcttggccacaaaacgaattcgatgtttttgccgttgctgactcgcggaagaaagggaagtgggaaaagtcaagcgaatcggtggaacattcgttggactgccaatcgcgcggagccaacggaaaatgggaaaagtgaaagtgagacaaacggaagaacggacaaaggaaacggaagaacggacaaaggaaacggaagaacggacaaaaggaaacggaagaacggacaaaggaaacggaagaacggacaaaggaaacggaagaacggacaaaaggaaacggaagaacggacaaaggaaacggaagaacggacaaaaggaaacggaagaacggacaaaggaaacggaagaacggacaaaaggaaacggaagaacggacaacaaactcacgtccatgtccaacgatcggatgttcaagtcgcgtcgagaaaggagcaaaatgttccaatggcaagaatggtttttgttggtcatcggagggtttgggtagccgggcgaactgagcacagagtccatgggaccgttttggacgggccaaatttcggtggagccacagaccaacgaatagttgagggagaagccgcggtagaagcgggaccttaaaaagggcaatttcgggactaatttcggcgggaaggggcggaggggtcgctttttgctgttcttttgatttgcctgtccgaatagaaatagacgaatgcgttctccgccgagttcacttccacttggctgtgcacttcgctttttcttgcatattcgggagatgtcagaaagttctctgtggtgaaattggcatttttctctgttattatttctctctcatctttcgattcatccgattattaattagtttatattgtatctctaattttcgctaattacccccccccctttcgacctcaattcgtcctccgtctccaaattcttaatgctcaacgacaaaaagtcgtactgacagttcgggtgctgttccaactcaatagccgtcacattcatcacaattgtctcgaacattggtcttctcagcgtccatttgcagcgttcgttgttacggtacctattgtaatggtattttcggtagggcattccacgggttggaagggtcgtgggttcgagtcccaccggcggcgaattgtcctccccctcccctcgtgccaaatcgctttctcaccacatgcccatgttggtcgtcggattgcgaagtgtgtttgccgtccatcttggcactaactctcccccacatttaaatccgctcgtcgcccctttcccctccggcgcttcgctcccttttgcctccgtttcttctctccgtgtcccattttctccttccacccatccgatctcctcccaagtcaatcggaacttcccggataaattcgggagaaacaccaaagtggcacgattagagcgcaaagtgtacattttgccacgttggggaggcgaagcggcgtcaaaacgaaatgccaacgcgtcggagtcgcgacagatttcgtcactctttgggaaggggaagagaaaggaaaggatggacgaaagaaagacgaaaaaaccggtgaattgcgacgaacggaacaccaaatgggataaacggaaagcgaagatgccgactggggcaattgaaaatcgctgaggacaaaacgaatccacgagttggggttgggcgcggagaagtgccaggaaatggcagagtcttcggtgccgggcggaggggaaacgatcagccgggacgaagttgcaccgaaggctgaacagaagtgatcagacaggcagtgctcgacggcccactatcggcagcttgggtagatgtcgcctctccatctgctgttggcacgggttcggtctgctttagttctgaaaaat

SEQ ID NO: 5557 - DNA, 2463 bp, Heterodera glycines
cagggctccccccccccccacccactctttgcgtaatgcaatgccatcgccgtcggctcgtccccccggggcattccgtccccttcccctccctcgtcctcctccgccttgtgtctcatccttatccacatcgtcccgtcactctccacttgtctcggcgctgtgccacaataatgtccgagcaaattgccggtggcatttttctcgcgaaactccacgaaggaatctgtgcaaaaatcggagaccggcaaagaaaggcgctccaccgacaccaaaacgcgacccccgggcaccgtttcgatggtccattcgcagtcggaaggcaacggaaccggggaaagggcgagtcgaccattcattccagaaagggagcctccgcaaactaagcaaatgccaactcagagaaagagtgcaaattcagagccattgatcactctcatcttctctctctatctctctcgtctttctgtctaatttctcgcttcccctctccctctctctctcatttctaactccccctcccttttcttctctctctcgtctcttctctctctatctctctctccttctctctctctcatttctttcttccccttgtttgtttcagtcatccttccgctttccttctattacatttgctttccgtgtcgtacgaaatcaaaaacaagttctgcttctgatttgccaaattcgtgccaattattcgcatgtccgagtcgcatgaaaactcgcggaagtgtttgggactgaaagtgccggttccatccggcggttgcggcgcgacaatgccaagtgattggggcccgcagaacaattccaattgcacttcttcggccgaaggcccattttgctcgctttgcctcgtcatttgaatttcttccacacggacgaaaatgcgttggtcggctgaaagggaaaagccaagcgatcattcgctgccaatcgaaagcaatcacggctttgatcagtgatctcccgcgtgatcagtgaatcaccgctttgatcagtgatctcccgcgtgatcagccattcgcactttccctccgcgccgcccattcgcgccttggccgtgtttagcactttccgtgccgaattcgccacgagagtccccccgcatttggcaaaaactctgagccgaaagccaatgggtttttgtgttgatttggcgccagaaggcgaatcgcccgagataaccaattgatcatagggtgcaccgcggaacagaacaaccgactgaaaggaattgagaagacaggggaaagagagagagacagggggagagggggagacagagagagagagtgaaagagagagaggaagagacaaggaagagagagagagaaagagagagagagagagagacagacagacagacagagagagacagacagagagagagagagaaagagagagagagagagagaaagacagagagagagagagaaagagagagagagagatagattttgtacttaccttattcccgcccattgtgatgttgagaggcttaattaattatttactgtaaattacccctaatgagtcataatttacctccgcgttcacatcctggcaaattcggtagcgcgtccgctgtcccctaaagtgccaacgaattgactttggtgcattttgcccacaaattcgtcgattggttggctttggttggtccgtcgatgaacatcagtccgccgcgaaggtaaatcagacgaaaaccgcaggaaaattcgttggggtccgaataattgaccattctttccttcttctcgagactggacacagaaggggcggggctcgacaaattgagaatttggaaggcgacgacgaatccctcgggagcttcgaattgccaagccaactgacagagggacgatggcacggaaaatgacaaaagccaacctcaacgcccttcgggtaaggcttggggaaggagggcgaatggatgaatgtgtccgagcgcgggtccactgaaaatgccattgttggggggggggggcgtaaatcaaaatgccaatgccaacagtgaacggcgcctccttcagctgccactgcttcggccgattctgccgcaatcggatgaaagctgacgcgggcactgaatacaatgtgatcgtccaactcgtcaatggtgccgaaagcaatgccgacaatctgagaaaatggcacggaaaaaccatcgaatcattggccccgcccgtctcccccccccccacttcatccgaaatccttgcggaagagtcagcgtggtagctgaacacaacggtcagttcgccgaatgaccacgcgaaggtttcgttgcgcaatcggccgcacaacgctttgatgggtaattgaacaccgtcagagtgcgtgaagggaacggcatcggcataaaactgaagaaatacaatgccattgggccattatctttctttgtcccacttactctctcccactctctctctcgtccggtctctctctttc

SEQ ID NO: 5558 - DNA, 3645 bp, Heterodera glycines
attatctttctttgtccacttactctctcccactctctcttttccttggactctctctttctctcccactggctctttctctcccactcactctctctctcccactctctctctctctctcgtccatctctttctcttcccgctccacattatctcttgtctttcccacctgaactccgtcgagcatttccgtcttcggctttcctccgtctccgtccgatttcatttcaaaacatttctgatggtccgccacttcgtctagcaccattcgatccaccaaaatgcgaattgtatgcccgggaggcgcgcggattgaccaaatgcatttgcggaaggaatcgcccggcacaaaatcggcgccttccgacgcatttgccgtgagaagagaattgtttccgctgataatgccgaccacagcctaaaatgaaattctaaactcattgcccttcgccatttgatctttgggcccaccaattgtcgtccaactcagccaaaaatgattttccgcctcatttcttgactggaaatcgacccgaatttggttgtgcttggtgatcagttcagttggctgccacaactccgagcagtaccgacgaggcatttcggaattggaggacgaattgaagacaaaaggcaccgattcttttgttccgctgatttcacttatcgagtcgggatcagtctgatcaggcagagggccaattagtgatcgaatgaatgaatgaatttgtcatcccaccgctaaaaagtttcggccacatttccgctgatcagaaaacaaagaacgaacgccgtcaacgggttgtgagttggcgatacggaaaagatggaaattaatccgaagccgacttccgggcgaagttctgatggtccattgacagactgagcaatttgaaaaaaggatcagttcagcggaagaacgcatcagcagaacaacgaaccccggggagggacgacgggggacaaaaagccgggggactgaaagaagcgaactcagtttaatgatcaatgggtttgacattgtacctgcaggtttccgttaaacccatccaagacgatgtccgtacattctgcaatttgctgattaattaacaatgttcttccacaaaatgataagtcaccctcccccccccccgggatttattcattttgcttcgaatggcatcgtgcctgtgctgaattgtgccataaatccgaaaatggccgcgtggtgtgccccgccgtgctgtgtgtatcggacggagagtgcgtttccgtccgattggatgggccgcgggttcgtctccttgcggcagtgacgcgctttcatctccgtccaatcgctgccctcgcccacttccagcaaattgtgcccaaacggtgaacatttgccctgactgtcctccgagtcgaagtcgtccatggcggagatttgcagtaggacttggttccctgggggaagagaattaacgggccaaaacaaagggataaacaattaggcaacctaacgcaacggcgattagccattggcaacgcaacgactgcgaatctttgtggggaaattgcggcgaggaaatggcaccggcaaaggcggagatgtgcccgccacagcctaagaagaaaagcaggaagcatatcaagggacacggcacaaacaaagcgaggaaagagtgccaaactgtgaggatgactcaccattctcaaattgttcgtaacggatagaaaagcgcattaaacggctgaaagccaagcggaatttgaggaaaagctgattgccctgggagatgagccgaggctgggggtggtcatctgaaacagcgaaatggcacaataaaacggcaaaacggacgaatggaataccacaaatttcggagtcgccaaaaagtccggggaaagcgggcgattgttcggaaggaccgttgcgaaccatcaaagtgccaaattcgcaagggacggacatgtttaggatggagaggagaatacggcggtttgagggcagctgagggagggggaaacaaatgagcaaaaaaaggacaaattgacaaagggagacaaatgatcaaaaaagtgcaaatgaataaatgtttaaataaaaaaggaccacaattcggtagacgcaattgtccgattgagcaaattcactggcatcgaagtcaaactgtgcctcgggggcagtgaaagtcctatcgcaatgggaggccaaatcgacggcttggaagcgggcggcgaaaccggcgccactgagagaacggtcgctgagaaagacaagtgccatttgggcaccggaagaaagaagcggcgggggcaaagacttgccacaaaatctaaggaaggcaaattgggaaatttatggttgggggtaattaagcatgtaatgattagataattagtgtaagcatggaaatgcttaaattttgttgcctttcactcacttgcccaaaactttgccatggttctgttcgtcctcgaagaattcgtcgtacaccgtcacactgtcaaattcgcagttgtctctatgcgcaacattttccacgtcgaacacgtcaaaagatagtcggacagcccttccctaaaattatttatttgttttggctctgattgcctgctatttccctcccccctctctccctctctctctctcctctctctatctctctcttttcactctctcttttgtttaccgttggcacttggagaaagtaaacacaaaacatgaatgccatgtacgagtccgggtagttggggctggtcagctgtggcgcctctcccgccacttcgtccgatccgatggagaggacaccgccgcatccgatgttgatcaactcgtaactgagcagaaaccctttgtttgaggctgctccacttgtgcctttgaattggaagaaaaagtatcagcagaggatacggtagggacaaaatccaaaggcatactgtaggttatggaaaagggacggatgccgctgctcaccaccatttctccgtccggcgcaatgaacggataacgggcacaaacgtaccgtctgttggccacttcgttggacgggtgaccgcccgaaaactgaaaaaagtttaataaaaaagcaaatattccgtctttaatttgccatccccccccctttttcacttcaacataatcctccatttgcgcatgtctctcgcggtggtaattgcacgtgttgaaatcggtgctgatgccaatttggtcaaaattgatgcgaatggcctgccgaggcccggcaattattcggtaagtgcatttgaacggacgcggggagggattaggaaagttcggaggagagattgtcccattcagagcagttaaatccttctcacacgctgaaaaatagatgaataaaagatcaagaggattgatcgaaggcgaatgattaaacattttcaaagcaatcgctaattaccaaattgatatttcaatgaaaagccggcaccgccgagggacgcgtcgctgtgaaatttcagagaaatgcgcggcgccccaatggccgtcttcggcggcttgtgcaaattgcagaaggtcatgtccaactcggaaatgtgcacaaagtcgccagagcacgagctgatggtcacatgccgaagcattgggttggcatactgtacaagtgaatacagtatgaatggatgccgaagaaagcgcagttcaacctg

SEQ ID NO: 5559 - DNA, 3005 bp, Heterodera glycines
tatacttttaaacttaatgaatgtatttaatattaatcttgaaagggctatttgttaatggtctcatttcacattaagatttgctcaaaaattctgtgtgtgatcataaattgttcagacttagtccaaaaagggtttgagagacacaacttccttaataccaattccaaaaaagcaatgcgatcacagccatactgtaagcctatacgaacaatgttagatttggtgagaaagaaaaaagttatagtccggagcccaaacgtgccgggacccaactgatcgagtccgtgtagcggtaacataaaaggtaaaattcaccggtgtgactcgtatttcttttggaggttctcttttttctttatcccactttctcccacaatccgcttcctctgctggcatcacatagttgcggaaatagggaaaatgaagcgtagaaagagcaacaaattacaaaatgtcccttatctctctctttctatcaatgaattctctccatggaggaccaaaggaaattatgtacttctttattatgtattttaatatgaaatatattaaacaaaaaacaaatgattgtgaaaggcggtagatctataattgctgcatcacagtcgggacagtggtcgatttgccgttttctgaggagatgaacgggttctgaaccaatcattttctggtcattgtgtggctctgctgccatttttgccatatgcgccgaattttcttgtcccaaaaccaatggcaattgtggggctgaatccgaaactgccgtaatccgtcgttgtccttttgttaattggtgacaatggcgatggtttgctgccggggacaattactcgctgctttttttctgtcattttattgttgctgctgaacagaggagaaatggtgaacttattgtatcggattaatactttttttaccaccctctccctaaataaaaagttatgcaccctacttggcaccagagttaccgtccgaagcccaacatttctcttaccgagtcccggcccaaaggttttgaccgggattcgggacaaaaaaaacatccctaaagtttgggtatggcaaaaatcaaatcaaaatttacagtaaaattccaagattttgacccaatattcccaaaatagacacaaacttaaaatcaaaaattataatttctgaatgatgtgttcagtatgtacctttccggttgttgtcgttcgtaattttgctcatcttttgtcgatgagcttggagatggaaatgaattggaagatatttggggcaagcagcacgaaaaacagcagaggaacctccggaactcagtactggtgaagctgaagtggaaaggtaatagcgaattatgggagaaaagtgcctgtaaatgagcaatttggaagaaccgccgccaattgccagccaagaaaatgcctatggaaaaggggcattagcagagacaaaggcggacgacacttgggaattgtgacacttacaaattgcatcatggaaaggtccgattggcccaccagcgaattgggcaacaactgaaacacaatgatcggaagccatgagagtaggaaagagacgaagatgaacagagctaaagggagggggagggtaaagccatgggccaattgggacacacaaatgacgaagtttgggtcggtgtcgagaattgttcgttgcaagtcttccaactgaatgagtgggacagatagctgaaacttggcacaccggggaacctcgtccggtttatttacagctgcaataatggcagcggaagtgaatgccattgtgcacagagaagggaccaggacgagcacggcaagcgtaacggaatatgccattgtggaggtccaattgagcagacaaagctccaactgcggcgagtatttggactaaagcgaagtgccgggaaagtgacgattatcgaacgatgcgacctccattttggcgataagaattggacaggcgatgagcagagaagtggcccaggagaagaagatccaacatttgcaccgagtggcggtatgagcaacttcgtaacgactcggcttcataaaggcggagtatctgtcaacactgatccaagcgaagatgtacacctaacaaacggacggacgaattgtcgaacggacggacaatcggtcattattgaaaggtaccgtggagcagatcaacatgacatgcacatacacagtgcatttgcaaagagctgtgggaatgcaatttggcaaagagcaaaacgcattctaccggaattgtctccggcgaagtgccaaccgggcctcaaagaactgaacaagctgaacgggatgatgagcaaggagcagaaaaggtcagcaaaagagagactgatctgtcggtgcaaaagcggactttcaaagcgactctctttccttcgttttgtttttgataaatattatttactaaacaatattgcccttctcaaattcctccgtggattaattattccccgtccattgcttcttcgtcttcatcatctccactaattccgattccgaccgatccgtccctttttccataatcccccctctcccccctccgtcccttggctaattatgcttcttccttctgtctgtcctatctatgtctctcaattcttcgttttctcgactccctttccgtctttctttattcgtctcactctctttgaccgtttgtttcttccgagggattcctcgccggtcgtagtgccctttttgccgggagggattatttgggaaaaaggcaaaaagtgagagaagaggcaagtgacgtcacttcgcttttcattcgtttgcttcacccttcccccccccccctcccttttcccttccgccgatggcattgccatgacggcaaagattttaagatgaaaatgaatgacttggccgtgtaatttccaattgttaaaagacccatccataacaaaaaggtagaaaatgtggaaaaggtgtcttaaggaaacgaaagcgaaagccacgacaaaacaatggaaaagaagcatcggacaatgaattggc

SEQ ID NO: 5560 - DNA, 959 bp, Heterodera glycines
cttaaaaagcaaaatccctcacgaactttgacttttccatgcctcactttcttctccgatcagtccaatcagtttttgaatgtttgtgggcgttccctttatcactgcttttctgctgctgtcttgtcaatttgagtctatttttgccgttgtcggttggttctcttggcacgtttcctttccctcccctccctttgcttctccgatgtgtgccttcccctacctcccccccccccctccgttctctccccctccttttcccttcttccaatttattttgtctgttaagccccgcccgcctcagaaaaaaaagatgagaaaaaatgaaaggaaaagagaaaggaacgaagggagaaaaggaaagagaaatgtaagtaattggtgagtgattttcaaattcaaaattcgaaacaacaacttcgaaaaactgactaacataacaagctgcagaaaataggaataaaagtggaagactccgttagctttgtagctaaaattaaatagcgacgaagaaaatggaaatgaagccgtcactggtggaagcatgaaaattggccaggaaggagcgagggagcaaaagatagtcctttcaaagcattggcacaatcaaataggagccaaaagcaaaagcttaaaacgggagaaaggaaaggaatgccgaagcgagaaagaaaaaggcaaaggaagtcctttcagatagaattaatttgaaaattgggggggggggggggaaaggacgcaaaatgaatccgtccatttgtttattggcgaaatcggcaaataattactacatgtaataaagataatgaataatcacaataaggggggggggggccgcagtgctttcacgtgccgttgccgccctcagtttccatttcgccgcatgaatttgcctccaccccttcctcctcctcctccaacaattcaacgtcctccatagcttcctcgtatgccaaagt

SEQ ID NO: 5561 - DNA, 3435 bp, Heterodera glycines
  misc_feature (31)..(31): n is a, c, g, or t
  misc_feature (46)..(46): n is a, c, g, or t
  misc_feature (64)..(64): n is a, c, g, or t
  misc_feature (69)..(69): n is a, c, g, or t
cccccccccccctcgttctctccccctcctnttccctcttccaatntattttgtctgttaagcnccgcncgcctcagaaaaaaaagatgagaaaaaatgaaaggaaaagagaaaggaacgaagggagaaaaggaaagagaattagagaaatgtaagtaattggtgagtgattttcaaattcaaaattcgaaacaacaacttcgaaaaactgactaacataacaagctgcagaaaataggaataaaagtggaagactccgttagctttgtagctaaaattaaatagcgacgaagaaaatggaaatgaagccgtcactggtggaagcatgaaaattggccaggaaggagcgaaggagcaaaagatagtcctttcaaagcattggcacaatcaaataggagccaaaagcaaaagcttaaaacgggagaaaggaaaggaatgccgaagcgagaaagaaaaaggcaaaggaagtcctttcagatagaattaatttgaaaattgggggggggggaaaggacgcaaaatgaatccgtccatttgtttattggcgaaatcggcaaataattactacatgtaataaagataatgaataatcacaataaggggccgcagtgctttcacgtgccgttgccgccctcagtttccatttcgtcggatgaatttgcctccacccattcctcctcctcctccaacacttcgtcctcctccatcgcttcctcgtcttccaaagtctccttctgcctgtagaacagaatgtacgcctcttgggaaagcacttccaagctgttcactcgggtgacattcgcatcgtcaaactcgtaccaatcgaggtcatccgaattccgacaataggccacataatgtccatctgtcaaaatgagtttttttcataggaattcagtcatcgtttcatagtccatcttatttagagtaaacttacattccaagttttgtcccttgtgagtgattaacccgcaaaggtcgtatttggttgggtttgggcattcgggtgggtcaaattgtgcctcggagtgtataaatggacgcaagtccaagttggtgaggggaaatgcgactttggagcccaatttgacgttgtacatcccttcgttgcggaaacgctttaaatggatgaccaacacttggggaaggcgagtcagcgaacagagtttagtcccatttcgaagtctgaataagcgagcaagtgacgagaaagcgcttcctgcccacctcaccttttgcactgttcgcatttgtacatgtcatcgccgtgcaaataatcgaccgagaaaaaactgcccaaacattgctccagagaaatgggacccgaaaaaaagtggcgataaagttcagtggcccagccggtccatggacgaatcagccactctctggcaattatcagaaaccactggaagggaagcatgacactcagagaaatgagcaaagcacagtgtaaacatgccaataaatattccaatccgtaataattggaccgaaggcttcgctgtgtaagcgtaagattttcaactgcgtttcgatgcctctgaaatggacaaatttattttccgccagtcaatggacagaaatgtactcacttcctcctctctcgcagtcaattgcatcaaattgtcagagcttttacggctttttactgcagttttcaaaatttgaccattcgttggcatcggcataattgaggaggattcctttaggggacgaggcggaatcggcacggagaggaagcagaaggggtcgaatttgacactcactttgccacaaactgaaaccgaagaatcgtttctttcgtcataaaaaagagcaccatttcactcattaatttcaaaattttgttaagtcagaggcgaatttcggattttcgttcaatattcgaaatgaaagcctttcaaagttcgggtctctgaacaacaacaaaaggaggttcggctaccattgcaagttaatgacgacttcagctgtccatgcagcagatcggtcacaatgctatcgttcactcttttgtactcctcccacgcctcctccgctgtctgctgtaaattgactgaacatatcaaaacgagttcagcaacaatagttgaattgcactattcacctgcttcgaagtgtccgcttcctccgacactttcggctctttccttcgcttttcttcgatggcattttgctcttcacttttcccatcttcggcacattgtccctcttcctcgttgtcctcccttttttcagtttcatccatcctattgttagaaatttgtctgtgattaatccgccgatttaagtcctcgtgaaggccatccaaaagaaatgcaataaattcgtgtgaatcctgctgggcaaatccgttgaaacgggtcgcgaacattccgacaacgcactgagttttggaaacatgtttttgttataaattattgtgaatgtataatttggtgatcacaccagaaataaaattcttgttttaatttaaaactttactttgagtcgaaacggtctaaaggtgcaatatctgcctgaccacatattcttgagaagttcagcgaattcttgtgccaatttgccttgggtgcccagaggattttgggtatttatttgttcggaatattctccgttgatgaaaaaagtagccaattccggaatattgcttaggcattgtaaggcactaaaaatttaaaaattaatcagtttttggttaaacagataaattctttctaatattaaaatgttccgcattaaagcagacattaaacattcttggcaccattcgaaaaattttctattagcctgcaaaatttcaaaaaatttcgttatgtttcaaaaagttatggcctaaaatttcgattcaaaaagttttttaattttcacgtcataaattttttgaaattttaaccttttgaacaggctaatttggggctaaaaattatacaagaatgtttaatttggatgctttctagaaaaagttatgtggcatttaaaattgtctaattatttattgtcgtgtaaactgtaataaagccttaatgctgcctaaggatggataaccgacctgttcatgaagcaggtgttgcccaaattggccaagccgcaaaggcccttcggataccgaacaggcaaagaatacaaactaaaaaaggcatttcgttcattcgaaattggtctttgaattatgtgatgcatcaacctgtgatttgttggcaaagctccgttagaaaatggaattgtcgcgacgcgtcctccaccattgtatttttccggtctttcgtaaattttttgcatcgatgcacatttacaaaactaaacaaagttaacgcattaaaggaacaaaggaatatgaacaatttgctagttggttttacataattccttatttttgaacagacaaaattaataaaaagaaaaaaaaatagaaaaattttaatggctttttaa

SEQ ID NO: 5562 - DNA, 1038 bp, Heterodera glycines
  misc_feature (15)..(15): n is a, c, g, or t
  misc_feature (1013)..(1013): n is a, c, g, or t
ccatagtagctaccnttcttctttaaaaaaattgaaaataacatacaacaaaatgaggactcgaacctgagaccccccttttggtgactaactcacagaccactaagacgaaaaaaccaacttatttgcgcttggagcccaaaattgaatcgccgtgttaacccatccttccttaccctttttccaattttcaattcagcccccaaagttagataacaaaattattattgattattttttgaatttttaaaacttttgtccgacggcattctaatgtagtttggaatttgctagttttgcaaagctttttaaaattttgagacaaaagtaaaaaaaaagctgaaaaattacaattgcaattgtatttacttgaaatggttaacgtttcacacagttttgattttcagatttcgtgtattattatcttaacaaattaagggtgaacatctaaatggttagaccaaacttctatttttatgttaacccaaaaattaaggcgaaaaaatccacgaagaagaaggtcgctgctcttcccgccgcgatcaaaaagacggaaactaaaaagccggcaaagagtactctttttgaacgacggcctcgcaatttttcaattggtatgagcatgataatattaaatatggtttttatctgtatatttaggccaggacattcaaccgaaacgggacttaactcgctttgttcgttggccaaaatacattttgctccagcgacagcgtgccgttcttgaaaagcgtctgaaaattcctccaccaatcaaccagttcaaatttgctcttgacaaaccaaatagttagtttttgttttaccaatgtactacgattttctaaattcccattaagccaaccagctcttcaaattgcttaacaaataccgtcctgaaactcgccaggcgaagaaagaacgtcttcgtcaacgagctcaggatcgagcagatggaaagcaagagaaactgacgaaacgtcctcctggtgtccacttcggcattaaggatnggtgtcaagccgtggagaacaaaaa

SEQ ID NO: 5563 - DNA, 2964 bp, Heterodera glycines
cattgtgaagggaaaagatttctcggtcaagttgtctaccgcaagactacttctgccgtgtgtctttgcgacgttaatccgtgcgtttaacattgttagttattatcgactatacaattttagggaggacagaaacgcgcttaaaaatttggctgatgttgcggtcaccaatttcaatgaacgcggtgatgaacttcggaagaattggggaggtgcgatcatgtcccagcgttcgcaagcacgacaggctaagattgaaaaggctcgccagaaggatgttgggcagaaagtttgatggtagttatcaaaaattgttgtttctctgttgatgataaaatttgttgacttttggtttcaaatttacaatatttgttcataccatcgttatctcttagttcttgaaaatctttttgttatttgtatttgctgtagagatgttttcttgtacgttaaatggggtgccggaatcacacgatcttttggagaagtgtcggctgccatttggtcttcacttacagccattccgtgatttgagggtactctgtgtgcatctttcttcttttgtagttctggattaagggattgaaagtcttgcagacagtcatcacgcggtgcagatattgcaggacatatatcaacccttttgtgtttttaatggacgcccgtcattggaaatgcaatttgtgctatcgcgcaaatgaaagtattactttccttgttgcgataattttttaagccttataacagtgcctgaggatttcgcatgggaccctcaaacgaaaacttttggcgacccatctagaagacccgaactccaagaaaccactattgaatacattgcaccatctgaatacatggttagcccgtgcgaaaattttttttagaaacaacaagttaagcttcgtcctcctcaacctccgatttatttgtttgtttttgacgtcggttccgcagcaatcgattgcggttacctcaacacttttgcagaacaactttcgctggacattgacaaattgcctggccaggaaagggctttcattggctttatcggtttcgattccgctttacattttttccaattcgatgaaaacgagagagagccgaggcatattattgaatttgatgttgaaggtttaactcaaaatattaatgtataataaatacttggcttttccagaaagttttgcgcctgtgttctctggactttttgttgaacttaatgttttcaaagaggttatttttaagaaaacaaaccagtttcgcatttttttagatcatcaaaaaatttatatacaacataccatcaatttttgaacgttctatgtcatcctcaaattgtctcggttctgcacttacagttgcaaaaaatttaattgtaagttttttttatctgtctttaattttattgtttaaaagaacgaaatcggtggacggataactgtttttaccgcatctatgccaaatctcggaattggtgctctgaaatgtttggaattcaacactgcaaaagtatgcgtgagtaaattggtactttaggattttcataccccacccacatttttcatgctaaaactaaacactgacccttatttaaacgtaataccaaaccagattttctttgatttgaagttacgaaacagaaactacttctattagcatgtactaattgatttctcttttacagaagatcgcatttacacctcaaattgacttttacaaaagtttggctctcgaatgtactggaaaacaaattgccattgaccttttcgttgtcggatgtcaaaacgtagatcttcgaacattatgtgatttgttattcttttgttattcgcttctgttaaccatttatggacaagggtggagggattagagggctctgttgcagttcacacgaccataaaaatttttgcaactttagtgcaccataactgttttaagaagcatccaaattaaacatttagtatcattcggtagccctaagaaaatcctctattagcctgcaaaatttcaaatcgttgggtttcaagaaatttatggctaactaaaaatatttagaaaaccaactttgaaattttgcaggctaatagaggattcttagtgctatcgagtgatactaagaatgtttaatttggatgtttcttgaaaaagttatggaaatttatggtcgtgtgaatttcaataaagccgattagagttaggttttttgaaatttcttcaattctatatgaaattatcctacattttccttttggcaaaaaatttccatccttacactgcctttcatctttctctaatttttcgcggaatttcaatcctcataaaaaatcggaatttgcctcaacccttggctatggttcaacaattcgctgattttttgctttttaagctgatatgtctcggttcagcagtggcaccgtgtaccatttccctgaatatcatttccttcgggaccaagtcgaagtcaaacggttccaaatgattttacgacgttactttattcgaaagcttggtcttgaggccgtgttgaggatacgttgctcgaggggtactcaagcaattgattattattgttttcttatttttattgtttaaattcacaggactttctcttcacactttttatggaaatttcttcgtccgttccactgatttgctcgccttgcccaatgtgagtcccgattcggccatgggcgttcaaattaaacacgacgaagtgatcacagccagtcaagtgtgtttccaagcagctttgctgtacacctcgacgaaaggtttcccttatccattgtttgaaatgtcgaaaagtcaggtgaccgtcgtattcgcgtccacacactttgtctccccgtgctcacacaagctgcacatgtattttcttcgctggacattaactcgtcaatatcgctactttcaaagatgggttagttctgttcaggcccgtaaaggagcgaggggcgggaaacc

SEQ ID NO: 5564 - DNA, 3442 bp, Heterodera glycines
  misc_feature (3390)..(3390): n is a, c, g, or t
cccccccccccccccaccaaataaatgatagagggaattttataagggcgtggccagggaacgagcaaaattggcaattttcaaaatactttcatattgatattttagcttctgatagagctttgcaaggcgctagtttatcagactgtcgtgaggcactaataaatgccgttgtcgatccgaccgtctgttatcagcgatcacatggtcaagttggttccatgttgcgcatgcctcctgaaggtggtcttcaatacatgcccatttacatacttggattgttaaaaaatgtaagtaaaacttataataattcttttattggtttaatttatgtccaaaagaaatccttaaccaatactcccgttaattattgttgcttgttatttttatatagtaatgatcgaatttcagagggcgttttcggattctctgcaaagggtcaccatcgatgaacgtgtggcaacttttctgcttttcaaaaatgctccgttggaagttctcttacttgagttgtgcccagctctttacgcttttcaccaaattctttactgcgaaccgaatcaggttgccggacaagcattttacccaatatagcaactgctaatcaattattgttaacgactgaaaatgattttctcaggatggacaggtcccttttcccgaccgtcttcctcctacttatgagcatatctcccaaaatggcatttatttgctcgacattggcacatttgtctatgtgtacgttggctctgccttaaatgtctgtattttgcgttctctttttggcaccgattcgttcgctaaattggattcggatgtaagtgaatgttcgactcttttgctatgactgtttcttttgagtcaacagtaattgaaattgacacttcgcaaagcaaacatttgcatgcctttcttcgccatttacaagaacagagagggaatatgtatgctccagctaaaattataaagtaagcgccttccgaaggaatagacgcgattcgaatttaatttagggatgacagtccaaggcgggaggcatttacgcgacggctcatccaggatcggtcggattcttcacattcttacaacgaatttatgcaattcctccaacgagaagtcagcaaagccagtaaatgaagaggatgaatgaaatttcttgtgatatcttcattttattcgtcaggaaattagtctctgttaataccgttgttcactaattggtaaatacatgtaaatgaatagccatttattatcctgccagaaacaagtccctgagagacccgcttatgtttcggaccgctaatggcccaattttcggttctagtcggttttacgcgtcccatgacgtgtccatggtatttaaccgttacaaaatttcgtaaaaccgaccagaacacacctttctactgatatcattgggcgtaagaaactgacaatgagagttgccagctttgctgcgcaaattgcattagagtcccaatattttacaatataaaaattaaaacaaacataagacaaaacttaaatgacatacaatgtattaataaataagtgaggtgtgacaataattcatttcttaatataaattctcaagggctgtttgatagttcctcgtcgagtcgccaatatttaacaatttttgccgttgtctctcctttttgctaccgaaatttgcctctggctttgatttccataaaatacgaatgagtagcgcggccaaagacaaaacacaaagaaaatagaaaacggagggacccgcggagaaaagcgggcgaattcggctgaaaatcgatgggtaaaagaattcgtacctataatctgaggacaccttttttgctttggctgaataatccctttgctttcagcaaacaatgggaaatatcgcatctggtaaataatcgcaccaagcgccttaattcaaattggaatagataaaccgcaaccatttaaatgatcagcacccattggacttcttggccatttattcgaaatgcactttgaaagtgatgttggatttcgtcgacgtggaaaccgttgtgcaacacggcgtggatccacgccgacttaaagcattgcgtctccaatctctccgagtccgccttttggtagaagtgcgctttgactttcctctcaaaatggcaaattttaatttgggaacaactcactgaatttggttaaagtgactcacttttatcactgcccacggctgcccgcaaaattccttagccttttgttcgaatttgtcgtgttcgtatttgccgcccagtgaaagaacgtcgtcgacgctgaaccaatactcgctgaacccgtacaattcaacgtcggaaagggacaattggggaggggcgtgaactccgttgaaaaagcattctttggctggagaacatttggagttggactcgaacagctaaacgataagtcgtaggggttggttagggattgacaaattcaaccagcgaaacgatgtcgctgacacatgaatcccagtcgccatttccctgaaagtgccaacaaatgttttggcatttttttcactcccccccccgttgaaccacgcaacctttcgtacgaattggtcgtaattctcctcggcatggctcaatttcagcatattcacaggcaaacatccgtcaacgacagtcggcactttcgcgccgtcttttccattgtccgtttcggtcgaatttgccgcttgtcttttgttgttcaaccgcttccacaaaaacttttcgtatgcttttgctccttcattgactccgaagccaagaaaagtggtgacgaacaatcggaaacggaaacgcgattcgtcgtcacgacagccgaggtttagcagctgaacattctcttgcccacccgttgcagcatcggaatggcccaatggaagttcataggcaatttgagcagaagcgccacccatgtcaatcattcctcaaagggcggactaaccaaaattgggcaattaaccaatcatttggccttttccaaattaccccccaaattgtcacttattttgcatttcttagttacctgctgttttcggtcgctcctttttctcaacagaaagtgctggttgtgatcgctcttcgagtgactccgatttggatttgtccaccgatttcgtgaagcgtcccagcatataatttatggctatccaactgtaaattccttctaaaattttttgaataaaatttagatttaaaagaaataaaaggggatggggtttgttctccccccccccccctttctctgtgatttcacaatttaccccatcggccgcttatcacccgaatgtgttggtccaaaatttgcaattttgtcatctgaggaagttcattgcggagatgttcccattaaatctgttgttttctcaaaatggagcgacaattattntgaaatgctcccatttaataacgaacgcactcaaatggcaacagacgcatcc

SEQ ID NO: 5565 - DNA, 3302 bp, Heterodera glycines
ctggttgcttttgtccgatttcccatgccatccatctgagatgaaggtgggccgctgctcattattgcaatgcacagcttggccgtggaagttcgttggagagacgaagggcgaagccgagagtttggactcattcaatcattttcacctcattcttcatttaaggatcgggacgatcctaagggaaggggggagttgtaaggattattcgacgcatttccctcatttaagtattccctattggccattatcaattcaatcatattttatccattcacacgcttttcctttttcgctgtaatgattctccgcccattcgcttcttttttctctttcccccagtgatcagttagtcagtcagttgttgagcagacttcaattattattccgatttctcgtttcgtgtaaatccaacaacgagtgaataaatatatcgacagtcaatgaatcgttgggattttggggcttagtcaatggccatggctttccccacttcctcccatgttccatccgggatagacggtgcggttggtctggggggcacagtgcgcatccctcactataataaatatttgactatttgggtaataattaaatgttggcaaacatttccggctacttccgtcaaaattaaatatatttatgtatttgacaaatttggtaataattaagtgttggcaaacacttccggctatttcagtcaaaattaaaatgtttatctaaattttgcataattattattaatattattattattatatatgttttcaatcaatttatcgaatttatatgcatatatttaaaatgcgattgttgaaaaaatattcaattacctttttatttgaatatatttatgaataagatattcattagcgtcaactaattaccatctcagcggaaatcctaaacagcttttagacatgaaaaacactcacatgatcataccaaattcgtagagccaacaaaatttcgaattccaatcccgagcttgattttgcgagatcccaatccgcaatctcgcatttcgcaaatttcgggattatgggattttgcgggatatatatctgcggatcccgttgtgtaaaaattttttagttccaatcccacgcggaatttatacctgcgtgatcccgtcaattttgaattccaatcccgcgcgggattttgctggatctcaatccgcaatcccgcattttggaaattgcgggattatgggattttgcgggatataatataccgagggatccgtccagtaaacatgtttagttccaatcccgcagtggaatcaaaatttcagtcaaaatttggcacattcttcaaatggcacaatttgtgaatttggtacaattatttaataatgctccccatatttgggcataattatttcaaataaaaagtttttcttttaaaggtcagctttttgattttggtcctctcattattgccaaatgcattattgtcaatcggttggtgtttatttagcttttcttttttaattgtaatgacaaatttattatgattttctagacacagaagctgtgaaggatatggcagatgaattttcagcgctaacatcctcaacatgggacattgttaatcagttgagatttgtcagtgaaaatgccgtgaaattcgttcgcgtcgccggccccgtgggcgccatcattgcgacagccattgatatcgcatttagtgtaaaaaatatttgattgaaaattatggtacttttctgttattcgaaagctcatgctctattagtcttacaaaagcaaaaagatttcatacatataaaaattttttaagaaaaatttcaaaatttgattttttttttttgcaattttcgtgttatatcttttttagaataaacatgttagctttcgaaagataacaagatcgttggatttggatgacgaagaataaattatagccaaaaatatgctggggcccaatcgttagggcccaacaccaaatgacatagaccacctgatccgggtattttttgaaaaatgcaccaggatcaggagtactgaaaacaggatttaagatcctcaaatccgtctgctccggatcagggctgggcgtaattacggatcacgcctttttggaccccgtcatgatggattacggatttttgggattttttcgtaattttcatccgtaattgggtttttggattatttttcgatttcatgcaagattatttttttataaaacaatttttataaaaattattttaaaaattaaatttttgaaaattacgcattacgggttacggttaacgggaaagtttacgcccagccctgatctgggtccagttcgataatcctgatcctgaatttttcaaggttccggccttacaatatggtcacggagttctaataaagaaatacagtactcatttaattgattttataatttgcattatacaaattgaaattttaagccagaatcagacgagcaaaaagccatcaaagaattgcacgaatttgtagaaagaaagtttgaagatctcaaaagacacgtagaacatgaagctaaatcaatcataaattatttagttgaagtcgaatataaaaacgtaacctaataaaattttaaataatataattttatttataaataaataaataaaatatttcataaaaatagttttaattaaagacatgaactttcaaatttgaggatcccgctacggggttagaactcaaaatttttttgcgggacagatccggccggattaatccccgcaaatcccctcattttccaaaaaaaaatgtgagattgcggactgggatcccgcaaaatcccgctatctctagttatataggggcgtgccatatcatagtattatggaaatctcatcatctttgggtgatgtgaatgtgtgtgtgccgtgccaagatatgatgaagttacaaagtttttatcaaaaattatgattttaggtattttaagaaaacaaaataaataataatttctagtgttgatgttactggataaaagtagtctcaattattaaagcatttggcactccataatccggcacacaaacgcatcgcgcaaaaatggttgcaatttcaaaatacaattttagggtgatatgtgtactttatgtttttttttcagacggtaacaaaaccattaaagattatcgatgatgcttacaaaggcataacggatccacgaaaagaagagcgttcccactataaagaagaattcattgccaaatgtaaaggaattaatacagcaccacgtgatgttctgattgtgagtactaaattctcaacattgaattttcgaac

SEQ ID NO: 5566 - DNA, 1468 bp, Heterodera glycines
aaatgcttaaaggatgtctgtacgttatcttagtgctgattgctgttagtttgattcggttgggcaaatgttagaggcgatttaagcattttggcccttaatttctccggaaaacttggaaaattcaacacaactccgcctaaaagacagatttctgtctgcaaaagaaatagaaatgtgaaaaaagatttgttctttcttatttagcttattttatcagtttctttttggtagttattgagatttgattcgtttttatcaagtgtctctattttaaattaacacccctttttcgggaaaaaattcataaaatttttttccatcgtcatttcgccttctcctttttagaatcttaatattttcagaattgctacgtacagttaaaaattcagctcgatcggttcatgggaagtggtcaaactcccaaaaaacagagtgtctttattttaaattaacacagtgtatttgggcattttataatttttgaaacaaatcgacaatttttaaatttaaaatttaaacaaaattttgagaatctatttctaaaaatgattttttcggacaatttccgatctttgggggtcaatagtctaatttagctgatgggagccgttctattagatcttttttggaaagctgccaaaatatgtacataaatatgtaaatgtggatataaatcgcggattatggaaaaatatggatatagaaattcatcctagaagcttcaaaccaagctaaaaacacgtttttcgtgcgtttcagggctcgcacagtccaattccatataattccaagccctaattataacttcacaggtgttggatacaaaaaattgctgatggcaacgaacggaaacgagaaccgctcgttcattttgctaaagtagtttggttggatttgatgagagcggtgagttttacggcaacggcgtagccagaccctttgctacgggggggggggggctcaagtcaaaaattcggtttttaggggttatattttttagttttttgaaatcccgaattagcggcatattttataaaattttagccgtttttcgccaaacaattactattttttgccattttgatctccatttttcaaaaatatggtaaaatgtgggtccggcgatgccgtcaagcgctaccgggaaaattttttgagaattttaatgcaatttgttaagaaaattgctcaacatttcaaagaattaaattacaatttttattttttttcctttttcagggggggggggcaccccaaaacgtcgccggaagactttttggaccataactttgttcattgtaaatcaaattaagcattcttggtgttgttcgatagctttatgtgtttactattaataggctaaatttaaaaaatttttgttaagtttcaaaaaagttatggccagaaggaactcaaaaacctagtatttcgaactttttttgctctgattttttttgtacattaa

SEQ ID NO: 5567 - DNA, 2988 bp, Heterodera glycines
  misc_feature (21)..(21): n is a, c, g, or t
  misc_feature (24)..(24): n is a, c, g, or t
  misc_feature (39)..(39): n is a, c, g, or t
  misc_feature (2841)..(2841): n is a, c, g, or t
  misc_feature (2936)..(2936): n is a, c, g, or t
tatgtccatattgggcatttntgntccatatctggcatnttatgtccatatttggcattttttgtccatatatggcttttttttgtccatatttggcattttatgtccatatatgtgttttatgtccatatttggcatttttttgtccatatatgtgttttatgtccattttggcattttttgtccatatatggcttttttttgtccatatttggcattttatgtccatatatgtgttttatgtccatatttggcttttttttgtccatatatgtgttttatgtccattttggcattttaactaataagtttggctgtcaattttaattatgtaaaagtttttaaagtcgattttttggaagtttgttttactacaataccaaaaaatcaacatcaatttttgctatttcaggtcgtttcttaggggtgtattttcccgaatttattgtattttttaatgaaatttttcagagccaaaaaggcaccaaaaacggcaaaatgccaaaaaaggcatttaaggcaagaaaatccccaaaaagacaaaaaaaaacataataaaagtaaacgtagaagccttataaactaagtggaaaatgtgttatttatgctcaatatatcgaaaatagtgcgcagaaaaaaaggcatatgcttcaaaagtcggtctttacttataacattcgatagctctgcaaagattaaaaaagttttacgtcccggcacccttgggtttcacaatttccaccgttgtgcacttggaaactgacttggtatgatccgagccctgagttaacaaataaatgtttaagaaagttttcaaaggaagcaaaaactttagattttggcacatttgtttacacaaagtttcactatttgtagaataataattcaggaaatcacttggccaacaatttcacgcactcgtgcaaaatcggcaattggtgtttcggatatcgcagagagtaaagaggcgtatcaatctgtagcggaaaagataaaggatgaggttgaccaattaggtgcagaaaagtaagcaaaattgagtgcttattcgtgagcacagtatgatcaagaaacttttaaatattatgtgtttgttgatctttcagtattgaattttagaaaatccaaaaagatggccaaaaaagtctgcctaaacaaaaaatcaatttacaaaattaattcaaaaaatgagtcgattagaaaatctttcttattttatttttaaattgttcgaattttaaacgtctttttctattataaggttggaattcttgcgccttgtaaaaataatttggttttattctgctggttttcaaaaaaccgcttatttttatgttgctgaagttttagctgatgcgcatagtttcattttaaatgattaattttcctctttttttacaagtacaatgttcagatacgattacgcggtcatcgtttttcctaattggactgacccagaagcgatggcaatcattagcgaagctaattcatactttgaattgattgacgtaaagcaaatcaatgttatcgtagtccgaattgaagacaacgaaacaaattttgaattggcatgcaaagcaaatgaatggtttactccaaggatagaaacaaaaatgaaatataccataaagtaatttgtatttggtagagaaagattaccgtaattattttaatagagccgccccggggctctgtttttcaacctcccctcccccctcaaaaggggggctttatttcggaggggtggctctaattcaggggggggggggctataattcaataaatacgatatattattttattcgtactgtttttcgacaaaaaatcgtcataacttttatttaagtcggtcaaattaaacattcttggtatctttcgatagccctagatgttttcttttagttcacaaaatttcaaaaagtttcgttaaatttcaagaaattgatgatcaaaaatcgaaaaaaaatttgtttcatttataacattttattcaaacaattgtcaattttttgaaacttggtatgcaaatagagaattttaagggctttcgaatgataccaagaatgtttaatttggtcgactttgacaaaagttatgacgaattttttgtcgaaaaatttgagtttgattctgcatcaaatattattttctgctgttaagaatgtggtgggatcacaaaagacatttaaagctcagtgatctcgcggatatgctgaaagaatggcttcaattttaccgtaacttagtcttggtacataattggaagtttttcagctccgctgccacaattactctcggtgaatgaaaaacattttaaatttatttttaaatttaaatttgatttttgacaggtgttactccgacctttgtcagatcggccagggccgaaaagggtttccggcacaaaattgtgccggcattatttgatgcagaaattttccatgttcacatgcttttgtgagtaatgcgccgacaaattcaatgagtcgagagcaatatgattagggataggatttttttcgtttttacaattgagtcattggatttcgaaattctttgttggatcaatttataaaaataattttattagcaaaaaaacgagcaatttttaatttttaccatcgaacacctcgaaatgtatttaatttgcaattttgcgggcgaaaaaaaaataaagaatgtgagatgatgatatttcttgaatttttatcataaacacatacttgattttccaattttgaatacatattttggcattttttgagcttttgccaaatattttagcatttttttagcacataaaaatcccatccctaattatgatattttctcacttttcangtaatttttttttttttggaattttttgaatgattttttaatttattattaagggatcgatttttaggcacaaaaaatcgcgaaataggcattanataggcacaaaaatcatcaaataggcactaaataggcaaaaaaaaagttttt

SEQ ID NO: 5568 - DNA, 1887 bp, Heterodera glycines
cagcagtagcagataacgatatttcaccatttatttgggcttcttctttcccttttggtaataggtaaataaaattggctttttctaattccaaacaaaaaaagacccaaaggtcatttaaattaatttttatttaaaaaaaggaaaataaattaattgcaaattttctactttaattcgcattaattttaaagcacagggaatgaatgaatgggtgccaatttggcaattggtcgttctcagcctggcccaggtattctgtccaccgcgtgtttcagtttcatgtacatttgactcaccgggttctgccgaattgcttaaattggaagtgtaactcattaatggtcatttggtcatttcttgccatggtcggcccggtcaatggtttttgtgagaaggacgagaattatggcaatcagaaccatgatgatcaaaatgaagatgcaagtaaacacagtgaaagagaactgcagccacaccaaagtgcggtacagccgagtccgtctccgattcagccgcagcatttcctcctgctgctgctgatcacttttctgaagctgccgattagtgcttttgcctctctgcacttcctctcttcccctctttctctctctcttccccccccctctcccactcactctttcttttcctctccctcttccccgcactctttctttaatgctctgcttacctgcctctgatcactctcttctccatccccactttctccttcatcgtctgctgttttgtcctccaaattggccctttctttttctttctcgttttcccttttcttttgtatttccatcggataaagaaacatttctgaagccgaatttggcaagtaataagctttgcttgatctgctgctgtaatttgttttttcatttgagaaggatggcgaaggcgcggcggaaggcgacgaattgcgaatttccgccgcagggggaggggacggagagggggcgaagggcgacggggggtgccaattggtgtccatttgacgccggcgaggagacaacgaatggtcaacgaaaaatgatcgacatttgaagaagcaaaaaaagggggtgggggggtaattattattaaaattaaaaattaattaaaataatagagaaaaatttgagagagtgcaaataataggtcatgtgatggcgaagtgttggtttgtgaggacagtcgattggctgtggcgaaaaggcggccgactaaggccaaaggatggcagccgacacaattcattgatcagtgatcaatgaacagattttttattgtgcccattttgcattgatttcaagctttaatacatttttatgtggcgttcacctgactgggcaattaattgatgaattgcattgaacaaataaaaggaaccttcgaattatatcgattaaaaagggaagggaaaggcccgcgggggggatgctctgctgctgatggtggtggtggtgatgtgatgggatgggatgaaaaagggggaaacgccggggagaataattagggggacgtgtgattgggaaggacgactttttaggttttgagccaccgatgatgggcggcgaccaactcacaacacacggaccgttcgatacaacaagctcacatttttttatacaatagtaataacaacaaattacaaatatacagaaaaagacaattgaacaaacaatcatgacgatttgattggatattgtcaaagtgaattggcaagtccccattgcattcccgtcacggcaaccgagagcccgggaaaattaggactggtaaaaatgaaattctgaacaacagttcccaaattgttagacaacatgaatatggaaatgcttctaaaatggcggagttttatgaatcataaatgcaaaatatataattataaatccattt

SEQ ID NO: 5569 - DNA, 5109 bp, Heterodera glycines
tcccactcactttcttttcctctccctcttccccgcactctttctttaatgctctgcttacctgcctctgatcactctcttctccatccccactttctccttcatcgtctgctgttttgtcctccaaattggccctttctttttctttctcgttttcccttttcttttgtatttccatcggataaagaaacatttctgcagccgaatttggcaagtaataagctttgcttgatctgctgctgtaatttgttttttcatttgagaaggatggcgaaggcgcggcggaaggcgacgaattgcgaagttccgccgcagggggaggggacggagagggggcgaagggcggcggggggtgccaattggtgtccatttgacgccggcgaggagacaacgaatggtcagcgaaaaatgatcgacatttgaagaagcaaaaaaagggggtgggggggtaattattattaaaattaaaaatgaattaaaataatagagaaaaatttgagagagtgcaaataataggtcatgtgatggcgaagtgttggtttgtgaggacagtcgattggctgtggcgaaaaggcggccgactaaggccaaaggatggcagccgacacaattcattgatcagtgatcaatgaacagattttttattgtgcccattttgcattgatttcaagctttaaatacatttttatgtggcgttcatctgactgggcaattaattgatgaattgcattgaacaaataaaaggaaccttcgaattatatcgattaaaaagggaagggaaaggcccgcggggggggatgctctgctgctgatggtggtggtggtgatgtgatgggatgggatgaaaaagggggaaacgccggggagaataattagggggacgtgtgattgggaaggacgactttttaggttttgagccaccgatgatgggcggcgaccaactcacaacacacggaccgttccccgccccttcccccccccccgcccaattcggcaccgctttatctcctccccttccaaagtttcatttttatttttccatttgtttacagacaactataactatgtacacatacaaataacatatttggcttctgagggtagttgaaatgcttctcacttcgctttcgtcccttttttctacgctttttctcatttcctaattagattctcacatcgcaatatctgagtgcttcggccgtcggtggtctgatgccttcgctttcgattacgtttagtgtccgcgtctccaccgccactgtccgtgcgaatcccttccgcgtgccgacgtcccttcgccgcctttgcctttttttcggcccctcagtgtccgtctcatcaaatccgaacagcgaaatgtttctgcccacaaaatgcgacgtcccttcgtcccccgccgaggccatcggccgtttcgagtcgcattttgggggctgtcaaagcgcaaaaagtgacgcttaaaagggccaattcttacgatcatttgggcacattcgtccgaactgctcaaatcgcagagggaaatcaaacagcggaagaccaatttgtcatcgtcagggaatttgaaggcggccattccctttaatcattgggtaatgaattctcgaagaacggaaaaatgcactaatgaattgggcatttacctgggagacaaaaatgttttgagtttcgtgtttggcgccactttcgttgccttccttcagaagcatttgcgaatagtcgggcgtttcaatgaaatgggggtcgatttcgcatctaaaaatgcctttccgtttattcagtcaatcctttagctcttactcacccattctcgtccaaaatctgcacattgttccgttcggaagttgcgtaacagtcgtgcaccaaaaagcgatgttcgtcccctaaaaggcggtagttttttttggcattcgatggggtcatttcgtcccaatggcacctgtctcgcattcccacttgtggaacagactttcgcccactttcgcatccaacgcaatgcaattgtcggggccgaatcggtgcaagcgataggagcaacgcgaagtgaccagagaccgctgagaggtcagttccaattctctttcggagaccggctggtggtgcacgcaggacacgtccaaaccctggggaagggggggggggggcaatcggagtgatcgccattccgttagcatgggaaaggcacctgatcagcccttgtcacaatgatcggatggaattgcaaaatgaccgtcacattgaacacgtagcccgactcagccgaattctgaacacggagcaagcgcatttaaatgggctaagaattgcaaaaaacaaaaacagacccgaatcggtgtcttctgaacaccgcactgaccaactcggaaagtcagagaattctcgcggttggcaccatttgagcgcaaaacgcactgagggtcatcgtggaagcgttgcgcgtatatctgtggggaggggagaggaaggggagttagtgggtgccaatccacagagatttggggagattagactgatttggaggggagcaattcatctcccccgtgaaaaaaacagaaaattgtttaattaattttctaactttcctataagcgtttctaattaaaaaattaatattttttcaaaataatatcccataaaaaactttactgaccattccctgcattggcttcgtggttctgaccgtcaaagtcaccgagtcgggtccgcaagtgatgtcagtggcgccgcggatgcgaggcgctgagaaatgggaattgaaaatgctttaatgggttgactcggagaatggccgagattaagcaattaaaatggggaaatgtgtcctttcgccactcactggcattcactcccaattcgaagccatcgcagccaaagccgacaaacttcaggaagctcttctcaaattcttgcaagttcttctgcgtgaagacgtgctcctttcgtccggcaatggccaacaattcgcgctcattcgaatttgtcggatggttcagcgaaacggccattgtttcgactccgatcgatcggagcatttcagcgacattttccacgggttccgaaatacgtccgtccgaaaaaagcactaccaatttggtcgcatttggtctcttcgctagtaataaactggtcatttatttcgcttttcaacggatgaattacgtaaactgttctgaattgggtcgttgaacaaacgcagcgcagatgccaatgccaaatgagccgaagttgtgcctttgatgggccgcaaggtgtttaagtagcgaatcacttccgaattgttgcccacttttgggtcgttgaacccgaaatgcttaaggttggcttatactccggggttgactcaacaactgcaaaatgccactcacaacaaatgcttgtcctgaaaaggttatcagtgccaatctgacagcctcggcatggacgtggacgttggagatgatccgattgatgatgaactgcacctgctcctggaacacctggttgatggactcgctggagtcgacgagcagtgccaaatcgagcggctgaatgggcggccaattaattattattattttaactgtgtcgaatggcatttacgctgttaccttatcggaccccttcacacacactggtcgctgttcacagaccttatctggccaaatggtggttagtcatcgccccaaaaaaggcccacctcaacgccgtgccacggggcgaacattggctcaattttatccaagtttttattcgtaatgattttcgattcgttctgaaaggtaaagttgacattgcgacacttcccaatggcactttacttttgttattttcatcagttcagccaatgccacatattctcccgtacctaaagtaattaatttttaaaacatttaaaataatttcgaattttaaaaaggcgtaaagcaaaaaaaaaaaagaaggagcttttagtagcaaaagtttcgcataaaagaatgacaacaacaatttgtcagcagaattggctcaccatacgcccaaatgtccgaatttgacactttcttccgcaatttttcggccatttcactgtccgtgggaaagtcatgagttcgaccatcggaaagtaaaaagacaattttgggcaccgccgatggtctgatgccatggctggcattttccagcgccgaaatggcaaattcaaaggcgccgccgactcgagtgatcttaaaaaagcgcaaccgtagaataaaaatgctatgattgttgttctcgaggccaatgttctcgagctcgtgaccgtgcgtaaatccccccttccacaggcaaatggattatcacggttcggtggactgtgccccatggcatgcccccccggcatttaccccagaaacatgtcgaagaacatcaagggcactgagtagctcgtccctgtgcgtgaacttgttgaagtcgaactccaaatgctgtacaccactgaaacagcaccgaactgtggtcagtttgacaggcaaaagcctttgcttgcctgaactgaatgagcatcacgcgagttgccgtgtccccaatggtcacgtggcgaacgatgcgtcggatgacgtcaatctcatcttggaattgatttctcagtgagccagaagagtcgagaataaagaccaggtcgaggggagctgctctgatcagacaacgagctgaaccgaaacaatggaaatggcacttcgaaggcaatgaatggcacttacgcttaacgtccatcggactatgaacaatctccggaggggctaatccgttgctaatcactcttatggcatcggtcagttgccaatggaccaaaacactcagtaagaaaaacgcaatctctccgacattcatttccacactgttaggtgaaggaaaagtgactttgtaaggcaattaaaggaaaatcgaagaaatttgtgcaagaaaagggaagaaatatttttggtgatcggagaaacgaaaagtgatttttccataaaaattttccaccataaaaacgggtcagtggtgctaagagtcagtccattgaaacagttaaaacgcgcatggaatttggaagtcctcattcgccatcgagaaatgacaattgttttgacccaaagaccgacctttgcccatcgaatgatccatcaa

SEQ ID NO: 5570 - DNA, 420 bp, Heterodera glycines
  misc_feature (55)..(55): n is a, c, g, or t
tactgtttgctcgaattcgagtccggggttctacataggtcgaaattgatgccanattcggattctcctacccttaaaacccctaatacaatcttttctcgaaaaaaatttcaaaaattttattttttgaaaaagggggactaccatcggtactattaccgttaattttaggttcctttttttggtcgttttcaaaagaaaattttttttcaaaattattaagagtagaatttttgaattgtttccattgatctagatgcaattttgacacatacggattacggactaaaaacccaaactccgtaaaatacggattaagatttttttttcttttccgataaagattagggggcggggtaaacttaaaaggtgctgctataaattcggtgtttccttcaattcattttttttcttttttag

SEQ ID NO: 5571 - DNA, 4350 bp, Heterodera glycines
  misc_feature (37)..(37): n is a, c, g, or t
  misc_feature (73)..(73): n is a, c, g, or t
  misc_feature (82)..(82): n is a, c, g, or t
taatttcacatctttacgttgccctcccctcacactngctcatttgtgtatttgacaccgtttcttttatctnttcgttaanaattaaaaagattgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaaaatttttttattgtcccaattttgaccattttgtgttttttcaacaaaataaatatttgttcaaatttaaagaattaatttttaaaattttagacacaaaaacaaatcatgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaatttttttaatttttccattttggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaactgcccaagagtatgattgtgttctgccggttccacggcttgggtttgtcacggaaaattttcttaataattttttttttaaatagctcaaggcgcgatgagcacctggatgcctgtgttcttatggaatcagtgggctcaggccatcggctctacattttcgagtttgaggattgcctccaggtatttttaaaatatgaggtcaattaattaaataaataaataaaacaaaaccccacaggtgaaaggacacatcgaaaacgaagacggaacaagtacacgcgtgatgattgagcactatgataaatacaatgggttatgtggatttgaatcgtttttggcgtcatgtgcttttaccttctttggattttttgttcccgtttcctatgaagatgatgattgatttaattttaaaataatttttattgtatattgtgtttcacaaattcataaacaaattcatccgaattacttggccttttcaaaaattgcataataaactcaaaatcaaatcctaaggacataaaataaataaaaactaaaacataatgaccacaaacattagagaaaatcgattgaaattttcttcgattaaaataaattttccgaaaattatttgccaaatattttttgatcagatcgtttggcatctcgccataggagtcaaaaaagtaggccacccccggcgaacgcgcccatattgcgcaccaatgggttcccggcattcccgacgggtcctgaagtggcaaaatttattttattgaaaatattttggcactcaccaaattgacaattagactgcagggaaatttcgtgcactttggcaatcggtcggccggaaaagtgccaacaaaatattttctcgtcgcccggttctcaaagagagctctgtcgatgaaccgattgtccattcctgcgacgaatccgcctctccctcaaaaacaggtaaaatcccgcagccgcagtacctgctgcaccaaacaggtagatgaggcagagaaaaaagttgattggcgacttctcgatcacatccggaaaacacagtacaatcccttcgtgtgcagcattggaggaggaggcatttgaacaaaatcggaggaataattctcaccattcatactgtaaggtcactagtgattgatctgttccggtcaatcagaatgagcccgtcagcctcggcataggctattaaagtgaccccctcgttcggaaccgcttcggcaaaccgaatgttcaccgctgtacagccctccttgatcagctcaaagcccggcgagtcctcctgcgcattggtcatttggaagacatagaggcagtaggcagtcttgaacatgctgtagctgatcccgttgctctcagttgtacaggccatgccaaggtgctcctgggtgtcatggtacgcccttgcgtacctgttgttcttgtagtccaagttgtacggaaactgtgggtatgtcctgccagaggcggtcagttcaatatcccgcacctgaacattttttctgccagaaatacatgtcaaagcggcacttacgttgtggtggttgaagtaaaaggggttcttctgattgtgcccaatgtaattttggttgggcaccagcccaatgatgaccctccgtggcacttcctcggtgaacagattggcagaaaaatcgtatcgtccaccggtgatgaacagcgacttcatcagcgtttttcggatgccgtatctggcgggctccaggtccaacttctttgcaatgtcaaggctgagaccgtccatcagatcaaccgtcttcactatcagcctgcagtcgacaatctcaagcgtgtacttgtccctatttgcggcttcctgatgtatcataaaatcgtccgactgcagggcgagctcaatgtcaatctcaacattgctgatcatgtacaagtcctggttgaatatgtcggcgctcagcttgcttatcgcttgaaagcccttgctctcctccaccgcctttttccttcgatcgtttactttggtcgggtcactgtcacggaaatagcctgccacgccaaagtatgatcctttgccgttacagggtagctgagctcagtgtccaggaacaccttgtagctgtacagctggtttgagtcgtacacctcccgctggttgatgtgcactttcaggttccggatgaacgttgcgccgggcatttggataaggccgaccgctgcgtttgccggcacatcaaccacaaccccatcatctgccacttttttgagcttgaactctgtgcacacaaacaccttgctaaggtctacatagctggtgattgggtggatctgaaccaacggatttgtctgctattgtatgtgaaaaccacctgccttaaaatgaaagggcctagagcttattgggttcagcgtcaggtactccctgtagctggagttggacacagcgcagctcgttgggggtatggtgaagaagtccagccccgcatttgccacctcagcacttgacgcatccacttttttatacaacattttgctaataataaccgagtgagtcaaatcttttcttctttaacagagctttttggggaacagtttgtccaacaacgtctgagggtttcaaaatgatttcagcttttttcccgcctcctcttctcttccttcttccgcgccccttttgtagtgatgaagaggccttgtccagcaatttttgcgctccctcttttccttccgacaccagcgcgtctttgatgttgccaccctttgacacctcgtttaggaatcgtgcacccgtctcgaggccctctttgccaatctcggcagcaatgtttgccgcatagggtcgtgccgcagtgaccattggacgaaggtagagccacaggttgcgcagcacagagccaactcctgctcccttctgtcgggggacacccaagaaataaccgtatccccgctgaaacgttggtgccccctcaaagacgctgatcggtccaccgcctccactttgcggataaattttctcgagccgtaaatttgagccgtcaaaaatcacgcgaaccatctctctcagaacgttaacacctttttaaactgaagagtcaaaacaacttggccaaactcaaatggcacctcccttaaataagtgattagaaataattgccctgctgaagagcctaacctcccggtcagagtgcgaatctcaacgtcaagcacatccacctcccttgctatgattttgtgaacccacggcgcctgggagtccttctctaccacactacccgactttccctcaacggcaatcacttggagc

SEQ ID NO: 5572 - DNA, 1271 bp, Heterodera glycines
aaattttcataatcttccatttctggaattttttcatccattttaatgtttttacatttactttttgtgcatgagcccattgttggatagcgtctttttgaaataacatttattttatatgaccgtaaccattttaaagtttgttggttacagtgtagtcgtaaaaattgtaaaattaattctaatgaacccattatttttcctttatcatcttttaatgctaatgaaactttttgtccagcgggtaatattgttaattcggttgttccactgactctacatacagaaccatttgattgtctttcacagacttcggaagttgactgaattgatattacttcggcaccactgtgcactaaatcaggcattgtcaaacataaaaatagtaatattacaatgcttacaagtctatatagtcttctgttttttcttttttgaattttttctttttctcttttttcaaattcatttaataaacttttctgtatctcatcgttaaattttttgtctaatttttggttcaagacccattttaacgccaaatatggcccataaaaacaaattttaataatccaccatatttttatgataaactttatgataaaacttgcttgcaaataataaaagaaataatacaagttaggccgattcctattaatatgagcgtttcggtcaacatgcattcaggatttgccaatttttctaggcaaaataaacatttaattaatttgcatatttctattggtgggcaaataatttcatttctataagattttcctttctttgtccagtaatttacggtacaatagtgttctgtaatcaatatttctttgcttaattcaaatagataattatttctaaaagtcggtgatcggcaatgacccatacaacaaatttcaaatttatttatttttgtgggtgtatttaattctattccttttgatccgcatttaatttcacaatctttgcattttaatttgactatgctttttgttttgttattttcctttgtgtttgttaatccaaataaatttgaactcattaataatattgtcataagtaatcctatgcctccttttaataaataatttcttgtttttgatcttgttgtcatttgatgtgtatttttcttttgaacttcacaaatttccttttcttttatattttcttcttttttattttcatcataactttttgtttctaaggaattattcacttcaagtgagtatattttgtttattggtctttctattattcttccagtcatttct

SEQ ID NO: 5573 - DNA, 4204 bp, Heterodera glycines
tttttagaaaaatgggaatcgggaagtgaaaacgaggcgttattggaacagaaaatttcggaaatgattgcgcttgattttcaaccattttcagtggtcgaggacgaaggtttcacaaggcttttgaattttcttgcccctggctacaaacaaaagtaagaagcaatttttccgcacaatattatttagctcatattaaggaaacgaaagcatttttccgactcattaattcccaacatttatcaaaaattgtttgcaaaagtcaagtcaaacctagcaaaatcagacaatttttcatttacaatcgacggttggacttcaaggaatgaagcgcagtcattgatttcactaacagttcatttcattgatgaattattcgagccaaaattttatattttggaggcaagggcccgttcatgggcggcacacggccgaaaattacgttgaaattttaaatgtaataaaagattaatattctagaattaaatcaattttttaggattctttggaactctttggcattgagcagcacaaaatccacttatttatgcgcgatgctcaaagtacaatgcaggcaaccacgcgtggtttaaatgttgtcgtgttgcccgaaaatttctgagcgcaccttgtggatcagttgaaagcgaaagattgttttctaaagccgggctcatttgtacggatttgcgaaaccggattaagggagacaatgttaggaaattgatttttttgcagtccaatttatcaattgttgaatttgattattaatttttaatattaattttttaatacataaatacatttatatttagtaattttgatttataactttaaagttaacttatgaaatattttaaaatttctgtaaaatttttcaaaaattccgagttccgacttccgaccttttttgggtcggagttccgacttccgaaaatttttggggcctcggaattccgagttccgacttccgaaaatttttggggcctcggaattcagagttccgacttccgaaaatttttggggcctcggaattccgagttccgacttccgaaaatttttagtgcctcggaactccatccctgctttccatgcattaattttatcaatattcaaattgtcgtcccattttctttcttcttcccatagactttaaaaaataatttttgcaggtaaaaggcatggggctagccatccacatggatcaaaaatagaatttaattccttcagtactaatcttctgcttaatttttcattttcatgcattttaggaaaatttataatatacgtatctcttttaatgcaccaatttatacccagtacttttgggttttcttttaataaacgatctttttcaggtatttgattattcacttcttctgaattggaaataaattctcttatattcatttgtgcattttcgaaaagtatttttaaatttttataatttctgattgcttcagctgaattattacatccaacaaaaatattgtctacaaaagtattttgtttaacttcattagctaattcggatttttcattttctaaatggtgtcttactgttgcacctaataaaaatggagatgatattacaccgaaaggcactcttttgaaccgaaatgcgcaaagattagcttttgttattggtttattaacatctttcaaccacaaatattttacagtatctctgtcattttcttgtaattctaatgtccaaaaagctctttggatatctccccaaagtgcaattttagaaagtcttgatctcattaacagtcctggtaactcaggcatataaatagggcctctaaataataaatcattgaggcattttttgccccgtatttttgacgaagcatcatagactactcttggcttctttccggctaccaatacacaatggtgcggcaaaaaatgttcatcatatcctttaatttcgctttcttcaacaattccttcttttaattgttctttaaaaatttcattgtactgtttaaggtgctcttcggatttctttaatttttcaataatgcttatcatcctacgataagctaatgtaaaatttgtaggtaattcctcttttgggcctttccatggccaacttactacgtatcgcccgtcttttctgtaaattgtgtctttaaacatttttaatgctacttcatcatctttttccattgggttatcttttataccaattgtttctaaatcccaaattttttcggattcattttcagtgcattctaatcccattgaagtgagagcacataatttgtcatttccattaatttcaccacatattattgggccaaaaactgtatgtactttaaataaaccttctttaaatggttcaacttttttaaagaatctccaaaattctcgcattccaattaaaatgtctggcttttcttcaattatttctatttttccgagaaattatatttgctcttttaatcttttttgttattagatcgattcgattgacaattatttcttccaaacctccatctgttgtttcgagttttattaaatattttggagaattcaaatgtgttggtttactttttcgaactgacaataattctaattctccttcgcttatctttggtggtttcaatttcataactatttattcttttagacatcagtaaaacttctttttcttccaatgtattttttattgcagtagctgctaaatttgaccttggattttgcttctgattagttctattaaagggcaatcggatttctgttcggtttgcacctgttccttgaaattctctcatgcatattaatttattgtggtctccattgcagttaaaacacatttttcctgtgcaatttattttttcatgtccttttttgagacatcgatgacatctgctttgttcgtttattattttcaatcggttttcttgaccaattatttgtctacattttgatggccaatgctctccgccacataaaaaacattttggattaattataggtggacgtgagttttgtttattatttgaatcttgcgtaaaaaagactctttgtgggtttctttcatcgtttcggttatttctcggctggttattttgccatttattattttgattaccaaactgtataaattgcttttgattattattccaattttctctttgtgttcctgctgttttattcatccttgtgcataaataaattataattccaaaaaaatattaattttaaaattatattatatcattatacttagaaattaatgactggagtacaatatcattaaatcatattttgttataaaatattaaaaaaatgcttcgaatacatatttaaatacctaagataatttataataattcacaaactaaataatcaaaatgtgaataagcacaaataaaaatctttttatacattataaaaaatacaaataaaattttaaaaatttttggaggatttatttggtcgccatgctggcggcaccgctgggggcttgaaccttatgcggacttcttacaggagctgttggcgcaggagtggtgattgccacgggaaaagaaaaatacatataaaaaatttcaactgaatatggaggactttttatatatagtaaaaaaatgaaaactaattaaaatataagaattaaaataaaggaaaataaatctatataaaatactttaatttaagaaaattaaagccttttcaacaatgttaaggcaaaaataaacaaattaaattttaaaattatggtggaatttagatgcaaaatccgtaaaaataaattattacaaatacatattaaaacgagaacttccgaaatcgagagtagtagatttcatggcgtcaactatagatgccaagattaaaaagaaaaaatagaaaacgtttattagaaatgtagagaaaaatatacattcaaaaaatataacaaagtagcgaggactttttttgttactcgtctaaatcatttttattttgagaaaaattaattttactcgcaagcactgccggtgcatttttgcgattactattagattatcgtatagtaaaaatgcaatgtaaataaagtaagaccaaagcaatagtaaactttatgagattaatttaaaagaataattaattaccagcacgcttaataacacaataattcgaatattttttataaaatttttataagccgcgtttttcattttgtagatgattaataattttatat

SEQ ID NO: 5574 - DNA, 1622 bp, Heterodera glycines
aatagcagcttcattgccctgcggtaatttcaataattcattctgtagtgcttcttttatgactttttcattaccgtaaagtcgctttagtgcatttattactaaattataatttctgctgttggttgataccctctcattgctcgggctgctttgccttttaggcttaacaataaataagtacatttttgtgcttcgggaatcggtttatcgcccatattggcatgaaatgcttgccaaaaaactggccaagacattgtgtctccataaaaatttggccatgggagtttcggataatatactggaggagcctcaactctttctctatttacaattctttgttcattcctttcattttcattttgatttattcattgttggttgccttgcgcacctaattcaaatgataatgtgtccgaaccatcatctgcttcatttactaaaattatttctatttcatcaattgcttctcttgcatcttctaaccattcagttacatggcgctgatttgcgttcatatttacaaaaagtgcttcttctgctgctcgttcatcaacttcaatttctgtcatatatgtgcgccattgttcaattctttcatcaatgaacgtcactgatctttttatttttaccaacgaatttcttaataaatcaatcccctcagggtctctttgttgcgcatcaattactggtctaatttctaccagtctttcagttaattttcttaaagacggatttatccgcattctaataggacctgacatgtttggtcgtggcaccactttattgactctcttttcagatagtcaataagaattaatttaaatatttattttatttaaattaaattaattttattggatttcccaatacttcaattatatttcacactttattagtgaattttgatcgaacaaatatatttattaatgaacgatttgaacgataaaaaaatggtgattttacaatggtttaaatacggcaattttacataggcgggctgacagaaatttaaatgtaaacaatgctgactaataaaaaggcttaaaatcacaaaggttatgaatttggcgtaaaattattttaaacagatgaatcataaaattttaaattttcgtcgctaaggatgaaattagcgacaattttatttataaactttaatttgtaagttagtcaatttgatttcctttgactttgtttttatttcaaaaacttcattattagtatctatgcatgatattgaatcattgtttatcaatcaatggtactatttaacaaattagacttacggatgaagaaattctttcggtccgcgctttaatatcatcgcattcaggcattaaatataaataataaaatgaatttcaaactaagttatataatatttttcttaagccttcttggctcgtcaataattttaaaataatttggacaattctctaatttttagcagtttttggtgtgtccgatgctggtcgtcgaaccctacagtacttgtctgaacattatgcaaatctgttgatgcattatttgtgcaccgactgcagcaacatggtcggcacttagtcatgccgaattggtccatctgtggccaaatcgtgtttttctatgcggaactgctt

SEQ ID NO: 5575 - DNA, 5023 bp, Heterodera glycines
  misc_feature (3730)..(3730): n is a, c, g, or t
aaagaaagatgcactctctgcggatgattaccctcgtggtaattcgatgttccaaaaaatgacttttggtcgaaaccattgctcgtttttcattctctctggcaatttttcgatttccgtcggatggatgggaatgaacttttcaaagcggtgcgaaagccttcgatttgaggaaagcaattttgagaaatctgtgcgaattgtttattcaaagcaaagtttaaatattattcaccgaggaactcattttgacgaaacgaaatgaaacggaatttgcaaattggtgccaactctcaaaagaatcttcaagctgaaacaaaagttcaaaataaataataagcgaatgaattatcaattgaccatcccattttcgtccccgtaacaactgaggaaggaaaacaatgtgatcaaagggggcgaatgttgccacaatgtttcggtgtcaatcgtcacgtcgtacagagcggtgagaagtgcggtaattgccaaagtgacagtctgtccaattaaagacaatggccaaattatgtgtttttggcccattaaatcgtttgcagtttcggtttaccaaagaaagcaacgcgtcgcttctcagttgtaagtggaaaaatgtttggcaatcgctcgccttgcgcagactttggacgagcgcgaggaattggccggaggagagggagcacgtcaaattgtgaagagcgtccagcgtcgagtggacggcggcacgggcactctgttcgcattctgccaaattctgcgagcggtcgttggccgtcgcaattcgttcgacggcgaccattttggagctgagcgactcgaactgcgcgttgagattgtccatttgattgcgcaacgaatccttcgggacggagtcggctcctttgtgctgtaattgggcgagtccaccctcacagagagaatcgaccaaattgaaaatgttggggaaggcattgacgaaatcgattatttgttcatgcatcttaaaatatgagaatgcaagtgattctctattgttggaatgccattattacctgctgtatttcctgaaatattccattgccaatttcgtccgtttttccgtcccccgaaatgcgccatttaatgtcaatgtttctgcttaattcaccaatttttcgtttcatcgccaacaaaatttgtcgtcgcgagtaaaataaattttcatttgaatggtccaaagcgattgatcccaaagcggcggaaaatttactgctttaatggataaaagtaattttttttaaatgagagtaaattgaaccgaccgaattctgaaaagtccgccggatgaaaagcgcaaaggcaaagcggcaattgcgccgatggtgagaaaagcagtggcgggtcggtcgtcgataaggaaagtctgcacgtggagattggtgggcacgaacagaaaggagacacggtatttttcacaggatggccaaaaaaggaaacttttgactttatagaaatttttgcgaaaattctgagggaaattctgtcgaaattggaccgacaaccgctaaaatttaaaatgggacaacgaaaacacctgaaggaaggacccgcgtaagagccgagaaattcgttcgcttgagtgcaaatcttaaaaagagcacaccgtacggaaaagcagacgaaggccagacgaccaacttcaatgttcgagttgaggtgacgaattgcgttgtgcaaagtctccaaaatggcggcattctttacgccccaaagtttgtccaataattcgtcgcgtaattccgtcgcccatttatgcgaaagtcgaaggatttctcgcggcacgaccatggacaatttgctctcgtacatcacttcttggcatttgatttgacgagagggaaaattgtgagactgaatcaaaaaggggaattcaaagatatttaaaaaaaagccacctgagacaaagaaaagaattgttcacgactgaaaggggcggtgagaaagtaggcgaaattgttgaccatttgttggcttagagacgaagcgggcaaaggctgagtgaagcgattgtaaaggacctattcaagggacaatcgacagaaattggcgtaataaagggcgaatgtgttcattaaacctggtcgtattcggcttggactatacgatgagagcaagtcataagctgaatttacaaaattcttcaacaaaaattaaccaatgataaaaaggaccttaactacccactggtcacattgtttctccgactgaaattccaagtgcaattctttgttgctttgccgaatggccaaagaatttttgttttgttccgaacgttggacgtttattttttcacatacaatcagaaaaggttcagaagcaaaatccaatggcttaaaaccgagcagattccctcgcaatttgacctggaattaatttctttaaaataaataagtaattgaaattaggcaattaattttaatcacttggcaaagtttggaatgcaaatgttcgcttgtaactttcactttttcactgctgcaatccaattttgtcgaatctttgtagagccattttattatgtctccggcattatcttcttccatgctaacatagattttttacaaaataaaaaaccttaaaaattaatttaggtatttaaattttcaatgaaaatagggatttttttctcttccatattaatttttttttttaatttagcatttttttagttgcccgagcatttttgcctgcatgtccttgcgcaatgttcgaatatatcggaaaattctcggaaatggcacatccagcactttggtggattcttccgccaatgagggctttttgctgctgcaatgtggtggcatgttaaccatcggcaaagatgtgggcaactcgcttaaacagcaatacaccaaagtctcagacggatacgcacttttgggcatccacaaaatatccaaaggcatttttaactgctaacagttgcccaattagacaaacacataaaagaacgctgtttagatgaacattttctggttgtggtgaagtccgttttgtcggttggccaactcttcaattgcgatttggtttggcaataattagccctccgttcgacgcttaattaactttaaatagcacaaaataaccaatgtccaatttgtctcgctgaatgttttgtcgaacaccgagcaaattgacgcaagaattgtggaggcatggaatacaaaagcaacattgtttgaactcatttcgactattttcagatgcaaaaatttctttcggcagggattttttactttgctggctcaaacaaagggagtaattacgacctgacgcattcacttcaacgcaggcaaacaattggcgaatttggacagtccgatttccgcttttattggtgttttttaaagttaattttgtataaattcataacttataggaatcggactttgtcttttccttttgaacgctttggagtgtccatcgacgattggctggtcaaatgcatttgtgggtcggtgcttgtgcggacgatttacgtgggtcatcggaccgcaaaagttgctttgatctcccgacttagctgcgactacgtcggcacccgtttcaacgttcgtggaataaatgtgagtttaacatttattacagacttcagttttataattgctttctttattatttttaggatgacggaaatgtggcaaattttgtgaaacggaacaggtctttgcgaactgaagagaatcgcatttaaaataaaaaatgttagcttttnaacgttcgaagaaaaagattgttcatatgtccaagttcggggctcagtgccacttttttgggaacagcccggcatcaatgttggctctcacacaattaaattgaaaccgttggaattttcaatgtttgcaatggaaaggcatggcataaataattcaacgaaccaaaaacaatccaattgttttaggcattattcatttttgaaacaattttacggtgatttattaagtgttaatttgctcggttcaaaaaagggcgaacggagtctgtcaacggcatttcaggcactattatttttttttaattcataaaatgaaatttcttttttcagacagcaataaatttgtcaaaattacattcggatgttcgattcgtttcatttgattaccacgcggaggtgaaacagtccaaagaaaatgcgaagcgattgatcagcgaaattgactcatttattgaccattgcagtttcttcttttctcatgggtaagttaatttcaccataactgcactttggttcacttttcctttgttttcagctcctttcagaagggtgtcatccgtacgaattgtttggactgtctcgaccggactaactgcgtccaaactgttcttttttgttgatttaattggtttatcatttgttttatgaccaattaagttgattgggatgagggcactgctcgcacagctgaacattttgggcgttgagcaattcaaggcgaacattgtcctccgatttgaggaggtcgtcagagatttgtggcaaaaaaatggggacaattgcagcgttatttatgccgggacgggcgcattggagggaaagtcgaaggttgttttgttgttatttggtctaaatgaattaattaaatcatttgctatttcattgaaacagttgaaagatgccagccgttccttcgtccgaaccattcaaaacaatttaatggacacttccaaacaggagtccatcgaccttctgttgttgggctgcctttttggcgacgacaaattcgacaaattgtccaaccttttgcccccttatctgatgaaatgtcagtccattccgttgttcatttgttgattaatttctctcttttcagcttcttcttactttttcggtcagtgtttaaataagataatactattactgtaattgaatcattataaatttcatgctctaaattatggttaagaatgtccgagcatcgaaagttttgttgagcaggagaaggaaatgtgcacgagtaaatcgctgcgagtgtttgttggcacttggaatgtcaatggaggcaaaaac

SEQ ID NO: 5576 - DNA, 1152 bp, Heterodera glycines
  misc_feature (1079)..(1079): n is a, c, g, or t
atccgaccaaacggacaaattattgtagatatattagccgcaagaaataaaaaaattaaaaagttaagaaatttgtccgaatgcgggttcggattcgaaacatggatgttttgcacaaatccaaccattttcagtcctaaacagctactcacgcgaaaacgtccccacgcgaaaacggccacgcgaaaacgaccccgaccgaattttttttttcttaatcgaattaattcaagtattcgcttcaacaaaaactataaaccaaaacagttattcaaaattttcattttttattttcaaatccaaaaataagcacaaaataagcatgtaatgctgaaataagcacaaatcttagaaataagcagacttggccactctggaataataccaagttacaaggtcaggaccagtcagttgatggacaactcagctttgcgacaattaacaaaaaaatataaaaattgaaaaataattaaataaataaaataacaaaataaaaataaagaaagtttttttgagaaaattttcgtttctttaggggaccaaagaactaaatgaagcgaaattataaattaatgttttcacaaaaagcttctaatttactaaaataacaatatttgataaaacaaaataaaatattctgtaattctttatattttataaataaatttggatatttttcaaaaaagaaacattttaattaatttataattccttttgttcatgccaaaactgcaagaatttaattaattattttaaaattctttgacttttgttaattagtagatcataaaaaacatatgtaagcaactaaactctataaatagttcaacactccctctcatatttattctccagtaaaatgggcacgttcattaaaaactgcaaatattcaaatttaataagggatttagtcacataatagaaaaataaaatataacaaaaaataaaatatattttatttaattttaattttaaaaataaacaaaagcgcataaaaacttagaaaatttgtgcaaagtcatcgctaatcatttcgatattctccaaaatgctaatataagaataattcccattaccantttaagatcgcagccatttatttttgttgcaactaaaaaattcacataaaagttgccatttttgatcaaacct

SEQ ID NO: 5577 - DNA, 2689 bp, Heterodera glycines
  misc_feature (17)..(17): n is a, c, g, or t
  misc_feature (2636)..(2636): n is a, c, g, or t
  misc_feature (2658)..(2658): n is a, c, g, or t
  misc_feature (2672)..(2672): n is a, c, g, or t
ttaagttttaatttatnttcaattagggctccaatccttttggacgacaccacggtcaattggccctcagattattcgtccatttttgagggggcccatccgaaatttttgcgcttcggccgtgccagtccgagtttgtacgacatttttgggttggaggcgcaccttcggccgccgcgtggtgacgaaaaagacaaattcggtgaccaataaataaattgaaaataaagtgaataaaaaaataataattataatttagttggcaattacgaacgatgaaaaggaagcgacgaaaatgaagaaaagaaaggaagaagataaaatgaagagaaaatttaaatttttattcattaattaattaaataaaaaattattcattcgttttattactataattttaattacttaattttaatttgtgcaactgaacaattgataagaatccaaacataaaaatggttatattttcattcaaagaatgggacaaaaccaatggaatttaatacaattaaaaggtaacaccaaaagtcaaaaataacccattaattttagtcaattaattgaataattaaaccgaaaaaatgctaaatccattaattttgacaattattattatcttaacaacaaatgcaaaagaaattgtgtcacaattatgcacaaagctaacgtcggcgagtgcggacgaaatcgaagcgttgccgggcctcggaacggcgcccaactttaagcattattctggtgatacgaagagcaataatggccgagaaaagccctaaagtcctattgtgtggccaaaaatccaattctgagttcaaaatgacgagagctttttcatttcaaatgatcagagtccaaagcccaagagccaattcccgagaatttgatcccgaaaaccctgtcttttattctcgcgattccaacacttaatcaccccacaaaggctacctgaaatcggcggacaaacactttctgcactattggttcgtcacctcgcagaatgacccgtgtcgggaccctctggtcggtcggattaggtcaaaatcggctttagcccaaaactgctcacaggtcttttggttcaacgggggccccggctgctcctcgttgggcggcctcctggaggagttgggcccttacctggtcaactcggacggacggacgctgcgcttaaacccgcactcgtggaacaaaaacgcatcggtgggccaaattcagcttggaaattttcaagagtttggccaaggtggtgttcatcgagtcgccggtcggagtcggcttctcctactcggctgacgaagaacgcgtaatgtcgggcgatgagtcggtcagtcgaaggaattcacggaaaaatattaattagcaatttatgaggcacttgcctaattgcctaattatcaaaaacatttgcttttgagaccgcccaaggcaattacgaggcggtgaagcagttcttcctcaaattcccgctgttccgtaccaatcgcgtgtttataacgggcgaatcctacgccggaatttacgtgcccacgctggttgccaaaattgtggacggacaagccgacttccccatcaatttggaggtgattggaaattgaaaaaaaaacaattacttcggcaattaaagggaatggcaattggaaatggctttatgaacgaagcaattgacactgatactttggcacgattcgcttattttcatggatttgttggagagactgaatggaatgcaattgaaaagcactgctgcggaggatgcgcaggcatttcgaaatattttttattgtcaatgatcgtttgcgattaagacaattgtaatttgggcgaacaattcggagaatgtcgcgcaatggttcagtaattatggcaaaatatgcatcgctttttccttcgcaggtgcgcgacataatattgttctgctggacgggagggattaacgtttacgacatttaccgcgactgctgtgaatttgctaattaattttttaaaattttaaacccattaatttccattagttccgcagcacagtaaaatggccgcaattcgacggggaattctccgtgcaaaagcatttcattcaaacgacacgaatctttgggaggtaatttcctaactaattgtaggtttaattcgcttattaaaacagccattggaggagattaatttccgcggaggtgccccgtgtttggacggtaaaaattaacggcgattattactaattagagataattagaccacgcgataaccaactacctgaacactccacgaggtaagttcactttaactgctactgtcggaaaaggtaacaaattttagtgcgtgaaacgcttcacattccgccgaatgtcccaaattgggaaagttgcaagtaaaaaatgagtggacataaaccaaagtttcagcaatcatttttatttagcgattgggttggcatactgtacacgacagaatactgtaattatattgattagtgatcagagtttaaatgctcttttaattttagccgacatgtcgccttttgtgaggaaggcgatcaatgccaatttgcgggtgctgctttactccggagacactgacatggcctgcaactttctgtcgggccaacacttttcagcgcaactggggccttgcggttgccnaatggttttttttggcattttnaaatcattttttanatttaacagacaatcgc

SEQ ID NO: 5578 - DNA, 1879 bp, Heterodera glycines
  misc_feature (45)..(45): n is a, c, g, or t
  misc_feature (81)..(81): n is a, c, g, or t
  misc_feature (96)..(97): n is a, c, g, or t
  misc_feature (129)..(129): n is a, c, g, or t
agtcgccggtcggagtcggcttctcctactcggctgacgaagacngcgtaatgtcgggcgatgagtcggtcagtcgaaggnaattcacggaaaatnnattaattagcaatttatgaggcactgcctaanttgcctaattatcaaaaacatttgcttttgagaccgcccaaggcaattacgaggcggtgaagcagttcttcctcaaattcccgctgttccgtaccaatcgcgtgtttataacgggcgaatcctacgccggaatttacgtgcccacgctggttgccaaaattgtggacggacaagccgacttccccatcaatttggaggtgattggaaattgaaaaaaaacaattactttggcaattaaagggaatggcaattggcaacggacacatgcatacgtcgatgaattttgatacgatggcacgttttgcctattctcatggcttattggcggagtcatcgtggaaagagttggagaacgaatgctgcaggggatgcgtaggtggaaaaagtgtttcttacaaatggatcaccaaaaaagggagacttcagatacttgcgatttgggtgtactgtacggagaatgccacagaaaggtacggtaaccaccttttgaaatggcaaccaaatgcattaaaggttttgaatatcatgcgttttgtttggcgtggcggactgaacgtttacgacatttatcgcgattgtggtcagtcctcgaatttacccacttcccctcaaaatgaccaagggtcctaatttctggcctttcagaccatcaaccgaactcaaaacgaatgaaagcgattcgaaatggcattttcaaaagtgccaataaaaccgaccggtggaatattattggagaagagctggacgcaaaagcaggcaaagttggcagtctttcaaaatcagataacttaaaggaaaatgaaattgcgcgcgagtcattacgggagattaagccgtgcgcaaacggtgggcaaatggaaaataaataattaaaaaatatgtaaaaaggaaataaaattacaaattaaattattaagacgaagaaagtgcacaatatttgaacactccaaaaggtaaatggggaaaagaagagaaaagttaaacgcataattaagtgcgagaggcattgcatataccagcgaacgtgccgaagtgggaggaatgcaggtgaacttggggggaggtcggcacgaaataaatcaaatgccaaagcacccaaacccggtacattttatttaaacaaaaaatgaattgccctttcttaatgagtcttaattgcctttgtctgtttctggcgcactgtttgctttagaaattactaattcatctctttttaattgtccttttctccagtgaatcggttttctcttcgttcgtccgaaaatacggtttttttttaaaatttatttggcttaattttatttaattgctttcccatcagatgacctttcgccgcttgttttgaaggccattgaggccaaggtgcgcgttttgctttactttggggacacggacatcgtctgcaactttttgcatggacagcgtttcagtgctcagcttggcctttcggtcggtgtctttttgctctttgtgccattttcagtttttcagaccctcgacgagaagaaaccgtggcattttgggggacaaattgctggttttaagacggagtacgcgcgaaggctcactttcctaacgcgtaactttcaaacaaataattttgccatctttcgtcacttttttattcagttcgcggtgttgggcatatggcaagcattctaatattttttttatttcatttttattttacagcatatttttcacttttcttttaaattttcggtcccccatggcgccctgccgaaagtga

SEQ ID NO: 5579 - DNA, 3321 bp, Heterodera glycines
  misc_feature (28)..(28): n is a, c, g, or t
  misc_feature (78)..(78): n is a, c, g, or t
  misc_feature (108)..(108): n is a, c, g, or t
aaaaataaaattatttatcgaattttgnggaatcggaattccgtgctaaataatgtccatatataaataatcaaaatntcaaaggaaattaaaatgttccaaagtgtntaataataaaaaatttgaaataatgataattttattaatgatattgtcataattgaaaaaagtattattaatttagatgtttaaattaaaatttctaatgcaaaaaaggacgaaaaacattttttaaatttttaaaaacttttttttaaatatttttaaaaattttatgtaattcaatttaaaataaagaagaagaaaaatagaagaaaacaaaccctttttaagtgaaattctatttttcattaaaaaccagaaaaaaaattttcaagtaatttcattaaaagagcttttttttattattaaaaaaaaatatttctcaaaattataaagggtagagaaagtgatgaaggttagttgaataattaaatgttcaaaaataaaaatgaaaatttttaatcatttcacaatagaggtaaaaaatcaaatttttaattatacaaataaaaaactctaatgacaaaaaatattcacttttccaatttttattttgcgattttgcacccttttaaaaaattaaaaagtgaattttaaaatgaaagaataattaaatattttcatttaaattatctaatatattaattttgcaatgtgtgtgtgtgtgtcacaaatattttgaattatttattgacacgaaatcttttttaaaaaataaaaaaattattgacaaaactatttcttaagactttcatcatcatcatcacagaatgttgaaatattaaagaaaagaatgttttgcattattttacctgtttatattcatataaatctttcggactcgctaatttttcatttttttagcattgattaattattgtttcatcaatcgttacaaaatgttgaaataataaaataaaataaaataatgtttttgtattgttttatgtacctgtttatttcatactaatctatcacacccgctaatttttcactttttagcattgattaattattttttcattaaccgttactttttgtacctgtttattcatattaatctatcacacccgctaatttttcactttttagcattgattaattattttttcatcaatcgttacaaaatgttgaaataattaaataaaataaaataatgtttttgtattgttttatgtacctgtttatttcatactaatctatcacacccgctaatttttcactttttagcattgattaattattttttcatcaatcgttacaaaatgttgaaataagtaaataaaataatgtttttgtattatacctgtttttttcatattagtctttcgcactcgctaatttttgttctttttagcattgtttaattattttatattttttaatttttaataaactacgttttatatttttaagattatcaattcttatattattcctgcaaaaattatggtacgcaaaaaacaaattttttcgaaagaacgggttgaaagctcccgcgaaaaaagcagatatgacgggttccaagctcccgaaaaaagcggtaataacgggttccaagctcccgataaaagcggaacagacatacaaacacaaacgatgaaaatttttgaaaagaaagactatgatattggaatagaagaaacaatagaaatcataaatatagacgacgatgaactatcagactattcagatatacaatcttctagccaaataaataatacaactcttagaaaaatgaaacagcgaaaaaaaatgaatattgatcaaaaagaaagcgaaaagcaaaaaaatcgcgaaagaatggctttaaatcgtaaattttttctagaagaaagtcaggctgaaaagcaaaaaaaccgtgaaagaatggctttaaaacgaaaaatttttttagaagaaagtcaggcggaaaagcaaaaaaatcgtgaaagaatggcttcaaaacgtaaaaaaggattaaatgaaaaaattgaatcttatatttgtgcagatagtttaagtgttagaaaacacaaacttggaccaatgaacaacgaatgtgtgcattgtcattctttaaatttttcagaagaaatagtcgcaggcaaaaaatcagaatttaaaaattgctgccattatggaaaagtattgatttcagattttcctgaaaaaaattttcctgttggattaaaaaatttatttattcgaaatgatgtaaaatgtcgtatgttttttgaaaatattagatatttaaatagcactttgtcaatggcttcaattaatcctttaagatataaatttaaacataatcgaggaccatattgtttccgaatttctggccaaatttttcataaaatgaatatagcacttcttccggatgaaaaagaggaaccaactaatggacaattatttattgtcgatacgggggacgcagtaaatttgatgaaacaatcaaactcaaaaatagataatgacttattgaattatttatataatttaattaaatcagaaaatccttttgctaaagcttttgtaatgatgaaagaagaagaagacgctgaaaaggaaagagctaaacaagaaggaagagaaccaattgaaatgaaattattgtttggtctagccccgaatatggacaaaaatcgatataaattgcctagggcaaacgaagttgctgttgtttttgtacctggagcagatggagaaatacctgagtcaaaaattgttgtaagagaaagaggaaaagaattaaagattttagatagtcttgacaaaaatgtaacacctttatgttatcctttgttttttccaaggggaacacctggctggcacccagaaatgaaacaaacaaatggctataaaagtctaacaagactacaatatgctggatgctgtatggctgtaagatgtgagtttaatccgatgttatttggagggagattatttcagcaatggggtgctgatgaatatgtctgaattgataatgatagattaaaatggattccaaataatctttgaaagattttggcagattcttatacaaatgtaaatagttttttacttaatatgtctcgagaaacaggtcttccagatggaagagaaattattttacattctacaattgtaaggtcacctagatatattgatacacatttccagtatgctctgaccattgttcctatatatgtaaaaccagacttatttgttacaatgacatgttgccgcatatgtgaagaacttcactaaatttatatatagaacgagatgctatcgaccgaccagatattattgaccgtg

SEQ ID NO: 5580 - DNA, 1702 bp, Heterodera glycines
  misc_feature (797)..(797): n is a, c, g, or t
gaaaacaaaatatttattaaagaaatgtcacacatttcattttaaactacaaatgaataactgataaaaaattaaatggaaatataaaaaaagccttaaataataaatataattaaattacattaaccataatttatgtaattttcatttattatttatttatttaacattttgtggaaaaattatggaaaaatgccgaaataaccaaaaatggattaaaaaaaataaactatattttgagatataaaaaaccatgtttcttttagagaaatttttatgaaatttcttgttaaatttagatttcttagtttttaataatttttttgtccattttctcttttcatctcaagttgcgttctttgttggatatatatcttgctgaagtacttttattattttaattatatatttgttatctccttttttcttttatcattttttagatttttatttcatctcatgctcaggttaatcacctttaaaaaaactaaaaattataagaacgaaaaacaaacatcttattcgtgctcagaactaaattaacacaataaaaaaatctttaaagcccatttaatccaatatccattctgtaaaattgttaatttcggtaattatgaattgtaaagtttttgaaaaattagtcgtccaaaccagaataagtccggaaattttaaagacaatttttttaaaatattataaaattctacgcatttttctacattctgtaaattccggaacgcgtcagaattattctggtgtgcttcagaataattctgataaattccggaacgcgcaanaaataattctggtacacacaaaatactctggatacctaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcgccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcgccaaatacttctgatactaatggtacgcaccaaatacttctgatactaatggtacgcaccaaatacttctgatactaatggtacgcaccaaatacttctgatactaatggtacgcgccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcaccaaatacttctgatactaatggtacgcgccaaatacttctgata

SEQ ID NO: 5581 - DNA, 3316 bp, Heterodera glycines
  misc_feature (963)..(963): n is a, c, g, or t
cggctgtcgttaatccgttccacccccgttctatcccgtctaattgagctttttttgagaacgcacagctgcatttgagcagctccgtgttctcgctctagacgagcacaaatcaattaattaattaataattagtacactaattgatcacctgcagttttaatgaccgtgcaaaaaatcgaatgtttccgtttaccgacggcaacaatttttattttaatgattagcattgacctttccttgaaaaacattgattcctccttgaaaagattctcctccgtaattgatcagaaaaaaaaactcattgatcacctgatgaaaaagccctcggctaaaaatgatcagattagcccattctaggtcccgatcaattcgaagaaatatattattattttaattaccaataataacaaaaatattacttttataaatatttataaaaagataaatactaaaattttgtctttttttgagaattttctaaattattaatggctttctctaaacaatttgctgtttttatatttttactgcttcaacattcaattcgatctcaacaacaacagcaacaacaacaaaatgtgatcgagcaagtgaatttaaaaatttaattttaaaatgaatttttcggtataaaaaaataaatttcaaaaaaaatttgggtttttttgaaatttgaaaattttgtcagcaatctccgtctgcaacagctgctgagcaaactttgccattgtcagagttgcacaacacgttgaaccagttcctgtaccaactgaagcagaccggcgaaaaagttgtggcacaaacgccgcaaattgcgtcgccgttgttgttcaacgccgccgccgcagccgccgccatgggacaacagcagcaacggcacagtgccggtgatggtggtgccgcaacggctggcggcgggtgggataaaagcgcgacaattagggaggggggaggaagttnggagggtttttaggctagagtcggtaggctgggtgaataaaaattttgagaaatttcgaatttccgaattaaaaatctgcttttggtattagtaaatacctaaaatttgtgcagattattggggtttccagtgagaatcggtagaaattttttaatttttttttttatttttaaacatatttttaaaatttatcaaaaatatatacataaaatgtgccgtatttttccaatacctaaaaactccttttttgtcgaatgaatctattgtacgtaattgaggatgttatctcttccgtgccccggggctgcccaccctttatttcccaaggtttggttttttcagcggcactcccccctctgctgtgcgtccgttcgtcccgcttggtcatgttccgcttttccccagctctttgctggtgccaaccgcggcccatttgccgccaacttttcgactgcccgctaccgtaatggaacaggtgggttacagtacagtgtagtcaaatcgtaacccaataaaaatgaatttattactattgaacagcataaagctttcccaatggaaggctctccatcaaatccgccggtggtcattctgtctccgatgaacaacaatcaactgcagcactcaaaacggcacaaaattggcagcgccgaaacaactgctggtgacagtaccacaaatggcacaacgacagacattgtatcaactacggtagcacacagtttcacacacatattactgtcattatccaatccgtactcttaatatttatgcttcattttttaaacagattgttgccgcaccacctttgagctttagccaaacccctgagcagcagaatacagtatccgatgatcctcccactacggtatccgagttggagaatacggtacatgacgatgggcacgcaaccgttgcagcaacagatgtaaatgccaacaccagacaacaacagcagcaggttgtcgctgctgctgtcgttccaccgttggcggtgccaattgaaattgaaacaacgaatgacacatcgccaaatgtgacgggtaaatttttttttagggaagcaattactgtattagccggcggtactgttaccgcgtttggtttcgctaagaatggcacggccaatttttagtgcctgtgccatttgcatcgccagcgcagactccgccactcagcgtggaaacaactactgtaacggagccgacggtggttgacgattacagtagtcaaaggcagcgcattttttttgtgcccggaggcgtaaaaagcattgaatccaacggaagccgacagggtacggtatggggagaatgggatgattacagtaattgtttttgctaaaacatcataaaaaatttgaattttttaaaaattttcagcacttactgctgttgatcttgaggcttttctgagatcagctaacgtcgcgcgcatactttcgacttgggtcagtgatcaatcgttgactgatccattaactgttcagaaattcggtcatcaatttttggctgatcgatcggatttagcaattttttctaatgggttttgatcagaaattgaatattctcacagggggtttttcctgtcgcaattttgattggaatttaaatatttcagttgggcataatcagcagataataaccaagatttatacttttttttgtcgagaaattttcatagaatcttgggctccatcattgatccataacaaaataatgatcggtgtaatttcgtgtgattttctgagtcaactttttctatttttccccaataagttttttttttaaatcagaataacgggagcagtaccagcagcggcagcaccaacgccaacaacaatagcaacaccacaatgacatcctcacaagacaccaagctgttcttggcattggtcgagagagtgttggagcaggaagttgcacgacgactagcggaacaacaaccgaacaacaacaacaacaacggggacagcaacaacagcgagtacggggacaactccacacaacgcatgtcaccgccgcaacacaaccacgcggcggcggtgaacaccgctgttgtaagaaaaagggggaacgcggaattttgagggattttaatattgccgaccatttctggatgatattagagcaagattttaaatttgccatctgggattttggctccattaaaatccgctacggtattttaggctgcggcgggcccttagatcaggaaatatctggtccataattaggccacgtaattattgggaggaaatgcttggctccacgacagtctcaactaacctttcgaattgctcatccccagaaatgtttgtccccgttttctctaccgtaaccccttttagca

SEQ ID NO: 5582 - DNA, 3202 bp, Heterodera glycines
aaatggtggtgcagctggcgtagctggcgcaccagtgaaagcggctatcaacaagcagcgccgagttgtgcacgaaacggactacaaacaacgagaacaggcaaaactaaattttttttttcgcgatcgcttgacaaacaaagaatcattggcacacagtagtagagaagtgcctgccgagaaaggtttttagatacgagaaccaagaccgagaagtgattccgagaatgagactaaaaattcgagatcaaaacttagtcccgagaatttcttgagtcaagatttcatagactctcgcacaagaaagctccgggattaacggcatttaaagcggacattcatgagttttaaggaaaactaggcgcttaaaacgcggaaagcggcaggcagggttgataagatttttgcctttttgaaggtccggatcggtttttttatatatagattcgatcgatctcgatcaatttttgaattggatcaatcattttcgaactgttcgaatttaccaggcagaatttgaccgtctgctggaccgtctcaaggcggaggaaagcattgcggacggggctgagcttggcgcgaaaagcggtggcgcaaaagtggcaccgcccgatgacaccgatttgcttttgattgtgccgcctcgtccaccgtccgatgcggcggctgtcaccaataaatggcagcaacaacaacaacaacaacaacagcatggtgctgctctgctatcagtagtgataaggaaattagagtttttgtttgacattttaaaaacaaatctggcctggataagtctggatcgtgactggacaatccgacagtggacaatccgacagttggacaatccgacagtgaggacaatccgacagaagtggacaatccgacagtggacaatccgacagtaaatttctattttaaaaaatattttcaagtcattatatgcattttactggccaaatgcattttgaggtgtccaatcaaaagtaaacttagttatgccataagtatggatgcgatttacagtaactaaaaccgccaaaatcgttagtttttaggttctaaaaaactataaattgcatccctagtcatagaaatagagggtgatcatggacaccaaaatgctctattggagcgtaaaatgcaatgtaaaatgccaataaaatacatcagactaaccatctgcaattcggctcaaagcttcaaagctatactcgaacccgtcggccaataaaatttctctgcgctgagttgtttcggaaacaaagaagattttttcatttggttgcagattagcagggggtggtgggatttgtggattgggttggactgcttggatttgtgggacgggttcatgaatttctccttcttctgaggacgacgaatccatttggacgaaaatgaatgaatgatttgaagaggtaaacggaatggtcaagactttggcaaacatttttatcagcaaaaatgctctcatttctcatcactttggttttatgggtcactccacatttacttttgcatatttatttatttatggttgtattgatcacttatctttaattattttttattttattgtacttttgttaccagcataccaaactaactttttttaatttggtaacaaatttaagctaaattgatttgattgagatatttttaggaaataatccgttctaatgacttgaaaatattttttaaaatagaaatttactgtcggattgtccactgtcggattgtccacttctgtcggattgtcctcactgtcggattgtccaactgtcggattgtccactgtcggattgtccactgtcggattgtccagtcacgttttcatagttacttcttttggaatgttatttatatttaataatgatcaataattgaaaattctcagaattttttgttttatcaatgctcatcgaattagaaactttaaatttatcaaagcataggaaataatttgagtgtgtactgtactatacataaataaaaatataataaataaaaggggagggatgccaaatgattttcccgccagcaacaattaaaaaagttggaggatttggggcatagaatgtgttcccggcttttgggctgctcccatcaacgaaagtgcgcggatggaatgttctgagcatcccgggcttctgctgcttcactcattgcgctttcttcgccacggctttcgctgccgtcggttttttgccgagtaaatacgaattgacgaagaagcggatgaaaaggaaggcgaacgcggtgtaaatggagaagcaaatgcacatattttcaacggactgttggcacaccgtcggacgggaggagaaaagcttcagacgggcgacgtacagagagatgaacacgccgataagcatctgatcagaggaggagggaattggccgagggagcggagggaattgtccggagaaagtgcgggaagaaagggcaccccatttcccacttgggtggtctgcagcgtggtcacagtcatcgacacccatttggggaatcggattccgaggctggcgaatgtgtagtaagtgtacatgatggcgtggactgagtaattcaattggatgaaccaacggccggcttaagagggaatgaccgtttagaatattctttttctttgcttttgttggtcacctgcggtgagttcagtcgcggaatgccaactaaaaaaggaaaaaataaacaaaatgatgacaatggcactttctgcgtccgtcagtcgttccactcacctgtaaatcagcacaaccgaatggtggaaccaatggaggaagatgagcgggcgtttcctcagcaccagcagaacggtgtccccaaactcggccactttggaaagcgaaaaaagaaaggcccaaagagcggccggctgagtgggcgaaatggaaaggcacaccgaatcctaaaagaaagccaaaacgaattggccatcttccgtcgaaagtgcccacttggaatgatctgttcttcataacgtagagaaactcctcgctgaacctcaacgccccgaaggtgctgaaaatggccaatccggcattccaaaagaccaaaaagttgcgcagttcgaacggctttctgtcgcgcatccaccacttgagataatggatgcctgcgaaggagaagcaaggattaaacactttagagagcaagcaattaattggtttctgaccggcgatataaaggaacaccaaaa

SEQ ID NO: 5583 - DNA, 1259 bp, Heterodera glycines
gcatcagaaggggaaatttaggatgagaaaaaaaggaggggggggggggagaatggaatatgcaaaagaaaggaagtgaaagaaaagggaggaaagattggccgatggtcgaccgaggaatgcgttccctcggaacggttggacggtttggcgaagtcatctgagaaaagggacaatttgcagcccatttatatgcatccacttgacttcactttaaaacgcgcaacttcacttttggaaatggaatttgcgtagtaatgcgatggaaagcgaattcgaattacacaaccgaccgaacgggcaaagggcaaaaaacccaaaaaaagccaaggttggggagggggaatttggaaaattcatgaaaagtgttcaacggactgacattcctaaaaaggaggccgatcaccagattcacacgcccaaaacgtaagacgcagcagcaaattacagcagagatttgtgcaaggcattaattttgaattatgcgatcaccccagggggacggacagtcgcagcagagtccgtccgttcggttcggttgaccccccaatttcattatcggacccaaagaatgtttcagcaacacccattctcgaaggttatttcaagtcggggctcacatctcttctgattccgagtgaattattatttatatgtacataataaaaatttattttaaaataaataaaatttaatttatattaataaatttttgtttttgatttaattgtctttaattttttgtcacttcacccatttgggaatagtttttaaacgaaaaacccaaaaacataaagtcatattgagaaaattgttaaaataaaaaataaatgtgcacatttttttgagaggttttatttattgaacttttaatgcgtcccctcccccttttataggccctaaaatttaaaattacatcaaaaaattgagtgtaattaattaattaattaatgagggtcaaaaattaaaagacatttaatttaaatttgcgtatttaatgttaaaaaattggataggaaaccaaaccaggccatgcctatttttggccatttatttttggcgggggagtgaaaggaatcgcgcggcgacggacgacacaaaggccaattgttaattcgctgtaaatcacgcccccggcatatttaatgttttctcaaaaaaaccattaattgaaatactatttgtgtaatgaacattatggaaatgtggagtttaccccctcccggtaaataacaatggtttttcgagttatataataa

SEQ ID NO: 5584 - DNA, 3829 bp, Heterodera glycines
  misc_feature (3799)..(3800): n is a, c, g, or t
atttcgggaattttgtctcgataaaatcaataattaatccctacatagaaccaattcatgatgattaaataacctgacaacctttgaaaaaataaataatggcaatctttaaagtcaaactttaccgtattgttccccagcaattcacttccatggacaatttatatctgcaaaatattaataatttaatatattgtatttattactctgattttttaacagatcatacttgatttttgacatggggtgtgtttgtcatgtaaatcgattactcttttttgggtatttcttgccgtttttaaggaaaaattttgaaaatttgagtgcaaattgttatggttaaaaatgactaaatttgcgatttttagccaatttttgtaagaaaaataaatatttttatggggcccgcgccgggaaaatttttttctggaattaatgaattttgtgaaaaaaattatttaatttagaaattttcctctttcccccttcactggcgaaccaccgaggggccgatctccccccccccctttctataattaaaaattttttaagtttcatttttcgataataaattgataataatttattctcactcatcaatcgatgtccaagcatcaggcccaaaacagctataaaattcaatttaaatttaataaaatatcatccatgaaaagcaaatgtacctgaatatgccggcattgttcacaagagcccacaattctgtaaataaaaaattattattttttaattaaattaaaaaaaaaatcaaaataagtccaggacagaacaacaactcgccaatgtttccaacagaattcaaatctttgcgaacaaaatccgctgcatcattcacagattggtcctgggtgatgtccaatggcactgttttgagttttgccgcaattccacgtttttttgcttcctcaatcagttcatcgcgtcccttaaacatactgctattgtgtagtgaaagaataatatggctaacataaatatatttttccaaacaaaaagtataattgaatttaaaaaaaaattcttactgccgaaattggtgccgtaaattaatcattggaatattgtaagcattaattttgagaaaatgccaaaatgtgttatcgtaaaaccttcactttttcagcaagaattcagaattttttgtcatcaataatcaaaaaatggttgttagaccacaataaaattttatttttatttttttggtgattatcatctaattatcttattttctgagtctaattactgaaaaccatgcaaaattgcgcatgccatacctgtttagtaaggcatccagcatatgtgagcattccatattgtgccaatttaagtgccaacaaataaccaaaaccagagtcacatccggtgacaaaaacagcgcgtttcgaagcattttgaagcgggattaattcctggatttggtaggggagttttatgcaaaaatttaaatttttaattttatgataatattttaaattaaaaaattgggtcattcatttaaaaagtttaaattttatttaaaataatataatatttttaattattttcacatacccaaaggtagcgaagtgcataataaatgaaaacaagtaaaggcaaaaacaaaatcatttttatgaatggaaagcaattaatttcttgcgagaaataactgtaaataataaaatgataaattcattaaaaataatgaaaatgaagaggagtttttgctttggaaagaatttgtgtaagaaaaataatcaaaaaaaaagataagagaataagaaaaaattgttttatatttttggaaattttaaataacattcttatcatgtgaaaacaaatttattttaaagtaaaaaaaaaattcgctaaaaccacaattctaaaattggtaaataacgattcatgccaattaggacctaatttctccataataaaatgataaaattttcggtatataaaatgaaaaacaatttatgggaaaaaaatttcaaattttttttaatgaatattcaatttccaatttcctattttatttttacatttttcaaaattcgaattccaccgggcaagtaacattttctgttttacagatcaaccaaaaatcaaccaataataataatgatgatgattaaactacaaaagcacctccatgcagcagcagcagcagcaagcagtccaatcctacgaaaaattgttgtttaatgtttaatttttttttcgccggagaccgtttttaacccttttttaaacgagaatctcgtccgtggagacaggtcgagtctccaaccacctgctgctgttgctggaattattttgcaggtaagatgtaataattgatcgatcagtttagttgagtgatcaatcttgaaaaatgtgtgcacaattttctcacccccccccccatttttaccgaatgtaattttcggtccgccgtcatttcaatagccaaccaaacagttcacccaactcaagaacaaccactcaaattggtccaatatttatttgtttgtaatcctgtgggtataaattaaatccatcaaaatgtcccaaatccgtcgtcgtcgctcttccctaatgggttgggcagcggcggcgacgggcgcaatgctgttgatgtccttcacctcaattaccctgttaatagagcgcgtacaggcgaagccgagcacacctgttggcggaccgtattcggagcatggtcactggattttttatttaattatttcatcataattagaaaaaagcgtcgccgcaattttttaatttgtgctgttgtcaattaattgttaatttttttttcacagtgtttagcgtattcttttatgtaacaatttaaaaaattttcaaatttaaaattaaaattatcaaaattttattttcagtggaaaagagtggataagaaattgaatttgtgaaatataattatatatttatacttaatgtataaaatgtgggtaccggtcctgatgtttttgttgaaatagccaaaattacaggaaaaccatgacgggatcttgttttattggattgccaatattgttcggttgggcctgataccatttttcgagtcaatttgacaattcgtacaatgagcaattaattgtaaacaaaatttaaaaaaaaaaagatttatttttcagagaaaaaaagttggaaaatttaaagaaataaaaacataatattttttaatattcattttattttttaagaaaaaattttcctgttcaaaactttttctccgaaaaaaaatatttaaaaaaatattgaaaatttttttttgtgtacgttgaccatttcataagtgctcacaaaaaattaattgaatgtttcaaattaaattttccaaaattataattagcattaattagcctaattattttaggttcacagtgcaatgaaacatggcgcccaaatctaattgagcctttacaaaaatgttcttcaacccaagcaaaaaacgagtgccaaaagggttaccattgtaatggcgccggattttgctgcccggaaaaaggttttttatccaggaaatttttgggttttcgtcagtgatttaattttttataaaattggcaattttttttgttatgccgaattaggtcattattagtgaaatcagcccgttttagaatgggtgtatttttatttttatgaaaaaataaacaaaaaatgattcttaaattaaaaaaattcttttttattgtaaaatatatttatattaaagcatgccatttttgaaaaagtgccatagaccctggttgcagatcctggaaaaacccggggcctggctggacccagnnctaagtcttgctcaaatttataattacta

SEQ ID NO: 5585 - DNA, 3989 bp, Heterodera glycines
  misc_feature (29)..(29): n is a, c, g, or t
  misc_feature (41)..(41): n is a, c, g, or t
agaagatatttcccgatgaatattttttntgttattcattntattaaattatgttaaaattttaaatagacttttccaggaataaaattcattttttatgaaatctataataattaatgaccaacataataaagtatttttcacaaattccatttaataactcaagatttatcaaatcatttttctttacagagtgattaaattttgggataaattcttgcaaggttattaaaggaatttagaggccttttgaaaataatcagttctttgtaggcattagagcccccttagccatttctttacttagtctggattttcgctcgaattcaaaaaacgctcaatgaaaaacctgaaaaatttctcgaaaatatctctcacgtattatcattaggggcttgccaaataggaacaaaatccgattactttaaagaaagttataacggaaacccagttttgaagatcctaaaaaatctcggttggcgcgcatttggcaaaatcgggatttttggcatggtgttgctgaccgctggggtttccttcaaaataaattgtaaggccaggagcgaaaaatttgccaattattaaaattttccttcaatattttttcattttgtggaaaaactccgactcacaaatcagtaccgaaatcccgagtctgagctctatacgatatgtataaactgcaacatttttcagttatttcattttataacttgattttaattttactttattccttttttaaaatttcattcattattttttaatgcaataatttctcataaataaattaaattaactccctcttttgtgcgttgccttaaattaccccaaacaattttatttcataattacaaaccattcattcatttctcttttaatttcttttcgcccatttatttttctgcaaaaaatccccccccccccccgataaaaaaaattcactcattttttccattcaattcaactgctgcgcttcttttattagagggggggggggggcgtcggtcgttggggtccattatgaatgggtttttatagcccctcgtcccgcccgtcttttcaccatcatagcaaactgcttgctcttccgatgatgatgatgattgtcttcatcattcacgctcatcattcttccgccaccacttcctcaaccattcaccacaatcatccgcttggttgctgttttgctgcggttgttccacatttattgtccatcattttctacctctacccccgcggctccctgaaaaacataaaatgcttttccttcctcgtcttggtactaattgtcgtctgtgtccattagccttgggcaaaattgtcattgtgctgcttcattttgtctgctttatcaaagtggtggacggtgaagatgaacatcagcagcaacagctgcaaattgaccatggcggagctgaacaaagtattgaaatttgaattggaaaaatgattgataggcttagtcgggttttgaaatccgcttgaaaaagttgtatcctacacataaccttacttttctgccccccggcattattcggactcaattttggccaaaatacctactggactcgtttaacccgaatttttgggataaaattaaaaccctggattgggaactcttaattatagcaagattcgaactttatcagggatttggtgttttataaatgccggccaaaaaataaggaatttaaaaattatttttatttgaatttaccactaattttcattactgctttaagtctgcttcgagccaagagatttgggtgtttcgtgcccaaaggacggaccgggaaaaagcaaaatgttttattacaacaaaattttgggtatttttttaaattttaattttaaatattttttttatttaggttcttgccaaccatttatctacaaaggatgtgcaggaaatttgaatagatttatctcggcgacagaatgccgaaaaacatgttcaaaattgtccaaaaagacccaagaatgggttttaggtgaggcaaggaaattaaaatgaatcaacggattaaagcgggatttaaagctggaaagaataaaaatttgtgatccgaacattcaaaaaattcagctgaacggtgtaatgccagtcacctcatcccggatggtcattacatcgaatgtgttgcagggaaatgcccggaagggcataagtgccatcccgccgatggtatatgctgcccaagaaaaggtaaacattatctggaattgagtacggtatcatatccagacatgtcccattattaggttaacgaacggtaaaaccaattacggtattaaattattcaaaaataaattcagagtacgtctgttctcttcaagataattctggcacttttgctgacggagtgccggataagcctcgcttcgcgtggagtgccgacattaaggtgcttttagcgtttttggttttgagcaccgcctaattaggctcgctcattagcccgttttggaattttaataaaattttttattttttcatcagtcttgttggcgtttctcctattttggtgcaaaaggcaactacaacaactttgcaacatttcatgattgtctgaacttttgtgatgaaacaattaattaaacataatatttgtagggatggcaaaaatatgtaaatacataataaaaaaaaaactgaaatcgctatttttttttgaaaatgtatttagaataattaggtcctttttatggcatttttttttgttccttattcacggttttctaataattttgcccaaaaaagttaaaatttatatacatttttgaccacttttttgtacatatctttgccatctttaatcactttttaaaaaacctttttataatataaaatatgtatgttttacataaaataaaaaatatatatttacaatttttttttattattacatcatataaacataaattatattaatattatacaaaataaattaatcaatggattatttcttttttttcatttttattattacgtatgtagttttataaatgacatgtagcaaatgtatttggagaggaaaaaaaatatttcagattacttatacaaaatatttcttcatttattaaaatactaaaattaaatcaaaaaaaaaatcctctatgaaattgctcctctttttctatttgttttttgcgcaattcgcaattatttggcaaatggacgcatcgaagtggcaaagttcatcgacgccatcaaaaaattttagaggcaaacaacgttttgctcatagtccattgtcacggttcgaggaatatcgttccaaatcgcgcaaaaatggtaatcaaagcccaaatgggtgttgtatgggaccggaatattttcagggtgtcgagcttggatagcagatgaaattgaattctgatttgcgactttttttggggttggaatttcaatttacgatttttttgggcctcgaaattccggtgagatttttgggggtgccggaataccatctccgttggataatacaagagcccggaagcagaatttatgtactgacaaatgagtcgggattttcgctggaattcattcacaaaaatcttaatgaaaaattttgaaaaataatttcagaaaaacaaattcaaccgcatactaacgagaatgaattaacaaaaaacaatgaaaaagcattaaatgaatcggatgttgataatgtccgtcaaaaacagaaaattgttgaatcttccttgtcaactttgcctttaaaaaaacgaaggaatatagtgaaacagcaggacgaatatgtatgtacatatttatcatttatcattagtagggctgtcaattttatgcaaatacatatttttttcctcggactcgctcagttgggccacttttttacctacattttttgcatgtgtttttaataatatgtataacaaaaaaaaatgttttgaataaatctgagaaaataacgctgaaaaatatggataattgcaaaaaaaataaataaaatattcagataaag

SEQ ID NO: 5586 - DNA, 1658 bp, Heterodera glycines
atcccgaaatgctaaacagaaacaaagcaaagtcagtacaaacggaaacaaatcccgaaatgctaaacagaaacaaagcaaagtcagtacaaacgggaccaaacccggagtttccagaaagaagcaaagcaaagtttgtacaaatggaaacaaatccccaattgacagacggaagtgaaggaaattcgataagccaaaaatcaacaaacttaagaaggcttaaaagtgagagcaatactgataaaagaaggtttttggaatcaaaaaaagaaaatcttcgaatggctgactcgtcgcgtgattatggtcccagacatcgacaattccctggccatgaaatatcgccgaatcggtcccaacgatatcatgatcattatcatacacattcaacgcgatatgcccctgaaatatcgtcgagtcggtcccaacgatattatgatcattatcatacacattcaacgcgtccttcttatcggcgaaattcatcaccagaccgacagtcttctgctatacaacaaggatcacaacattctgagaattattcaacgacagatgctgatcgaaatggaagagactcatcgcaacagcaccatcaacattacagccatccaagctcgtcaaagagtcaacggagttattcttcgcctgatcagaaaagagcatcttcgtcggaaagtcgtagaactaattattcttcttctttggaccaatatattgatcctcagtctgcacaagcacaaattattcaaaatccaacccaagacgaccaaacttcagaacacagttccaaagaaacaaatcaacaaaaacaaccggtatatgaacagaatttagaaaatcaactatatgaccctctgcagccttcatctttaaccaccaacgcgcaagcatacaatcaacctaaactgttacaaacttctcatgcttcacatggacagccaatgtttttgccgatgaattatcaccagcctttattgcaggcacaagctgttaatgtatcgactcagcctgctggctttcctttacatgcttatccactgcaaaatccgactcaaaccaattttatttatcaatcaggtatgctcacatgataacagccatagacagactcggataataaaatttcaaagttttcatgattcgcatgaaagttgcttgaattttaacttatggaaaaacgctatttaaattttcagttcaacccatgattgtgcaaccccaaccagggccacttgtaatcactcaaataacgccccaaccagttttaccacaatacattccaactcaacaaggcccaagcactcaataccaaagtgatgcgcatcatgtgatcacaacaaacacgaattcgggaaccaataattctgcaagacaaaatcaacatgcattttttgattacaaaaattatccgtctaattattccgaaagagagccagcttcccagaatgtaattgttattagaccaacctcgaatttaactgaagataaaggcaaagctttaattaaatataagaatggtaaaaacccaaccaattttgaacaatatccgactaagcaacatgttcctcattccgtatcagttaataatcaaacaccaagtacttcacaaccaaaagttcaggaatcacaacttgatgaagcttatttgatcattttta

SEQ ID NO: 5587 - DNA, 3230 bp, Heterodera glycines
  misc_feature (851)..(851): n is a, c, g, or t
tatgtcccctctcttaacagttcatttccaggtaattacctttatgctgtttgggtaggggtcggaattgacaaaagtactttcatgttgaggatcatatcttctaacgcattttatttcttaaatttaagtgcgaagtttgcggacaaattttgtcaattcattttttgtacaatgcgctgcttcacctttctctgaccatcttttatgtggctcctctttttcaaaggcttttatttgggatttacaggtgttcataacgtttgtaattgtttacatttgttcagttttaggaggatcgcaaatattttcacgacatttcgtctcattatggaaaaaatcatgcacataaaaggaataaaaaaatgttaccaaatgcaaaatttgtgttggatggacacgataaagaagtgaattgggagacaacggaatggtacttttctgactatttaggttgaatgtgttcaatggagttcaaaagggaaatatttgataacaatggacagtgaaattgtccgaatttggtcgccatggaccggcagaaccgaaaatggatacgctgaacaagtcccacccccctctattcattgacataattatttttttttgaataattaaggtcgttttgaaccatcgtccggtcaaatttacctacccaaaaatgtacaccgacgtcgaagacgaaaggccctcgtcaagccaaacactcagccaacggacatttggtagcgaaaatcgcactgacaatgagtcgcgttgttccaatgacaatggcatccaattgctgattgaacactcccctacgcggaacgtctttaatgccctcgacaatctcccgtcactatacgccnaaacaagggaagaaacctcaaaagcagaaatgacacaaatggctaacagacaaccgaaacggctcattgtcatcaaaagcaatataaacactacgccggcaagtaaaataccaaggttgtcgataaataaaaatcgaaagaatttaattcatatttaaatctggaaatccggtctctgggaatgacaattcatcctcccttcatgtttaagagttggagggcatgaccatttcacgccaagtcaacataaaactcctaaaaggaagcgacgaaatctgactgccgaatttaaaagttgcgggaacacaaagaggaaaaagttaataaaaagcataggataagcggatgatgaactctttaaaggtattgcgtggatgcaacttcgccattgggtcggccaaggtcggcatcgacaagcggagggagcaaaagtcggaagaacgtggaacttgtcaagccgacgaatacaaaaaaaattttggattattttgaacgggttcaaaatgctgcatcttctccatcttttcaatgatttttttttcttatttgaattgaagtaaattccaatttttcagagtaaattatgcgtgtcatccaaatttgttaattaacatttactcttttgcattaacacatgttcaaaaggaactcaattaattgttttcggatgttcgatttttcggaagaccctttggtcctctcttttttgtcctctgcgcaaacgaataaaggaacgggttcagttggtatgtctctgtaatgaactttgatctttttttgttgtcttaaattccagggagtggatgttctccatcgtgttcagtgtacgacgaaaccacatcagtttccaagccagtggatgtgttaattacagcagacaataataacgttggcattctgccgggtgaagcggaagaaacggaaggcgggagcaatgaaacgccgtgcacttccacggaacaaaaggtcaatgaaaaaacaggcgctacttgcaaagcggtcctttttgaaattttttttcactttttttggtcacatttttttttttacacataatgatgaatattaagaattaatagcacaattatggtgaataaaaagtatattcacgatttttaaccaaaaaaatttttacaaaacaaaagggtcccccctatggttttttataaaattcaaaatctatcactttataactagtgccaaatttgcttaacaggcccaaataattgtcatattcatgatcagcgacctctaaaacccccgggtacttggtttcaggactttttaaacaaaaaaaaaatgtgaccaaaaaaagtgaaaaaaaattttttgcaagtagcgccaaaaaacatttaaataccgtatggctcttctgcagttaattctttttattaaaagttaaattattacccacatcttattagtccgtctcaaatcgtcaaaatttgtccaaaatgtctctgctgaaaagcgtcgactccaaactcggcgatgaaattctcaccaccatcgtggaaacgacggacattcgactcgacgacatcgaaggaaatgcaatggcaaaattagcgctggaagaaagtgttgtactgcctgcactaaacccgaaactcttcacgggtctgcgggcgccgtgcaccggaattttgttgtttgggcctccggggaatggcaaaacgatgctcgtgggttgacttggcaaattcattggctaataaatgaaaatttaaggcaaaagccgtggcgaatgagtgcaattcaacattttttagcatttcggcagcgacaattatgtccaaatgggtgggcgacggagaacgactggtgaaagcgcttttccaagtggccagaaatgcacagccatccatcattttcatcggtaaaattaaaaaagggaaatgagtaattcaaagacatcgaacccaataacatcagatgaagtcgattcgatgctttgtcagcgttttgagcaagaggacggagcagcaaggcgagtgaagacggagtttttggttcagttggacggatgttcttcggaaaaaaaggcaaatggccacgttttggtgttggcagcaacgaatcgcccccaagaattggacgaaggcattttgagacgatttcctcagcgaattttcatcgatttgccggacaaaaaagcacgttttcaaatgattcgaaggacttttgaactgaacagcaccaacttacaaattgaagatgccgaattggagtaatccgtccggtactcatttgtcaaccaaagccatttttcaggaaaatcgctacaatgactgacaattactcgtattccgatttgaaggccctctgtcgagccgccgcaaagtttcccgtgcaaagtgcgagaatggaaaacaggga

SEQ ID NO: 5588 - DNA, 2855 bp, Heterodera glycines
  misc_feature (22)..(22): n is a, c, g, or t
aaacccccgggtacttggtttncaggaccttactaacaaaaaaaaaaatgtgaccaaaaaaagtgaaaaaaaatttcaaaaaggaccgctttgcaagtagcgccaaaaaacatttaaataccgtatggctcttctgcagttaattctttttattaaaagttaaattattacccacatcttattagtccgtctcaaatcgtcaaaatttgtccaaaatgtctctgctgaaaagcgtcgactccaaactcggcgatgaaattctcgccaccatcgtggaaacgacggacattcgactcgacgacatcgaaggaaatgcaatggcaaaattagcgctggaagaaagtgttgttctgcctgcactaaacccgaaactcttcacgggtctgcgggcgccgtgcaccggaattttgttatttgggcctccggggaatggcaaaacgatgctcgtgggttattaggcaaattcattggctaataaatgaaaatttaaggcaaaagccgtggcgagtgagtgccattcgacgttctttagcatttcggcagcgacaattatgtccaaatgggtgggcgacggagaacgactggtgaaagcgcttttccaagtggccagaaatgcacagccatccatcattttcatcggtaaaattaaaaaagggaaatgagtaattcaaagacatcgaacccaataacatcagatgaagtcgattcgatgctttgtcagcgttttgagcaagaggacggagcagcaaggcgagtgaagacggagtttttggttcagttggacggatgttcttcggaaaaggaggcaaatggccacgttttggtgttggcagcaacgaatcgcccccaagaattggacgaaggcattttgagacgatttcctcagcgaattttcatcgatttgccggacaaaaaagcacgttttcaaatgattcgaaggacttttgaactgaacagcaccaacttacaaattgaagatgccgaattggagtaatccgtccggtactcatttgtcaaccaaagccatttttcaggaaaatcgctgcaatgactgacaattactcgtattccgatttgaaggccctctgtcgagccgccgccctttttcccgtgcaaagtgcgagaatggaaaacagggatttgaggcgatgtacggctgaacaattgcgcccagtgaatgtagccgatttggaaaatgccattcgcagtgttaggccttcaatcaatgccgaaagcaggaagaaattgatcggatttgcggaaaaccacgcaaaccaacagacataatttatttttgtataaactcaattattgttttttttgttacaaaattgttgctaaaagcattcaataaatacatagctttgctaataggatgtgtttatactcaaaggtttcttcgcccagttttttgtttttggcgttttgctaaaattcttaaacataaagaaagaaaaaggcaaaagcataaaatgaaacggaatgcgcagataaactcccaaactattaaggaaaaagggagcgaaggacgaattgcgcagtcgtcgactttctcctcttcatcattgagctttcatcgatttccttcgtccaacgacaatttcaattgcaagtgaatgagcccattcccttctcttcgctcgatagagggcgaaattaaatgaacaattatttatatggtttctttgtggtaattgggcatttgtattccgtttttgccatttctccttacgactctgacgctctttgtttacgccaaaatataatttctttgataaaatcgaaaatttacaaacacgcttttgcttttgaaaaaggatttcaaatgtttggttgagatttaaaaaacctaaaagagaaaggaaatggcaaggcggtacatgataatgtttgacagtttaaaggaacaacaagaaggggaagttcgcagcactgaagcaatgtccgaattggtcggttttggggcatcggaattaaaaatggaacacaatttgttgaagttgcaagggatcgcttccttcaccaaaagtgttcaacagacgctgaacagttacgaggtgcgcaaattgggggacaaagtgcaggggtacgtgatgaacttcacggaaacggagcaaaaggtgcgggaggcgacgaacgaggacccgtggggtgaggagggcaaatgtaccgattggaaggaaaagcaaagaatttaaggaccgacggggccgcaaatgcaggaaatcgccagcttcaccttccaatacgaactttacacaggtgactgactaatcactgcgttgttttgcaattcattttttatacagaagttatgggaatgctatggaagcgaatgtttcaggagaataaattggcatggcgacgcgtctacaaagtaaaacgtgaaccaataaattcattcatttattaatgttgccatttcagtcactggttttactgaattatctgatcaaaaatggtagtgaacgtgtgatcagaaccgcgagggaccacgtcttcgaaatgcgatccctcgaaaattacaaatgtgtggacgagcggggcaaagacgaaggaatgaatggtctgtctgaatttggttggccttttgttggatgacgaagccagtttagctctagtacactttaggggtccaatgttcagtttcttgggccgtaatttctttttttctatatctgtgcctacattcttggtatcaaacgaaagcttaaagtctcatgattttttcgttttataccaagaatgtaggtattgacaaataagaaaaaatttttgaccggagaaactgaacattggacgcctcgagtctattaacgccggcggagttcagtcagacatcgtgtgaaattgat

SEQ ID NO: 5589 - DNA, 2025 bp, Heterodera glycines
  misc_feature (24)..(24): n is a, c, g, or t
  misc_feature (1907)..(1907): n is a, c, g, or t
  misc_feature (1922)..(1922): n is a, c, g, or t
  misc_feature (2000)..(2000): n is a, c, g, or t
cgtttccattcaatgacagggtanatatttttgttttacagttggccaacccttcgacaatgactcctttttgggtttggacaaccacgaaatccaagtcgaacagcaggattcacaaacgcaaaacaaccaaaaaagtgcggaacagccaaaaacaatcgcagtgggaagcacgtgggaaaatttaaagggaaagtgagtgaaaatggaatctcaaaatggagaaataccctttctttcagagttaacatagactttgaccatttgtgcctcaattctccttcgaagccgactccgtcactcaacgaattgaagatgacttccacgaaagggtcaaaagctgctgcttcgtcctcaacttcagcaggtttaaatgccacgacaaatttaacgagaatgttttacaattaagggagtttgctgttgtaattggtttttgcgtgtcatcatttgccgtcgctcttcttttcgcaaaatcagtttctcttccacacggtccataatttggtttaaaatttcaaagtgcttcattaatggaggattaaattttctttctgtattttctcagccgatgttgcgaacgccttatccaacccatttttcttactaaattattcttttctcttctgtctgtccgaatcctttcctttttattgttactcatttctgtttcatgccgaattaactgaattttactgtgatagtgttcctttttgttattcgatgataaaacctcttcttttctattaacagttcatttaattttagaatacttttcctaattagcggttatgcgtaaaatacacagttagttgtaagtcataatttactaatttgaaaaaagaaccaataaatttccgataaatttaagaacgtgaaatcaataaatagaaagttggacatgtccaaagaagctcaaataacaaatgttatacaatcataatggttagttttttggaatttagaaatccatcaaattaatttactgaaatataaaacagactaaacagtttccccagagttttaaaattgtccgattggtcaatcggtggatgatgaggtaaattcatcagttttctttctcctgcgcagtcgcttcttggagaagcccgtcctttgctggtggcttttcgtccccttttgcttttccatggcttttccgactgtcaatggcatccaaaatcaacgcggcaaacacaaaaataatgccgagcacgtgtcgatttgtgtaagggtgggaaaagatgatgatcgaaaaaacgagactgaagagttttcgaagagttgtgatgatggaacaggtgagagggccgaaatcggtgaccgttttgaagataaaacactgaaaacgagcaaattaattaaacggagaatggaaaaaagggatgggacgagaggacctggccaaccgcaccggacagcgagaagagaagcatttgctgaagaatgaaagggtaagcggcgacgaatcggaaaaactgaaagagttcgccgctggcgagaagaattaaggtgaggaaggcggaagagaaggcgttcatcgagaacatcatggtccatttgtcggtggtgtggtaatggcgaattctgtctgaaaaaggggggggtgagaaatgcatttatggggaaggaaaggagggcaccttggacggcgccagtgaatccgtccattgccaacgacagacacagaaacaattcgccactgcctaactgaaagccgacactgcccttctgaggtttgtacaaaaagatggccattccggtgacgatgagaagcacgtaaaagtatttgcgaagtccgtaccgtttgtgagcaaaaaggacaccgaacagcatgatggggatgggtttgcacgacttgccaaggacctgcagagattcaaaaatggaacagttcaatgggaggngagtgactgacttgngtcgggtaattgacccattccaaggcgtaactgctgaagagcatggccaggaagtagctggttgagcacattgagtancagtgaatcggcacattgtccagcg

SEQ ID NO: 5590 - DNA, 6284 bp, Heterodera glycines
  misc_feature (4580)..(4580): n is a, c, g, or t
gacccactgggaactctgctggactgctccctcttttcatttcggggcagtctcaacaagggtaaggcatcaacttcttaattacgaagaagcaacgcttctctcgtctgtattaccatcggcgaggataatgtgccaaaccatgcccattctcccaatggtttttattaaaataggcaaataaaaatttaggattgatgaatgaagacaatgcgaaagatcgtctggaggaatttattggcgccgagaaaacagaaaaagctcaattactgcttagattaaatggggaagagtacaaaggatttgtgaaggaaatgaaagagaaagaaaaattggaaaagagtgaagaggaaaaagaaagaaacaaaaagaaaagagaagaggcggatgaaataatgagaaaactaatcgaagaggaaagaaaaaaagaagaattgaagaaaagaatggaggaaatgcaacgagagaaaaaagaaagaagactgaagcaacgagagttgcagagaatgaaagaaaaagagaccgaaatggacaacggggacggaagagagcaacagaatgaagacagagaagccagtgaagggagtcagagtgaggaaaatagttcttcattggcagagagttttgtcataacgccaaaaagtgtgccgaaggaaagaaaaaacggaatatttgaaaataaggaacagaacggagagaaagaaaaaaaggaaaatgaattattgtttggaagagaagaatggcaaaatgagttggacaaaacaaaactgatcggtgagttatttggggagcgggaagtaggagaccgggattgatcaccaatggcacaatattagcatccgccaagttatgatcaataattcctaatttacggtatataattctgacaaatttattgaaaatgtataccatttttcttaaaatttaagtaaattctcaaatagttcctcggaagcgtgtatctttaatgcctgtccccaaaagttccttagttttttatatttgatattttcgttactaataattaaaatacgcataaagtaaaaaaaataaccgcgttattttaaggtcatggtaagtaaatatactaaatattttaaattatttattctttgtaaaattggttaatttatcataaaatttaaaggatttaagagataaaaaataaattcccaaaaagaaaatcacaatttactagagtgcagcgggaccgggacctgaacacggacaactgagtaccaaggtcccggttttgaccagttttgaccgggatcgggaaattcccggttttcccagccaaaaagtcccggtttttcaacccaaaaagtcccggtcccggtcttgcccaaatttcccggtcccgctgcactctacaatttacaataactatttctttttaaataatgtttattgttcatttaagattttacatctgatcaatttttacatgaaaaaattgatgcatttctccaaaatccatcagagacaaagaaacacatgttggacattggggtattcgtaaacgaacttcggcatcggatggaaatgatcagacaattaagcaaatttgagggaaatttggaaatggaacaggcagaaattgccgtaaaaatagaaagaatggctaaaattgatgagaaatggacgcaattgaaaagggaattgatgagggataatttgatcagagatcggacacaatttgagggagtgatcagtaaaatgtaccgtcttttgaagcaaatgatttcaatcggagaagcgaaagaattgcaggaagaaaaggaagagagaaaaatggtggccaatcagttagctacggtagggcgagaatcaaacgcggaatgggaagaagatacggtagaagacagagaaaaagctgcgataaagtcagtcaaaattcaattgcacaagaataaattggcaaaagcaatcttttcgaaagaaaaacgggcaaatgaaaacgcagagaaaaacacattttgggaaatggacagagagcaaaaaagtgaaattcttatggaactctttgaatacgagcgacggaaaacaaaaatgatcagccgatttgaagaacatttggagggatggcagaaattggaggagcagcaggaaattggttatttaaaataaataatatttgcaaatttaaaaataaaataaaataattatttattaaacaataattcattgtttaaataaaataatttcagacagaaatttacggggacaaaaaaatgcccagcaaatctattttgactttgctcgcccccatttggaggttaatttccccgaaatttcccaacaaattcgcaacgaccaattggaaaacattcagcagaaaaatatggtaatttttggcactttctaacaaaattgaacacataattttacagtttaccgattttataaaagaaatcccaaaaagtgacgcaaattcagtcggtgccgcatttgacacattgaaatcaattatcgaaaaatgggtaaaaattgttgtttattatttgaatttatattacagttcatcttgggcttttgtaccttccgtaaaaataattagcatggggaagaagcgtcagtcacaacatatacattttttagtttcataaaataatattttgaaaagagccgaatccttagctttttataattaagaatttcccgacaaattattggctttaatataattaactctttaataatccgctgaccattttcccatttcagtcaaatggcgccgcccgtctcatcgtttcgggctcacatttccttggaacgcgcactgccgactcggacattgatgccatttgtgtggtgccccaaaaagagtcccttaggggggaaagggagaaatttctcggctttttcaattgcgttttgaccattcaaagggagcaacgaatttgttctgacaattcgctgcactgccaattttgcaaagtgagcaaaaacaaaatggaacagagaatttaaattgtttaaaaaaacttaattaaaaatataattaacgcatttatgagaaatatatacaaaaatttgaaaatattgttgaaaatatgggaaaattttttttgatattctttcatcttagaggaatatatttttgaaaattttaaaggccgatgattttcatgttgataattaggcacataaactcaaaatcaggtaaaaacaattcattttaatatttcagcacgcaaatgtggaatatttgaccaaattcccgagtgtccatatccaattgataaagctgaaactgctcggcgttgagttcgacctttccttggtctctgtgccggacatggaattgctgccggacgaaccgttggaagcagtcgacgtggaactgatgatggaaatgatagccaaccaaagagtgccgtccgaagttatgctcaaaacgatggctggtaaaagaatataatttacctaattgattcataattaagctttcaattttatttttaattgcttctgtccccataggttatttggacagccaccaaatgattggactaatcgcgccaagaaaccggccaaagttcagaagcttcgtcattgccttaaaacactgggcaaaacgtgaatttaatttattcaaatttttgaaataaataattaataattttgtttaggatcgcatatttatggcaatgttttcggctttttcaccggtgcaattttgtccgttttggcagcaaaagtcattttatggtatccgaacgcatcgcttcctttcttattccaaaagttcatgctgctcttctccacttggtgctttatttatttatccaattccaattaattttttttcactatttgtaaaggaattggccaatgccggtgaaattaacgcaacaaattggcacaacttttgacgcgttcgcttggaacacgtcggcagatgggcaaaaaggcgcattaatgccaataataacgccgggaaaattggcgcaaaactgtgcaattaacgtaaacgaatcgacaattaaaatattacaagacgaaatgagagaaggtggttaattgggcaattaaaatgatattttctgtcccttttctttttcagctcatttgtatttgaccaaaaggaccgccgcaaattttggccaattgttttctcagcgaaatttcgttgaaaaagttggctaaatacattgtaattaatttgctaattgttcttcaccctttttacagttcgaccattttttgatcatttcatgcattgtcagcctaaacggtcaaattggtcaattttgtgactttgtccaaagaaaaattcgtcaacgtttggccaatttggatcaaattttggaaagattcgtccattatagccaagtaaatccggcaaagaatggcgcagattgggcgcacagcgacaacaaatgtcccgagaaaatgcgacagcgcttcgaaaacattgagtgaggctgaagcggcaatagcggcgccattaaatgaaaagaaattatatatttatttaatcgcttggcaatagcttaacaaaatttcctataaatatgtagagctttagaattgtgccaaactttaaaatttggccaattcggaaaaagtattanaaacctacaaattgcatccctatttattaatttaaaagaaaagagaacaggccacgaccccgggtccgatctataagaagtttagttcttggtgatttgacgggagttgggtggttcaataaagcatcaccaccctaaacatggttgctacacttaccataagcactttgacaaggaaattgtaagataaaataaacaaaaatagaattcttacagatttaagtgtgctcttttatgtgatatcaaaaattatataacaaaagttggacaaaatggtaaacattggggtgggaaatccaaccctccacctttgtcccgacgattggctccacttttatatgggtctttgtgcctccactttttaaagagtttttgaacctccccgcttgcttaattcttagattatttccttatttaccaagtttatcaccaaattcgtggtcattttaccacgtcatttaaccaatttcttattgatcgggccccagtggcaaaatggggacaatggaaattatttaaattttatccaattataataaacgcattaattaatgtcattttaaatttcagttctcccctttgtaaattttggattgtcggactcaaaataaaagaagaaaactttggcactgaccatggaatatttatgaaagaaataaatgaaaatttggagagagaatttgacgcgaaaattcacaaagaatatgtgataaaagtgctgaaagggtggatgcatcagatggtcaaattggaaacgaaatatgtgaagggcgaggaattggccgaatttttgtgaatttgaaaaatgaaaaatgggaataaaatggcaattaattaaatacatgcctaactcaattaaaatatatattcaattatcaattaactcaaaataggaaaaaataacccaattacataaaaacctttagagaaaagccaaagaatttgtgacaatgaaaaggaaatgaacagcacacaataactaggacgacattgcctcattttatttcttttttgttgattttttgttgttttttttgtttttgttttttattaaaatagctgaaagtaaattctaccaacaaagttcgccaccattatttaattccaaggaaattattaaattagaattaattgcgcacataaaaatttaacaagtattatttagaagcttcttaattcctctgaccaaaatcttttaattttgttattcttagcaaataaaaaatacaaattgggagttgttaattcacttgagttgccacaatcttcaggatttcaatgggcattaagaatagtagaaatctgatttttttttatagtaatactcaaataatcgtcaaattttcgtggttataacttaaagtaaaatttaattttttaaaaatctgaattcagcctttagaaaatcttttttcttatcgttgttatctaaattatatttacatctgctgatgattttgcactctccgcggtggtcaaattatcggctgatattaattaaatcgatcaattaatttactcttctcgccattcctttgtctctttctttaattgctttatcgagtaactgttaattgtgtaataaattccttcgaccattggtaaaaactggggtaggtcggggccgggaattttgggcaagaccgggaccaggacttttcgagttgaaaaccccgggactttttggctgggaaaaccgggaaa

SEQ ID NO: 5591 - DNA, 2721 bp, Heterodera glycines
ttatgttcagatttgattttgtaagtttttcactcggaatttctttaaaattgttcgttttcaaaactttcaaaatttcaccgaaacatccaattttctccgacggcctttgtcgttgtgcaaactcaaaaatttcagttttttttaaaattttccgaaaacccaaaaattaccctttttagtgcaaaactttgttagcaaatcggataaaaaaaattttcttgcagtgcttttcggaattggataaattaatattatgttcatttgatcaaatgaagatacataggagttgaaatggaatatatttttttatgcaccttcattgaatacgtcaaagatggattcaaaattgtaaaatattttaactatttttccaaaacttggccaaatttaatttgaaaaatcaatctttggcactgcgtgaaacgaaagaatggaacggaatggttaagaattttgggaaaaaataagaaaaaattttccttttttagagaagcctctcccatattaccaggctttgctattgtaatagcgccaattaaattatcatttccaattaattttttaccaactcacagatcactattttctcggaccgcgaatttgaacaaacgacgagttacggaccggcaggcatttttctgatatttttgccaaacacggaacgatgggccaaggaatcgttcgccttttgggcacaaattgaaaggaacgaattggcagaaaaaactggcggtaaaattcggcaattttcgcttaaactgcaatgcctttgttttggtgcagttcacctcatttcgggatattgccaatccaatgacaaagggtggatcgaagagcatgtgatttttaattatgccaattagccttaatttgtttttactaacgcatttattgaggctgatttaatgtccgacattgtgtatgactggaaatggttgaccgatcaccaattgggctcactattcgtcaaaccgtacaggtggtctcattttacacatctcattttaccagggaacctggctttgttcagcagggtgaccagggtattatattatttttctgtgctagagaagagttggaatgtcgcttttcgttatccaatttctgacatttttcagcagtcgaaattcctattgccaattgccggattatttttagccatcggaatgccaatttccgtacttttttgaggtagtcggcacacatccctggtctatgccatattttaccgcatatttaaaaaaatattaatttggcatttctataacttgcgtcctactccatattgccccctccaagctttacgcctcatttttcagctatggcgcccactacacgacttatgcagcacaaggtcgtctgtatgtgccatggctccgtgcccaactggcggccgaaagtggccaagggttgctgcacttccgacgccaacagatcggctctttgcaggaggtgcgtgtcaaacgatgctctattaattcctcactaattgtaagctggtcgactcggatcagttccgtttggtggtgaattgtgccggattggacggcggacgcttggcgggcgatgatggcacttccgtctacccgaacagaggcattggcatcgaagttagtggccaaggctttatttggtcagatgttaaagcgccttttctttctttgcctcttattttaaaggttgaagtgactggacattcccatttcaactactgggaagatggcatcttttgccttccgttgtatggcaaaggaatggccaaagaaaatttcttccaattttcagtgtgtcaaatggccgctttttaattggcacagttcgacaggacaattgttggcagttggaagtgactgaggaggaaaagcgcacaatttggacacgttttgttgatttgcaaccgaactttagagtaattgaaaaatcataaacacaaattaatgttgatattaacataaaatattcatgggtattttttgtttcttcaaaggatgccaaaattgtctccacgtggtgtgggctgaggccaaaccggcacggcggagttcgacttgagcatcagttgcgcaccaaatccaacggcacaggaacagtgcatgtgaattcttgcaaaaacttcaatatcccaattagagggtttagggcaatgggttttttttggtctcttaattaaagaagattcggaatgatatggggaagggtaatttggaattctgagcgaatttaattatacttttatagatcatgaagaattttcattggtaaataaaatgtaactcccgccctcaaagttttgtatttcgtaaaccaaaactaagaaatctcttccaatttttatcttaaaatccatttaaaaatgcacttcttttttcgttttgaatattttaaagaaaacactttcagatagtagtgtaagagtttccttaaaaattcaaaattaattatatttatttatacaaattccattttttcatataattcaattttttgggtgcctaatttttatttgtttttttaggaatttataacacgttcgcatttttggtgccggtatgcggcctcaaaaaatgaattctttgcaggtcattcacaactacggacacggctcgaatggcattttgttgagttggggctgtgcgagtgaagtgatcagactgatcggacaacaaattgttggggaggagaaaagtcatctctaattggcattgaaaagtaaacaaa

SEQ ID NO: 5592 - DNA, 998 bp, Heterodera glycines
ttgttataggccattcatccaatctccatacttaaaagggggaattaatttgagggttctcgccaaaaaacctttttaagaaagaggaagtgcagccgatggacacagagaattggggaggaaatgggacgaaaattacaaagacgccgagcaaaacgccaacccagccacagaggacacgcaacaaaagttcatcaaacgaaacgagtgacagcgaagtgcaaacgaccgcggcgaggccatcgacagcgacgccggggaaagcggaactgaaaagacgcaccacggaagacacaagcgacagcgaagcagaaacgccggcaaaaagcaaagtgttggcgagggcaactccgaagaagcagcagaaagaggcggaaacggccaaaaagccggcaccgaagccgacggagggcacttcctcggaggactcaagcggatgaacgtggggcgagaaacaagaaccgtacaattgttaatgatatcatttttgttgatcgttgattattttcagaattccactcattttgaaagtttattcataaatttgctaaatataaaattgttagtgttaattgagactcattttccaaaaactgggacaatatgacacctaattcgtttatgtgtgtgagcaatttgtgcattctattccttcatcccttcggcgggtcattccttttatatggccatccattttcatattccataagcattggccatgttggcatccgccaattggtcctgaattgttttttaatttttccgtataaatgccattcacctcaagcaatcggatcctcctctcgtgctgtcgtaagaccactttgattttggccaattcgtcttcaacgcttccactgacctacaaaattgaaatttaaatgagtcattcactaataatgatttattagctaatcaccgcggcagcggatgaattgctcggccttcgcgatgcgttcggtgtcgttgcggcggtgctttgtccgtccgcttctccg

SEQ ID NO: 5593 - DNA, 2496 bp, Heterodera glycines
atttcctcgtcgtggcgtaccggcgcggctcgctgctgctgagggggcgccggcctttgcatcggcggttcgggcggatgttcttgttggcttaatggagtctcgctttctttaaattggcaacttttcatttgctcacggtggcatttgtgccaaaatgtttgccttttttgccacttgcacttttggccccgcctttgctgcctcggggttcaccggaattaaattcggcggtgcgtttttgccgccaacgaattcttctgctgtcaaagcgggtattaagctgcgcgtgtccgggtaaaggtcggccttggcaaaaccatttgttattgaattgcattttcagtccaaaattcatttacttgccacagatcggatttccgaggcacaaagaattgaaggatgtcaacgactccttttgtggtcactttgtaaatgctaaatgcatttttccgttcgtttttcgtccctttgtctcccaccgattgatttcgttttccaacgaattcattccccgtttcggcataaaggcaaatccccgctggggttccgaggttgtgtgcgtgttaatgtagtggacgtacggcgggtcttcgttgatttcgtagtaacggatggcacagtcgcctttgcccatcaaatagcacaagcccgagtcctcatcgtacagcgggaacagcacgccattggacgtgtccaatctgagagcattggacatgacaggcacattattatgggtactgtaccacgaatttgtcactcactcgtcttgcattatcggctgggacaaattgtccgggtgacgaagagcatacaatcgctcggatcgcttggtgaatccggtgctgaacacgcgcccgtccttggtgaaaattgctctttgcggtttgacacctgcgcaatttgccgacattaattagccaatcattaaatttccaatcattgcactcatttgtcttcagcagttctcccactttctcaccttcatggcccattccggagctgagcacggcacctgaacaaatcaataatcactttttcatatcgtcggctgtcattagctgctcaaatgcccactgacccgtgtgagagtccattattcggatcattttgtccttgcaggtggtcacaaacctacaaaactatgcgaataacatcgattaaacaaacatttttgttcgttgtcatttacttgctcccgtcgtaattgaacgaaacgctccaaatttggtcgggatggccggcaacttcgagcagtgcttcgcctgttcccacgttccacaacaacaatttgttctcccctccggcagttattaaaatgcttcaaaattgttgataaaaatattcatttgttgtgccaaatgctttttctcgacttgctcgcagtcggatgccatgccaaagtgttgacgcgcttctgatggccgttcagctccacgacgggctcatggattgtgcggagaaggcccttctcggggatcagccacacctgggcaaaacggggaaaaagcggatgaaaagcggcgaatcgacggggcgggggaactttggcagtggtatcttcagagcaggaggcgatcacgtggtcattgaatggggaccaatgcacttccaaacaaggggccttatgagcgtccacaaatggtatttccttaagagggaaaatgtaattaagtgccatcattggcattgggttgccaatctctcccaattcccattggcattatgccaatctctcccccatttcttatgccatctttgggccaatccctcccccacccgcccaatgtctgactttgtcaatgcgtccagctttgttcaccggaatgaccaggaaaggaccgcccgcgcctttgttgacaattgcctatgaaaaacaacaggaaattattgtctgacagaatttcgccgactgttcgcgacaatccaacggtttttgcagaaaaatgtcggatgactcagcaatttggttaaactcacaatgaatttcgggttgacagcacaaaactgcgagtcccaagacacttcggtgatgcgtaccttaagagatggaatgaatatcccttcaaaatcgctcacttacatcctgaatgcactgttcctgtttgacctgcttacagtacaccttaaggagacaaatgatcaaaaaaagccctgccgttgaaatgctttccaatcggtcacttacgtgccggaatttcgactgacggacaatgcttgacattttcgcttcgccttgccaaaactttcaaagatttcaagcagcttcaatttttagattcacgggcaatcaaggaaaagtcaatttggcttcgatcgatcaaagctgagcgtctaaagggcccttttcgtccgtcacttgcgccttctttttgctttgtgtctccgttcagccgctttttccactcttttgatcaatttgccgagaagaaatgaagcgaatggggggggggggaaagagtgggaggacagtaaagaaaaaagggggaggataat

SEQ ID NO: 5594 - DNA, 4255 bp, Heterodera glycines
  misc_feature (12)..(12): n is a, c, g, or t
ctctagagtctnttgctagggcacagtctgctggggcaaagattcctcaaatccttccattcattccgccgctgttcactcccatcccacgagaaatgtaatgaagcgacaaacgaacagcgaggaaaagagaaggagaggagaggagaagccgatgatgggacacaacagaagcagcagctgaagtgaactcagcggggggggggcaagtgaaatgaaagcgaatggaaagagcaaaaggggggcaaaagggagggaaagggggggggcgatcgacggaaacatcgcacgacgaacggacggacgagcggaggagggcccgcacaggtcaaacaaccgctgccgaagaattataagagttttcaaaatcaaattgtcgagatgaccaaccgaatgagaaagaagacaaataaaacaaacaaaattggaatggtagtgaaaagcattaattaatctaatcattgaactcattaattacctttgagtttctttaattaaatatttaagttttactaagcgatgtaagtgaaacagcagagttctcttcttgttaaatttagttccccttttttacaggtatacggtaattggcaaatggtatcattgagaagctaaaacttatattattaggaacatagccattcttgagctgacttttttttgttgtgtaaaaaagcatttaggttttggtttgattagaagaaaaaatattagtcctaaattgcgtccgaatacaaatggtcagctgcatgagagttagaggcgattgcttctttgctaaaaatttaaattgacaaaatgccaaaataatatctaagcctaagcctattttgggcaattttttgtgccagatttttcggcatagatttgttttgtttctagagtgattgaattcaacggtaaagttttatttattcgctagaaatttcgatgactccaatcatgaaaactagggttgagcggtaccggtaccggtaccggtactggccggtaattaccggtttttttggtaccggtaccggtaccggtttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatgtggtgtagtggttaaactttctacctttcataatttttcgcctgggttcaattccccacttggatagaatattcctcacattttctttaccattattttaattaaaattttaatttaaaaaaatattccaacttttttctttcatgttaagcatcctaaaaacccaaaacttaatcaattggtcatttttttttacaaattctgttaacaaatcgcattaaaaattacaaaattttttcccggcggcgcctatcggcaccgccggccctccttgtcccccaaaagtcttggaaaaaacgtgccgcgtaaaaagcggtgttgaaagcaaaaaaggtcattgatttacattaatttacatggccggaaaccccttcgcaaaattggaaaattggctgctgatcccttgttttgcaataatctgaattttgaggtctatatctgaattttagtgttctatgtactgaatttgaaaaaaaaaacttggtcaacctaatatacatatacttctgaacaattctaatgctaaaaaacaggtactcgcgcgaaaactgaataaaaattttgtatttggaaaattttgtccaaaaatttttatgttctaaaattaccggtttttaccagtaccggtaccggtaccggttgaaaaagttggtaccggtaccggtaccggttttttcagtaccggtcagtaccggtaccggtttttttgcaattaccgattaccgctcaactctaatgaaaacgaaacttaatctggacaaaaaacaaaaacgatcgataaacaaaacgattttttaaatgaacacatagatatagattaatttccaaaataggcttacagtatttaacgactaatcattattagtcttaaaattacagaatttttaaggaccattcaacaaatttaattttcaacaatggaaggcgttgttctagaagagactatggaagagaatgtaatggatacagaatgtaagatataaaatgaatttttatataaaattaccagtttttagtggacgacctcaaaaaaggagcagcggtaaaaaggggccgtggttttgaggggtcgcagaaaagtgctgtccaagtctatgaaactttggacgaggagggctccgtcggaggaccacagcgttctgttgaagtaaaatctgtttaaaatgtcatttaccaacaggaataaattaagggatggatagtttttgttacgaatgtccacgaagaagcacaggaagacgagggttggttgtccgatttgtcattttattttcttaaaatggatttcagtgaaagatctgttcaaagaattcgggaatgtgatgaacatgcatttgaatttggaccgtcggaccggctatttcaagggctataccattgtgcagtacgaaagccaagaggaagcggcagaggccattgccgggctgaacggctacgactttttgggacaggaattgcgagtggattggtgttttgtgaagggcgggcgcgagagaaagcgatgaatcggatgagaagaagacccaatcactcattatttgttcatccattgatcatttgtttggatttcctgcattatttcgaacctcctctttttgctttcttttgtccaatttgtttttgctgcaaaatggaatatttcactaaaattttgtcattagtcttaattacagaattaagaaattgagttgttttcttgcgatggtttacgggacgccatttgaaaagttagaggatgaaggaagtaaggaaagtcggtttaagcacataatttttatcaataacttacagggaatgcaatttcaaagcggcctaagggaattcaagaagaaattgtgacggacgagcgcgggaaaaggcgattccatggcgcttttactggcggattttcggccggttatttcaatacggctgggtcaaagcatggtgagtattggctgtattatactgtatatgatatacttgtttaccgtttgagattttaatcaattttgaattcaggttgggtccctcaaacattcaaatcatcacgcgaagaccgtgccgacaaagttcaaaacacagccgaagattttatggacgaagaggtactgaattgctatataattgggaacaagaaaggatgtacgaatcggtcaaaactttcttgttgcttcgatgaagtccgaattttaggaccttggagagtttgggatcgcagcacgaaaactgcggccaaagatggacttcatcgactcgctcatggccactcccggcgaaaagtgtcttttggcctgggaacgttcgtccaccactttctcctcttcagaatcaggcgccgtggctgacagcggaagtttggtggaaaaattgtcagaaatgcttcgtccggtaaggtaggaatttcgcgatcttaaatacgttttatttgaccaaaaagttattgcattagctttgatttagtgattcgattggtgttcgtcttctcaagaaaatgggctggcgtcccggcaaaggaattggcatgaaaatgagccgtcgtcagttggaacggcaaaaaggtcctctttttgttataatgttgccatttctttttaatttttgacgttcagtgatcgattcgcgcgaggctggtcgccatggtcaattcgatgaggaagccgttctcgaggtcgaagagcaattacgatcgcatttccccatcgaattttcaccggacgatgtgtcaatggtcgaactgagtgcgaaagaaaatgtgcatggtctcggctacaaaccgctggcagaaggtgccgttctgtcacaaaagtacggagtgatggaatcggcactgaaaataaccaaaaagagcaaaggcattcgtggacaggtaaattagtgaaggaaacatcaaatccaatttaagaaatgtgacagaagcgaatttgcatttaaggcttttggtgttggagcctttgaagaggacgacgaggacatttacaccaatttcgacttgtctcagtacgatttcgaagtcggcgcctcaacttcgacggcacaacacgaagtgccaaaatgtaatccctt

SEQ ID NO: 5595 - DNA, 1373 bp, Heterodera glycines
ttgtttctcctcctctccctcttcctccgtttcttcctcctccaaacatctttcgtattacttctctgattccgcctcctcttcctcctcgtccgtttcctcctgctctccctcctcctcctccttctccatgttcttctcctcctcccccatgtcctcctccgcgtgcgcctcctcttcctcgtccgtgtcccgctcctctccctcctcctccatcttcttctcctcctcctccatgtcctcctccttgtcccccttttcctccttcttcttctcctcttgctcctcctcctactccgtgtcctcctcctggtccccctcctcctcgtcccccttttcctcctgttccatgtccgccttttcctccttcacctcctccttctcctcctccttcgccttctttaccaccaccaccttggcctggtccctcttctaataaatttcatttactctttttggcattgctttcccctcacctccttccgcgccatcgccgccttcctttccttccgatgcgaccaaaatgaagaacaaactgagaagagccaaaatgatcagttttcgcattttataatactttttaaacggaaatttaaaatgtttattagtaaaatggaaatgtgttttttccgttcccttttctcacttaaatatttcagtaaattcagcgaatttaatgaatcgcgaggctttccatagagttgtgtacatattacgtgttacagctgatcaaataaaaaatgggtttaatgaatttttaaaagcattgcataattattaggtacgaataaaatggattaatgatttcagggaacttacggcaattaatgaaattgaattttggatttttttttaaatttaattaaaatatgtattatcaaaaatgaagcataacataaattgcctccgtacccatatgtgtccaaatccatacaatcaggagcgctcttatgcaattcaccatctcgtgccccctctgccaatagtagtttcaaatctcatctcgcagttgtagtggtccctggtccattggggtcaaagtagtcgtaacataagcgcacgagtcgttgatcatcgttcgctcaagttgaacgaatctatccctcgcgtattccatcaccaccgtattcctcattcatttgaataatagttttcattccgtacagtcgaccgtttcaattttggcatatccctgtcgatcattgcatctacctcgaagatagcagagtgcatacagttgaagattgtaccaagggtcgcccctcctttcctcccatcggcatatatttgatatttatttttccaattttccccttccattcggtggttggccggcattttggaaaattgtacagatttggttggtgcattat

SEQ ID NO: 5596 - DNA, 1014 bp, Heterodera glycines
agtcgaaggtgtcgactgattagtgggtcagaaaagtcgaaaaaagtcgaaacgaaaccggaacatttggtgatcatttcgaaagaatgtaccactcgcgcaacgcatcagcaatgtaaatttaaccgaattgaaaaattgaattcatttttcagaggcaatgccccgtttttcgggatatttttgtctgattttgtcaagatttcgacgatttggtttggtatccgactgataagctaaatatgtctgtttacaactttggacaatcataaaataattaataattaattacccattttgccactttcattccttcgtttccctttcgcttttcaaatgctatttttttcgtttccgaattttgcttcaattgattattcagcttaacgttggcattttgcaatacgggataaaatggcatttttcagttaagtccattttttagttttccgtgtatatttcattcgttcgttcctcttcagaagaaaattcatttgcatattttctgccctaaccattaatttaattatttaaagaattaattaatcagataacacaaatgaattacacattaatttgcttttccattttgcttcaatttacgctattttgggcttcaatttgtgcagcagacaatggtcctccattaacaattaaacaattaatttatatataattgagtgttttttcaaattccatttaaaatcgttcttttttctttttttacttttcactttttaagtgccttttcatttgccatttcccttcaaaactttcactgatgggcccagcaaaactttgctgaaaattatgttcaattacagcaagaaacgtttctcaattctgaaccaaaaatttgacatttttcctgcggaaaattttaaaaatgtttttttgacgcattgcaaattcgtaaatgaaaattttggaggagtcaaagcatggaaagagcaattggggcgcaaaaaaatgagaaaagccacacgaaattggccaacttttaaaaaattaaaa

SEQ ID NO: 5597 - DNA, 3793 bp, Heterodera glycines
  misc_feature (51)..(51): n is a, c, g, or t
  misc_feature (1406)..(1406): n is a, c, g, or t
  misc_feature (1625)..(1625): n is a, c, g, or t
  misc_feature (1829)..(1829): n is a, c, g, or t
  misc_feature (1851)..(1851): n is a, c, g, or t
acaaacagcataattaaagctgttttttaaacaactgtctgccagttattntggagtttaaaaaaaaatttaaattttgattattattcattaaattaaggtgaattaatgaaagaatgtgtcaccgatttttcaattctacgaatatttttcgaaacggccaatttcattctgcaaaatgcttacatggccaactttgaggaacgtgccgaacgtttagctgatttttggagccaattctctaaaaatgaacattcgaaaccaccacaaattggcattagcactttccaaacgaaagaatcagaaataagtaaaattcttgtgattttttgaattaaaatcatcatccaaaacacagactttcaaaaaataatgggagataggacccgactagacgatataaaaaataaaataccttcagagatactttatgccaacaattttcacactttaaatactaaaacgggcgaagtgttgctgaaactgttaatggccaatattagtggtcgcattttgcaaaaaaataaattgccaacatttgaaaattgtgatgaaattgccgacgaattgggcaaaatgaaatggttggaaaacgcagtaatggacgaatcaaacggactgaatatgaagggaatttacgagaaaattttggaagaatttgacaaccgtcggcacaatcaatattcggcggaacgatcattcggaatgggtaattagcaaaatatcatttgcgttcactaattggataagtgagtcaagggtggccggaaaagccattcccgaaaatgaaaatcaaaattaaattattaattcccatcccaaatatttaattttcagcctgctcagcggaatttttcaagttgcattcgctgaattatttgagtcaatttgttctcagacaaattgtccaatcggcgctgacttcgcaagcgaattttatgtacaaaatatttcaaactgaaatgaagcatttgtacgaagaattgcacatatttctacgagaacattttgggacggtggttggccaaattggcattagcagcagagaaaaaggaaatgacgaaattgaagacggagagacggacggagacggggaagacacaacgggggagagtgacgaggacagcgacggagatgagcagcagaagcaacagcaaaaccaagcagtgccagcacaagcaccaaggcatcgtgaccaacacgagcgcaatgacgatggccatggacatggtggcagaggaaaagccgaagagagtgccgttgcggaggaacagccgcgggagcaatgccaagacgaactcaaacacccgaaacaaattggagaagcagcactaagtgagcaacaagtggaagcagtaactgaaccaacagaagcagcagcagcagacaaagggggaaacggtggntggtgggtggcggaaaaattggcgaatttgtgcaacatggccacaatcaacaagaagggggagacgagggaagagttgaggacacttccgacgaggacgaagtgtaccatgacatggacgaagaccaattttgaggaggaggagaaagagggaggaggaggaaattgcggatgagaaataccaaaacccggaaaattagccaaagaacggaccaattgngggggagaaagtgccaatgaacaatggagaaagtgaaaaataaaatgaaaaggcattgcaattagttttttggtcacaaaaagtacgatttgttaaaattgaaacactcaaaatgacgtagttttgaaataaaacaaaaataaattttatatcttcatataaattcaaattaggggctagaaatttttttatttgttcaccttntaattttcaattcagtacaatnttatgaaatcagaaaaatcacttgaattttccattttatgcttttcaataagctctcaaaagtttctgtttgttcagcttttcattaaatgtaattgacgcacaaaatccattttaatgaattggtcctcaattattcgtgagcataaaaaaagaaaagtagaaatttcggaaatcattcagaaaactttaatttaaaaaaatgaggaaacttccaattcttgctcttattttctgcttgttgctacttacaacgggtaggaaacgtattaaattaaccaattagttaatataattggtctgtgaattcatttattaatcaattaattagtacctaagtaattgttttttcaatcataattataagtgtaagaaaacaattttagaaggaagtatatttcgccgaaaaaacagaaagaaaaattcatcgagcagcgaacaaagtaaggaattagaaattaaataattatttattatttaattttaagaaacacaaagaagaaaccgagggtatggccgaagtcgcactttttcaaatggcaatggcatgtatggccaatcgaatggattttcaaatggccgatttggcggctccagtgtctattcaaatagcggccggtcgaatagctttccaaatggtggatttggcggctccagtggcttttcatcgatgggacataactcgggcggacttcacggctttgggtccggcccaccttctggaggctacggatacggaagcggttttggtggaagaaaatgaaaaaatgaccgaaagtgatcggcgagagaatgatttgtgctgttgccttttatacatgcaaaattaaatggaaaaacgcatttcaccagcagaacacttttttaaatcaaatcacagagaattaaaaaaaagaaaagcgaaggaaaccgcaaaaaaaaaatcacaaaaaatcactcgccaatacataattggcttaaaaatcggtctgtttcgtttcgcaatgcttttaggattcatcttcgtcccaattgatcggctttttatcagtccgctgctgctgaaaatgccaacggagccatgccaagcatatgcaaaagcaattgagcaaaacaaacgcggggacacttctgcataatattgatatattaattaataaagaaatgaaaaataatacaaattcactagccttcgcttttcattttgtaaatgaaaatctcttcggaaatttcccacaaaattttcccgaaaatccaaccaattgggccatttcctatcataaagtgaattgatctgacgtttgaatccgctgggcttcgcaacatcaatcaatctggccaattccaggccaaacgagaacaattcgtggataaaatggaccgattcgttttgccacattttttggttattaaaatattttatttgcaaattccatggtgccgaagtctcattctccataatgttgtttataagtaatttaagttttgtgcttatcagttcgactaattgacaaatacttttctgcctataaatttttagatttttctatgttttttcagctcaatttgttcgtcgatagaaaatgaatgttcatgaaaaaaatggactctgatacattccagcaaaaaatcagggatatttttgaaatggccattccaattaatgctaattaacttcggtaattgctttgggttgtttgcgttgttgttattgctccttaattatttaatgaaatcgaaagttggctttatcttaaattgaataacacagaacctcacattttagtgcatttttcttcgctgattctgcgtttctttaatgcgacatcggaaaattccatatccaaatatgccagaccccgtgccacatcggagtgccacttttcgctaccttcaattttggcaaaatcgtcccttaatcggctaaatgtggcaccgacaaacaaatgcattgggcacagttt

SEQ ID NO: 5598 - DNA, 1584 bp, Heterodera glycines
atttcaaaattgaataaatgcgccattacggcaccggctaataaagtgtcgtaactgcgcactttgcttatcatataagtgcctaacaatgaggaaaaagaattttagtccgatttctatatttaaaaactaattaatatttttaatttttgaaaaagtaaatttttttataacaaaatgaattaaatccacgcgttttttcttttaatttttttggcattttttaatccgtgccatgaatgtcttttgcttttgtctgtttaccattttttaaactcgccccgcaacaagtccatcatctcttgcacattcatcagcaaatggttcggctctatcgctttccattgacgaatttggtcggcaaaatcgccaaatattttatggacattaattaatgcaaaaaccagcaaaatatagcacgtatttggcattttttatgcaagaaaagcttaaaaaagcaataaaaaataaataaaaaacagaaagacatttatacaaaatgataaaaataattatatataaaataatttgctatttgatataaaaatgcctatttgttaattgattataatctgttttaatagatttatgtaatacatgtgaatattgcatgaatgttgaggaaatctgcgaatatgcattagcaaatatttttatttaaatatatgtttcattgtcaccaagcttaaaattggttaaaacggtctaagcgatctaaaaaagttagaattgatggaaaattataattagaggcgcgattgcggttagcattctgcaggtgaaaaagtgtcgcgacagaagtgcccatttatttaaacttgtggattatgtatgtacaaggctgcagacgtgctaacttatcatcattttgctggtttcaaggggtcaatgatgatttttttaagatgatgatttgctgatttttgggaaatttgctgatttttttttacaaaactgggcacaattaatgaacaagtcaaaaactgtttttcactttactatttgtagaaaattttgatcagaagtatcaatcattcttcattcgtcaataatgccatcgtcggccaaacaatttccagttgggtcgtaaacgcacggaaaacggaagcattcatcatgggaaaggcatccgttttcgttgaaacgtacaaagaacagaccacttgccaaaagttagctttaaaatgctttttcaaaatgaaaatggataaaaatataatatttttaattttttgtacctccaaattctgaaaaggaccaaaagtgcctttttttattggcatctcatcgacccccccccccccccccacccgcaattgtccttccaataattacttacattgtgtgccaattgattttgcttggggtcgatacaaaacaaattaaaaaggcaaaaagaatagcgaaatgatagcagaaattcatttgaaaaattgcaaaaaaataactgaagaattaacaatttataatttaatgtgtaaaattcagcaaaaatgaatagtcattttccggacgtaaaaattaattccaccaattaacggaagtatttaaataatattttataggagccaaaattaattgatt

SEQ ID NO: 5599 - DNA, 2659 bp, Heterodera glycines
  misc_feature (25)..(25): n is a, c, g, or t
aaaaatatttggctctgttacactntaggcggcgcccaatcaatgccattctcagtttcctatgccataacttttttctttgttggttaatgcagacattcttggtaccaaacgaaagctaagtctcggaaatttataaatagaagaaaaaagcaaataatgatattaagaaaaaacacactgagagacgaaacccaacttttttcgagtaaattataaaattctatagattttaagaatttgggaaccaagaatgtgggcattgatcaagtaagaaaaaagtatggcataggaaattgactaattgtgagggtggtcattgattggacgcctaaagtgcaaaagaggcaacatttttgaattaaaaaaccaaattaaaaaagcgggccacggcaaaaattggagggattgggcgaatgccccaaagggacgcgccgcaaaaaaacactcacaaatttcgccgacacagactttgctgcccgactttgtgctcaggtcgaaatcagccgacgcacagaaagggagggcaaattggaagagcaaaaaagcggagcaaactgaggaagaaaaggatggaagaaaagcgacgcttttggagggcaatggcattggaatttgagataattaaactaaaaaagaattccaacatgtgaaaagggcaattggggcaattaaccatcaagttaattgttaattaacggcaattaattaaagaaattggcaatatgaaaattagcgctagtcaaatactaaactttttgagaattattgacaataagggacacatatccttttggctatgattttttaagatatatcatatctagccatgaaagcgggtagctagctgttcatgaatcttgtactcctttcgaatccccaacccgggtcaaacaaaaaatcaatttcgaaaaccgtattttgactttttttgagttcggggtagagattagaattggtaccctttgaatttaacaattttcaataaatttctttttgattaacgccaaaaaattgttcaaaataataagtgcaaatacgtacatatatattattacactacagctgggagtgtgctctttttgtggtctttttggcccattttcattatggccggccgccctccgtccaaaaaatagcaccgattttggccaaaaaagcttcaccttacgccccccccccgtccccgcctccgtctgtttaatgcttctgctgccaccaaaatgcgttttatctgtcgtcgttttctccccaccccttcctttctctctcgctcctcctctttttctcattccacctcattatttccccaatgcttttcgtgtgctatgacgaagtacgaaaagtgcaagtgatcaaattaaaagcaagataattattaatttaataaataaaaatttatattttaaaagcaaaaaaatatatatttgacttcgagttttcttttattgcttatgctttgttaacattgcgcaatttggcctatgaagacttccttaaaaatcaagaagaagcatctaataaactttgggtataaaaatcacttttcgtattttgactcagcacggcttttccgtaaatcctgactggtgggggcttaagagttaagtcagggtttcgatatctgaggatttttcctcattttgtggtctttagaagggtcaaaagaggacttttttggaaaatgaggatttgcggatttttgtggtcttttgataaaaaaagtgacaaaaaacggatgattttttgaaaaaatagggtatattaatgttcgaactttttcttcaaatcttaaacattttttcgaaaaatcctcatttcgcactcaaaatcccaatttttttccggcagcgcctatcggcactgccggaccccttcccccccaatgttcccaaaaagttttttggaaaaaccgcgccacgaataaagcaatttaaaagcaaaaatattaagtgaaagaattgaaattcaattattttattttatttttttggaggttttaaataagattagttatagatttttaccaaattattaattttgcgattttaggcctattttttaagaaaaaataggaattattggagtccggcggcgctgataggcgccgtgattgtttcaaacgaaaaatatgacagttaacttattttgttcgaaattttatgatcttttaaaaaatgaggatttttcatgccaaatgaggattttcaaaattttgagatcgaaaccctgagttaagtctgtcaaggtcaaataaatgcgcacaaaaatgggaatctgtgaattcgagtgcacggaatgatgagagattgacgcacaaaatgtttaggcaatttttgaaaagattcaaaaatgtcataaaaatttgaaagaaaaaaagaataaaactaattgaagaaaaaaaataaagtaaataaaaacggaatgaaaaaacaaacaaaaaaagaaaagaaatgggagaagaaaaaaggaaaaatgagagaaggagaaaagggtaaaaagagggagagaaaaggggcaaaaagagaatactcaaaacggcgggagaggtcgtcgcaaaatgttgtcttcgatcaacgacaagaatttgtaaggcaaaatgaaagaagcgaaagtgaatggaaaaggaagggggaaagtggaaactgagggagagggg

SEQ ID NO: 5600 - DNA, 1915 bp, Heterodera glycines
attatcccccccccccccccgccattcactaaaagcgggcctttgaggaaatggcaaacacttttgcaaacatatgaccaaactgatcaaaaaaatgccaaagtttctttgtctattaataaatccgataaattattgtctagcgaaaaactgtttaattaaaagaaaggtaaagacgcaaaataaactcttattttgagatatgaagttgaattttttgtccgatattcagtaattagcagtggtaagttatcggaaaatgaattttaattttaagacaattaaatgaaattatggcccatgaaacgcgacggaaaatttcgactctcgcacagtacatctctattagaacgagagagagagagaggggcagagagattgagagagagagagggagagaaaaacagagagagaaagaggagagagaggaggggggggggggagagattgagaaagagacagagcaacggctattaggtcgctcattttttcttaatttaattgtttcatttttgaactttctgttaatcaccctgcttaataaatttaatccattcaaaaataagtttcggaaaagcaacggacccccaaccccaaagagatcggcggaaacccaaactcacaatcactttgctcggctgatcagcccaatctccgcctaaactcaatcccacatcccagctgaagatattagcagccatcgcactttttctcaggaaatccaatttaaattcgggtcgcattttaacaattttcgcgcagcgcctttctcacgccttttgttggactttgtttaacttttcaattttttacataattcacattaaaacaattaattgtatgtacttaattggttttttggcttgggaatgatcagcagcagaaggtgatctctgttcagaaaaaactagggttgcgtccccgaccccgcccccgaccccgaaccccgacatttttggcctttttcggggaaaactccgaccccgaaccccgacgcttcataccccgacaaccccgaaccccgacccttaaccccgatcggggtcggggttaaatatacacccctaagaatggcattttcgtgggagaaaatgcaaaaaagttagacaaaatttgaatttttttaaccatttgccaaatttttattaaataaagaaaatttgctcgattttagacatttcgaatgtggtgtagaagttagtgcatcacattgacattactttctgtcgtgagttcgataccgtttgacgttttcttctttaattattttctttgttacaaattgttttttttaaattaaatactcatagaaatcgaccaatcttggcatattttgacaaaatacatatcgaagaaaaacaaaaatttaccaaaattcataaatttttttggtgaaaaatcttagaaaatagagcttaattccaaaatttagcgctgcctatcggcatcacagggcccaaaaagtcataaaccttattaaaaaaattggctcaaaatcgcaaaaatttagcatattttggacaaaatctgttaacagatctaaccaaattttcaaaattttcccggcggcgcctatcggcaccgccggacgccgtaccctttctcattaagtctttagaaaagagcgacgtgaaaaaagatgttttggaaaacaaaaaagtaataaaaaattttaaaatttcaagaaaaaaaaattaattctatacaaaatttctgataaaaaagaaataaaaaaatataaaaacaatacaaatattattatggaaattaataaatattatttccgaaaaaatatttaaaaaattttgactattaggcataaggtaaaaattgaaaaccccgaaccccgaacgatttggcaaccccgaccccgaaccccgaattttccaaccccgacgtcggggacgcaacccta

SEQ ID NO: 5601 - DNA, 2780 bp, Heterodera glycines
gccgattggcagactggcgatgatgctgctgagaaagcagcccaagcagcagcagatcattgtgtggtgttgagttaacaagttctgtagctgtacatcgcgcacactttcagaaaggcggagaaagtgccctcaggggaaattggggggggggggaggggggcacatagggacggagcgtaagggtgtcacgaccgaaattatatttatttgcaacgcgtaattaattattgtttttagaaaaatgcggaaatttcggcagcaaattttgtcacttttccattttgtggtgctgcatattttaatcgcaattaatagcagaataataaatggtaattaattagcgttttatcaaaattttcctctgttttgggccaatttgcctccgatgcgccggtgtccgtccgcggcaacccaaattacgacggacgcgcgctgaacattccgctggacttggatggcacgttggagctgtaccaacactggatggaccaggcataattaacgaactaattaattaataatcaatcttacggtgattaaattgtgggttaaaatttttatctaaaaagtttgcttaatttcgtaggcattcagcggaatgttcgctgccgtggccaatcaaaagtaaattaattcacaaataattggaataaaatttattttaaaaattaaatgtaataataaaaaatattaggatgtcaaaaacgagcgaaaacgttcgggaagagatgggacgatgctcaaaacaagttggaaaatggaaaatatttaaattaataacaataaaataataataataattaatatttattaaatatttatttaatgaattgtctgtcattaactaattagggcaaaattataggtcaaagatgttatatcgcatgcgaattgcttgtcaagattattgaaaggcgaatttgaggacaaaaagcccatttttcagaatagcaacagcccaatggtgaaaaatattgaaatttcaataaataaattaaattaaattaaaatccgccaaaaatgattcaacagaaaaggaagtcgcggttggaattgtacaaatcaaaaggccaacaaaattacggcatcaaaaacatggacctaatgtcgtcaaaagtgccaaaaaaattattggcgcaaaattacggcacaaaatttgccgaggaagacatgcaaaagcacaagcgaatgcggcggcaaagcagcggaaaaagtgggcgaaaaccgacaaaaaaaaatataaacaaattttagacgagaaattcttcgtgaaaacagcgcccaaatattttctgcgcgaacgaaccgcccaaatgagcccattgggagcggtggcacaactgctgacaaagtcgctaatggcagccaaaaataaaacggaaatggccgagtaaaacgaattaaaatataaaaaatttaaatttaatatttgggattgactcggcgctttgggaagcgttaaattggctaaaattctctttcaaaaaatattttaaattaattttggtattcaaaaaaagccattttaaagtgttgttctgaatttaaaagacaaaactcagttcagctttacagtgttttaaatgttttcagatggcaaaatacgatagagaaaatccgacaaacttcgaaacggagaaaaacgatgagaaaacagaaaatggaaccagaaaaaggcaaataatttaaaaaaaaaaaataatataaataccgtttcagctttattgaaattgcagcagcaaattgcgggaaatggacaaaataataatgcgggggaacaaattccatttggagaggtaaaaagggggggggggaattgaaatgggcaattaaaatggagggggaataataaaataaattaaaagtgaatttatttttaaatggggaaaattaaaaaataaaaagaaggtgctaatggcataaaatctaaataaacccagcaaaattggtcccgaaatctgaataaggaatgcttcagctttcttttctttcctatctctgccgctgtactgctccaactttgtgcacaaagttggagcagtacaaaaaagcgtagaatgagtgataggcaaaaataaaagcaaaatgaaatactcaccttttttcagggtaacttttataaaaaatatactcttgagtattttaaaccatttaaagaaaagaaatttcttaattaaaagatggacgaaatattggagcgcggaaatcggacggaaattcgtcaaatcattcggatggcacagcgccaaaaatcggcacgacgcaacggcaaaaaggacaaaaaaatggacccggacaaactcgtccaggcaaattgagggggggggggagcaattagcgaagcaattaattaattaactaattaattttccaattggcttcagttggttcgccagggcgtcactttgggctttgcgctggcgggccaaaacacgacgggttgggacgagaagacaatgcgattggtgtcaccacgcttcctgagtgtggtggcagaggaggaaatggcatcggacaatgaaacggtggaaaaaatggaaaataatcgaatgaaaaaagttggcacaatgccaacggagtgaaattggaaaaaatgacaaaaataattcgttttatttttagtagagacccgcacgatcggtttttgattcgatctttttcggtttttcggtcttttttccgataaaaaactgatcgaaccccctaaaccggtctgtaatttttagctatcaaaaaagggcaaattattattatttttaaattgagttttctaattt

SEQ ID NO: 5602 - DNA, 2298 bp, Heterodera glycines
tttttgggtttttttcgttttttttttcgaaaaaaaaaactggatcgaacccccctaaaccgggtttggtatttttttagctattcaaaaaaggggcaaattattatttatttttaaattgagttttttaattttgaatatttaaaaaaaaattgaacattgcaaatgctcattgttttcgttgttctttttcaatttaaattgccatttttcgacttgattttttttttgaattttcactcctttttttattttccatttaattttatttaaatttaaattttttatcccccttttttcgttttctttttttattttccatttttattttccaatttctcatttctcagctgtcccttctgtccccctcccttctgtcaatgcacgacgatggccaaggcattgaaaagttcgcctctttgccctccctttttcgcgcgctcaatttgcgcgatcagcagcaatggctcaatttgataatggttgacccctaattaatttggccaattaattacaaaacaaatttttcgtcgcttttaggaagccgcgggaattaacgaagaagcgaagaaaatagcggacgaaacggagaaagaggaaaagggtgggaaaagaaaaggaaattggaatttaaaaaacaaaaattggcaattgttgcagaagttaaaactgtgccaacaattggtacggcggcggacaatggcacgagactaaatttgaccgaaatttggaaaaagtcgcgcggaatgtacgaaaaagaggtgcccaaattggcattcaattagacaattctcaattttgaatgtgaaagatccgtggcgaagatggccaacctttgtatttcacgcgcgaaaatgtgacggagcgatacggagaatacgaaacgcgcaaaattgacttgtgggaaaaatttatgagcacattttccgagaagcaggtgctaattgggggggggggaggaaaatgaattaaaataaaataatttaataaagaaattcgaattgaatcggactggatttgtgccgatgcggccggaacagatgcgaatgatttacggggcccagtcgccgttcaatgacacggaagtgcgcctgagggggggggggaattaaatggcacaaaatagcactgatcagcagagtgatcacacgcactaattggctaagtgatcaaagaatattttgaatatacaacacaaaaaatgattttccattttggcccgaaattttcatggattttccaaatgttgtgatccttaatttacgcaaattaccaaatgatgcttttttatcagaatttcgaacttttcggctaaatttttagtaaattaattatattttattcatttcatttttaggctttgcaccgtttgtcttctctgaatgagacgcaaattcacgagggaatggagagagacgtaggcacaattagtccacctaattatcaactaattaattaattactttttttaaatttttaaaacgttctaacatttatccgtctcagatccacaacatcgcgcgtctgaagcagtggcgccttcaataccatccccgcgctgagtttcactcgcgtcggcgccgtgccgtcgttttgtaagcgtcaacaactaattagttgactaatggtgagttgactaattgcgttgcgtttttatgtcgccaattgtctcctcgccttttgttctcgccgcccctgggcttagccaagcggtgattctgtcgcccgttgtgttgtcgccggtaaattccattcaatgcgtcctattttcattggtgctatgccattagtcaaaaacggtgccaggtcgtttcgtaaaaactgccaattttacagatttttcgagaaaaatctgtaaaattggcaatttttcacggtcaaaagcatcaaaatgggcgttagtttagtcaaaaaaccatcaaatcaaaatgtttttgatccaatttcaaaagcttgatattatcgatagccctaaatgttttatattctcctgcaaaattttaaaaattcgctgagtttcaaaaaaattaaaccaaaaatgttaaaaaatttggttttttttccccagggcataacttttttttaaatctattgaatttttagaaaattctgcaggataatagaaaacacttggtgctatcgaatgatgtcatagttttaaaatttggttcattttgggcgaaatttttgaataattttctttcaaaattttttccatttgatgggtttgactagggataagccccgagccctcgggtggcaaaaagtcgggggccggggacctcggggggcgacatg

SEQ ID NO: 5603 - DNA, 2874 bp, Heterodera glycines
tttctccgcttcttctgctcaccaaatgcggaatcgtcgaaggcgaatccgtgaaaatgagtgagtgcgtctcgttggcttatcgcattgtccggatcagcagacgcgcggatgagaataaggcgagggggggggaagcggatgaccaattgaggaaagggcgggggacgggagggatcatggatcatctccacggatgatcacctcatccatcgacccacgcccctgattcatcttcagcctcagccactcactcatccgtcgatccgtagagaagaggagtctctgaagagcggtgggacgtgatctctcccctcttgggcccggaagatgctcatgcagatgcttaaaacatttcttctccttttttcacatgatcacacaatcaatgttttacctgacaaatagtgctcgagatgggtagcacatcgtatccccctgttatatcacgcatcaatatttttctgaactgcacaattgccttcagaagaatctccgtatcattttggcaatatgattgaagctcgtccggcaaatagaagggtgttgttgttttattttcctcatacctatgggaaatggggaacccccaccactgaaataaccctatagttttgcttaccaactgacaaatttatcgtatttttctcgtttcattgagccagcacagtagtcttctattggcggcaaatgcggaagcctcacgtcatagttttcccttaaaagcattattttttgacaaatgtcacagctttcggaaaaaccttcggttgaaagcatagggaaaaaaaggtttctctgcacagtccaaattgaaagtttttggcagttgatcgagacgaacgggcatcagaaggcaagaatctctccagatgagcagagaattttgacggctatgctgcagtcgaaactcataaattttaagcccgttcatgaccacatctggacgtcgactggtctcgcccaaatactttaaaacgaaatgtccgtcaaaacgagaagagttgtgtgcctgaatttgagctgatcaattcgaggctaaaatagtcagcgaagcaaaaaaaaaacaaacaacaaacccataaatacgtcttgtgtttattgctccaagcacggagaacccattcgacaaaatccctgagcggttcatcaccattcgcttcactcctgtcggcaaaaatgtgagcaagcatgtattaagaaaggaagaagaaccgaccagtccttctttctgcacaaaattccctcctcggttgtgcatatcgcacattctacgcattcgcctgtcacagaatcgcagcattccgtgcacgtgatgttgaccgacaaatggttaactttgtgccgctgatgacccgcttcttgtaggtgttcgagccgcgtttccgtgtcccagcacaaaatgcggtagttttgcttttgtttcgggacaggaatttttttgatgaaacaagcagcatctttttcgtggtatacctgcgcatttttgtgaaaaatttgttgtccttatccaccgcttaacaaaaaaaacgtacattacagcgcccacaaaaactggtgtaacactggtgcgggtttttggcatcattttggaatgttcgactgcattttgtgcatcgtttcagcagtctgcacgcttgtccgctccgatgagcatcaaaacaaatgcgtgaaaaaaagaagcgattgcattgagagcaatgtatgctgacgcctggttccctcgcacatggttgctgtggtcctactgtacaacaacaacaacaatgaacaaaattttgcgcacacggcccacaaaataacctcttgtacactgagcacaccggcttttgcatgatatggtgtgtttggcatcagtggtgtagacgcattcgcagtcaatacaatatttacggccaagcttgaaaaaacagttgacttttttgattgcgtcgaaatgtccgccggacatgaacaaagcgaccacaaagcagcgccccatcggccccttccagataggcctcggtagttcctcagggcggtcctcaaacagcacaatgcggtacattcccggatagagccgatcctgttaaaaaaaaaaatttgccaaattatgcggcagaaagcattttcaaaaatggcactgacccaatggttttggacatgcgggacatgctccaccccgtatgcttgcccatcagggtcaatgccggcatgcagcatcaacccccggaccgcttcttgcattcgacccgggctggacagaagacgattcagtacttcatgatttgcgcaaaaatccggcctcctcatcactgctgttgcagcagcggacggcacgttaataagatgatcactgctgctgctgctgcttacgtccccttgatggcattgttgttgctgtggtgcaatcatttttgtcaagtcatgatcagtgtaagaacgggcggcaatcaacgcgtggaacaggcagaaatggtcaccgacattccgtattcggatcaactgcctttcgttgtaaccccagtgctgataatggtggaagcgcggagctgctccaaccggcggtgcaatgcaggtgatgacaatttgaaccggttcactgagcaacagggatcgcttgctcattcctccgccatgcacgtcttcgtctccgtccgactgtcccagcttttccagttcgcccatcagagtgtcggctgtgttctgctcaggtggccgtatcggtagcacaatagggtcagttaggcctatatgatgatggatgttcgatgggggcatttgccaacaaacaaaacaaaaaaaaatgagtaccgtttccatccagaaaaattccaatctttgtcactcgtcgtcttgggctttgttgagcggcgccgccaccgtcttgtggct

SEQ ID NO: 5604 - DNA, 3250 bp, Heterodera glycines
agtgctgcttctcttcatacaattggtcagcagtagcgccccctttttcatcatcatcatcatcattagcttccggattgctggcgttgttttctgcttcccggcggtcattatcactgccgccgccgccgccgccgccgctgtcaacattgttgttgttgttgttgttccgctgtgattacctgctgctgctgctgctgctggcgctctaccgtagcctatttgcatacaatggtcgtcgacattggcgccactgttattgttgtcctgctcatcatcatcatcatcatcatcaaactctgatgatgaggaggaggagcgctgctcaaagaaggcgactgtgcgaaagtcccatctgcggcgccgccgcttctgtcttttcgctttacgtttttcatgcaaattctcgagaagaggaggagcagtggtagcagaagcttcgtgatgatgaatgtctgttgcgttaacatccgcttcaaccgccggctcaggagctctcctcttcatatgctgattagcaaaaaaacacatgtgtgtgggaaacatgagcaaataaaatttgtgcttcatgaacagtgtggggtaggatattagtgtatagtatacagaagatatttatcatttaataactattttatgatagggcttctactacaaacgccattaatagctaattgggaacctttggctcatctaaaaaacactgatatttccgatcgctgtgtgtgtgtcgggtgcgacacagattcattcggtttttcttggacgcttcggtggcggcattcgcgtgcactcagcatcgtcgatcgtgtagatgtcatcatcatcatcaccgtcattgccgtttccatctttgctcccgcctttttgcgcatccacactatcatcaaccgccgttacctgctcaggcacccggattgaactgatgacccagtccagcgtctcaccttttgccttgaaaattgggcaaaatttgtgaaaatgtcatgtgcgcaaaatatttaccttgacaatcaatttgagcgcgatagtttcttcaatttttgattgaagcagggaggccagcttctttggacgctgctccgctaaacgtgaaaactcgtcaatctttaggccaagatatttgacggccgtggatgaaaatgcggtaatctgcttgctcgtctcaatgtcttcacagtcacgcaaatcgatgcgcaagtaaaggttgttcaaaggcgagaccgcatggtgatcgcaggactcacaataaagcgcttccgtaagctttttcttacagggcatgcccacggttttaaggggacatgcctagattccataaagcaaattgaattgttttagagagtgagtgtatgagtaaatgaccttgtaaagacagtactgaacattatcgacgactgcgcgcacaaaaaatgtgccaggtgaattgaactgaatcacttcacttaaatttttaagctgcgcaggaaattcgtcggcagcagctttttgatttgaggaaggcacaaattgaaaacgcataagtttgtcgctcattttgtcaatgttttggcgggaaaaacggctccaaaagtaaaatagaattaaaatggctaaaaaggtttaaagtactgagtagggattaaaacatatattgtgaattactaaaatttgtgaccccttgatctatctccctgcctaaaatggtctcctgacattttttggacaaattataaaaatgttcgacttttcgaccttttgttcgaacttgctattttggtctgagaatgtctcgaaatcattttgaaatttgttgtgaagaatttttttggtcttctggctactctagggctcgaaatgatggccaaaaatttttcgaactgtgaaaagtgggtctaacatcatttttggacaaaaatacgagcatttttacccctttggggtaaactctagtctgtaatggtctcctgaacattttgagagaagttcgaacaaagttcgacttttagaccttttgttcgaactcgctattttggtctgagaatggctcgaaatcatttttttattagttgcgaaaattttttggttttctggctgctctagagccccgaaataattaccgaaaatttttcgaactgcaaaaagtgggtctaaacgtcatttttggacgaaaatacaagcttttttaccccttatggggtaaacccatgcctaaaatggtctcctgaacattttggaacctattctaaaaatgttcgacttttagaccttttgttcgaactcgttatttttgtctgagaattgctctaaatcattttgtaatttgttgcgaagatttttttggtcttcttgctgctctagagcgccggaataattaccgaaaattttacgaactgcgaaaagtgggtcgaaaagtcatttttggataaaacaatatgcgttttgaacccttgaaactattccttggctaaaatgatcttctgaacattttgagagcagttcgaacaaaaatctaaaagtcgaacaatgttcgaactcgttattatattttagagaaggggtcgaaataacagagaaacatttttaaaaaaaaattaagtaattgacattatgacctatttttttttggcattaaacaacaataagctcttttgaaacggtgataattaaatggccgggagggtactgaaatggacgggttcaacaatgatcaaatttgaccgatggggtaaaataacgcgcattaagaggggtgggactgaaataggcaggcccaggtggggctttatcgatgagaaacaatttgaagacaatgagccagagagctttggaggccatttatataccgctgttttcggtccattaagacttaatggacaggccgttaatggactggtccattagtgggtcctgctggcccttttggccgttaatggaccgaccgctaatggactggtccattagtgggctaatggactggtccattagtgggctaatggactggtccattagtgggctaatggactggtccattagtgggctaatggactggtccattagtggggtccggctggcacttttgccgtaatggaccgaccgctaatggactggtccattagtggggtccggctggcacttttccgttaatggaccgaccgttaatggactggtccattagtggggcccggctggcactttgccgttaatggaccgaccgctaatggactggtccattagtggggtccggctggcacttttgccgctaatggac

SEQ ID NO: 5605 - DNA, 2164 bp, Heterodera glycines
  misc_feature (2095)..(2095): n is a, c, g, or t
tgtttttggtttagtaggcgaaatgaatagtaggcgaactgtccaattttggcttagtaggcgtaatgtcgagtaggtgaaaaaatgtcatatagcctaatttaatttttgaaattcccttatcccctttctacttattatttatccattcttttccgatattttttccccgaattctccctcttcccatgactgcagggttttgaaccaattttaaatttttttattttatccgtcggtgtacaaatgtattcagatgcttctttcaaaaaattcctttctgtattcgacgactttttcacatttcagtccatcttcctcaaaaattttgcatcttttcctttcgacttccttcgtaaaatgccaacaagcacaagatgaagaagcaaagagtgaagaaaaatttgaagaaaaagaaacaaacaaacggcagcgaaaagggtcaattctgaaggagaaaccgaactatctaaagcccgtggaaagcgcgtggcaccgcttccttcggtctattggcatgagcagtatccggcaaaggccgaggtcaagtgctggctttgctgacaagcggtcggggtttgacaattgggatttggatgtgccaatggaaattctgctgaaggaagcacccaaatggtacagaaaacagccaaaggcaagtgcttactttagcaatcaaaaacatttcataaaacggatcaaattaatttcagctccttgcttctgaaatgtggcaacgaatcaaagaccgagttcttatttatgatcgaatgggcaggggaacggtgcacggcgagacatcaatcaaatatgagtttaaaacggacgaagtaaataataaaatcgtgttttggttaaactgaaaattgtcaggattttgggaaatggctgaccggatccgactcggaatggagcgagggcttttccaagtgcaaattgtacagaagcgaccgtggctcggcaatctttgagggcacactcagcacacgactggtcaaagtaacgtcacaattttaaaataaacttttcaaaattatcatgaaaaaattctctgtcaaacggtaaaaagtaataaatttttgagtgggaactaattatggcttcgtgcaaaatttaatttggtttttgttcgaatttggggttcagattgtcggcatggatttctatgtataatcaccgaccctgaaaaattcctgacttttgttattttatttttttatccaaaaaatactattttaaaaccatttctggcgattttggccatcaaattggaaatcttggtatccttcgaaagctctttccatagtttaaaatttcaggatggtaaaactcaaagagcaggatggtgttcgatgcgttcgctgaacgacaaaaaagccttcgataggaaaaattttttttcggactggtcccactacacccatcttctgatcaaggtctaagcaacaaatccttgcaatttcaatattttttcttttaagtgccgtggcgatggtcgcacttacaaagtgatgttgcacattccgcagtttatggacatcacttggggcaattcctacacgtatttgctgcacacccacggcggcccccattggcaattcgaaatgattcccttttcacgcttcgttttcacagtcgaagggcgtgcaattgatgttcaatatccgttggaccctcgggcggcgaggtaacgaatcggtctgaatttacttccctgtgagcctaaaacttttgagctcgattggaatcactctcatggacagaattgaggggccatttcgtctggaaatcgactttattggtgccacacatgacataagtcacctcgaaaagcatgcttatgagaaatacaatattcccctaggcaatccgatgttgtaattgtttccccccgccctcttttccgccgtttattctttattcgtttaaataaaacaacgtctgtagcacatgtgcttctcgcttggtaatccgttattaattttcaatttaaatgtttcgtttattcggtcccactaattcgtcttccgtcggatttcgggcggcgtgtggtaagtgaccgccaactgaaatctcatagaaataaaaacagtgngtacaataaatttgtgaatttttgtaccaattgtgtcaatatatgcggtttgtgttgatgggctgagct

SEQ ID NO: 5606 - DNA, 4516 bp, Heterodera glycines
ttatagatcggagtagagctcggcctgtacttggatccaggcctgtatttttcctggatccaggtacaggcaaattttcggcaacatgtatttttcctgattttcctgtacttttgtccagaaaatacaggtacaggccaattgggaaatacaggtacaggtacatgtaggcttttttcaaaatataccgagctctagatcagagttttgaaaaattccgcagtattttcaaatatgtaaatatataacgccaaaacttaatgaggaaaattatatttgaaaaattctgcgtttttcgtaaatttatcgggatttttataaatgtaattcctgtcctagttaggtttttgatttttttataaatacagctgggaatgggacctcaggcccccataagtttttttatttttcgctttagggccgtaaaattaaaaattcacaaatgtttaatctgtaatttcgattttaactttgaaagagcgagagagagagagagagaggaaaaggcgagagaaagaggaaaaagagaaaaagagagagagtgtagagggacagagaaaggaaaaaaggaaaatttgaagagagacgggaagaggaggagagaaagagagagtggaaggaacatttaatcgattacttttgctgcatgaaatgaatgttttgtgagttccgttagttcagttcatgtgactaaatttatccgaattatttgggctaaaccacaatggtaaatcactgaagaatggatgagaaagccctaattaggattgtttttactaattatgcacaaataaactaacaaactcagagagtttgctttgtttaattattctttttagaagttatatttaaacaaagaaacggttaagctaccagcagtaataatacctactaagtcagttgttttctgtcaccaatgctggttagtgcgcctctcatccaacaacagcaacagcagcaagtgttccaacaacaacgcccttccacttccgcttcttccgccgatggtcccttttgaaaaccctttaaaattggctttattagtgtttctttatccaattttagctgttttgcttccgcatgccacggaagcttctgcaccaactccctatcagcagcaacaaacggaggatcagctcgaattgccgacctccgtaccctccgctgccgactcccagcgccaacaccgcgccacccaacaaccgcagagattcttcaaatccggatcggttggttacatttactaaaaaatcattaaatactgggggtactttgtgcagtttacggggcaaatttcacatacattttcaaaaaaactgaattttagaaatcaaagaaaatgttttatggggttttcgaggtcgctgatcacgaaaccgggctcagaccagcggcaagaagcccatgagaattcgaatttcacatacatatatactcttaatgagtttaaataatcttttattgcggtttagatgactttaagctcattttcatgtattttaatcttgttcggtccaaaaacttcaaattcgaacatttttaattttcgactttttgttcgagttctggtcaggggttcgaaattggccgaaacggatgcctcgtcatcaccgacctcaaaaagccccttgaaacttattttcattaatttttaaacataaccatgtaaaataagtacatttataggcatttgaaaatgtttgttaaatctgccccgtaaactgcacaagtaccaatacatgtgcaagtggtgccccaaatgaacaacacgaccataaaatatttgacaattttaatgcattgtacaagcatcaaaattaaacattattggtattactaggtcgttgcataaaaaagggcgctttttcaaaatgactttttttaagacttgattaacgtttgttatgtcttttttgtgtgtaattcttttatctgaatgttctcgtcatgtttttgccaaaaattttgattttgtccttttatatctaaagttacagtccaaaaaattgggtaaggtcaacaaaatttggctaccattttacaccaatgtccataacttgagttaaaattgtcaaaacgacttaaaacttggtcagattatgaaatttgatgagcttaacaagaaaaagcctgaaagaaatttttctgaaaaagaaaaaacaaaattttttggccatgtttattttggccaagtttccaaatctattggccaaaccgaaagtcaaaaacaaaatccaaaataattccatcggggttttgaggctttttatgcccttaaataatataaaaaattacagaatcgcacaagtttccaaaattgtgttatgggcgattattcgaatttctgaaaacgaaggccaaggagaaaacacttgtctttggacaaaggatttttcttatattttttgaacacatgcaaaattattccagcatagtttatccgtaggaaatccttgttttaaatccttttttaaaattttaaacaacttccctaaagccttttttggccatttttcaaaaagtgggaaaatttgggattttttggccataacttttttaaaaattgtttgagtgcattaaaattgacgccattcaattcatctcgttattctgcatcagatgatattaaatttattagaatttgttacacttttaataaagttacactcaattttctggttatagccaagtccctaattttggcaccaaatttcattggcccatggctgacaggagaacaacttataggacatgctacgtcacccgtcttattccctggaccctatagacttaatttatggctaaattatttctctcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtatatttcaatttggctcgttaaaaaagttaaattaaaaaataataataatagtcaaatttggcccaaaatttttaaaatttctccggttaaaacgtctagaagcaatactcaatcccaattatccatttttttttatctccgaaattggctatggtgcctgacttcgataaattttcactgaaaaaaattattataaaaatttatatttcgctctttttccattcacagaggctggcaatgagaaggcgccaatggtccaatttcagtcctcagcactaaagcctcgttcgggtcccatttggtatcaactcgtcacattccgattgcaatctacaaaattctactcaatgtaattgaaaaaaattttcacagcgcacaaattgaatttagggcccttatatgcttgctcatcactttgggcatgtctattgacggtttgattttaataatatgttaaaaaaataattgacaacagtgccgtaactttaggtgtgggcattcccatcccttcccatggtcattttaacatgttatttttcgcccatatggcctaaaattagtcagaaaaaaaaatttacaggccgaaaccaaaaaaaaacaaaaaacaaattttcatcgggtattttattatttcatttatcaattgtttttgtaaaatgctacataaaagaaaatttgagcagagttctctctctccttcacaaaaaaaaaaattctgatttttttaatttactaaaaaacgcttaaaattaaatattgtcgggaggaaggtgggggtggagaaatatagtagtttttttcttgaaagaattcaaagtttgaaaattttttaaagtttttggcggcaaaattttgggtgcatccgttttccatctgtccaaattagtaaattgtttttttttttactttttcagatccgtctctttcatatgcccaaattccgcggcttcctcaagagtgcgctgcgctgcccgaacggaccaacgaaattgtgtggctgcagcacatgaaattcatcgtcttcgacgacactgttctcataaggttcgtttttctccatttttccccgatttaatgggtccgtatgtcataaatttgtccgaccgactcagactcttggtaatttttttttaaattttctattcaaaattggataactatcaaaggaattattcccccaaaaaaccgctgggctgtcgcccatttgtcccttaccaccgaaaaactgggaatgtgttggcaccgaattttttttttaaataataaagctgtaaattatgcttacttggtataccatgtgagcaaaaaaaaattttcaaaacgtttattaaattgtgattttttgagtgatagaattggtgttcccggtgataatttttttgccgtcgacatttttccctatcacgtttttagaaaaatattgaaaaatctat

SEQ ID NO: 5607 - DNA, 2076 bp, Heterodera glycines
  misc_feature (2064)..(2064): n is a, c, g, or t
aatttttgaaaattgtcggccatttgtttaatttcataaattgtttcaaaatacctacattttctattttatatatacatataataaaaaataagtgtgtgtgtgtttagatcattcttaaattgttcaaacaccaaatggacgcaattcttgcaaccgattggctccacaatgcgttcccagagcgaaagacaacaacaacaacaacaacaacaacaatttctagtgtggaagaagaattagacgatgccgtcaaagcagtgagttttacacaaaaataaatttaaaaaataaaataaaaaaataaatgaataaataaaatcaaggaagagcaaatcagttggcttaaaattatcgaagaggaggaggagcgaggaaatgaattgcaaactggtgaaatggaagtggaacgagcgaaaggtttggttgtttacaagaaaaaaatgaaaaaaaatttagagattgagccgccaaagcgacaacacttacagtccaagtgtagctgtaacgaaaagcaaaagagtgtcccgctgattgactttctctgccaacactacaaatgttctgttaaagagcttcacgttctgcttcagacgctgaacaaacgtcgcgaaatttcggaaatgttgcgctctcagcttcagttacgcaccaaccatctgcgtcctgcctggaaaaattttcgcgtccattgcaacgaactgacaattcatcctgctcaaactgcatatgccatgcgcggttatcttggcattacggttttttaaatttaaatttatcagctcctcaattgtatagatgatatacattgtttttaggtccgtatttactactatgtgaaacatggcgtaaagctcgtttatcctcagcttccctgtgttcttcaatttggcggtggtgaccattgttctctgtttccgcttgagtgtctgagcgtcataaaagatgcctgattaatacgcatcgggtgttttatgtgtgattaagtttgctgtgttattgttgttgttgttgtttttttttttaaatttctcctagataaaaaatgttaattattcaaaattgtaccgcggtgtttaaattacagctgttgcctttcacaaaagagcagtttttgaaaattgcaaaaaatggcttcaattccgagtacgacccccaacgatttcatgcaatcatcatacgactacgtctccccaaaaaacgcactcttgcatgtcttttatttcgatcagcccgtgctgtgttgactggtgtgccttgtccagacagagcggtgcgcgaggcacaaaaaatcagacggagggtgcagcatgcgttgggctcccagctaggaatccacgagttacgtgttacaaatgttgttggttcttgcactttatcacatcgattgtccatgctgaactttttaccaacactggacccacacaggttccgcaacatcaaatatgatcctacaatttttcccgccatgcgttgtaaaatagtcattgacgacgacgatcacactttggtcacttgtctagcctatcattctggaaaaatcattttaacgggatctaaaaggcaggacaatttgaaccacgctttgcattcattcttagctgtcttaaataattgatttgttcatccaattgtaataaacacttttttgtttttgcaactgatttttttttattgattccaagttgagcacccaggacggttagaaattaaaaaggcatcatcatcatcatcaccaccatcatcggcattaaattgctgtaattcttgcccctgctgatgctgaactgtttgcgcttctcggaatccaaacggggttgtcttcatgccgggtcgaatgcgccccttcacataatggggctgatagtctttgtgagcttcgtgggtgtacaggtccgaacacggagttcgaccaatttgaggaaatttgattgttattgacgcactgcttcccggaacaacatgaacatcttccatgttaagcacatcgtcactgtggcatacaatgttaggcggagtgttttgtggaattgtaaaaaaaaaaaattacatttgtccatcaantgttgtaatgtt

SEQ ID NO: 5608 - DNA, 5462 bp, Heterodera glycines
  misc_feature (5409)..(5409): n is a, c, g, or t
tataactatatcaatgaggattatctcctcgtccgactttcctgtttaatgaagaataaatggttcagtgcgaccaccacgcactgcatcctctcttggatcaagtggtcttggaacaaatgaggcattatacagccgccgaaattctgggtctactcgaaggcgttgcttcacttcacatccccagacaacctccaattcaaacccatgttgattctccagttcaaataatcgcctctttgttcgttcatacaagtcttcagctgtcttaccacccgccaatttttgttgtctgtcgtttacgtaacattttggacagccttcaccgttttatgaaaattaaagaaaaagaataataacatttttttaccgtgataaaagcagcccatatactcaatggcaaggtcccgttcaggtggatctcgtgtaactaatccatcaaggcgataaccagtgtcctcaacgttagcttcaccaatggaccactgtgcagattgaacatgcacccccggatgggtcatttcatagtaacgaatgtaacgtgccgattcagcagatgctctcctcccccttagatagccaccctctggcgcgttaaccagcttattcattggaagaaagcagcgacgcagagttgccaaagcaaggccagctgctgtggatgcgactttgaacggatcgagcccattcgtattctcagcaataattttgcgaaattggagcacactttcgcgtagaattgccacgtcattcatacagtataggatgagttgttcacgtaattgaaagcgtgaagcgcgattctcggactctcaccaatgaaaaaaggcatctcttttttgtgctttcatgtgatcaggttgataaaattctttgggcggtaaaccacgcaatctttgatgcaaattttcacgccgaatgaacagataaggaaaaaacggttttgttgtcgcaacttcggtgttcaatccaaatgtgcgtggcagtgcatccaactcacagaaaaaaaagttcagcgaatctttgaacaccacatcccgttggtggttccccttcaaagtcatcgaaaaaattttcagccctattgtgcaaatacgcttttgtggtaaattgcgccggtgaagtgtctccagtatcaagtgaatgtcgtattttccaccattatgcgacaaacaaattgttttgacaccatgcgggccagttcccgtgagaaaattgataaagtcgtccactgggtcattgttggcattgtcaaaactatggaaaaacagtcttcgtgggttgtaattgacacaggctggtagagcactgtcatctccaggcacatttaaaaatggcggggaacaccaacgacgtccccttggtcccacagggggactgcacacacatccatttgcgtattgtccaacaccagagtgaaccgaaattccttcatttatgcacgcttcgcagattatttcagcaataatgagcagcgggacatgcttctgtacaaccttggtgcgaagttgaagtggtaaatcctgggacgtttcagcatcaaaaaaacaaagcctgactgccttttttggactgtttgcgtcatcatcatcttcctcctcctcctcctccacttcattaccatcatcatcatggcctctatcgttaccactatcatcatcattattattattaccattatgatgatttggttgtcgcattcttctctctcttcttcttcttccgctagtaggtttatctttcagaggttgtataaaacatgggtatccaatcggatgtggcccagaacagcgtggacaacgcatccatcccgtttgactaattagtgctggacacttatgcggatagttcgcataagtaatggctccacattgtctgcatgcccttctccattcacatattggacgaaaagttcgtcctcctcttcctcccccttcctggctatgcatagctgaaggtgctcgattgctcaggtgataggcgtagcagtcgtcattgggaaaaacgaatagacattcactgcaaagacgattgctagctgttccatctgctcgtgaatgttgtttgcacgggtacccgacaccaaagcgtaaacacagacggcaaacgactttgcattcctgggggtggtaccaacgtgtcacgcgacgttcacaatcaatgcaatatccttgcacacgaaatagttgctcaattcgtccaacgtaattgaaatgttgattttccaacaaaagacataaattgaacttggccgcctcgcctgatgctgccttgaacacaattcggtactcacgttccttctcaaaaaccgcaattcgaatttctccatggccataacgctgatcaatccaagcttgtaatttttgaacatcgtcaattgtgtacatatgcttgtttcttggtattccggcgcgacgcaataagttacgtgcctcaggcccgtgggtatgctggcgattcgcgtagcttttgaaagcgggaattccaccgccacctggtgttcgtgcccgccaatcatgcaagccaagcaacacagctctggccaaacaaagacgatcattcggatttttaatgcgaatcaacgagcgaacagtgttcaccaatcgatgttcatcctcaagactgcatgcacctatttaaaaaattttgcaaaaaaaaaaaaagaaaaaagatttaaacctgatcttccagcgtcgctctgatctgcttgcattggccataccgcaagtacttttgtcacagttgtgccagctgttagatctatgccagcggcagattgatcgttaagtctttgaattaaatcagcaattgcggcgggattgttctgctcgggaggacgaagcggaattgtaaatggattttcaaaggtcggtgggtgtaattgaagcccgattagcataggtgccgaacgcccatcaagcactcgatcaaacaaccgtcgcacaagacgctcaagcacgcggtcgggccgttctacttcttcaagtggcgcaaaactcacttccgcaatttctccaattgtgttccgagggcgattgcgcatttgatgaacagaagttatagtgaaatcattttggtcaaaacgattcatttttttaataaaatctaaactaaataataaataataaataaaaacgagcttttgtaaatttaatgacaatgattagtactaaaatgaagtagtgataccaaaatgttggttgttataacaaaaactttataaaaaaaatgtgtgatgtaatgtaatgtaatgtaatgtaatgtaatgtaatgtaatgatgttaattcctacctaattatgggagcgccgtgcagactagaacctcaaagcatttaatcaaaagcgttaaccactatgctacggcgctcccattcgctaattattatttctaatatttatattcaaaaattaatttaaatatatatatttttttaattacaaattaaaataaagcgtcaaaaatacttacgcaatggattagagccctattcagaccaaaataacgagttcgaacaaaatgtcgaaaagtcgaacattgttcgaactctacaaaaatgatcaggaagacatttccagacagggggtttctccaaggggggtcgaaatgttgttatttttgctccaaaacgacgtttagacccactttttggagttcgaacaaatttcatttgttattttcgctcacagagcacttgtaagacctcaaaagagactttaaatgtttgtacagtgactgggagccctgggttattgaaaataaaaagttcgaacaaaatgtcgaaaagtcgaacattgttcgaactctacaaaaatgatcaggaagacatttccagacaggggttactccaaggggggtcgaaatgttgttatttttgctccaaaacgacgtttagacccactttttggagttcgaacaaatttcatttgttattttcgctcacagagcacttgtaagacctcaaaagagactttaaatgtttgtacagtgactgggagccctgggttattgaaaataaaagttcgaacaaaaggtctaaaagtcgaacattgttcgaactctacaaaaatgatcaggattaggtctaatatctgaattaaataaaaatgaatattaaagtagcgtaataaagtgatttaatacatttaacttaaagtaattttaaaatgcattttttcatttgaaaatatgctttttcatattagaaaattaatatataaaaacgaatataattaaggaattaatatttattataaaatgagaaggatgtttgttgctgatgaaaattttaacaaaactgaaaaaatgagaaaaggcaaatgttcaggagcttaaatatccttaaacaacggtaaagggatgagcatataatcaattaattgaaaaatcgaaacagaggcgtccaccatactctctcaccgccacacgcccgcctccgcagcgcttgtggtgaagcaaaggggaaaatttttcaccatttagtcaacaattatcccattcctttcaactcaccctgtggccaagtggttaagctcctcgcttccactctcaacggttcgagtccactaccatgtttttgatttttcacaatttttcggaattttcatcataaagtcaacaattatcccatacctttcaactgcccctgtggccaagtggttaagctcctcgcttccactctcaacggttcgagaccgcgaccatgtttttgattttccacaatttatcggaaaaagtcgcgcagctctcgctcatttaaattaattaatttaaatttaaattaatttaaattaattaaattctcgcgcacaagtccatccaataggtttcggttgaagggatcaaagatcatccaataggtatggggcggggggggggtccgaaaatatggattgaaaaaaatcgataatcaaagtactcgtacattgtagtaaagtggaacagaaaatggaagagaaagtggaagaggaacagaaagtggaagataaagtggaagagaaagttgaagagaaactggaagaggaacagaaagtggaagaagaagtggaagaggaacagaaagtggaagagaaagtggaagagaaagtggaagaggaatagaaagtggaagaagaagtggaagaggaacagatgtggaagagaaagtggaagaagaacagaaagtggaagagaaagtggaagagaaacagaaagtggaagagaaagtggaagagaaactggaagaggaacagaaagtggaagaagaagtggaagaggaacagaaagtggaagagaaagtggaacagaaaatggaagagaaagtggaagaggaagagaaaaagcaacaaagggaaagaggaaaggacaaaaaaagaagagagcaagagaaagcgagagtgatgaagtgaaataggaaggtagaaagggaggnagaaaggggatgagaaaagagaaaagtaagagattttaagtgatcatattaaa

SEQ ID NO: 5609 - DNA, 10040 bp, Heterodera glycines
  misc_feature (9913)..(9913): n is a, c, g, or t
  misc_feature (9931)..(9931): n is a, c, g, or t
tcggattttttgtaatccgaggcgtctttttccttgctcatttggcccctcgggtttttcgtaacccgaggcgtgttcctttctccagtgaccgacccctcgggttttttgtaacccaaggcgtcccccattgtgagcaggtcgctcctagggtttttcgtgacccaaggcgccacccgcttacacggtcggacccatcgagtttttcgtaactcgtagcgtccttcttcatacactgtaagactcttggtgggtctgaagtcaaactcactttgtccactgtttgttcaacttactgctattttgtgaccccgaaccccacacaatttgttcggaagtcgggtagcagaacctaaaagtgagcaaaaatgtcgggatttttgcggacaaaaatcgcaatagagctaaaggctcttgaaaaggcgaaaactgcaacagaattgcatgttgagccggaccaaactctgaccacattggaaaatgcgattctcctggaaagcgcggcagagagaataaagtcagaggtggaagcagtgaatgccaaaattgaacaaatttggacatcagcaagcaaatggcatgacctcatacaaaaaatggacaaggacgaacgaaaaagtgaacagacagtgtatgatcaatttcaaacaacggagaaactgaacacaaaaatggaaacagccaacacaaagctaaccgaactgaaggacctggcgatgaaggtggaagctggagcaaagctgcaacgctcaaaagcagatagagacgcgcgagtggagcaaagagaacatgcaaaagcaatgtcgaagtcgaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagtaaaacggagaagctgaatttgttgaaatcgctggttgagcgagaggccgcattgcttatcggaggcctacgcctggaagagaaaaattacgaaattgccatgaagctgttaaaggacacctatggcgacaaaggcgaatatgtaaggaggttgcacacggagttgtcgaacctcaagagatgcttttcggtggaagacacaaagcatttttgcatggaattggaacgcctggcaagagaattggaagcagcggaagaagacattgaagggccgccaatttatttaatgcttgagaagaagctatacaagcctttcctgcgtgaaattctggaagagaaagcaaaaaatccagacttttgggacacgtcatccctccgaaaggccttaggaagtgcattgagcaaagagctagcaatcaaagaagtcatgagggagtatggcttcgaaggcaaagaggcaaatccagagcatggattcaaacgacaattaaggcggaacagattcggaggctcagtcaatgtagccacaacacatttcggaaaacccaacggagagcgaagaaaaattccggaacaaaaaatgccaaatccgaggcaaggccagcgaagttttcagcagacgccacgaaattccgcattccgagaccgtaagggacaaggaagaagcccaaaaattcaacggaatccaacggcagttaacactcaaggggaactgcttctgtgtgttttctgtggagggaaacacagacacgacagttgcgaaaaggcaaggacggtgcaacaacgatttgcagtcctccaggagaagggcttatgctacaaatgcctgaagtcaaatcatatcggaagaaattgcccatgcccgatgaaatgtttcaagtgccagcaagcacacccaacggcattatgccatcaggcaaacccacaaagggtaacagaatggaaaaacatggcaaaccgagtcatgaacgtccgggaagaagagaaaccggacaaaagagacgaattcaaagaagtctcattcacgccctcgcaatgcaattcagtgcaaggaaattcgcgagtcctgctgagaacagcagaggtgaccatcttcaatccatccaatccaaaaagaagcatggtcgcatcagtttttgtggatgacggaagtgaacgctcattcatccgtgccaatgtggcaaaacaattaggccttccggtgattgaaacggaagagtgccatttgactggttttggcgagaaagaagccaaacgctacgtgagcaatgttgtccgcgtaggatttctgggagtcaacggagacccatatatatgcgcactcaatgaaatggaattcattgtgaaagcgatgcccatcgtaacgctgaattcgatggatgaagcggaattaaacaagaaaaaactttcccttccatcgcggccaagacagccagacattctgttgggaatggatgtcagacatgacctgaaaataagagacgaaacagaaaagttgccaagtggattcacattgtcaacgtctcgagtcgggcggatgataagtggttatggccaagtccagggcccaatggacatgagtgtgcaagtgacgtacactggagcactcataagtgccttacaatgtgccagtagcagaagagatgctgacgaagaaattgaagaacagataaagacatttttcgggctgaacataatcggaatgagtgacaatccagaagaaaacgacaaagaagaagtgatgagaacgttcagaaaaagcttgacattcaaagaaggaagatatgaatgtggcctaccatggaacgaaagagtaaaggatttgccgacaaattttcaacaagcgagggcaagactttgtggcacagtgaaaaaattgcgagaattaaatttggtggacgaataccaaaaaattttcaatgagtgggagaggaacgggataatcgaaagagtgccggatccaacacaaacaactggaccggtacattatctcccacatcggcccgtgataaaaatggacaaggccacgacaaaaataagaattgtgatggatgcatccgcgaagccagcaaaccgcaaaggagccccatcgttgaacgaatgcttgcacacagggccgttgttgttaaacgaattgaccgggatccttctaagatggagaagaatgaaggatctaatcctggcggacatcgaaaaagccttcctccaattatcagtgagagaggaggacagagacgcgaccagatttctgtggctggaggatccacaaaagacagaaatttcaagcccaacatatgtgaaaaccgttgtgtttcggttctgtcgggtctcatttggattgacaacttcaccatttcttttaaatgcaaccatccgtgaacatctctcattctacgacacggttctaccgcaaaccataatggagaatttgtacgtggacaacatactgatcaatgtgaagaagaatgaagacatggcgcaaatttgccatgaatcgatcgagctgttccgtcaagggggaatgaagctgcaggaatttttctgcagtaagccgatcgccatacgaagccttcctgtggaattattggccaaaaaccaaaaggagataaaagttctcggaattccgtggacgaatgaggatgatgaaatttgcttccgatttaaaaaatttgccggaaagcacacgaagaggaacatcttggcacacattgcaaaaatttatgaccctttggggttagtggcgcctgcagtgctcccagcaaagcattttttgcaaaaacgttttgaagccaaaaacggctgggatgaaggattggaagaagaattgattcatgaatggaatcaaatcatggagacttggcaaacgaaagaggggacagaggtccaaattcgattcgcacgaagagtcgacaacgaagacgaagtggacaaggaaatgcattgcttcgcagatgcgagcggaaaaggcttaggcgttgccatttacatccgggaatcgacagaaaaaatgagcgccaatttggtgtttgcaaagagcctggtgaagccctccaacatatcagatgttgcggcaacaattccaaaaatggaattacaatccataacgctgggagtgaagttgttaaagtacgtgctccaacatctcaaactcaaaccaacacagacaacaatttggactgacagcttgtgttccgttgaacgaattaaggagcataagaaatgcgatcgatttgtttcaaatcgattagcaaaaatacgtggacagtttgaagtcaaacatttggtcagtgcagataatcccgcggacgtggcatcacgcggcacaacaccaagagagttgagcagaaatttgttatggaagcatggccccaaatggttatcagaagaaaaggccctgtggccaaaaccagcaaaggtttatcacccagatgaagagaagctcagggcaagtgcggaagatgaagaagtgaaaacagccgcagtcatgaatgaggtgcctttccaaccaaccattgatgtgaaccggtactccagctggaaaaaggccaaaaccgtgggtgcctatgtcttacgctggatacattcggtggcaaaaaacggatacaatggaaatttgttgccaattctgagcaaaatgggcccaaaaaagcacgggaaccaagacaagggcgtactgtcagtgcccgaattatgtgcatccgaacatttgctgatatgggaagcacaacaacaatttccaacggaggaaaaaacaaaggaaaatcttcgtctgttcaaagacaaagaaatctggagatgccgaggacgcattggagaagcaacagtaaaggaggaaacgaaattcccgattttcttgcctcctgaagcatggaccacaaaactcattgtgctggaagcacactggaaaatgaagcatccaactcacagtactctgttggggtacatgagggaaaagtactggatacccaaaggaagaaggttcatcagaaacacgatattgtctgatcgacacggatgtttgaattgccgcaaagagaggcttaaaccatatgcctatccacaaatgccaaacttgcccagtgaacgagttgcgatgataaggccatttgagaagacgggcgttgactattttggcccattaacaataaaaggcggagttaaagtctacatcgcactttatacctgtctcgtaatacgagcggttcatttggaagtggccgatgattgtacggcaacagaatttttgaggacctttcgaaggttcagctcacgccgcggcctcccaagcctaatgtggtcagataatggcaccaattttattgctggagcagagtgcataaaagaggaatggagaagagaaatactggtggaaaccagccactcaggagtgagttggaaattcaacgtaccacgagcaccctggcaaggtggcgcatgggaaagactggtgggcatcaccagaagtgcgttacaaagaacagtgggaaaaagcctaatggaaaggcaagaattcgatacgcttgtttgcgaaatcgaagccgtggtgaacacaaggcctcttacattccaatcagaagaagaattcacacaaccgctcagacccgtcgattttttattgccatataaacgtgtggaaacaagccttccattgtcggacgaagacccaagggatcccgactatgcataccaaccccgaaaaaagggagaattgcatcaattgatgagagttgcaataaaaagaatcgatcgattctggaaacagtggaaaacggagtacttactttcactcagagaaagagatcgaaccaaccgagcagaaggaagtctcccaagagagggggatattgtcctgattgaagaagaggaagacccacggtccatttggacgatgggaaaagtcgaaaagcttttgaaggggagggatggactcgtgcgcacggcacgagtacacacaaaaggaaaaactctggttcgagcgattaaccttttgtaccctctagaaattaacacttctgcggaggacgaagtcagtcaaattcaagtgactgccattatggattcaccaagtgctgtgatggaaggcggggacccgcaaactgtcacaacggagtcaagtctgcctccagggacagtgatgcaggattcacaaatcgtcacgacagaatcgtctcctgtcagaggaaggaatgagcggcaagctgtgaaagagagaattcgaaagagacagccaacggaggaagtcagaggcaaaggcaaattgaagaagaatgggccatatgatccactgcgaccgggcaactacagaattcctcgccgaaacccgttctttccgtcacaagtagcgtacaatgagcaaacacgcacgtatcgacgacgacgggggaggacgattgatctttcgggattgaggaagttgttcgctggattgggcggcactgaattcgtgagacgagagctgcaagagaaggctaacccggctctaagagaagaaaggctgcgaaaagataaagtcaaattcatggaagatgacgccaggcgcgtcgctgagcgtgaaagaaaggcagcagaggagaaattggaaaaatcaatgaaggattctcaacggcaaacgaatgtcgaatcatcgtcgggcggaacgacacgtaatcctttcgaatcgatggaagtgcttcccggagaccccgagccagaagttcctttggaggaattggcacgccaggagaaatttgatagggaaatggcacttgaacagaggaagatgtatgaaaaacgaagagcagagagaaatgctgagaaggatcggatgcgttggggactaccacgcggagtggttcggagaaaggggcattatgcaccgcatcgagggatcaacaaaaggcggaaatggcaccgtggacggcaccttaatgagatccaaactgggcggaagtaccgacgtccacgtggccatgacatttctccgctacggcaaccaaatggcgccacaaccgaattgctggccccaagtttggagatggaaaggcaaattcggaatgacaagcgagcacgggacgagagccagtcaaaggagcccgtgcggtcccagcgacgactcaaaggcagagatccgttggacgaacagttgaaaagagggcaaaaaggacaacaagctgaagagaaccccgacagaataaagctggcaccagcaagtcccggctaccgacgtaccatcaattattcgctgtttacgcgatgtgagcctggtgtaaagggacacgaaggttgtctaaggaattgcaccatgggaagtctgtcccacggccggctaaccaaaatcccgcaagccgaatcgaagcggtctgcctggcccaagccttcgcattcgattggctaggacgtatgcacgccaagaaattcaatgaaaattggtgcgccttgctgggatgcggaagcgagattgaggattcattgaagaattggtggacgaaagtgctccaaaacaatgagaagacgataccacagaagcaactcgagtgtgtgctgacggcatgggacaattcgtgccaagtttttggacaagagtggaaaggaaaaatctatggaccagttggtttggaggatgtactagtgaaaacaaatgtgataagtgcagaggcgcaatttgagagttggctcaggaatctcacggagagattcggccagaccttgaccaaactgagagccaaggagtactggaaggactgccatctccaaagcaagagggtattggttgtgagtaaccaagaagccgcagagctggtggccaaggaatttgaggaagaaggctcgagctggttcgtccattttggtgacaaaccgttgcgggaaaagatgttcccggccaattggaatatcaaaattatcttcaatttggagctgaggagggaagaaagagaagaattggaagtgttcaaagaagacataaaagatatggcaagggcaggactggaagttcatttggcgactcggaaaaatgcacgtttgccgcgagagtttgaggaattcgccgagatgcaaggctgtggaatttaccaatacgaaaaaattggagaactcgcagcggcgatcagaggaacatcgaccaacacgggaacaaatcccgagtcaggagagtcagcccagaagagtacaaccggatggaggcgagccgtaaccaaaagtctgacaggattgaccatgctggtcatgttattgatcacactgttgcaaccaatgatgatcaatggacaagtcattcggccggaacgaaacggcagatggattcctgtaaatcccttcggaagaccactacgaatggaggaactcgttggatttacggagccgacggtacctcggctgagcctcgacaagagagggcaaatcacgcccactttgccgacaacagcggcggatatgtctattgcgcatatccgggaatggtacaaaaaggcgcggatgcaaacgagtggtacgactcaaactttggcagcaacgacgacagtgcgtacgagtaccagtaccagtacagtaatgactactctacgaactcccgaaacgacggtaaccacgagaacgacgacgaaaacgaaaggagtcaccacgcaaccacagtggaagactaccaatcaagaaccaaggacggactcaagacggaggcagtggactcaaactccaagccgtcactggactgatcgaatccgagcaaccacggaaggcccatctcaagccagtgccatgccaacaacgacaaagccgaacccaaccgagggcacggtgaccgatgaaacgaaaccggcggtacgacgactcaatcgagaattggaggaagttcaccgtggagccgaccccatttattggtgtgcccacaaaggatcatccttgtggagaataccggacgcggataaatcaccattctgcaaaccaccgccagggctcacctctcagtggaaaagattgaccatctcactctacatgccgtatcggaagccacaaaaagtgaagaaggcctacagatgtgccatcaaacgaacgaaggagtatttttatactaaccttctgggggatcagttcgttcgtacggagaaagaattcttgccagtacaaaagagaatctgcatggccatgattgaacagcacaaatgcccgtacgaagataagccaatgactccgattgaaggaggcggatggatcagcaacaacccagtgaacgaggaatttccgggaagattctcaagtctaatgtcgggggagcgagagaccgtaacgctgaattgttttgtcgagaaggcgacgctgttttaccgccctcacaattttgagttgatcagcccgctctactcacacttggaggattgcaactatttgaccggaaactgcaacatggcagacaacacaaccctaaattgggaaacggagtgcaaagagagctgcaagccatgcgactaccatttcgtcgaaagtatggacggagagcacacgggatcaacagattgggcaggcggaacctggatatccaaaagcaaggaacaggcgctaacgtttagcaaagaggcgaaaatggaaacagcatgcaatgggaaaccgattcgcttgtcggaccaatcgtttggaatcctggaggatgagtacctgaagatcgtcaacgatcgtggattgggaaaaagagccatccaggaggaacaactcgcagcacaattaaccgcaggacaactcgccacaagccgataaatcgcgcagcttttttccaaggaatgccgaagaagttccagaggaggaaatccgaccattcaggccagacgacttttacgacgcaaggatgttatggccaggtggttaaacgaggacacgatgcaaatcttctcgtgcgctgagttttcaatgcaaaatgtggaatatcaagcagtcaacaactgctaccgctacattccggtccaaatccgncattgacagaagacgctncacgcattcctggatacagcgcttcacatcctcacagcgtctcaccattcgcagacctgtggaaattaccgctaccatatctgcagctgagccagagcattggatcaaa

SEQ ID NO: 5610 - DNA, 2327 bp, Heterodera glycines
acaaaatagtaacaactttctattcctgtacggcttttttaattacactttttttgccaacgaacggagaaaaaagtcggattcacttagttgataataattgattggacgcataaaaatttgattggacgcataaactggacttgagccaaaataagtttcaagtgctttttacgtcgctgatcacgaatacggcaggcaattcgttgtccctatatatcctctgtggtgtatgatagcactgatctgagcccggattcgcgatcagcgacttcaaaaatcccttgaaacttattttcattaattttttaaatataaaaagaaaatttattaaaatcatatgaaatctgtcacctaaactacataagtaccaaaatatcttggacttttaaaaagctacaatcggcaatacccaaaactattaaaatcacatagaaacataaaatcttttaaatacaaattccctacattttttccaattgcgtttcagcgtaatcataaatatgcttgggcaagcattgacacccgcacactttgcacgagacgcgcccattcggtgtgtgggcagcaccttaacagagataaaacgtaaaaatgattatttccattaaattaaggcctaataaaaagtttttaaaattgttttatcgtgtttctcttacatttacaacgatcacaatgcttatgaaagcaaggaaaaagactgatgcttggcgtaaattcatcattgtttgcgctgttgttgatttcggcacgacaaacatcgcagatcaaaaccatgatgtgtaatttggaaatgaaatgctagtctttggcataaatctttctattattcaaagtgaaccgaaagtatctgtaggtttttaattcttcttaatgagtgcgatcctcggtttacaacattttctcgaccacgaaacgtgcccaagccctaatagctagaataccaatgtagcgtttttggtaattgtaattggcaatgaaaatatttttaatataatgccaacaaaagcgaataatttgattttaaaatcatccacatgaatttttttttaattcaacatgtggacgacatgcatatacatacccaaaaaataatagtgtcgcctgattgtaaatcgaaatccaaacccgaacacaaagataattctattttaagctaccgtttagcaaatcaaagattcatatgaagaaaaaaattgctaaaatcattaaaagcaacaactctgttcgagttgctgtgaggtttgtacaaaagacatggctataattttttttaattttaaaaattaggatcagacctcaaagtggcaaagaaaaggaagagcccatttgtctgagcgtaactcctggtgaaccacaacttacaatttcgcgcgataaaacttttacatatggttccaaagattaagtttaatttttaaaaatcggctggttttttagatttcgtcttcgaccaaatgactttacaaaagactgtttatgacaaatgcgtgagggaactcgttgatggtgctttcgaaggatacaatgccactgtttttgcatatggacaggttttttgtttaaatttgaataagtttttcaaagtttaccgtcatagactggcagcggtaaaacattcaccatgggcaccagcttggagggcgacccggccaagaggggcatcataccaaatgcggcacagcaaatcttcgatgaaattgaggaaaggcgtgaacaagcccgcagatctggcaaagtgatcccctcatttgaagtttcagctcagtttattgaggttggttggtggttgtgaccagcaaaaatcggtaatattgtagctgccccacccccatgttttgaaaaaaaaattttgttttcaaaaaacatgaaaatatgtttcctggggttttcggggtcgctaatcacgaatccggcattcaattcgatcaattccgggtatttttacttggaatgaaataaataaatgcctttgcgcttttataaatattaaatgccaaataagcatttttatttgaaatatatataatattgatgatcatgcattactagagcttggatttttatgtgctaaattcctgaaatataataaaattttgctaaaaatgctgaaatttgtgctaaaaaccaaaaaaaatgccaaattatgtgcgaaaatatgattgaataaaatcgtctgccaatttttcggatgaaaatgttctgagtgtacagacattttattaattaaaaaacttgggttttactgggtgcttatttctttaaattgccatttggctctcggatggggccccctccccggggggaaaatcgaaaacattttt

SEQ ID NO: 5611 - DNA, 837 bp, Heterodera glycines
tgccactgttttggcatatggacaggttttttgttaaatttgaaataagtttttcaaagtttaccgtcatagactggcagcggtaaaacattcaccatgggcaccagcttggagggcgacccggccaagaggggcatcataccaaatgcggcacagcaaatcttcgatgaaattgaggaaaggcgtgaacaagcccgcagatctggcaaagtgatcccctcatttgaagtttcagctcagtttattgaggttggttggtggttgtgaccagcaaaaatcggtaatattgtagctgccccacccccatgttttgaaaaaaaatttgttttcaaaaaacatgaaaacatgtttcctggggttttcggggtcgctaatcacgaatccggcattcaattcgatcaattccgaaccttggactcgagttcggataaaaagtcgtgaattcaaatttttcgaatttccatttatattgtatatttgtgcgtcaacttttgtagctgtacaacgaagaactcattgatcttttgtcaccggaccgggactcatcctccatcaagatcaaggaggacccgaaaaaccacgaaattttgctgatgggcgcatcatcgcgaaatgtcacttcgcaggaggccattctgtccgcgctggccattggtgcccaaaaccgaacaactgcagcgactaacatgaacaaacagtcgtcacgctcacatgccattttcaccttgaacatcaagcagactcgagtggtgccggttgatgtactggatttttttgggagggggcggcactggtaaagaaacattggttcacgaaattttttttaattttagaaaa

SEQ ID NO: 5612 - DNA, 1432 bp, Heterodera glycines
atttttcgggaccaatgttctttactattaacccccccgcgggtggtgtgacattttattatacttacaattagtattgtataatttaggacgattcagacgagaaggacaacacagcggatgaaggtgatgatgtagaggaaagttcggagaagatgggcacaggagctgaagtggaaacgttgcacgccaagttccatttcattgatttggccggctctgagcgtttgagcagaacgggcgccaccggtgaccgagcaaaagagagcatcagcatcaattccggactggtaaatgaggggagatgtgtctgggcataccaaatccagggctatatataatcatttgggctcaaaactgacaatgagaccaaaatgattttctttggttcactatttagttttttcacgttttacatttttttaaaaaagccatggtttgattgagcagattagccatccatcacacccctttacaatgacttaaacttggatttttgaaaattcaaagttttcatattgaaatattgggaaaattattaatgcacagcaatttggtaagcttttacaatccacagcttgcacttggtaatgtcatttcggctttgggcggtgcaaaaggtcgaattggtagtgtccatgttccgtatcgcgactcgaagctcactcgtctcctccaggactcacttggcggaaacaggttggaattgcaatttcttttctgacaaagtaatcactgtttagtcgaacatttatgcttacgtgtgtcagtcctaatgaagtggatgccaatgagacgctcagctcgttgaattatgccaaccgagccaaaaatataaagaacaaggtcaaaagtatttcaccgttactcaattgtcttattttttaggtggttgccaatcagaataaatctagcaccctgattacggatcttcgcatcaaaattcaactgctagaagctgaactccatgaatggaagacggtatttagattgatttcaatattgttggttcatgatcaatcaccacttttaggggaagagacgtaggtctgggcacattgcagttactgagcctgaggacaaaaacagtaccgaacaagtttttggttgcttggcgagattggatgaggaggaggaagcggaggatgctgacaatgaggaagaacctggagagatggaacacgaacgaatctgtacggacttggacaaactgcaggagaatatcagcagcaaagagcgacttatggccaactacgagaaggaactcgagaagattaagcaggaaatcaaccgcttggaagagacgaagaaggaaaacaaacaggaaatcaaccgcttggaagagacgaagaaggaaaacagcggatgaaggacactttcgatcgtcagatggaggagaaggcgcgcttagtcagagaagtggagtcgatga

SEQ ID NO: 5613 - DNA, 2858 bp, Heterodera glycines
  misc_feature (2822)..(2822): n is a, c, g, or t
ataagttaaattttgtaaattttagtaaatattaaattatagtaataaaagaacttccctcccgtctttgtacaacacaattaattgcaggtggatttgatcaaacggcagcgggaagagaacaaacgcatccgcgacctgatgctgacaaataccaagaaattggcaggtcgtgatagactgataaggtgagaatttatgccttttgttttaatttaattccccccacccccttaaggcagcaggagatcaaaatacagagactggaaagggcgaatacgcaaaaatcggacagccttaaacgcaaaatggaggaaatgcaaaaattgaagaagaaggtgggttactactttctttgataaaggactcacaacctgaatttcaaaattaattttgtgctaccggtagtaataagttcattgccgtaatttttttcaataacataggttttcaaaaaaaagccatagaattttctaaaaaaaattttgcggcgacgtttatttctcggcgcgcttttggccggcgatgtttgggtgtaccgtgcgcatgcttttatgttgtgcagcatttttttacttttaaaatattttgaaattgtggcccagaacaaaaaagtaccccaaaaaaatgttaaattttatttagaaacctttatctgctaactaaactcatattcaggaaaggcgtaagacaatgttcgaaacgaacaatccacgaaagcctctaacgccaataaacgagcaactgactccagagagtaaacatctcgagcgcctgaacacgacatacattgttgatacgccatctgaggaacagaagaaagggcgtttattgggagaattaccggaggaaaaggattccaattatcaaattcccccccttttgagtggttgttgtccgaaaggaccttctgtttaaacatatgattatatggtacaaaataaagaacatttttatcaattgttttactggtgagataaatatccatcttactaatgcagttgctcatcgatatgcgcttattctacgtctaaacatatttttgtatatgtatacgtcttacattttttgtttcccgcagtggctcaaaaaatgaaattctgtcattacattaaaaagggggtgcaagggatttaaatagatttgaagcattccatgacattttgtgcttatcatttaaaaaatatttaaaaccctattcataattttttttaaacaggatcattgcattgattaatttttttaattttgtaaggaaattaagtcgggtacgtaaaaacaaactagaaaagcctgacatactaaatttgtagaagagttttgtggcgaaagcattttcaagggcctgatgctttatttttatttttttgtctcaagttgcacctatttacgaaggttaatgtccgggagacatcatttgaatatgtgtggcattatgtttttgttattttccccctccactcattcattgttgacccctcatatttttgcataaatacccctccttccttcctccctcgttcacttttcttcactttgttatttatgaaaatttttaactctccatttgtccgttaagcacaggggaatttactttgggttacaaagcttcaacaacatgcaaagtgtccaatcgtcggccaccggggcagtgaccgccgcttccaccgttccgttgagcattcagaatgaagtttgttttcgctggaagtatttaaataaacaaacaagccaataaaactgattttaatttcagattttgtggatcaaacaggacgctctccaagttcgcaacgccgtcattctcttggagcaggagaaggacagtcttcgcaaagcaattcgcaaactcaaggtttgcggatagaaagaaacaaatttaacggtgaaatttgcgttgggttggtttaagcttttttaattttcatgatttttttacaaaaaaatccctttttagttggagaatggccgcctgaagacaaaggtgaaaactttgaacgaaaaggtggcaaagattagcaacgaggaaatggacgatgaagagggaaaattggcgcctgaatctgaattggactatgacgaactaaaccgaggggatttctacctaatcggaggtgtccatggtaagtttcgaacttttttgtgaagtggtaaacatatataaaatcttgaaagttgtgaaagactgaattactaaaaacctataaattcaattttagacccgatcagtcttcgttttgaagctgcgatccgtgaccaaaatgccgtcgaacataaaagtgccgaacgctactactggtacaaaatggcggaattctttggtgacgaggaagccatgaagagcattctgcacgcgcagaatgtccaacaggccgaagaggccatgaaaaacatcaaaggcttcgacgttgccgaatgggacaaagtcagttggaatgagaaacattggtggaaaggaaaagggttttcaggtcaaacttaaacattgggaggacggacagcgtctgaagcttgagcaagtccgttggatcgaaaatttgctggtgctgaccaaaaccacctacttggccattgcctctgaagacaaagtcccccccccatcggtccactttttactgtccatttttgcagtttttcggcactggatggcgcaagaatcgcgacgaggccaacaaaccgatcttttgggatgggaagaatgagggcgggaaagtgatgatgcacattcgccatgagctgaagtccaaacactcatggactggtccacaggaggaagaggtccagcaaatgcacttctgcccgtcttatactcaacaccattntccaggagtccaatacgaagttgcgcgagatgatgc

SEQ ID NO: 5614 - DNA, 2453 bp, Heterodera glycines
attctgctgaacatttccattgctcctatccctcggctttccgttgtgccgtcatttgttctctccgtcgttgccattttcatcgcttttgtgcaaaagccgtgcttttgcgattttaaactatttgctcataaaaaaaaattacaattttatttaaagcatgcgccaaattgaaatgtgtggggcgttcgaatgataccaagttcgttagatttggttgaaaaacaaaaaagatagcacagtgcggaacgggccaactgcgtctcaggcaactttaagaagtcataacttttttcacagttgaccaaatcgaataaacttggtatcattcgaaagctcttaacaagctctatcaattttccaataatcacaaagacaaaccgacatgtaaaaaaagttataaataaaaacataaaaattttgacttttttgcagtgttcatgttgcaacgttttaataatttttcaatcgcttagaaataaaaatactgaaaaagggatgaaaaaggcaccaaaggtcaaaaaaggcaccaaaattacatgccctggcataaggcaccaaaatcgcaaaaaaagaaagctcaagctagaagcttcaaaccaagttaaaaacgtgtttttcgtgtttattaggccgtagcaagttagcaacaaaaaaaaggcatttgcctcaaaatctggtccctactgatcaaaatgatatttttttgaatttttccatctttttttcatgcatttcgccaaaaataataattaaaaattaatacaggaaatcggaacgggccaactccgtctgagccaactttgagtcaatataactcttgaagttattgaccgaatcaaacaatcttgatatcattcaaaagctcttcacaggctctattagcctactaaaaattacagaaaatttcgaactataaaaaaagatagaaataaaaaacttcgaaaattctgccttttttgcggttttcaactgacaacttttttgagagctgattaatcactgagaaatagcttataaatatcttctaaacatctagggctttcgaatgataccatgattgtgaagtttggccaacaaagaaaaaagttatagctttttgaacattgctgagacggagttggccagacggagttgacccctaccgcaggaaatacaagtttttgtggcctgtacctatacctgtgttccaaagatggcctgtacctgtattttctgtacaaaagtacaggaaaaaagttttacctcccgcccccttgacatttttatctctacttaaagctcacaagtagcaattcttcggcattctaattattgaccctttcctagcgggttaagttccatcgaaggcgcatccaatccaaatcattgtttttgtaatttttgctcgatgcaaaataaaacgccacggaaaatttcgtcatttttaaaggggaaaaaatcaatttgtttttgtttgaagaaaaactcagagattttttccctagattttgacattaattgttgtttttcaacttttgaagctgcacaaaacatgttcgttgctttggaatcgaatccaagaatttttaatatggtattgcaaccgttgatagtgaatttgattgttttaatttagttcctcgatcaatttggctttgaaggggtggaattcaatgagcttttcggatttgatcctgaattgatcagctgcgtgccaggacctcacttggcgctcgttttctgctacccttaccgggagaaggcgtttgaatatcgtaaaggcatctacggacagttggtggcttcggacaaaggcatcgtgccgaagtgggccttctttaccgagcaatttattgctaatgcgtgcgggtaccacgcagtgcttcacgcagttctgaacaatttggacaaaatcgaaatatgtgagttcatttacattcgttcttcaacaattttttttacagctgccaatggttattttgccaaaatgattgagcaattcaaggacaaaaagttgaaaagcgaagaaacagaagagatagaagaatcaacatcttcccaatgcacgagcgaagactttgtgtctcggatgacggattttttcagtaaaatctctctggagggctctgagacggatgtgtctgggaaaattgaacaccatttcatcgttttcatcgtccgcgacggacatctcttcgaatttggtgactttctaattaatgaaatgatgtgagccaaacgaaaggcgaacttttctatgcacttatggggcgttatacgaatctgacattatttcaacaaactccgaacccctaacctaaatttgaacaaaaaccgaaactcgagaaatttgcattcttttttttttgttcggttatgggttaggaattagtctaaattatgtcagattcgtggtctgtggccccgaaaacacccgtaaacagttcacgattaccatctaatatcaatgt

SEQ ID NO: 5615 - DNA, 1283 bp, Heterodera glycines
aatctgacatccatttttgaccaattcgaatccttaactcaaacaacaaaatagaatttcgactttttgatttgtcttcgccatatttaaattaagttataaataaatattatttttggtgttttttggggatttggcgaccccgattttttgttaagataataacattttggggattagttttttggcacttttttccattttttctaaacattgctaatctgggccaggcccaaacattccctcccaaattaatcccacagaaaaatgtatcagcgaaatgacacgaattgttcaatgttttggcccgcgactccttccatctgttgaccaccccacgcttggcccggcccgaattgttcaatgcttttgcccgcgactccttccatctgttgcccgccccgcgcccggcccggcccaccaatcaactctttccgcccaccgcaaatcgcctatatactgtgccccgcccactccgatggacgctgctatttaagaaggatgtgccaatgacttctcactcgctttttttctcactttttctccgctgatcaccaacgacgaattttctcacccaattttgccgaattcatttaaaataaaacaacaacaaaaaaaaacttttctctcatttgttcacattgtcccttgttttcccttgcttacaatttgaccaattttggcgctccgccatttggcccccttgcttttctcctttctcgccttgctttgaccaattttggcatttgccatttggccattcttcgcttttccatttgcgttgaccaattttggcgttcagccatttggccatccctttgctttctcgcctttgcttcgtccaaccctttggcactttcgccctcggcatttgcctgctttttctcacctttacgtcggccgaccgcttggcttttcccttaggtcgcccttttcctatccctttcccctggttagcactcactgcctcgggaaacggaagctttttttggcgcttatttgttttgagtgttctgctgaatttgggccccccccccttctcttgggcgtaccccctccgattcccagctgttgaacacaggggattaagagtctggtgctcttgtcacgaaaatgagctaaccgagcaacttttagtttaccttttttggagactcccgaactcctaattttgcttatttatctcccttttctgcctttttgcttaccccgtgccttttcttctttctctttttgcctgcagtactttttcctttgcttacctaccctcttttttatttttt

SEQ ID NO: 5616 - DNA, 4911 bp, Heterodera glycines
accttcctgcgcttcagctacctgactttgatgggcctccaactgtggccctcattctgggccgctttttcccataccattcacgataatgcctctctgacgggcgcgcaaaaactcacctatttagtgggtcgcctaaggggtaacgcccgcactttggtggatgggttcgcactaaccgaccccaattatctgatcgtcgttgaccttttaaaagggcggtatggcgacgatgataaaagggcggaccgcctaaggagtgagctcttccacttagctaagccaacagggcattcctcatcattaagagccttttctgagaatgttgaccgaatttgccgacaattggaaagtctgggcaataacttagatgacaaccccttcctaactgtggccataaaggaaaaattgcctacggaaataaaggcacagctttttgacaaggaaatggaagagggaggaccttggacatcaaaaacatggagggaacgcttagcacgggtagttaagcttaaggaggccgtccacgccccgtgggacaacaatcctggacccacccaacctcatcccccgagggcaccaccacgttttgttgagcccatccgacgctcttttccggttgttggggaaacccgaaatgggaatggacaccgggaatgttccctttgcctctccgatggacataaaccctcaaattgcgtgttgtaccgaacggtggaccaaagaagggcccgcctcgcagaacaagggcgttgttctctctgcgctcgtgaggggcaccgccacgaccattgctcctctaaatctctctgtttccgctgcggggggaaacatcatctgctcgtctgtccaaacccagaaaagaccccggccaggggagggaattcggtccccttgggccccagatttcaaacggcacccaatttcagtgggtctcaaaaaggcgtgactcccacttccttggtaccgagtacgggcgaaaacccaaacgttgtgtcctcaatttcgcacaatgaaaatccatttattctttcccctgaggcacaaccccgaccaagagcttatttgatgattaaggaaatttttgttttcaacaataatagcccatgtcctacggtagtccccgtcttttttgaccccggttcccagccgggtttcatcgccactgatctcgtttctctgatcagtcccagtctaatcacagaggaaaatatgtctgtggggggatttttgggtaatggtccatctcaaccaatacagttcaaatcgccccgtttttcggttcgcctccggcgaagagacggtgggtgggaaacggtagagctgaatcagaccgacaaaatcatcccaccggtggagtatttaaaagaaatgcattggaaaggccctaaggtattcagattgggggcaacaacaaaggaaccaaaaattcttttgggaatacgggaattttggcgattttttgggggatcccgagaaattttccccggtcttttccgcattgacactgtttttgggccactttttggaggcgaaatggatggttttgccccccgttggccccagtcccccaattaggccctcccatggcctgcggagcagtcgttcaggccgaaaagccggacgaactggtgaagcggctgtggagcctagagtccatcgggattgtcgatcctctggacccaaatgatgaagcattggctaccgccctttttcgggactcaattaaatttgaagatggccgttatgaagtgggatggccatggcgtcctgggggcaaggaccggttgggcagcaatttctctctcgccttttcgagactatcggccttatcccaaaaattacgaaataatcaagaatttcgggagaaataccaggccattattactgagcaattggaaaggggcataattgagccagcaattcgcactgggggccaagagcatttcattccccaccatgcagtggtaaacccgaaaaagttgcgcgttgtttacgacgcttccgcgcatgaacggggaaaggcttccttgaatgaactgctgctccctgggccaaatttggtcccggaattggctggggttttacttcgtttccgggccacggttcaccctgtcctgggggacattgaaaaggcgttcttggccgttggccttaagaacgaggaccgagaagtggccaaatttctctggcttaaggacccctcccaacccccgaacaatgacaatttagtgatctaccgcttcaaaaggatcgcttttggagtgaattcttcaccgtttcttctggcctcggtcttgcgctaccatttggcctctttggggaaccccttgggcctggaacacaatttttacgtcgataatttgctcctttgtagcgaatcggtcgaagaagcagcccaagccgttcaaactgcccgagaagtgatgagcaaggccggcatgcgtctacacgaatttgtagccgctgttccatccgtttttcatggcatccctcctgacgaagtgttggtgggcgaagaacaaagggttttgggcattttgtggaatttggccaaggaccaaaataaatttcgaattcccccggaccagcgacttccccccaacccgccgagggatccttagcgcaatcgcatcattgttcgacccattgggcctgtgcagtccctgcctcgttaaagcaaaaattttcttccaatcactttgggacctaggcaaaggatgggacgaaccgattggggagcaatttttaaaagcatgggacgcaatcatttctgagtggagcggcccctccctaacatttgcacggcaaacccccagcagccaggccacccttcagctgcatgtgttttcggacgccgggccaaattcttttgccgcagcggtttacttaagggcacaaaggggagaccaggtccacatttccttagtctttgccaagtcgcgtcttcgtcccaaaaagttcaaaaatgatggcctaaccatccccaaacttgaactgcttgggctgatcacagcgattcgggccaaaaatttcgtgaccactaattttgaacgggtttttgaccaggtatttttttgggcagactctcaaattgttttgtcctggctctccggcaacagcccccaacccgtttttattgccaaccgtttggccgaaataagaaaagaaaaaagtgctatttttcggtatgttcggtcctctgataaccccgctgacttggggacgaggggggcatcacccaaggagctctgtaacaacggattgtggcactttggccccgactggctcaaattaccggaaaataaatggcccaatgagtttagggacgttgttttcccgccggatgagctccaaacccaaggaccggagcaccccccgatttaatcattgcctccgtttttgaacccccccgccgatcccatcctcttaaatccgcggcgctttagcagctggtctaagctgctggccacgacctcttttgtcctttattttttgtttaaatttttggggaacagtgaaaaatctagaaataagtggccgttcttcggggagcttgaaggggccgagccgtcgtcttgggcgtctaagaatgtggcccgaaaatggctcctaaaaagggaacagatggaaatgtccacggggggcgaagctctcatggggcctgacggcttaattcgtctaaaaacccgcctcgttcacggcactcaatcagctgattttaaaaacccagtcgttctttcccgggagtcatggatcacccgtttgctcattttgtccgcccacagttccctggcacacgcgggcgtggactatacattggccagttttttaagccaattttggtgcccccgggcacgtcgcttaattaagagctttaagggaatgcctaatttgtaaaaaggacaaggctattaaattcgctctcccagcaatgccaccccttcccccgtcaagaacaattccaagttcgccattttcctttgttgggctcgactatttaggtcccactctttttaaatccgaggaagggcaaaaaaaggcttggattttgcttttcacctgcctaagctgtagggcggtccatttggaaatggtggaatcattaagtgccgctgattttctttcggcatttcgacggttcgtcgcccggagggggattccaaagcggatttggtcagataatgggacccaattggtactggggagacaacttttgaggctttattatgactttcccgtggaatggaaactgatcccaccacacagcccatgggcaggaggggtttatgaaaggatggtggggttagtaaaaaccgcttttcgtcggagtttgggaagggcaactcccacccgggtccatctccatacccttacctgcgagattgaggcaattttaaacagccgaccaatcacatttgtttctgacctggaagatggtcctttgcctctccgcccgttggactttttggcccccctttcccaaaatgaggtggtcgaacccgaggaaccggacccagctttccaaccctcctcgtctgaaaaattggcgcacttgtggcacgtgacgaatgagtcacttcgtcgtttttggaaaatttggagtcgggaataccttttaatcttgaggggcaggacccaagacacccatgctggtccccgactttttgcccccggcccgcctaaaattggggacattgtgctaattcaacaggaggaaattccccgaaatcattggcctctcgggcgaattgtggctctaattcctcccgataagccaagaagcgcaaaagtggcaatgggaaggggaagagaattggagagatctgtcatcccaaatttcaccccggggaacacttaaggccaaccgcttaactcgcttaggttacgctttagcgccacactttttct

SEQ ID NO: 5617 - DNA, 1015 bp, Heterodera glycines
aaaaatgaattttatttgtcttacaatggatcgaaaaaagatttaaattcttcaaaaatgtcgtgaacacaaacgatacaatgacagcgaaaacgaagggaattctgagcaccacgaataaaacgccgaaaatgatggatgcgacgataattttgaagaagaatgcgccatcatcaacttcgaactcggaaaaacaaaagcgaggcatttgtctttggtctgaaggtgggaaatttgatagagaattatgaaaagttgtcaaaggttttcggtacacgcacgaaaaaaacgtccgatggaggtgcactgtgtgtgctgccatgcccgcgtgacaattgcggacaaaagtgacagcacatgtccggttttctcggacaaaaagaacaatcatttgcctaagcccccgaaacaaaatgtttgggaggcatttaattcattagacaaagaagaatttggcggaaattcgacggcaaaaaactcgagcgcgtgaaagccgaaccccgaatcaggacaaattgcggctggatggcgaggacatcgtgctctacgacagtcgcactgtcagaattggagcaaagaacgttgtgctcgtttttgggtgcgaacgggttgtctcattaggggccaaagacagaatttatatttaattttttagagtttggacatttgagcaaaaacagtgcaacatggcatttggacgggacaattatgccgaaattcacgatgttattacggatcttggtctgcaggtcgaaggatacgcagaaaaattgaaggactattcgacgcggcgacattatgacgggcagcgcattaggcagagcaactttcaatagcatacatatttaaagattaaacattcgtcataatttgtcttctcttttttatcggttcatttcatcttccggccctcccctccccttttttcggccgatctctccccccccccccccattctctccctcttttctcccatcagtcgttcattttcaattatttctttctcattttgtgt

SEQ ID NO: 5618 - DNA, 2984 bp, Heterodera glycines
tttggcagacggtcattcttttgcctttccaatgtccttacgtgccttttccgtttagctcctcgagatcatccggtgcataaatattgggaggtgtcttcttccgttttcttccccctccgttcattccccctaattacccccttaggctggtttgaccggtgaggcggcattgacccccgactgtctggtgaacattgagcagtccggcaccaacgattactggggcatccttcacgcgttcccaattaatgaagttcttcgagcacgcatttacgacttggaggccatgctaagagcagtgatggccaaggaggaggagacaggtgggggagggcgaaaagcattggaaaatgccggggaacactcatttgtcagggaggaagcacgccgtcctttacgtgatggacttgacggggctgaagtatgaccgcaatctgatcactctcttggcaatataaaattggccaatttggggccaattagcatcattcccttcagagaggggctctcagtgccatttccgcctttataaccgaacattacgttgagatgatccacgaatttgtgctcgtcaatgctccgagttttattagcacaatttggtaagaatgcccactaatcgacccatcgatcgatcggatatttatggccaaattaaggaccatcgcaaagccattgctgcccgagagaacacgcaacaaagtgcaaatattgggcaagtcgacttggcgaagcgaaattttgcaaatggcatgtgccgaagcactgccatcgttctggaatactgaaggggaagagaaggtgaacaaagaaaaagaaatgccgaaaaaggggaaaagtgatttggaaaaggcggcgattggcattttgggagggagaaaagactgatttggcattcattacttagtaccattttacagcacttcttggccaatctgaagcgatctccaccgattgacgtgtcaaattaccacaaaaatggtcagcttccgcccggcttttacacttcgcttacaattggcgctggcaaatgcggcacaatcgaagtggaagcgacaaaagggcaaacgcttcgttggcaaatcgaatcggacggccatttttcctttgcggttcacttcaaaagtgacgaaacttcgccccgtctcgtctacccacgactgaatgttggtggaagaacaaaaactgatcggacagaacgaattgtgtgccatttcagcaaattcccggcccaacttttgtgcctgtcgacgaccatttgcaatgcgacgcgaccggcgtttatcagatttggatttccaacgaacacgcgtggatacactcgctcaaaatgcgttaccgaatcagcaaagaatgagagaataaacgaagggggggggggagggagacgaaaaagcattgaccgaaggataagcattgacccgagggagacgaaaagcattgacccgagggagggggagtgttggcaatgtgtcattacaaaatcattgtttgttgcacactttctcacatggatttactgcatattggacagtttattattatatttatttctgctgaattaaatgcgacagcaaatgatttcttggactattaataattatgaataatgctgaaaatgttttctttcgtttagttttttgcttttcgaatgtttccgctcagaaatttggcaattggtatcaaaaagaattgaatgattgagatcaaagagatgcccaggaagaagttgagttgaccgccgatctgagagatgaacccttaaaatggaattcatttggcactgatcggaagaccaaccgggggcagttgtggtcagctgttcctcgtaatattcaacctgaacggcgggcattcaaaaaaacccccgctgatcacctgcaaattctcatacgaagcctccaaatggaaaacgaagggatttttcgtttcgaacttttcctgttggtgctgaaacttgtggaaatacagctgagtgtcgacgatgtctctttggcaggagggcaaacactgaaattgttcaggaaaagctcaaaaagaccaaagggtccgtccgaatttcccacctttgacaaattctgatactccgatcggttgctgactacgttaagcaccgatcggtaattcaggaagatcactttcgggtcgcacacttccaattcggggtttttgtgggtcaaatagaaaattgtgcatttgaatggtttggtgacgcgctctctgagcaaattgaagtgaaatggaaggaaaagcagtgaatgaccagtcgaccgacctcaaccacgaatcgacgtaacaattgcctctttccatggtccgttcggaggaacagtgggggttgggctggggagggaatggtgaaggggttaaggattttctgtttttacaaaataaaaaacattggctgtgttcaacgaatgcaacggaattctcagactttttttgtggccgtaattcaaaatgcaaaattgatttgaaatcttcattttggttggtgcttattaaatggtaaaaaccaacccaagaatccacaaacctaaaactacagtatttttttgtacacttttgtaagctctgatttcccccccccctcaaaaaacaaccgaaagcattgaaatgcgtcgcttcttcagtctgattctgtaccacgtgtggttgttcaaataaaagcgtggaaaggtggcgaagtcttcactgttttgcgatatgtaagccacgacttgtctctgaactaagcattttatgcacacggaaaaataaccaaaaattaaaaaaatattaaaaaacgaatccgcccgaagggattgaagacacaaagaaacatcgtcaacaaagtttgaaatctcttttagttcaaaaggttttttacttgaattccttcagcatccaaaaacggagaatgcatttgattgaagtaaaaggtgagttttgcccgctcatcgggcgccgtttgaggaaagtcccgcaagacaaagcagcga

SEQ ID NO: 5619 - DNA, 963 bp, Heterodera glycines
tttcgatagtaagttttttatttgtttcttatttttatgttccaaatggcgagaaaaagcttatattggtgtcactcggaagcttaaagtctctggaatttatcaaactcactaaaataataaatagtctttaggcttagaaaatccaaagagataaaaaaaagaataggagcttctttattcaaaattttctgaattttcatagatttatatttttttgcaaaaaaactattttcaaattaggcggtcacagtcactaaattttaaaacttgcaaatttttgctgagtaaaaatatttgagttttgagcgaagatagcactttaaattttttaatatttaaatttaataaattcatttataatctatttaagaattcgtgggggggggggtcgcttggacggggtcagctcattgtcaatctccgcacttacaatttggcttgaacaaatcgcagcatgggatttcgcgtttgccgtagtagcaagattggaataactgctcggatttgatggcattttgcgaatagaattccgctgcttttttgacctgttcgcattcgtatccattttcctcgaaaaagaacttgaagaattgcaaattgctccgcgttttgcgccactgtctgaaaagcgtgtccaattcctccacctccgagcggtccgtcagctgagtgtacgcgtcgaaatgttggaaacccgcgccagccattgcgaacatcatcagctgattgactttgtgacgggacagatggggcaggtggagacgcaaatcttcaccaataaaagtcaagtttcagtggcaaatggccaacggtacaaacagagaaagtacagtacccttttcaatggctgcgaaattcactgtgtcgacgtgtttaggacagaaagaaatatttgggaagtgaaggctttggacctgacggattgtgttgagagtgacctgaagagagggcattttgagt

SEQ ID NO: 5620 - DNA, 1279 bp, Heterodera glycines
gttcatcttcaagttgttgtccatctccagtccattccatttccattcatctctatttgcttcccttcgcactaccatcgatttcatcacaagttcataaatactcctcacatctgtcccccccccccacattttcagcatttattcattttccgcctttcttttgcaattgctttggttcgtacattttgtcaactttgctttgtcgatgttccattccaactcttcttcttcttcaacgttcaactccttctccaaaatggatgagttgtgctgctttctctgcaacaacactttcactgaggtggtctttcgtccgttcattagtttatttctgctgatcactctgatcggctttaccttggccaccattcagcctctaatgctcagctgcggccactccttctgccgtctctgtgtccagccttggctccgccgtgccaccgtttgccctttctgtcgttgtccgactttgcagcccatccccaacacaacaatcactcaggcgcattcttttctcaaatttctcagattcatttattttagagagtgtccgaatttaagagaattaatgccgaaaaaagcaattttattcgaagtgccattcgacgcactttccattcatcgaaagaagtgaataattaaataaataaaaagcaataaatattaattaggaaattaaggcaaaaacacttcaaagggaggcattgagggcaagtcaaaggcgcccgagaaatgttgtgttgccgaaagggacagaggagaaaaagggggaggaaaatgccgaaaaaggagtgggaggacaaaagcagcagaaaaacacaggggaaacaggaaatttgcggaagggaattggccaaattggaaacaaattagccattgtgcagcagcagcagcaaatgaatggtgcccatttttgagggggtgctgtgtcgaagtgacaaaagtgcgaatgagtggtgatcagaagagggggtccacctcgtttcggcgctcacgtttcggcgccagcatgtttttccactatagctttctctaacttttttcattgtcatccaaatccaacatttttgatatcgttcgaaagcttaatatgtttagaagctttttctaagctattgcttcacgattagacaaataccaaaaaagttatacatgaaaattgagaaaaagtcgaaattttaaagttttttctcaataaaattttttccaggcttgaaaaacttttcgtttttgataaggctaatagagcatgttaagagctttcgaatgataccaa

SEQ ID NO: 5621 - DNA, 1725 bp, Heterodera glycines
  misc_feature (1712)..(1712): n is a, c, g, or t
ttttaaaagaactataagatattttttcaggtttgagtcaagattttttggggcactgtatttctttcataaaaatataatttgtttgggaaaataaaaataaatcgaaattataaatatggtcaataaatctaattaatagattaaaataattatattattattagttaaataaactaattattccgtactgaaatgacacgcctcttctgatcaccactcattcgcacttttgtcactttgactcaccacgtttgaggggatgatgatgaaagtgccaacagtgagtgttgggtggtcatttgtggggttcgtttcatttcctctggtgaccatgctttatcagctgtggatgatagtgccagcgaagggtgcggcagtgcgcactctttccgttccgcgaccacttcctccgccacttctctcttccgtcgctcgccttccccggcccaaaatgaattcactgttttggtaatttcctccgtcgattctctacaaatggaacttcgaagtgccttttctgtccatttaaataatgcgcaacacatcgaattgtcagagagaaacgaagtgagaattatggcaattagcgtgggtaattaattagttcttttataagtattattaatgattccttttcatttaccccccaccctttttattccatcgcttttaagtcaccagccgaagtgaccgacgcaattggaaatgcccaaagagtggtggcgatttatcgaattgacaaaagcgaatcattcgaacgaattcgaaaagtgttcgaatattgttcagcaaagacaattaacacaatgaaagaaaaggtcaaaaagaaattaacataagaatgaattgagcggaaaaattcagggaaagttttcgagtgattggactgataattaaccaaagggcgagggaagtcggacgaaagagtggccaaaagttggccgattcattggggacgaaattcagtgaaattggactgacaatgctggagaagacggtgggcattgggcttttgccaatttagtcagtcattgtgccaatgattcagttcccaatttggttccattgccctcgaccaaatttggcatccgtcgaattgtctctgtgttcccacggcggcggattgactggcgtatcgcctctgtcccttcaacttccaacaatggcacgaccccaacggaacggcactgaaccgatcgcttataaagagtcagccaaagacgagttgcgaccggcaatgggactatcgggaagtgcgataagagaacagcaacagaagaagaagaagacgaatatcgaaggaagagagaaaatggaagaaataggaggagaagggaaggaaggaaagaaggaagagggcggaggaggaggaggaggagcaacgggacgagaaggaagcggatgcacactgatgtgacacaacaccggtcaatactgactctggttattaaagaggaaagagctgctttttaaaaaagattcatttatgctcggtcatatgttcatccatcaatttaattgttttgtttaattgtaaattataaaattaaattaagttttaaataatttatgttatttggaagcagaaatctgaaaaaaattcttgttatcttttcgatagctcataattttgaaataataatttaaatgttattcttcttgttataacaatttaaaagtggtgaaatttttaaaaattacatagccanaatagagaattag

SEQ ID NO: 5622 - DNA, 1172 bp, Heterodera glycines
taattagcaactataaattaaagtgacaaataatataccccacactgggttaaaagatacaatataacatatatatttttacccttttcatcggctcaaattaattaaaaaataaatattttttaattaagttggcaaatatttattataataacattttgaataaaacaaaataaatttaatgaactcaaaagattttttaacgatattcgcaaaataaaatttcaaaatttattaaaaataaaaaaatgaaaagctttatttataaagaatttgaaactaaataaataaaaatctttgacctctaaggatttttttttacaattcttcttaataaattaatttataataatcattgtgaaatttgttatttcacttttaaattaacaaattattttataaaattaaaatttaatttaaaagaaacaaataattgtactataaaaagtaataataatgtactaaaccaaaaattgaaacatttaagaatatttaaataaaaattgtgaagcatttttgatcaatttacaaaaaattccaaatgtaaccatttttaaattaattaattatatttattttttactttgaaaaaaaaagatctaaaaacaacttttcaaaaatgataaatttcaacgataggaaatcaaataattattttgttcttttctaaaattgaaccctaaataattttttttaatattataataaaaaatggaacataataacgaactaattaacgcacttaattgacaacacaaaaaagattaatttattaagattgagtattaaataaattttaaataaatgaaaaaattcatgaccatgactaacaaagttactcagagaaaatgcatggaaaaattaaatctttttattaatagtgaatgaatgaacaaattaaataaaattaaattatttttaatactaaagcaagttttatattatcaaattccttaaaaaacttacaaataaaagaaaaaaaacatggatcagaaataaattatttaccaaagaaaattcataaaatcaaaaaaaacataataaattattactatagcatactccgctgaacgcacataaacaaccactactggacatgattaaaaacaaaaatattaagcataaataataaaggacaaaaattttgcaaaagaaatttaattctttatttt

SEQ ID NO: 5623 - DNA, 3478 bp, Heterodera glycines
  misc_feature (3460)..(3460): n is a, c, g, or t
gacattttatttatttatttattaattgataattttattgttaatatttttatttttccaaatacaatggagttatgaatctatttttcaaaaaacaaaaaataaataaaaaggataactggttaatagtaaattttgatgtgaaaacagagaaaatcggtaagatttcaatgattttttggtcttttgaagtcattgatgttttttagtcaattgaaatgatttgactagtttatgacaaaaatttaggagttttgcttttttcatgttgaggttcatacttgctatatcctcgtcaaatggcaatcattctaagcaagtttttaaattttaatatttcaatttttgcttaaaaatttccttgccaaaaaagtacaattatttcaaatttttttattttatttaagaatatttaaataaaaattgtgaagcatttttgatcaatttacaaaaaattccaaatgtaaccatttttaaatgaattaattatatttattttttactttgaaaaaaagaagatctaaaaaaacttttcaaaaatgataaatttcaacgataggaaatcaaataattattttgttcttttctaaaattgaaccctaaataattttttttaatattataataaaaaatggaacataataacgacctaattaacgcacttaattgacaaaacaaaaaacattaatttattaagattgagtattaaataaattttaaataaatgaaaaaattcatgaccatgactaacaaagttactcagagaaaatgcatggaaaaattaaatctttttattaatagtgaatgaatgaacaaattaaataaaattaaattatttttaatactaaagcaagttttatattatcaaattccttaaaaaacttacaaataaaagaaaaaaacatggatcagaaataaattatttaccaaagaaaattcataaaatcaaaaaaacaataataatttattactatagcatactcgctgaacgcacataaacaacgactactggacatgattaaaaacaaaaatattaagcataaataataaagtacaaaaattttgcaaaagaaatttaattctttattttgtataatgtggcgatcggacaacgacaaaaaaatgatttacttcgttatgttcatgtgaataaataaaataataaataaaaattacaacagataaaagaatttacgcgataaacacataggacttttcttcaaaattttccctatttttaaacaaacggtaaaaatttaatgttttaaataaaaaaaaattttataataattgaacatggaattatttaaaaaaaactacaaacaacaaataataataatataataaaaacctattttctccttggggtcaatttattttcttcgcatttcgtgcgatcatttagagttacacgggtccgggtatttggacaaaaaccgggtccgggtattgccggtctagaaaagctgggcccgggtcttggtgtaaatgaataattaaaatgtttctcatacaaagaaactctttgtatttatttgtttacagcaaaaataaatttgagtttggattaccaaatttaatatttgctaaaattaatttgatataatttatgtaagaaatgactacggcttgaattcaaccttattctcgatccccacattattatccatttttaatacccctaacaatggcatttttaagagggaaagcaataaattgcattaatttacaattaaaatataatttttattgttggttaattttaggtgaaataatttgaaatttttataaaattgaacaaaaaagtacgaaactcggccaataatggaataacaattataataacaaaaaataaaaaatttatcaaaaattaaaaacatttatttaattcagatgcccgatcatgagagtttaaacaacaaaaaacttttaaataagcgaccgatccaaaaaaacccataattattatgtttagatctaagctttaccttaacctaaactgaaattttaaaattttccgagccaaaaggtaagaaattcagaaaaagcccctttactctagaacctctctgggctaattcaagaaacattgtccattaaaatatgaaagtgattatttatatgaatttatttttgctctaattattcttttatctcgtctatttaaaaaatatttgttttagacaaattgaaattggggctgattaaaaaaatcacatcaccaccctgggactacaacatatcaacagctaatgacaagttaattaataaataaaatttttaattaattttgcaaatattataaataatttactaatagcaatatagctaatattttatttttatgttaatagaataacaaagttaaaatacaaaaattaataaaaaataatttacgcaaagcaacattaaacaataattaaatggtgctgggacgtttcttaaaaaccgccagggcgtttcttaaaaccgccaactcatatgattatgtatataaatatatatatattagaagtttacataacaataaaaaatttaaaatacatatgcatatctattgacggtaaaataaaataattatttttatccttctttaaaacgttctccaaaaatatgaactgaccagcataatatattctaaaaaataaaatatttaagatatgagttggagaacagacttttgttagaaagcaattaggatattcattaaggcaattgcaaaatttaatatcacaatcgtaacgtttctgatatttttttatgtagcacacatcgtggttatagcaacaattatcaactgcaaaattttcgaatataaaattgctaattcgtaatttgttacttttttgaaagttgcaaaaccagattacaggagctattagacaagagtctaatagagaggtgccacaataagtcccacagaatttctttgcaaataaaactgccagcctcatatttcctgctgacacctattggtacaaccaaataaaaattaagtaaataattgtaaattaatttaataaagatttttagtctgtcactgctagactaataatatttccggctgacacttacttgcacaacaaataaaaattaatagatattattgaatatttaatttaacggatatacatacataatcatatgagttggcggttttaagaaacgccctggcggttttaagaaacgcccaatgtggcggtttttaagaaacgtcccagcaccctgcactgtcaacattgtgcgaatttccatgtatgccaagcttccaaaaattccttatttatatttactcttaaagctaaaaataattaaaattcattaattttctttaaaaaattccctcgaattaaaattattttgggcaaaatctattgacaaatcccaacaaacttgaaaaaattttcctcggcggcgccttacccaaaaattcttttatttcataaaaaaattggctaanattacatggtcatttttt

SEQ ID NO: 5624 - DNA, 2937 bp, Heterodera glycines
aaaattcatctttatgttagaatctcaacagaattcaggtccgggtttcggaattggtcgaatgggtatcaaattcgtgatcaactaccccgaaaactcccttagaaatgtttatatgtatgatttataaaaactatttttttatggtctgtaaacgacataccggtaagtactagagcccggaaatttcaaatttgcggatcctgttgcaggattggaattcaaaaatttttgcaggaccggatccggccggattaatcctgcattcgcccactgacatttagcctaatgtacatctcgcctatcgcattcataccagggttgttctgggacgagaaaaatatcggtcgggattcgggtcagccaaaaatcatcgggtcaggtttcgggacgaggaaattttcaagtttcgggtcaattgacaattttattatatgtttaaaaatcaataagaagaattgggcttcaattatcgaatttaacattttatggaggaaataagaaaatgtaaatttcagtgcattcgagatcgaaaaatcagatttttttaacggaaacgatgcgggggggggggggaactgagccgttggtggaactgatatgaaggggaaacggcggggggggggacgagctgctccccgcaaatgtccaggaaatgacatagtaaatatgtttgattttacacaatttttgcaagcgttttatgttttttttcaaagaataaatattagataataaatgtttgagcaggtatttttaaaatcttgaaatgatttgacgagaagggaaaacaaaacgaaaaaaaatgggcggggcaaaagaaagaggaaaaatggtaaaagacaaaaaaaaaagaaatccaaaattcatcgtttcccacaaatccatgggcaaaagcattctccgccttctccatttgatcaatcaatggtcgctgttgtgccgcgtcgtctccgtttcttccccaaatttggctgccgtctgccattctttcatctgccgttcagtgccccgcgcggagaccgtcggtacgcatccgatgccgacattcgacgcggtcagccgcacgtgccgttcaaattgctgcacgcactgcaatttcatgcgttcacgccgctgcaccatgtgacaaaggttgcgcatctgtggaggaaaagccgcgaattttttaaaattgaatttctgccgtttttcaatattttacatccatatttcggcattttcaaaaaccccaaaaaatgcaccccctaaagatggaaaattgtgactttttttcatgagcaaaatacgcgaaaaattttcaagggtctcaattatggagtataattcggcaattgtgaagatcattggtcccgaaatttaaaattttatgggtttacgaatttttttaaaccaattttcagaaattttttgtccatatttcgtcaatcaatttataatccatattttggactttcctgcaatgttatcctacaaattttcggagacggggagaaaaatgaggaagttgtagccgttttcttcgccaagaaattatggtcaaattttcaaaaattatagtaaaatggggaatgatgccgctgccggaaaaaattggaaatttactctaatttgttatgcaaatacaaaaattttttcaaaaaatttgcccatttaacgaatggcattgaactattttagggtggcacccttccgctaaaaaattcatttttatttttcgaggttgaaggctattaaccattttttgaaaaattttagtgtttttcgtttgctttttgcgcgttcgcttgttttgccaacccgttcgaagaagaggcgaaggtgccacactttgtccggcttttcgtttgtcatccgtcgaatttgggccccgacgcagtcgccgtcggcgtcgcctccgtccgccgtcaccaattcggaaggtctgaaaatttttttccatttaattttttgctcttcggcataaaaatttgggtgaaaaaatgttcaaaaataaggctttttgacttttttaggcttaatttcttgaaagtcgatcaaatttttgaaaatttttttaatagaaatttgtttgaaaattttgtaaattcgcagaaaaatgtcccatagtgccacaaaaagagtcattatttttagtagatttattaggcaaaaaaaaaatatataacgaacagttcaaaaatgtcgttggcggccaacaacgacaggtgagggaacagttcggtgcgctcgaaattgttggcactctgtgcgccgccgccaccgatgccccacggaatttgcacgccgtggctccattcctcacgccatctgtccgtcacgcggagcagcaccggcggttgctcaccgtggcggcactcctcggcattggcaccggtgccaccaccgtccaactgctgaagagcaaacgacgacttcgactgccacggcacggcaccacccgcggggagaccaacggcattgtgctgcctgacgcgctgcagcaaatccgtacggtacagctccgtcggcattccgtctgaatgtgtttgccgatggggtgatcaccaaattaattttcaaaaaaaaaatttttttcatggattttctacaaaataaaggaaaattactttttaaaagtttacgcgttctaccgttgaccatgctcactttcttaagccatattaatcgtagccagaaaaaatttcggagggaatccaaaatttttttgctcatcggacaaacattttttactcgtattattttaaaaaaattttcagcgcaaaagcgaaaaagcaggaatttatagcggttttgcactaaaaaatgaaatttttgtcaaaaaaacggaatttcggcttttcaaattgtccggtacttgtgtggtttacctgacagatttcacatacattttcaaatgcctataaatgtattaattttacattgtttttttaagca

SEQ ID NO: 5625 - DNA, 3672 bp, Heterodera glycines
cttgcagtgcgctcaactaagtctcttggagttagagcattcttcatggtatcatcaagaaaatcgtgcaatgtgggaggcccggaacattctagacagtttccaaaccaaacactcatagtaaaaaattatttcgttagaatacgagaaataatttgaaacgaaacactggttactaatcaacatatctctccgcgaaaactccagatccaaataaatccgatctctcatcagatacgtctcggcgagcacttgcaggacacagtaacggagcacaaaatgaacacaacggcgcacacagagagaaacgtcgacggaggaatcgctgaggaaaaaaccaaaaccaaaatcatgataatgaataactaaactattaaaacactgactacgtatgagcagaaaccacggattgcttggcatttgggggatcggtggcgcatttggcgaccaattccaacaaatgtttggaccaaaacggaatgttcttcttcagccaccgtggtcccagctcgtgtgccatcgccacatatgcctgcaccgagagggagacgttttccaattagacaggcagctaattcggtgccctatcccacttcggcgatgccaatgcgcgtctcgcgctgtccccgtgggttgtagccggtcgccgtcttcgccgccgtcttcagaaagcctccaactccgccccgctgcattccgttggcaagacagcgaagaatgtcctccaaagtgccggcagtttgcttggagccgcaagggccgagagaggggccgcccgcaggggacgaaacggacgtggccaattggccgagtgatttcgacccaactgaagaaatgggaagttttattaaaagttataaaatttaaagtgctccgatctaaaaagacccaaagagatgagttaacaataagagaatatgccctatttggcgcactttgtttcgtttgcgctgcgacgcgtgccgccattttagcaaatacttgggcaatggcctggcgaacttcgaagttggcacaattgagcgatttgatgcacaaagtgcacatcgattccaagtcgaactgggcaaacagcggcgaatcgggttcggccacaagagaaaccaaacactgaagccattgaagaagtaagggtcatacactcttttatggttttttatatttaaaaaagcgaaagtattaattaatttagggcatttgcaacatttttctgcaaaaatgagaatttgtgctaaattttactttcgctgctgccgcacggacagaaagcacctgcaaaataaattaattttctattttttcatttcgtttgttccgccgttttatgacggcaaattttttttatagcactcacccgatccgctaatgacttggccaaacttttgtaaatttctttgtaaatcggaaatgccccggcgccaaggcccttcaccattttggccattgtgtgccaaatttctacccgagcagacgactgtaaaataagcagaaaatgaaggtaaagaagggggtcacccgaaacaaacctcggcacttttcatccatttggcgagtgattggaacgtttcctcgtaactccgtccgaccattcggcccaacttttcgtacatttctcccaacacacaaagtgccgtcctttccaattaaaggatttggtaattttcactgatttgcatttgtccccttttctgtccttacaatttgacttgactctgtcccgatgggtttttcagcacgtcgttgcacgtgtttatagtcaagaaaaggttgtaagtgtccgcaattgcgaagatccgcgcgatgcatcggccgaggagagtccgcgaaggcggcggacagccgccggcgatgcgacccgtcagctgctccaacagcttctgctggcagtccttcaggtcggcctgtacaaatttgaaatgcaaataaaaaataaggaagtaaaaaatttaaaaaatgcaataaaaattggcatttaaatttttggggattaaaaagtgccgtgcttttcaatttgaaatgaccttttttgtcaaaggcaatattctgtccagaaagcgcagccattcgtagagaaacatcgccttttgcgggtccgggcacatgcgaaaggcgtattcgttgagcagcaaagagtgggactcctccattttgtagtgggaaaacaacggagaggaggacgacggaggagcagaaaaatcagtggcagacgaaagggaagaggaagggatcatccaaagggatgccgaaaatggaagcgaatcggtaaacggaaaagctgataaaacaatgggaaagacaaaaaaacaatcaacagcaaacgaaacgccaaacaaaataatttaaattatgggtcaactttattttagtttgtcaaacgaaaacttcccaaataaaaacgagatgtcaaaacaaagcatattaacgaaaaaatgaaataatttattacaaaaatttagatgcaaatatcttacagaaaatggtcatagaaaaataggcaaaagaaacaagaaaatgcattaaaacccgcaaagagatacacaatcatatgaaaataccaccattactcctccatggatttttgcctcgtcaaattcgacgcatttgaggcggtcgaactgcgtcgcttgtcctgttttttcggttcgcccatgtacaaattgacctgaaaagccgccaaataattgggcccctttcattgttttctcacccgttccactgctcccgggttccttttgtaatctatcaaaaactgacgccctttcgacgctacgcttatgtagccgatcacagtttggtgtgccgtggtgaccaaccgttcgtccaaatacccattgatcacaagcttacggatgaaacgttggcagtccttcaaaggcatttgaatattttttttgattgtggcggtaagaaaacgaattttccacctgttcactcaaccctctgcccattgcgaaaattggcagtcgtccgtgtccattgtcatccacctaaagacatggtcatttattgtcggtggattgcttgcgcttccgtacttttcgcttcactgcctttttgcccaattgccctctgaacaattcggccaagtatgcgacgccggaattgttgatgaaccgaatggactccaacacggcgaccgcttctttggtgaaatcgaaaagttttgccggaagttggccatgggtcgcggcgtatgcgcaaattgtgcaaggggctggcgttaaaatgcaattttcccggtcataagtctgaaaaaagggaaggcatgcaatgttttgatgagaagaaagctttacaataattcttaaaaaatgatggagaatatataatattttttggatatttaatttttaaattatcggttttgcctctccaaaatgtgaaatgatcagtttccgacgacactcggaaatgttctcgccgtatgcaattacattccacaaactctgctctttcatctgctttatttcaggctttggttcgtcatctgtttgtaggaaaaatggtggaaatcattaaatggaaatattataatatgctattgaaatggttttgaataaatcactttcgattagccttttgatccgcaaatggtcgttgaaattgtacatgacaatacaatgcgcaacttggctgtctcgttcagctcggccagtctccctggtagtaaca

SEQ ID NO: 5626 - DNA, 2301 bp, Heterodera glycines
gcatttgaggcgatcgaactgcgtcgcttgtcctgctttttcggttcgcccatgtataaattgacctgaaaagccgccaaataattgggcccctttcattgttttctcacccgttccactgcttccgggttccttttgtaatctatcaaaaactgacgccctttcgacgctacgcttatgtagccgatcacagtttggtgtgccgtggtgaccaaccgttcgtccaaatacccattgatcacaagcttacggatgaaacgttggcagtccttcaagggcatttgaatatttttttgattgtggtggtaagaaaacgaattttccacctgttcactcaaccctctgcccattgcgaaaattggcagtcgtccgtgtccattgtcatccacctaaagacatggtcatttattgtcggtggattgcttgcgcttccgtacttttcgcttcactgcctttttgcccaattgccctctgaacaattcggccaagtatgcgacgccggaattgttgatgaaccgaatggactccaacacggcgaccgcttctttggtgaaatcgaaaagttttgccggaagttggccatgggtcgcggcgtatgcgcaaattgtgcaaggtgctggcgttaaaatgcaattttcccggtcataagtctgaaaaaagggaaggcatgcaatgttttgatgagaagaaagctttacaataattctaaaaaaatgatggagaatatatacaataatattatttttggatatttaatttttaaattatcggttttgcctctccaaaatgtgaaatgatcagtttccgacgacactcggaaatgttctcgccgtatgcaattacattccacaaactctgctctttcatctgctttatttcaggctttggttcgtcatctgtttgtaggaaaaatggtggaaatcattaaatggaaatattataatatgctattgaaatggttttgaataaatcactttcgattagccttttgatccgcaaatggtcgttgaaattgtacatgagaatacaatgcgcaacttggttgtctcgtccagctcggccagtctcctggtagtaacactccaatgtctgtgggattgtgtgatggatgatgaagcgcacgtccggcttgtcgatacccatgccaaacgctaaatattaaccgaatttaaattcattataaattttacgattagcaaaatacatttattgtattactccatttttgattcaactaaaaaaggattattcgaatggaatgtgcagttgtaactatcaaaaatcccaattaaattttaagccgattgaaaaaaaaacagcaacaaaattcaaatatgcatgatattagtaacaattttgcccaccaacagttgcgcatagtatctgaatactgttggacatccattttcgctgtgtgtccactcttcgctgttccgccaaatcggcatggtatggctgcgcaccaccgccgaccattttcgccacatcctcgcagtcttttctgtggaagcgcaaagagattttaatttaaaagatgcaaagttttcacttggaaagacagtagatgatcccggagccattcgggtacatcttgcgaatgtgatccaccacctttttgaagttggcctgggatttgtccaccacgtcgtagacgaggttggggcgcacaaaactggaggtgaacctgtaacgcaatttctgtaacatcgcagtccaatggcaaaaaaaacaccaaacattttgcaattggcgatgtttagctgctgcttcacgtcgtcaatgatgcgttgagtcgcggtggctgtcaatgccatcaccggcactttgtctttgccggaacggtacggctcgagaacggtgctcaaccgggtgtagtcgagcctaaagtcgtggccccactgggacacacagtgcgcctcgtccaccttaaaggaaaaagcaaatttgaaaattggggcaagaaacaaacacaacggaagactacacctaatcaggcataaaataatgactcaccacaaatcgtgccaataaattgcgccgaaaaagggaaatgaatgcgtcgtttaatcgtcttgatgcactaatctgcaaaaaatgaataaataaatcgagatttactttacttcataccatttcgggtgtgacatatagcaatttgatggtcggttcaacggacgacaaatctgaataaatggactccacttcaacagaatccattgaccctcggagaagggcacaggaaatctaaaagaaactatataatgcaaaatttaacccaaattttgcccattttaagataat

SEQ ID NO: 5627 - DNA, 1688 bp, Heterodera glycines
catacgtgtacaaggggtggtcacttccaagggtcatacgacgtacgatcgggccaggggggtggtcatatgcgattttccttacgacggggtccaaaatttttgacgaccttttttttttttttgctcatcgctggtttttttcgcatgtgcatataatttttctttgaaataaatgttgatcgcaattttacaggattttatttttttacgattgacggaatgtttaaaggaatcagatgaaaaattcactactaattatttcaaagcaatacaaagttcaccccccccctttcagtttcctcataagaacgaagtcagggggaggtcgacccgcccctatttaatgcatgctaacacactaattgtaagtgaaactggaccctgcaattctgcaatttaataatttgatcctgcatcagggaaagaagcggagaaatgacgattgtaacgccgggatggagcacagctggcagttggtagcacaaactcttcccagaccctaaaagtggtggtaaaacattcaaattccaatactgtctccacccgttggcatcacaataaaacaatcgtgccccaaaagagcggcgaccaccgccggcttttgcttgaagcggaaataggaaaagccaaacacgtcctgaaaatgcaaaggccaataaaatgaacgaacggggtcactaattttatgttgaaatttttttccatttcgggaagagggaattcccgcccctagctacgggcctgaaaataactatttgttctcttattgtgttataatattggaataaatttattccagaaaaggtgtcttaatcttaaacttccgcgaaaaatgagaaataaataatggaagaccaccttcaattttctgaacacatccttttgtcctccaactccgagcaggtttactaaaactcagcaaaaagtccaagaataggctattaattcaaatgaattaccatcattgtgaaattctgccgaagaatcgcgtattttgaatgggccattcggtgctgatgggttggcaacgacaattggtgggtgttgctccgccttctcgaatagaaaatctagaaaaaatcttaaattggcatatcttaatgggtacaggttatatttgtgggttggtttaaatttaaaaaatccaatccgaaactgaaaaaagagatttattcatcggactcaatgttttaccgtcatcgataaactcgtggaaaggcccttgatgagactgtcctccaactccgagcagctttactaaaactcagcaaaaagtccaagaataggctattaattcaaatgaattaccatcattgtgaaattctgccgaagaatcgcgtattttgaaaaatgaattattgtcattgagaagttctacagaagaatcgcgtttttttaatggctcattcggcgctttttgaccaaacgattggtggaaagattcctgatgagatccattgcagcaatgaaagacgggaaattttatagtttcatcaattggaacaaaattgtaacgagtaacttgcggaagagttcctggcatcatctaagaaggtaaaaggttttaagagataaagagaaagtttaattgatgacttaaagggaagataaattaacaacggataaagcaaaagtgaatcgaaatgtgcgatttcgaaaaatgaatattcattttgtattttaag

SEQ ID NO: 5628 - DNA, 3278 bp, Heterodera glycines
ccccccccttttgtgttcttccgccgaatttggcttccccacaagctcccccccccagcagaagaaggagaaagatcccttaatcattaagtgcgtgtcgccatgtttatttacaaagggaaaagcggctaatgaatgaatggcctttgaagtgccttttgacattgcgccattcattcgccgcttcaccgccccgggcgaaagcggaaaattcccgggggcaatgaaaagcatctctttccgtgttagcatttcacacccgtggtcagttcatgttgttgtctcccttatgctgttgccctaaaaccttttcatttcaatggcacaaatcggcaacccatcggaagggcttttgcccttgcgcgaacggcggaatggaaacgaattactgaatgtttttaatagatcagttttggcacttttctcttctgtaattgtcatggatttacattgttccatttatttttttttcaaaaaagtggaattggcatggaaaaatcagaaaaaaagtttaattagtaccaaaaggtattttttaataaaaaaatatatttttttaaatttttcttaattaatttttttagtttttccttttttttgcccccccccccctaaaaaagtgtcgtattttcttattattttttaatttcttttttttcgtcgatccgttccatttgccaatgcctttctcgtccccccgcttttcccttctgttgcccccactgtttcttctccttctctccctccgcttctgtcgttgtccctcctccaattcttcttccccccgtccttttctgatgagtcggtcccttctccgtgtccatccgccacttttctccccctccaatggtcggcgtcataaagccgtgccaacgttcgcttcgtccctttcgcccccggcgccgcccatcggacggatgaagccgaacctcgcggtgtataattatgcagctggtagtgcaactgctgttcccagtgatcagtggaccaacaacgagactggcgaagaactgcttgggaagggccaaatgctggcaactttgccggatttgagtgagtgtggggaaggcaccgaaaaatatgctatatgtcgaaaacggcatttgccggtcgtcattcgtggaacaataagcagttggccaaaggagcggcacacccggacattttgataggggacaaatgcccaaaaaggaagaattggcacccatggccatggccattgatggaagatacaaaaatcgaaatccctttgaatttgtttttcccatgctcaggtgatccgtgctttcgacgctatgctaacaggtgcctgcccttttatctgccgtggctttactaattcagtgccattcattaatcccccgtccccgaccatttagtattattgtcaatgcgcaaccgttcgagcgtcggtcgagcatttcgttgatcaactgtaaggtaattttctggttgaccccaactcgacctcgagagggaaattgccagaaagctcgacagtcccggaaaatttattccatacgcttattcccaaaggtgcaatgccttcgctctccggtgggcctttactcgtgccgctccttcgtctacgacaatttgaaccaagtgtgcgacttgtttgcccacgtcggtgaccaatcgccggcaaagtgagcgtggaaatcgtgccaaataactcaaattatcagtgccataatttaaatgtcaattattggtgggacattcgaaattgggcattaaaaaaactttatttttgcctcggtacttattctacgctattcaactgctccctttccttgtaaaggcttctccgtttcaaaacgcgtgactatttcgagccgacctccgccattcattgtgccatcgacgaaaatggcaacccccggggcaccgttgttgttccgctctctgccgcaatggcaccgacacccgtgccactgactacggacatttccatcagcaaagcatcgctatcattcactgacagtggggccatagaccatggggaattggaagaggaatctgagaaaagtgcaataataatcctaagaaagtccgggataagatacctcttcgggatgccgaattcttaaaacagaattcatgttttgtgcccatgccaagtttcttccaacaatttcggcatttttatcaggtcccccctccattgtgccgcctcgtcagccgacttcggtggcacccgcaactgcaactggagagcagtcggaggaggccgaggaagaggaggaggaggaaaatagtcaacaattggccacaatgagcagcaccagcaaaagggaggaggacgagcaggggaagaagcggaacggagcagggacgggagagcagcagaaggagagagagtgcacggagaagcaaagtgagggggagggaggagaaaaagaggaagacgaatagggggagggggagggggacggaatggcacatgccaaagggaaggctaacggattggaaaagttgatcctgactggctttgttctggacccgccgaaccgggcggcgatggctctcacccaaagccattgctctccgactgagataatagtggcattagccatctcccctatggatctttcagcttgtatttatccttaaacattcaaattttaaatttgctgaacagtgccccgtttcttgcgaactgccgactttgaggtgagcacacatttgaatgttctcatttgaaaatttatatgcttttatcagtttcatttttaactgatgaacatttttgatcaaatcaaaatttaaatttaaaaattaataattaaaatctgtgtatttttgcagcttttcggcttcgatgaatttcgcattggaaatgtgcgcggggtggaggagtgcgcgaacagttgcaacaacaaacgcgcctcaaacggcatgcccatcaaatgccactcctttgagttcactgccgcgcgctccgagtgtatttttgccgccgaattggccgtccccttgggcactttttggaattttttgaaaattaaatccattgataattaaattataacatatttatttccttaggaaatggacagctcagacaaaaggcgggcacagattattttgaacgcatttgcgtggacaaacagttggccaagtgagtgccaatttgaattttgttttgatatatacggtatgagtattaaccagaggaacggtgggtatttgatacaggagatacggtatatgccagtagagccgggtaaaaaaatgaagatgcccattttcgtattattcccttcagccaatgc

SEQ ID NO: 5629 - DNA, 2007 bp, Heterodera glycines
cgattttaattgttaaatttgtattgaatttccgttgaaaaaaggaataattttaaaaaattagaagaaaaacaactacttggggaattgatctaaaggaagaatactgaaaagaaccaagataccccttgaccatgtatgtgaataaggaacagaaagcaaaaagttaataaacatatattaactttaagtttatcaaaagccaattactaggggtgcattttcacattgaaaactcaatctttaggggtgtgtttttccagaaacttcgggtaaaatagccgaagcacgaagttcgaagccgaagtttcgcccagccctggtgcggatctgttctgatttatcagaaatgtcctgatttggagggagtgatccaattttgttgatttcttaaaattcttcagaaatttgtaattttgtggtgcaatgtcacacagattttaaaaatttaccacggcagtgcctaacggcaccgccggaccctaaaaatcatttgttttcgtaaaaattagctcaaaatctcaaaaattggacaattttttctccattctccgcccgatttcatatggcatttaggcagaaaatctgcgggggtgcgcgcctttgtggcacggaggagagacagtgcaatttggcaaggacgcggaagcgccagcgcgaggaaatgggagtgccgaggggaggtcagtcagaagtgccgtgggttggggtggggcttttgtgggtttgggcatgccttaggaaaagaagtcattcagttcaatgcccaaagcaactgaatgcgatagaatgctgatattatacaaagcaaagcaaaagtaaaaaatactaataattataacattaactaataatgcatttcattctccgcccatttgcccttttttggctcattttcagaatcgaggcgaaggaatttggacgcagcaaaacattcccagcgtggcaaaagtgcgacgacaacgacgcctttccactggcgacaattataaagcggcagaaggaaggcaaaggtggcataaatgccgttcttttgctgccccccccccaaaaaacatagcgaattgattatttatatgcattttaaatggctaattttttattttttgataaattaatcttcttgtgcctgtacaagttgtggtttcattatatcccggtaagtggtggaattactttgattgtcgaaggaaaccaactactaagtttttgaaaatcacggatctctgtaactgaaaagtgcctgccgccttggtccctaccccaattttactttgtttccaattttttattggctgtcaatccggcacaacccattattgttccatttattttttgacagtattcaccgaacagagaaccacgtttcattgattgtctgttatttggttgcgttttcaaaatttatttggaataatcaattgccataattagggggtgacaaattatcaaaataataattaaacaaaaaacccaaaaacggaggtctaaacaaatttagaaggagcccgtgtgcgatgcgcacgaccaaatccgcccatgtcatcattgtcggcatcaccaccatccggcaccacttcatcttctggcacagcagcttaaatcaataatacgaaagactcatggacccaaatttaaccaaccgcctttttcttccaccagacggcccattcgttggtcccccctcttttgactgacaagttcactggatgactttggagcaaatttataaggagcccgtgtgtgatgcgcacgaccaaatccgcacatgtcccctctctgtccctgtgtctcttcgttgtcctcttcttccccctttggctgacgaatgtcctggccataacgcgtaaactgaaacatcacatgttccatttttaatatggttttgactgacaagttccctggatgactttggcgcttgttctcgctctctgaacatgtcatgcttccaaccttaatcaattttaatttcctggcttatgatcccttccctttggttttctccaa

SEQ ID NO: 5630 - DNA, 1304 bp, Heterodera glycines
tcatacatgaaaaagggggggtcgaccccccccccccccttcgcccgcaaagtgccccaaaatgggggaccccttcgcatcgacgggggtgtaagaggtggggggggggggtcgtagcgaaggggaaaagaggaaatttctgaaaaattggctattttcttaacaaaattcattaaaaattcttacaatttttccccggtggcgcctatcggcaccccgaacccccctgtcctccaaaaagttttttaaaaccatgcaaaaaaaggctttttaaaaacaaaaaaagtcgtcgtcgacttggtaaaatgctttgaaaagcaaaaaagaaaaaaaaaggtcgtcgatttacatggccgggaccccttcgcaaaattggccgctgacccccccccccccttttttcatgtatgttacaaatggttgtgaatgtgaatatttcctacttaagtcattttaatgtaatttaaaaaatagatgtggtcgataattcggtgcagaacaccaaattgtataataaaactatttcagctcaaatagttaatgttaaaaaaattatgtaaaaaacgaaaaatcaacgatttgagcaatttttgaaatcacatgacattcgggaatagcaccttcggttttccttaagtctggtttatgtttgaaatgtactttagtcaatcccttgttttcaatgcagaaaacccaaaaaaaaagcaatttgattttaacgtgcaaatggggtgaggggtgtaaaaagtggatttttcacacaatcaatagcccgtgtcccgtacattatgcaaatttatcaaaaccttgtttcgggatgtacgccgggctgtccttgcactcgtcttcgtccagctcctcctcatcctcttgttcctcctcctcctgttcatcttcgtcctcatcctgttcatcttcgtcctcatcctgtccatcttcctcctcctccccctcgtcatcttccgctcctttccttcttctcggctcttcctcttcctcctccgcttcttcgtttctatctatgtccgcctcttggacatgagactcatccgtcggctgctgatggtcctataaaaattaacaatactttccgcgttttaaacccatatggcctgtttttccatcatatattatctcccaaaacaacacttacctcgatcaaacattggaggcgcaatttccgttccaatgcctcaattttttgccctgcctccgaataagcggcgaccaatttctctttgtgcttaaaagaaaatagtagaaaatagctgggctttgctattccattgacaaaccttcaaaaa

SEQ ID NO: 5631 - DNA, 4344 bp, Heterodera glycines
  misc_feature (64)..(64): n is a, c, g, or t
tttaatatatttttagtaaaataaataatttttttgcattcatctaaaaaaatttatggtttanacgatttttcaaaaatttgagctcgatttaatttgtttcaattagcctttgcaaattgccctgttgttgtggaaatccctgacgttgaagcagcagcgttcaaagtgatattgagcttcatttacgcggacgatttaagcgaattgaatggagacaatgcaatgggagtgctttgcgccggtgaatttttttttctaaaataaatgctttaattattggatttactaattagccgataaatacaatatccctgatttggtccttccatctttgcaaattcccttctccgaattgcgcaatgttttccttgcttatgcccaggctcgtcttttcgactttgaggtgggagagaaataattaaaaatgaattaaagagaattttaaatgcaattattattcaaaacatttttaattttaggaatattgcaatgattgtttggattatattgacaaaaatgcggacgctttgcttaaaacggaggaatttttgcaaattgaccaaaaattgttgtgtgaaattttgggacgtgaccaattgcaaatcagtggagaaatttcaatttggaatgcggtaattctacttaaaaataaattaatttcatttttttaaatattccattaattttaattgttttttttcggcactccgttggacggaggaaaaatgccgtgaaaatggcattgaatgttcagcagagaatcgccgtcaattgcttggcccggcactgttcaaaattcggctcccgcttttctcacatgtggaatttactgttcaaattggtaaaaagtggatttaatattaaaacaaagtaaataatgggatatcaattttaacataaattacctatattaactatacagaaaagcaattagaatatcgtttaaaatttatactttattagttagtaaaaatttataaaattagacatttttaagggttgcttaaaattaattgcttagaatgccatttccggcctgtctaactcttatttttacagttccgtccggcattttaattgcagaagaagtggtcggcattgaacaataccgtagccaatcgaaaatgtgtggcacttccgaaggattactgtacggcccattgcaattcccgagccattggcgaaatttgacatttgggaaaattattttggacattgaaaaagtgtcggaatttgtgggagaaaaagtggggagtcgccgattcagtgaaactgttcaaatcagaggacttccttggaatattttggcaaaaataaacggaaaaactgatgaaaaatgtctgggcttttatcttaaatgtgcagcagcagaagaaggtaaagtaaatcaaatgctaattattttacattaaaagttgtcttaatttaaattaagatgagaattggtgctgtgaatgttccgcaacttttcgaattgtttcgcaaaagttcgacgtggagaattctactggcaaatttttcggacaaatttttgatcacacagcggatcaagcaggattccatggattcatttcatttgcggtgagtggttgtttattaattgatccattatggttaattaaggaattgctggaccctaacaatgaattttacagcaacaatgaggacaaagtgacattgacagttgactttatcttaaaagatgctaaaatgggccaattttctgctccaaaaacagcagacaaaacaatttttatggaaattgaaaaagcttccgaatttttttgcgaaatcattggaagtgagcgaaaaagcgaaactgtgctcatcaaaggacttccgtggaaaattgtggccaaaataaaccgaagcgctgatgatgagaaatgtttgggcttttaccttttatgtgccgtcccgaaagaaagtgagtggaattaattaaaaataatttaaaacaataaaaaccagcagggctttattaaattatgctattatatggtggcaaaatctgttaataaatatcacaaaaaatcaacattttcgggcggggcaccaccggaacctctctaagttttttttttgaaaattggtacaaaaacacaccagaaaaaacgggatgcaataaaaggggctgatgggtcgactaagatttttcgaatggatcggacggtaaaagttgatcggaattcaaattattaacggtccataaatttgactagtttgttgcttttcaaagcttttttgcggcgtaatttttcaaaaaaaaaaccaggaacacgaggggtccggtggtgccgtcggcaccgtcggagaatttttgaaaatttacggcgatttgttaacagattttgtctaaaattgaccaaatgtcgcactttttgactcaatttctacaggattattaagtaaaagccgatccggcggtgccaaaaggcgccgccgggaaattcacaaattttgaatgaaattttcgatgaaaatgagttaattttaattaaatttattatttaattaattcaaaaatatttggcattttgtccataaaatttttcaaaaaaatcaataaaatcccgcagaatcccgcacaaaaaatcaaatttgccgctacgggaccggaactcaaaattctttgcggactgggatcccgcgggattaatcccgcattttccaaaaaatgcgggattgcggactgggatcctgcaaaatcccgcgcgggatcccgtcccgagccggtctctgggaatactgaaaataatcagcggaagcaaaaaattattgtttattgtttattgtcagtaaagaaaaaagagtccacaaaagggaaaatccgcttacattgaggacaaaacattaattaaaaatgtcctcaagaaagcgcaaaacaattaaaacgagatcaccgccaaaataaaatataatatgaaatcaataaaataaataaatagcgaccaaatcacttttagttttaatggattaaaaattcgactttaatttttccggtctattttacaggaatgaaatagttttagttttatttttaaattgatttaatgagtttatttcaataagctttttatcgagttggttccaaattttagttacccgccctgcaaaaggtataaattttttgaataaattttgaccaattttctacataatgtccttgattccgttatgtccttgtaaatcagtatatacgtccttggaaagagagagtttaaacgatacgagcactgaataatataatattaatttgctttaagcaccgaattggagtcgcaagtgttcggcaacttttcgaattgtttcgggtgtacctagggaatggttcgaacgccgcattgttatcaatgaaacacctattcacggatttgattatttcgttacattttcgtatttggtaagaaaatattttctttttgggaatacaaaaaatatttaattaggacatatatttttaggtatttaccttttcccgagctccctatattatgaaacgaacgaaaaatatttttttatttgtgcttgttaagctattttttattattagtgcatattttctgattttattgttagggtggccgaacgtttcgtcactgaacctttcgtcactaaacttttcgtcactgaacctttcgtcactgaaataaaataaagaattatttattagtgaaaactatttttttttaaataaagttatgtatttgaaattttggagtgtctgatcagtgatcaccgtaaaaaatttttaatggacgtcaaaatttctcgtttcccaaacatgagtgcctaaatgtaattccccaaatgctatttccaatagcggtaaaaaattcttaactatctacttttacatatttctgtaatttagctatggaatctgactcatcgcctcgaaattgctctttcaagaatctacaattcgttagaagcgtggcatatcatttgtcgggaccttcttgatttgttgcctattttcacaatgcaccggaaaatcgtataatgaaagaggtgcttaacatagaagttatttatctactgctttacaacaatttgctgcatctcatcgttacataactccagcgagcataacaagatgcattgcaatattttagaaagttttcatatctattgtttcaaactgattgatatgttacacaaattatgcatgcggtacttgttgcatggtgacgtcggttagacgtattctgtacatccgccagggctatggacgtgcaggccgaatgtgggacatgcaaattccgatgccaaattcggatgtagaaccattgatcatcatgcagagactgtacaaagctatcaccgacatttattatg

SEQ ID NO: 5632 - DNA, 2092 bp, Heterodera glycines
atttctgccaataggttcgagtgccgagttatgacgtgccaaactttttttatcccaataaattaaataattaattgaatcgttcgtgctgtttggtggcacagatgttgtgtgctcgcttccactttttgcacccataagttcgaatcccttatatgtaaattcatttttttattttacccttgaacacccattttgaaacgtaattattttcatttataatatgcatttatatcagagttttgtcacccggccaaatttttgttttgaagtcccaaaagataatgatacttgccaaaaaataaattgcgaaaatactatttacttcgttgcggattttgtgagattttcttatgtttgcacatttttttcacgattaccactgggctgggaatttaagtcactaaaaatcttcaaagtattttgtgattttgagctaatttataagaaaataatgggtgtctggcggtgccgataggcatcgaagaaaaatacgtagacatcaattttattatgattttttggacagaattcttagaaatcgttgtgccatgactacctaatataaaaaaaaattttataattcttttttgaaagaaaaaagtcacaaaatggtcaacttttgcgtcaaattttgaaaattttaatggaattttggagaactgtgaaaatttttttgggatttttaagaaaaattagcaaatgacaatattttttaattgaaaattcaagatcttaattaaaaaatggagatttttcgaaaaattatcgtgacttcaatcacgcgggaccccgcgggattggtaaaatggtcgggagggatcccgatgaaatcccgatcccgatcaatcccgatgaatttaaatatcgctcgggacggatcccgaggtcgggatcccgaatttaatcccgcgggaccccgatcccgtccggtctctaatagaaagtgttctgtctctgctgatcaaagttctaatgggcagcagctcaccgaggacgtctcgaaattctcgtttaatcacacccaaatagcttaaaatggggaagattttcgtaaaaaacctaggggttttggtgaaggaaaagggccgataggccgagggataattttgatcaaataaatacagactccgcccttggtaaaatacgatcgaactgataatgtttttgttccagagcagaacaaaagagaagaaagcggacgagtgaaaagggaggagagaatcgaacagtcggaggaggaggaagaaaaagcggaaggaagaggaggagggaaagaattggaaaaggacaaaacacacgccaatcccttgaaaacgcactccctttttggccaaatttcaattttatttttttttaaatttcttcgtcggcaatttgctggtctttttttctcttactctgatgatcggtctgcgtctgctgcgctctctctatacaccttactcactgatttatgtgtcattttttaacaaattggttttgatgcgttttttcaagttttatgtgttatgtattaataaatggcgtgaacataatttacttttaataaaacaaagaaaatgaagcaaaaattgaatataacttcttcaaaaatttgattgaaatgcgatttaaagaatctttaagtgaaacggttaacaaattaagtgagagccgctgctgattaaaatgaatagtttccaaacgatggcaataattaaaaatggtaaatgtgattaataaaacagtaaaatgagacaattaccataaaagtggcaagtggcagaacgaattcagaggttcaaaaagaaaacgacaaatgcaacattaatttgccccaatttttgcgggattttgatgaaagacaagaaaattgataaattttgaaaattatttcgttcaatttcaaaaaagttatgaccaaaaatgtctgaaaaactggttctttgactacttttacccataactttgctcaaacttgaccaaattttttaaaattaaagtgagctaatagagaacccataggctatcgaatgtttccaagaatgtttaatttggttgactttgacaaaagttatgagtagttttttaaaaatttgtactggaattg

SEQ ID NO: 5633 - DNA, 2451 bp, Heterodera glycines
  misc_feature (2210)..(2210): n is a, c, g, or t
  misc_feature (2368)..(2368): n is a, c, g, or t
  misc_feature (2371)..(2371): n is a, c, g, or t
  misc_feature (2377)..(2377): n is a, c, g, or t
aggaaaaggacaaataaatgtagcaaaaaaggcaattcttctaaaaaaaagaaaatggacaacaacaattcttgttaagtgaaggagtgtgacgcgtatttgatggactctaatcaattaggcataattgtgtttaaggtttattaattagccgattaattaagcataatagacgggactgcgctcgcggattgcccggcacagaatgcaggagaaaaccatggcgaagaactgggcgaccaacagcataagggcactggccagcactgcgttgctgtccattttgtacttcagcacggagaagcagtcctcctgagaagagggtggcacaatttgcaaataatgccatttgtgcgctaatgtgaaaatttgtaataatttatctttaaaaaataagcaatttttagccattttcgtcaattttgccattttggatcagatttcaaaaaaatggaacaattgggaccagcgatctcattaggcaccgtaagtgaacatttaaattttggacaaattgattaagaatattgaatttaccgccttggccaattcctgggggcacagctgctcgtccaggtacagcttctgcgtctcgatggtggccccgcagcagtgcagcgccgtctggatgggcttcaaattgcgccggccgtccgccgttttggcactcgcaatgaacgcgttgtgcaccgagtcgaccagctcggcacggttcgtgtacagtgccaacaccgtgacgaactcgatcattgccaggatgagcaggaggacaaagtactgtgaataaactacgtacatttttagtgcaatctagagaaacagggcctggaattttgaaatgaatgaaatcgggtcatatggatggggggatttctgtcataaaaaaagttttgttttttattttaaatagtacaaacattaataaacattgtgataggtggtgctttcggccaaaaaattcattcatacaattagagaatttttgaaaaacaaacaccaattatataaataaaccgattgaaactttgttactttgaaaatatgttgttttcgtactttgttgcggtttagtggaagaaaaaatataaaatttaaactaggttaggtgtcaaggaaattttgaattaaaaatctttggcacaaaaattggaaagtgccgaaaagcaggggaaaccgtaccaaggtaagcagcacattgttctcgcacgcggcgccgcaacagcccaaaaaaccgaccacgagaagcagggcaccgaccgcgaccaaaatctgagcacaaacatgacaattcatggaaaaaatgtgccatgaaagacaacatacccaaagcgacgcctcatactgaaaaatgggggaaaatttgttagtggttcaatgaaagtgaaaaataataaataaagcggaaaatttagttagccttgctaggcaaaattcaatttcgaaacgaaagatgtcatcaatatttcatttttgcacggtttttgggaaatttcacccaaaagttttagcaccatttaatacctgggccaattcatccacaaaatgtgcgtcaatgtgcgctttgcgggcgaaatcgggcaaattagttgagaaatctttgtccaaattggcctgaaaagttaattaatgcgctaataattacaatagagcgaaacgaaacattagttttttttagcttttgcataaacaattctgaatgtgttgagccgaggatctcaaaattccatcaaaaaatttgcaagtctctgaactccaaattatatgccctactaattgccaattagtaaagaaattctgtaattatttgtgttcacccaaagggaaaaggagaagacgagcacgccgaggaagaaaatggcaaaattggtgacaaacatcaacaatttgaccactttattgccataaccgtagaccattttattggatggtgtttttttaatacctaatctgaaatgttggaaataaactcaaaaatgtaaatctttgcaaaatttagttaatccccttccttcttcaatataattgcacatgcctatgcatggacggtaaaaaagaaaatttgaattttcgattttttgtctgaattcgcatccgctattcggaattggtcgatatggatgccggattcgtgatcagcggcctccgaaaaccattggaaacacgtcttaatgacttaaaaacaatttgtttttcgaaaaatggaaaggggnggggggggaaccaaagtattacgcaaaaaaaaacaatatcattttgcaattctcgcgcagcttttacacatttaaattgtggttggtcgataaacccattgtttcgatgtgtcatatcagaagaaaatctcttaaccaacgggaagacaaaaaaaggntgngcgagncgagagaaaaagaagtgtggtggatcgatcaggacgagggtgacaatgataatgatgatgtttggtgcatcatc

SEQ ID NO: 5634 - DNA, 5007 bp, Heterodera glycines
  misc_feature (4959)..(4959): n is a, c, g, or t
  misc_feature (4962)..(4962): n is a, c, g, or t
tttattatttataattttttaaaatgtttattttgtttgttttatttttaataaatttttcttcgagttataatagccctattctttaccctgaacgatccagggacaccgaaatgactgacatttattataaaatagcctcctttgaccattcctacttgaataaaattaatcaatctgaattattctcaatgattgatgaaattgttgaaaagtttcaactttgtaatgttgaagaaacgaggtcattatcgagatgggtatactgtatgctactagttttgctgtggatagcaattgttatgacaggaatttttctctattttaattccttgattcgaaatatgtgtaagcttatgcatatatgtagagacgaaaatgacacaacgacgataaatcggattctagcgggaaacacaaagaccagagaacactacttgggatgcttcccttgcgacaaactcccaaacaaaatcaaccagtatccttcaacattggtggcgaacaatgacccatccaataaagagggaacgcattggatagcaatgttcatcgttgacgacagaaccgtctactactttgacagttttgggcgtactccgaacagatgtatcagccactttttgcggaattatgaaaaagtgatttcgaataagccaactattcagtcagtgttcagtgagaattgcggctactattgcatttattttgttcattttatgtgctcatttggaggaagaaattatgagagtaattttgaaaaaatgacaaaaaagtagaagataatccagatttgtttgtcgtgaattttgttaagaaactgataaaaagtatttaaggaatttttcattaactcatttataaaaatggatcgattagacacagtaattgcttctcttctgaactgtcccgcacgtaacttgtgcgactgcttaaatcacctggatgagattcaaaaagtagaaaaatacctcaaaggaaaaactctacaaacaacatacaaaaatcaactaggtgagtacaaaggttttgagtacggtggaattaccaaagaatgtgcccgtaagcaaatggcttacaatggtttcaagaatgtgaccgtcgaccagcatttttatgtacggcaccgcatttgtcttcgctacgctaataatccttgcgtgattgagaagcatagaaatggacacgaacgattctacccacttgagcttgtgaaagtgaaacacggagacaaaagcgatatttatttgggacaaaatttcccaaagtctatacctttacttgacgaaaataattcaaaaataatgacaattattatgattcttgtcgtttatggtgaatatttgaaattgcagataatttgataaaattgattaaatacaaaatcaatttcttcttttgatctagagcctgttaagtttaatttaccgcttgaaaatactatgattgatatttttgggttttggtttctatacacgagaccgggaaataactcgggggtgaaggaacaatatttggcgcctagaaagtcggacagaggtcctaagcgtatatgaaaaccaacgtctgctgttgctaccaaattttgtactttaaattcctgaatttgggcatcgtaatacccgcactatcgaattcgttcggtgacttgctccgcagcttgcctacattctttctcattagctgctcctgtgcacacaaattttcccgtaccaaagataatagcagttgcatttgggttgtaaacattcataatgactgcattcattcgtttaggggtatattttgtagaaggagaaataatataaattttttcgagattaagcctagtctttatatcaataactgcaacacaatttttaatcgttggaaaaaacattttaaatgaataatgggagaaaatttttcctatttatacaaaataaattgaatttagttataatttattcctaaattaattttaaacttttaattaatttttatttaatattaatttgaattttatttcaactttaattataataattcatttaattttatttttagctaacaatttatcacaatcgggctctcaaatagcccctgcgggcgctcaagtggtagcatacctacactcaatagaatttgagttacctctgaccaacagctggtgctttccattatcaccagcgggctcttaaatgacacacacgtgcgctcaaatggtccctgcgtgcggtcaaatggcctggcatccctttcctccccaaagggcacgacggctgatgtccgtcccatcgatccctccaataggcttttaattttttttaattttattattttatttaattaattttttttaatcaatcaaaacccttcaataggcttgggttcaccccgcacccgtccaataggctttggtttttaaatttattatttttaatttatttaatttaattttaattaattttattttaatttaatttattttttaatcttttttttatttatttttttttaatttcaattaatttgaactttaacttttatttaattttaatcctattttaatctaatttcatttattaatttaatataattttagttttatcaactttaattctaattcatttaactcgaattttatttttagcgctcaaatttaacaagcgggctcacaaaaggcccctgcgtgcgctcagatggcacgcgcgagcgctcaaatggtccctacgtgcgctcaaatggcatacgcgagcgcttaaatggcacacacgcgggcgctcaggtggcatgcgtcccttcccttccccataaggcatgacagctgacgcccatcctctgcctccctttcccttctctaataggatttggccttgggttttatacttcagatgttttttcaattatttacctcttctgggattggatatatttattataggtgttttttaaaggtttaaatttggtactgaaacgtccctttccactgggactgaaatggcggggctgaaaattaagggcgaaaatctgcaccagtaactactaggaaccccaaaaaaaatattaaattaaaacctttgaactcccgatcccgctcccggaaaattggacactagaaaattggacaccaatggaaatttggacaccggaaaattggacaccgaaaattggacactagaaaattggacaccaatggaaatttggacaccggaaaattggacactgttgtaaataaaaattaaaataaacaaaatatattaataaacaaaaattttggcttggcctaaaagatctttatcttaatctgcacatatgttgtttataagcgtaaataatatggaaatgaatttgttattatttttgtaacatcagaaggagaagaaaaacatcatatcattcataaagaaaaagttttattacccatttttcgtgcattatttggcacattgatcaatcaccccccatttttggtgcattttttggcacattgatcaatcaccccccatttttggtgcattttttggcacattgatcaatcaccccccatttttggtgcattttttggcacattgatcaatcaccccccatttttggtgcattttttggcacattgatcaatcaccccccatttttggtgcattttttggcacattgatcaatcaccccccatttttggtgcattttttggcacattgatcaatcaccccccatttttggtgcattttttggcacattgatcaatcacccccatttttggtgcatttttggcaatgtcatctggagaggaaggcgaattacatggcgatgggtctgaagcaggcgatcaacaagatttggaggaacaacaatcatttcgagaaaagacatcatcaaaaaagaagataattcttgtgcgagatggatatgaatatggatttgacaaaatgagtcgatcggatcccagtattaaattaaataatattttatttcataattaatttgagatttggaattctatcgctgcatttttcgaggcccaactggtaaaatttattgtccagcgaggcttcatgttcgatcagattggcatcgggatgagcaaggcagatataagattgggagaaaaacaaatgcgggacattgccatgggcagacggatgaatcggcacgtttaattggaaaatataccattgaatatttctgaaataaagatcagagaagcacaaatgagacttcggcaacaagccgcttcacaaaatccattgccaacaagacaagcaattgccaatgttcgtgagaatatgccatttgaagccattattgctggaccctcttcttcgagtctggcaaggaactacagaaactatgttgtccaagaacggggcgaaaggggtgatgatcagcttgatttggccgatactgcacaaattcaaattcccgaaaatcttcgggtaaactttgtctttgatggatttgtcgataatctccggatgttggtttttgctaccgaatctggaagaaaccttttggcacggtttgggcagcatgcggcaatcgatgggacttttaaggtgtcaactattcaatgttaaagttacagaaattaattgtttagtgtgctccggcccatttcactcaaatttacacgatttctgttttggtggataaggtcgctgttccttgtatttatgggcttttgcgatcaaaatccgagaatacttattcaactgttagtcaatttgtaaattaattgctttaaattaacacaatcagatgtttcaatcagtgattcagcatgttgttgattggcacccacaaacattcatgatggattttgaattaagcgcatttaatgctgttaatcgggtaaaatatacatatgttaattttgttttataaagaaaatttaaaggtttttccgaatgccgaacggtctgggtgtttgtttcattttgcgcagtgcgtttatcgaggattgcaccgattgccaaatcttanccnccattttaaaggatgagcagcaaagaattaaaattaaaagccttt

SEQ ID NO: 5635 - DNA, 2822 bp, Heterodera glycines
aaagatagaaataaaattatagcttagtaatattgacaaattttatttttccaattcacatggtgatcagctgagtgcaaactaggctaaatttcaaattatagtgtcagcttgtttatattcaaaaatttataagctaaatgaggaactatatttaaagaaataaaaaatatataattaaaatcgtattatttacaaaaatattacgaaggttaaaaatgagttgcttataacgggcaaaattcccagtgcatgagatggaaatgaatttagtgcgataaaaaatttctttgataatgcatacccatttgcaaattaataatcataatatttaaaatatttaatctttaaatgttcagaaaataagcaatcctaatattttaaaattataatttgaaaaaatattatttaatattaaaaaaaatagttcaaatactcaataaagaaaaataaaaaagcaaaatattaattattggaataatgaaagaagaaaaaagtgttatataaaccaatgtagacgaaagagcaatttcgttcagaaaataaaattaagaaatttattttcaaacaaggtatctttttcaagaccaccattgatcagaaaaattgcaagattataaagaaaaaaactcacaaattgttcctcaaaaatatccaacaaaagaataaaataaattttagagattttaataatatataaaaattaattcaatgtatattcaaatgtcaatgattttaaagaacataatttttaatcttattaaagcttttttctaaataaataaaaataataaatttaagtttctgaaattattaataagtgattataaattgtaatcttgtcaaacgattctcacgtggaaaatcccagagatttttttattgtaataattatgcgaaatagaaatgaaaaatttaatttaaaaagttaccccagcattttagcattagatttacaaatttaaaaaaaaaattacattagacttttttatctttataattaaatacgaattaaaaattttattttttacacctgtagcaatcctcattttaagattatttgcttttcttattgatatgtactttttaataagatatcttttcgcaatttttattctcgcaagtcgcaagaatttttcatttttatattgactaacgtgcatttgtggagaaatatcgggcttttggggtcgtttcgtaaaaagtgccactttgggcgtttcgtaaaagtgccaaattgggcatttcgtaaaaagtgccaaaatgtgcgtttcgtaaaagtgccagggcgtttcgtaaaaaggccactttgggcgtttcgtaaaagtgccactatgggcgtttcgtaaaagtgacaaatcgccgatttattttatattaaatacaaacacgcataatgtattagtggaatccactagattttacccctattatttaatctcccgtcttgattctttcattcgttccataattcctatcagtcgaatccccactaattacttctcctcattagttcattcattccataaatcccaatcaatcaaatccccgctaattacttctcctcgttagttcattcattccataaatcccaatcaatcaaatccccgctaattacttttcatcagtgtttccatcttggtaaaagtgtgttcaaattcgcttttctccgttccgagttcgtacatgtcatacgcaatgcgtaaatacatccaaacgtagtcccggtgtaaggaatgccgagatggtcccttgtgctgctgctcaatgagtgattggagccattgggcccaaacgatcagatcatctgattttatatcgcggcgcatccgatcaacggaatcaggcacaatgttggcgttcaacaaaacgctgacataatgatcaatgagtcggtttttgtcgaagaaaactaaatggagaaaaaagtatttaaatggcatgccattttatatgggaatttttacgaggaatttcaaaaggactaaaaatttagtgtatgcgaaaaaaaatttcaagtttctgtacaggattgagtttttaaattttccaacgatagaggagtttttcaagaccaatctggtgatacccaatatcagggcacaaaaaatcccataataaagctgcgaggtcccaccacccagttctaacaggggaatttagtaccaggggacccccttacgcgtccgtaattaggctcctcacgacttgagagggaagggatggtaatggatgtcttgggacgtctcccctgcggggatcgattggccatgtctctcaaacgcttccagactgactccgactgaactctctggctgactccttttaagttccccacgattgatgcggcatttgaggattgacatttgagacccgaccaatttgaggacataccaatttcagaaaaaaataaattaaaatttattttatatcattcgaaaaaagaaaaagcctttttcaagggccaacgggaacgaatataaagctattcgttatttggatcatccaaattttcagaatcttttgcgcataaggagatattgaaaagatctaagattccgggctctgttctatagacaatcttgtctctgtatgttttttccgttctcgaattcttatcccttgagttgggtcaactcaaacagccgcagtttatcggcttcaacccgctctcctttctttaaaacaataataactctgatattcaaaagtattataaattcattcgttgtttgggtttgtggtcctaaccaattccatgtgtaaatggaaaaagggggatcttccagcattaccaaaaacacatgttcggtgtaaattag

SEQ ID NO: 5636 - DNA, 2462 bp, Heterodera glycines
  misc_feature (2129)..(2129): n is a, c, g, or t
taaaagggaaaataatattatctcttcagggcaaaaagcattaacaaattatgtaaaaaaaattaaatccaaaaaactcaattccttacttaatcgataacagtgggaatatttgctttgatgaaaaggaaaaatgtaagcttttagcagaaacattccaaaaagtatttattaaaaacaatcaaatttttgattattctgaaaataattctccaagagaaaagctttctgatatagaaattaatgtggggattgtatggaatttactcagaaaactgcctgggtgaaattccacgtctccagataatcttccatatattttgcttaaaaactgctcggaaacactagcagtaatattatgcgatatattcagactaacacttgattctggtcaaattcccaaaatttggagaacttccataatcgttccaatatataaaaagggtgaaaaatctaatcctgaaaattacagacctatctcacttacgagtacggtctgtagggtatttgaaagaattttggcaaagaaaataactgaatttttgaataaaaataatttctttgcgaatgagcagtttggctccctaaaaaacagatccacgacaacccaactattacagacattaaacgttttttacgaagccatacagaatcaaaaagaggttgatgtcatttatattgatttttcaaaagcattcgattctgttcctattgatttgttacttgcaaaaattaaaaatgctggaatagttgggaaaattttaatgtttttacgtaacttcttgttacaaagaagttttagggtaaaaattgaagactattattctgaaagctataatacttatacatggggtaccacaagggagcgttttgggtccattattattcttaatatttatcaatgatttaccggctaatatacctaaaaatgtaaaaattaaaatgtatgcggacgatgttaaattgtatattttccatcaaaatgattcaaatacaaatgatctatctgaagccataaaaattcttgaaaaatgggccaaatctaacggcctggaaatatcggtcgaaaagagtcaaacattgcatattggcaaaaataattcaaaaaaagagtattttcttaatgggaaaattattccaagcgtagaaaaagtcaaagatttaggagtaataattgactctaaattatcttttgctgagcatataaataaaatcgtaaaaaatgcttatttaaaggcatatcatattttgagaataatgaagacaagagagctaaaaacgattataagaatgtataagacttacgtcagacctcaattagaatatgctgttgaaatttggaaccctaacctaaaaaaagatatagaacgaatagaaaaagtccagaaatttttcacgagaaaagcctttaaaaatgcggacttttacatagatcatattcagaaagacttgaaatttgtcagcttatagaattagacgagcgaagaaatattgatgacttaactaccgctttcaaaattatgaagggttttacgaatcttgatgctagtaattttacttattctgatcgatctactcgtaggccattacttttgagagtgcggcgcacaaccgcaaaaagtaagaataatttttttaaccgtgtagccaagaatcggaataatttaccaattgttccaattcagccagataaggcaaatcaattcagggcattgctaaaagctatggtatgagttctaagggatttaattgacatttatttattatatcatttatttttattttatactttatattgttgtactatttgacattttttattttttatgcgccacataagagcattaatgtgcccgtggtttgctcaataaaatataaacatgaaaaaaaacagggatattaattgaatgaactaaacaataaaatggaaagttgatgagatgatgaagaaataaaaagcgattcggaaaaaggaagtctttagaaagttagaattatgatagaaaattataaattttgtttgaacatgaaaaaagcaggcatattaattgaatgaacaacaataaattgggagatgatgaagaaataaaaagcgattcggaaaaaaaggaagtgctatccttgtgcanaagtttggtgtttttatagacgagaagcgaaagcgagccatctgattctctggctggtggattctttgttttgaaggcatacattgtggtgttcatccacaggtccttgtcgctgagcaaaccccgggcctgagccgcctcaatgaatgatccgtacacagtgccagcgtgcgtcctcagtgcttcccacccagttgggtcgcaaacaaccaaaagcagcaaccgaattgcctaagaaaattgaataatgctgaaagaaagacattgtcaccaggaggtcgcgattgttaggcgaaacgttcttcagtcggcaaatttcggaaacactcggcc

SEQ ID NO: 5637 - DNA, 1846 bp, Heterodera glycines
tcaggcatggcgctcagttcagcggtgagatgtgcagagacaatggcgcccatgacgaacatcgtttgcccttccacggttcggcaccattccgccattctgtcgacgaaacaaggaagcgagcgatcttcggtcgatgactcacgaggcgcaaccggaccatacccagcctaaaaccaaagcaaaatattagttgaggaacgtaacgagaaaggaagcaaaataccaaggatgagaagagttggttcaaagccgtgccgttttgaagaacaccaacttgaccggtgttaaatgcagccaaacgctcgatgtccaagaaattgcgcgccccagcacgaattcgaagaacagcaccgcggacattgttcggagcaagatgagcaaacacctgtgaatattttcaaattaatattcatcgttccttttctgcacctgttgtggtcgtatggttaaagcgttcgtatcaatattcagattgatccgccgtcgaatgtcgtgcatctgttgggcgagggcattaaagtctgtcacgtagtcaagcagagtgtcctaaacaaaatgttacacttaagtgaacagaacgaatatgacatacgtcaaaatcggccaactccccccctccctcgacttcggtttcgtcttcttcgtcctcctcgccatcgtcgtcatcatccatctcctcgaagtcatcatcagcgaccaagtgcgattgcagaacctgctcattggcgtcggctgcctcggaaatgtggtcgtcctccattgcgccctcgtgcaccgcgggtctttgctgcgtcaattcttcaccggtgtccatgtcttcctcttccgagtcatgaggcgactcctcttcactatcccctccatcctcgttctcttcttgagtggtgtccaacatactgtcgataatatctcctcgcaagtgcccgggttcgcccatcgattcgtccaattgttccacgtctccatgttcgttaggaattgccgcatgattttcttggtgtgcgttttggtcttctcggggagtcgaagcaatgggtgggtcaatgttggttgccggtcgacccatctcctcaaaggtagcacggctgagagtcaggtcatcgtcgtcgtaatattgaaatgagcgcgggtcataagagaaggatggcaacaaataagaacgcgcgcccattgctccgaattctgcgccgtttttcgtcaccattccttcgagcagcttcagcaatgtgttcacagtgtcgatacccggcttctcatgcaactaaaagttgttttgagacttcagatcaacaaaccattaattaaaacgcaccggaattttccaaatgcttctgacaaaaacatttgccaagttcttcttgtgaatgcttttgacaataaacatgccctgctttgcattgtgttgattgttcacctgttcaaaaatattccatcttttttctatatgatttaattacgcgcacctgtaaacactccctcaaatgcattgtcagctttgccaaaatggtcactttgtccgcaaatttcgcataagcaccgctgttgttctcatcggaagttgccatcgcacagtcaaagtcgccacattcgatgagaagtgatttgatgttgctcacgacatgatcggtgatgcgctgacctgacgaatttgagacgagctcgctgaccacggctttggcccagtgggcggtgtcggacaaatcgttgacgggagcggataggaggaaacgttcgatgatccagcgaagaaccgattggtcgccgagggattgctcgatgaaaataggaacagccacctttggataactgcgaagcacttcggcaatcaatttgagcaggtttg

SEQ ID NO: 5638 - DNA, 2234 bp, Heterodera glycines
aaacgcaccgcgaatctctccaaagtgcattctgacaaaaagatttgccaagttctgctcatggaagcttttgacgataaacatgccctgcttcgcattgtgttgattgttcacctgttcaaaaatattccatctcttgtctttaccatttaattacgcgcacctgcaaacactccctcaaatgcattgtcagctttgccaaaatggtcactttgtccgcaaatttcgcatgtgcaccgctgttgctctcatcggaagttgccatcgcattgtccaagtcgccactttcgacgagaagtgatttgatgttgcccacgacatgatcggtgatgcgctgacttgacgaacagccacctttggataactgcgaagcacttcggcaatcaatttgagcaggtttggaggctgcataagacgggtgtttttgtctgcgtccgccaatgtgtcaaattgcgccaagtccgtcacgatttgactcagaagctaaatatgaatagcaacaattacatttgacaataagaatgaaaacaaccgcttgaataaattggtctgaagccgccgctgcacttccattgcctgtgacgtcaccccgctgttctttgaccagaatttcgttttgtttgatggccatgcatttcttcgccgcgtccatgtaaagtgggggcgaccgcgccgccaaaggtaccaacatgcgcagaactctctaaaagtggatgaattactactatacagagactttgaatgaaaatgaacaaaccttaacatccttctgataacgcttcgttcgcattgcatgtctgcgcgaagtgatctcctgcatcgaaattggctggccattgcaagttgcggtgatcatttgttcgaagactgactgcagaagagcggcgtccgagtcgatgcactggcgaagaatgagcgttgccaacgtgttcagtgttggaggcgttgacgtgccatttggcaccatttgtgccgaaatcggattgcgcttcatctccagcagtgccttcactccatcctccttaaaaaggaatgttcaaaatgaaaatgcatttagacagacttacattcagaaactcctgcgccatcccatccaatgaaacgaggcgaagcaacaatgtcagcgcgttgtgtgccaattcgttgtccaacggttgagtgctgctcgactttaccagtttcaggatgcctttgacaagcagtcggtgtcgttcagtgcccttcctgagttcactttccagcttgacaagcttctccatattgaagtctccgcgcaggttggcttttgcgtagattggcactgatgagtgaagcggatggaagccctgctgttgctggtcaggcaacaaacgcttggtcatctcgttcaggtcaatgaagtaaacgcgctgggcaaccgtcagacgaacagaagtcttcttctccctgacagctttgttcagctgcgcaaccgacagcggagtgaattcgcgccactcgcccgcgcccgtgtaatggtcatccgctgtccagtagaaccactaaaacttggtttatgtgctgcactttccacaaacaaaagacgcgacctgaaattgagttccgtccaatgcttcctgtaagagatcctgtcgtatgtctgcactccgctcctgctcgtacatgttgaagaacagcaacatcggcgtcagcaatttgctcgtcaatttttcgcaacaattgccattgatacgcgcttcgaagagattaaacattcgatcatatgtcgaacactccggagaagccataggtaacattgaaatgatctgcaaaaatatgattcactggtcaactgctaatctttagttttttatatctgaatatttcaattccgcaatcctcctgaagaatgggggtccctaattttttttggcgctagttgcaaagaggaaacttttgaaaattttttcaacttttttttggtcaaattttttttttgtttaaaaagtcctgaaaccaagtacccgggtgttttaaaggtcgctgatcacgaatatgacaattatttgggcctattaagcaaatttggcgctagttataaagtgatagattttgaattttatcaaaaaccataggggggacccttttgttttgtaaatttttttttggataaaaatcgtgaatatacattttattcaccataattgtgctgttaatacttaatattcatcattatgtgtaaaaaaaacaaaaaaaaaatttgaccaaaaaaaagt

SEQ ID NO: 5639 - DNA, 7777 bp, Heterodera glycines
tgtatttatatgctcatcatccccatttgaccgatttgtctgtatatgtccaaatatctctgatgtacatatatttgtagtcgtgtataaagtccaatgaattgagaaaaactcggaattttgtaatattttgattttgggctacaatcggttggaaaaatgaacaagaacctttcagtttattgacggtactcagtcagccctttaataatttattttaagattttctttacataagaccttttttaactcccccaattcctcccctccccacgtgcaattcacaataaaacggaagacaaaaaatttggaaaaattacatttatttaatttgatcactctaaattcattcctattcattgattttgtcttttattaagaggtttataacaaaagaaacgtgaaaatcattaaaaacgaaaatgagaaaaataatcaaaattgaaacgtaaaagataattaaatatatatgattaaaacaaaaaattcaagcactggtaagaatgggggtctgagtgaaaaaatagtgatgaaaattggagttaaaggaaaaaataaaaaataaaaattaatattgtttaaaagtagcaggcttttcgtctttattctctacttctttcccatggttcagttcctctagagaaatttaaatattttgaattttctttttgtatactcaggggtttcctatcgagaaaataagatttatttacatattttatcattttttaaatgaaaatccgtacaaattgttgaacctattaatcccaaaaaccagccttttttgttgaaaatctgttaacaaattgcacccaaatttttaaaatttcccccggcggcgcctatcggcaccgccggacccttttcttcccaaaaagttttttggaaaaagcgcgccgaaaaaaagttatgtgaaaagcaaacctgaatttctaataatactcgatcatttagtccaaaatgattaattgtttgaaataattgaagaaaatttgttttgaaaattttcattgatttaatttagctttaacttttggagtttattcaataaaaaacaaagtaaaaatttaattttgtattattttcagttgaaaaaaaaaattaaaatttgaattttttaaaaattttttgaatttttaaaaattccctgttggtcccggttcccggtctcgaaaaaaaatcgaggtcccggtcccggcttcttaggtcccggtcccggttttgcccaaaattcccggtcccgctcaactctagttagaaatattcccattttgtgccgcgctagcgacgacctttttttcttttcgcccgtgcaccggcacttgattaattattttttctaatcaggaaaattttaaaaagtttaaaaaatttatgtttgaaaacttggaaatttttggggttttaaatgcgcgattcccagcaaatttttttgtgcgatccgcgattctcgaccgcggcttccgaggccaagacaattgtaacaatgtgttctttttgcttttagtggcactaattgcatcgggatcttcggaaaaatccttaacaaaaatgcaataaaaagaaaaatacaactctaagaattgaaatttttctcaaaaattgatccgcaaaattagtttttttgtttgttttcattttcccattttccgcttcgatttcgccagcagtacattcgtttccttctgcctcaacttttattggagtcccttctaaaatcatttaatattagaaaatttatttttttttcaaaattaattagcaattcccatttaattttcaaaaaaatgacactttaaataacactcacatttttaagctccagtttggtgattttcaatacgaattccattttgacaaactttttattaagttcctaaaatgaaagttcacaataaaagatgtaaattttaattgatgacctaaaaaagaatgccccaattcagaattttatttaaaaatgcaattgaaaaattggatttaattaatatctgagaatagaacaaatatttgtaaaaattcctttggtatgggcctggggggggggctcggagtcggggagaaaccctagtttaaaaccaagagtcaagaaatgccatccttatttaagagaaattaaattattttgtgaagtttctcgtattaatttttaatattcataggaattttttcgaagaaacttgaaactgagtcacaaaatcgacgttttaataaacgaaattaatagcaaataaaatagtaattagtattataaagccaaaatcaaaattgaaaaaaaaagaatttaaaaaataaacataaataaagtaaaaatgacagcaattagatgaatttctccttcttccattctttttgctttcttcagagagtcgccaaattgaatttgaaatttggcccaaagttcgcctcgattttgtcgcccacccacaaagaaacgcacggaaacagagaattgagagaattggcgggagtttgaatgaaaaaagaggaataatcttaaaaataaaattttaattaatttgttttttcattttaattggcccacccattcgttggccattcttcgtcaagaagatcagtcgagtatccaagaaaatgccacatccgaccacgtcaccagtggaaaactccgatgatttgtatgccatttccacgtccgccgattgcattgccacgggggaaaatgacgaaccaaataatgacattggcattttgcacggccgattgatgccattacagccaaatgagccatcgcttcggtacccgtaactgttcaaaatttgaccaattgacccgtccaatggcacttccaatcgcagcaaaactgttaaaataaattcaaaattataaataaaacgctaagaaatcatcaaaatgaacacctttccaatttgaacactttcatttcgaagtagaaaattccgggacgacaaaagttcgtaattggaaatttcgcaaaaacagagcgccatcctaattaagaaagtaattaattaattacattttttaatttttatattaaataccaaatctgttgcccttgcaattgatcgtcaattgcttttccccaatgatttcgatgtctttgtggcaaactttggcatcccagccattttgttgctgcgaattaggcacttcctgaaattaaatggcatttgtgaaataattaaggtttccttcccacctttgcaactttcgctgagacaaccgccggcggcgaatggtcgcccgatgacgtcactaaagcaactaaattagcaataaatacattttaaaaagaaaaattaattttttaacacctaaatatttataattagggctgtaaaaaatatgtacaaaaagtggtcatatatgtacataaatatgtaaaaaaaaatcccgaaatatgtaagaaatatgtataaaaacccaaaatatgtacgaaaatatgtaaataaaattttttttaattgttattttttggaaaatttttttttcataaagtgttaaataggcacaaaatgccataaaaatgaccaaaatgtttaaaatcaccttttaacatttgaaaaattatttttggaggggtacatttaaaaaaaagattttttaattttttcacaagaaatttctaaaaattttcaaaaattctcagaatagctatgtaaaaaaatgaaaaatttgccgaaatttttggattttttttgagaatttccaaaaatttccgtaaaaaatcctcaaatatgtaaaaaaaatgaaaatatgtaagaaaaatgtccgaaatatgtaccaaatatgtataaaatcccgatataatacgagggttttgtcccctctcaaaaaatgcattttttttataacgccaatttttaattttaaataatttgccaattgtgcccacccaaaacattgtttttgtccaccacggcatattttccatccaatttctgttcggtgtttttgttctgttgaccaacactttccttctgctgcttttcctctgctaaacaaatgtatccaattgaataatagaaaatgaaaattcaaaataattggcattggtcagctaattaaatatgttcatttaaaatttgtaactgatcaaaattgtaaaagcttatggtccgttaaaattttttcgcctttttaaagtatgcaaaatttcggtccgttaattatttattttaaatttattatttaccctttctgccctcctctttgttctgccgattttccaattgtttgattcgctccaccaatgaattgaacacatcgacagaaactgaaataattttgaagcatacagtactgtccgagtacggtaataaaaattatttatttttttaaattgtctctaccgtattttttgtccaattgctgctgcttttcctgctccatcttctcaactttcgccttcaattcactgttttccgacatcagcttttgtttctccaactctgctttaagcgccttctgaattttcttacaaaattcgaaagtttctgttttatgcgcgttcgctctcagttatttcgtcattttttaaattttttttaataattaatttttcttacattctctgcattcaattccccgtttttgcacagcaatttcgtttctctcaattcggcactggcaagtttttctcggcattccttaaataaaaaaagttttttcagtccactaaataatttccaatttccttcactcattaattgcatgatttttggcaaaatgtctcttgattgctctcggaattggtcggccctttgtccgtgactgatccgtccggcctctctcccccccccccatctgtgctcatttgtcctccccccccccactgtgatcatttgtgctcccccctctgtgctcatttgtccgttctgaaatgtcccaccttcaacagctgctgatcactgaccaaaaattgtgctgccaattggtcgctcaaatctccgtgccaactgaacacttcatacttgtccacttcttctgctgctgctgctaatggtgataaatttttattttattttatttaaaaaagataaaataattttccttttttcgtaattctttttttaattatttctcttaccctgatcagctgttggacggaaaaagcaatttggcgaaccgataaaatttgaagacatttttcgaattaataaggtattaattggactggctacaaattaaaatttttaaataaaaaaaatatgaaaattggaaataaaattcatcttcgcatgtaaatgaatgcatgaacatttgatcttttgcgctgaatctcccctctatttatgggctggcatttgacggcaaaaaagtaatttgggcaaaattatgacccatcaattagaatactttttagaaatttataataatctcttcttttttttggcttgggctgttgagcaaaatgatgacctaaaaaatgggagagggaaaatgcttttatgcaaaaattgaaaaaaagtaatatgattggagcttaaagtattaatcagcgaaagatgtgatggacaattaaatgtttctttttggtattaatatgtaaattgttcagcattgttgtgatcagtgttgaaaaaacggtgatcaaaaatataatatttttatgttctaaaacattccatttcattgacatttttagtgacgaaataccgtaaatacaggggtaggtaccgtaaaaagttccaggggatgggaaattttttttttaaattggctcaaaatcgtaaaattttgtcattttttgaacaaaatcgttaagaaatcgcattaaaaattacaaatttttcgccgagccactgtccccaaaattttttggaagcgtgccgcaaaaaaaagcatttttaaaagcaaaaaaagtcgtcgtttggcttttatttgcaaaatttggtaaatttttggacacaatttgttagcaattcgcattaaaaattacaaatttttttccggcggcgcctagcggcaccgccggactctcttccctcacacattctcaaaaagttttttggaaaaagtgcaaaaaaaaaaatcaaaaagttttttacgaaaatttcaagattaaatttttgaaaaaattttcagcgattttttctaaatgttttcgaaaaactattaattcctataaaaaattgaaaatccgtttcaaaattttttcaactttttttttttttacaagtacatattaaaataattttttttggtgtgattaaatctattatttcaactgaccgatgttttttcaagttttcaaaaaatgcttaaatggttttaaaatacattcttattataaattagatatttttagacgttcccaagcaattaattgattttttcaagcatttgtttgttttttaaaacaaatttaaaaaaatccaggtccaggcctggatccaggtctcgaggagcctggatttttcctggacctggattttcctaaattttaggcaattaaaggaaatgcacgacgattttgaaacaaaaattgatgaggtggaaagaatttaaattttataaatgcaattacctatttttattttattttccattggaacagaaactaaatgcgaatgccgaatttgccaattccatccaaacaaaatgcaccaaatttgaagaacagcaaaacaaattgaaaaattgtgttgacattttgaactaccgattcggaaatggtaaaattgcataatttaatatgtgaaaaataaagcatttatttaatgtcattttaaaatttaattatgtatatatatgtgattaaaaattaagttaattcaaaaagattaatagggaatgctgtaaaattactttttttaaaaagaataaaaacaattctaataaatatttgtagtaatatttttaagcactgattgaacaaatcttggaattacaaaatgaacagaaggaaattttgggacgaatgagtgaaatggagaagaaacagcaaaatgacgaggaaaaggaaacggaaaagtacggtaagtgaatgaatgcctaccgtaatgaagcatttttaaatttaaaaataataaaaaattaggcaaactgaatgcaattttgggacggattatcattgtttatgagtcaaaattggatatttgttaatcattttaattgattaggaacaataatttttgcgctgtaatctgctgatcgtcttttgcaaatgcaaaaccagcagacgaagctttgtgccaaaattgatgcggtggaaacgaactcttctgcaaaatggagtagtatgattcttgagttgttgaatagaggggaggcggaaataatgttacatttagttgatttatcagtttttgtgttttcgctcgcaaatagttacaaaggatatttttaaaggatgaattatcttcagtgtcgagaatggttagttctgcttgttgaataaataaagaaaagtttcaataaattttttccagtcatcaattaaaatggatatgcaataatataaaaaaattcaaaggagtgaaaagttttccaaaaaaactgcatatattttctagcttgaaaaattataatcaattaagagtgttttcccttcatgttttttcaaaatttaacctaaaatcaataaattattgatgaatcatgatttcagaatggcaaggaataaagtgatacggacatcaatattctttattcttcattgctcatttaaacttacatatgtcagcggattaataatttgcttctatatcacttcagctcatcgctcgatgtcgaagaaggattaacgcggcacaattgagatcccccaacaaataacatactaaaatga

SEQ ID NO: 5640 - DNA, 2507 bp, Heterodera glycines
tgcctagcgggggatgcgccgaaggcgctgaccccgctagtaacatataaaaatgctaccaaagcgcgctatgggctttcagcatgaaaatcctcccaaatcgtgaattattaataatttttttaattctcatgttcaataaatttatattctgtccatcttttttttaattaaaattatttttaagaattgtcttacaaggaacacccgaactgtgagtcggaaaagcaacaaaaatccaaaaaattgatcattttatggaaaaacaaagcacaattaaattttcataattttccctggtagcgcctatagagacaccgcctgactatataccttaaagtccttaaaatgtcaatctaaaacccccggaaaatgtttattttaactacatatctgttaacaaaccactactaaatttcgaaattctcaactttaagatttaacacacaaaacaaaatgaagtggaaattcactgataccatttcccattctaatcagtcatccatctccatatcagcaatattcttttcattcagtccttcttcacttggattgtccatcataatttttttcgcaacaaaattacacagattttgatggtttaatcccaacaattgttgttttaactaaaataattttcaattaattagatggaaatgactttttacatgttgattttgtatgggataaataatttcgacatcatcgttagtaattatattatgattatcaattctatcagctgtcatcttatctttgcttttgctccaaaaattaaatatttgttcaacataagcagcgcattgacgcacatcaaacttaagaaaaatatataattagatttgctaataaatattaattacattgtttttgccaatgccaaagtcctcaaatttggcaacagtaatccgatgaagaaaagccgtgggaacaaatccacgtttaaccagaccactaaattattattcattttcccttagcaaataaatattttatttatccttttatattataaataataataattttgttaagtaaggtattgtttaatttataactgactctattttgtgcatttctttacacattaattctgccatcgttatgaacattccgataaagcataatgtgcttccatttttatgttcaagcttgaaaacataattaattaattgaattttaaatttcttttcttcgtatttaacttacggcagaaagggcttttaagcgagaatttccatccaattcataaccaatttcattgcaactcattaacaaattataaagaagtgtgcataaattaggtccaatcttcagctgatttgtttctattatctctctgatttcattatttatttgcaaaatttgaaaatcgacgcattgctaaaatatttttctgaatatttttgaaaaatattaaaagcaaactgtgctaaaatcattggaattgagcgatgaactaagttgggaaaacattttcaaaaaagcaataacattttcaattggtatcagtaattttggctcattagcaaattctaaaaaataattaattatattaaaaacaacaaaataaattttaaggtattattacctaatttccttaaaaatgttgatgtgttttgttgaaaatgaggctgaaatcccatttctgtgttcattccatttgcagtgccaaaaatttgagaaatgcatgcaaaaattgcaaaataacaaaaatttgacattttcactgaatgaattgcattaacttttgaatcttttgatctgtttattatataattaaaataatattattaaaataaattcttaaaaattatgaatatttcgaaatccatgaatttgcattttaatattgaatgacatacatatacgccgtatagaaaaaataagcagaaaattcttaatctcacattgatttttagcttgtcatttcgtgacatgccgagttaataaaataatttttgaatgctataaagtgatttaaaaatcaaatgagaaaaacagtaaaaaattttcttctacactttctatttttttttgtataggcttcttttcggcccagtctttatatacatgtggcccaaaatgtaaatattgatatcatagtccccaaactcaaaataataacggtctgaatcggtgtaaaaaggttagaaatgggtaacaaaaaaaaagaattaggggcgcgcttgcccctttcaggctgaaaaagtgcaggaagtggagtgccaaattcagcttgggactcaacttaccatactgttggtctgacggccaaatttaatttattttcactgttcgcaatcactttccatcacgtcgatcaattcggagaaatttaaacattcaaacgtacgagtgatttctgctcaagtggaacgaagccgtactagaaagagttgcgccatagttgtatcaaaatcatggacggcaataaattgagcagctttttacggaatgaatgtaatcgctttgcggaaagctcagcgggccgtatgataaacttg

SEQ ID NO: 5641 - DNA, 1109 bp, Heterodera glycines
  misc_feature (22)..(22): n is a, c, g, or t
ctcatcgtccgaatattatccngttcctaattaaaaaaaaggaaaatatttaatattatttaagtttttaccgggtctttgtcgtctaagagaaaactgttgctgtcataaaaaataattgttgtgcgcattcgcattattggaaaagtaattagcattggtacaatcaacaaaaacaccatcagatgcctaaagtgttttttccatagctaaaaatttttaaaaaacggaaattaattaatttaatttaaatattaattaccattttgtgacgcaatggaaatgcaattgcagtgaaacgattcaacaaaatgaaaactgtcacaatgtttgagacttggaataccaaagtttttgtgaaaaaggttaacaagacgattgcccaatttggtacggtgctgtaaattgacaacaattgttggccaaagaatgctggaagcaaattgcccaaggaattgggcactaaactaagaatatcctaaaataaaattccaatttaaataaattttgaaatatatttttttaaatagcttacaaaaacgccacggatgaagaataatttgtaaaatggtgactttgaaaattgtttatgctttatgatagtaatcatttccaaaatataaacaattgtcgaaggaatgtcaatgcaaattccaaaataattaaataactgtcgatggctgagcgacaaattataaatttggtcgagcattttttgccttttcaaataaatttttgacaaaggtaaattttttgttatttttatagaaaatggccaccgatgccgagagccaccttaaaaaatttttttttaagaattggaaatttttcacgggttttgtgcaagaatttatcaatttctgagaatttatacaaataataaattgtcaaattggcagatataagttaccacaaacactaaatagcgtcgaaagatctgaacgtgaaaaatgtttgctctcagccaaaggttaataaaattagaaaaattaaattttctctttatgcaaaagactaattcaatagaaaaattattgttgacgctattagttcaatataccacaaaattctaagcacaaattaagataaatggtactcactcattatat

SEQ ID NO: 5642 - DNA, 1915 bp, Heterodera glycines
  misc_feature (113)..(113): n is a, c, g, or t
  misc_feature (1821)..(1822): n is a, c, g, or t
tttgctcttacgtttagagccaaatcacccagacacgaaagaatacaaatatgcctcacccaattggggatcttggctcgacttttcagtgatctttcgcacctacttcctcncctttatacacacatttggtgtgtttttccggcatttttgctaatgccttttttacattgctgccgtggcggccaaataatttggttgtaaatatcaaccgccgccaggaggagtcgaatcgaccaaaatcgttttaataaattgtgtttggcatttatttttatatttagggatgaaacaaatttttaaaaataaaacaggaaagattgtcgctcttaagaaataactcttaaaaatcaaaaataataattatataatacaatgaaaagatttgtatttttctctatattctctcgcttaactagtccatatctcggttttcttgatgctctctcaattcaatggtcgctggtgcccgtttaaacgtggccactagaaaattattcagtattttatttatatcaatttgaagcctttgctttactctatctaatgcattttatttcagaatttatcaatttttaaccaagatattgtttgttaaaaatacgtgcaaaagtggagaaaaatggcatttaaactgcccgggcgttgcacggagttacatatttaccaacccaatataagagatgttctgatttggaggatctgaatcttacaaaattataatgttttaatttataagaaagtagctttcggggtaacgaccaaaatttgttgtttttcttaaaaatcataaatttgagattttatggcgaactgttaatcatttgttcttttttatccaatcatgttattatctaactattttcttgttgctttcacaatttatctttagtattgcacccactaaccacttactggcaccgcccaaaaaaatctttttcaagagtgaaaaaattagaagggctgggctgggaagcttggccaatcatctgctgatggtcttttaagcgcttcgctgattgggtctgttcttgtttctaaaaaatgttctgattgggggtagtgcctattttcatcagaaaaagtaaaatttctggaaaaattagttactttctaacaaaattcaataaattctaaaatttttccacggcggcgcctatcggcactgcggcccccaaaactcctattttcgaaaaaaataatatttgttacattttgatcgaataaattgtaaaaatagctgatttaaagtaattttgcataatattcttattttgaccctaaaattcttattttttcggccttgatgtttttattttgaaaaatctcgatccgggcccggtttaaacaggtgtatcgggcgtcccaaatttgtcaggcgctcgcgggcaggaacttttacaatttttggaacgctgaataaaaaaaaacaaaaattgtcttctattttaacttgagataattatttaaatagctagcaattcgttaacagaatttgtcaaaatatgaccagtttctttcattttttagaagcattagcacaatcaagaatattaaatagaccatattgtacataaatgaatgatgacttttttatttattattctgtagaacttattttctaatttcgattcaaaatttccgaattccctcactattgcaccaatttatttatcaataatttttctgacttttttggcatataattttgggatatacttcataacgaaaattctagcccacagattaaaaaactttcttaaaaaaagtaatattaagcaaagcattataaattataataatgcttgcaaaatttattanngaatttaatgcgaataataaatcataatatagccaaaaatatattcattaattttgcttatattgcctgctctatttttacatttgctgctaa

SEQ ID NO: 5643 - DNA, 2210 bp, Heterodera glycines
  misc_feature (54)..(54): n is a, c, g, or t
atgatgaggagcttgacgaagaattttggaacaatttgcctaagatcattgatntaccaaaattagacggagttggatttataggaaatcatattaaatacaccaagcaaacaaaaaaaggtttgaataaagacaaaaaatactaataaataatattttgtaaaaaattactagaattaatttatgtttaggtaaagatggacaggactcagcaacaattcaactttgagggggcaaaaaaatctgattggaaagctattcaatgaaaaattaccagggctgggattttcatggaatcaaggccgccgttttaaatcaattagatcacttctagctttgccaacatgttaaaagtcagaaaattcaaataatgatgttatgccaaaatattcgttcaaaatttcaaaggttttaaaacggttgggactagggctacgatttatagttgctaaaaactgccaaaataattagtttttaatttctaaaaaacctccaaaatagttgctaaaaatgggtaaatagttgcaaaaaaagttccgaatttaggggggtgtaaaatgacaaaatgtattcaaaaaagtaaaaaaattaggccaaatcagtattgagataaataatttttaaaatcacaaattcttgtaataaataaataaataaattttggaggtgaatttttgagaaatttttcatttctcataggtgcatttttgaaaattttcgggtcgattcttaggggtgtattttttgaaaaaatttaggtcgattcttaggggtatttcctttttattgtatttttgttaacaaattttgggcaaaatgccaaaataatcaaaattgtttttttcaaaaattttatagttttttaattgctaaaaataaaaaaactagaaaataagtgctaataactcgaaaagtagtttaataacagccgaaaaaaaacatgtttttcgtgcatttcaggccacggggagctcaggaaaaaatagtgaaaaaactataaattggagccctagttgggacaacttttgtattttttcctctttttccagagctgaaattggttttaaggtttaaaattgttttataagaatttactaaatgaaaatcctagccttagcagattgagcaaataataccttttttcggtcctttattttgcgttattattattcttcattttcttaatttgtacaatatacattctctctatctctgtctatcttctcttctctctctctatcttcggttacgctgccacacgcctaattttttattttttttcggtcatattgtaaaatttcaagacttctatcagtttcaaatgattatagtagagtagagcgggaccgggaattttgggcaaacccgggaccgggaccttttcgggttgaaaaaccgggaatttttggctgggaaaaccgggaaaaaacccgggactggtcccggtcccggtcaaaaccgggacctcggtactcagttgtactcagttgtccgtgttttggtcccggtcccgctctactctagattatagcaaggaaatgcgtttttcaaaaagctcataacttgctccattaatgtgctgttagagtgaaaattctctatcatttctctgtgctaaacagttccgccaaaagacaaccgaaaaataaatttctagctgatggcggccgttcaaattgaggtttattagaaaaatgctaaaatatggacataataccaaaatatggacaaatatggagttggacataaattgcgaaatatggaaaacatgaatatagaactccgtcctagaagttttaaccaagctaaaaacatgttttttgtgcgttcaggtcgcccataatccaggaaaaaatatggattcccacatatgtaattggacaccctagtttttgaattttcaattaaaaaattgcaagcaaaaaaaaatagaaatattgagctcgggtcgccatttgtgattgattatttctacaattcatgttatttagatatgacttgtttattttgtgcttattttattgatttgggtacaaaaattacaaaaaatggtgtttattagccaaaattttaaatgccaatttttgttgcaaaatcttcaaacctgataaaaaaattttcaatttctctaggacacgtgtcggcaacacaggccaaaattgattgcttagaagaaatttcgcataaagacactaaagaaaattcaaaaa

SEQ ID NO: 5644 - DNA, 2049 bp, Heterodera glycines
  misc_feature (52)..(52): n is a, c, g, or t
ttttcggttaaaatttctccgcgctttggccccctgctctttcgggggcagntatcatttttggtgccttgtccaccctgttgaccattacgtgggcattcccccgttttttgcgcccttttttatcaccggctcttcctgcccgtggtcattgttttttgccttttgcttagccatcgcccggccatttctcgccgctttggcccttgtctttttccgttgcctctggccagcatcccactgactcaggcccccccttttttggcttccctgtgtttaccccatctaacacagtttgattaagaaactcactcagaatgcatttgacgatgaatgcgttggcgtccgtgttcagctcaacggtcgggtcgaattggaagcgctgctccacgctgttcagttcgccgcggaccatctccggcaggtgcaaaatgttcactgtcactttgccaataccgcctccactgctcatcaccgccgtgttagcggatgaggtgacggcaccaccaaaatggccagcagtttccctctgttcactcggcacgggcagcaaatcgtccatcgagctcttaaaaatacaaaaaatttcgttttgttgaaatgttttaagtcaattgtcatacacggcgatggttaaatacaggagaaatgtggacataaaaatggaaaaacaaattcccaagcattttttcttccaaaaaacaacccgccgataaaacgtacgtaaagatcctcaacaggcgtcacactgccaggccattggtgttgctgctgtgcagcagaattcactgccgacggaccgcccgccgccggcgccatgccaccaccaccagctgctgacgacgcgtagcttcccagttgcaccgccggttgtcctgcctggactccgccaagttctgctttgtgctgtgttgtgcctgccgccggtggtgccgttgccgccgcgaccatttggcgatgctgctgttgctgcctctgctgcatcatcatttgttgctggagctgttgttgttgctgctgatgaaagagcatttgttgctgctgctgtgtgttgtacgtcatgttcggctgttgctggtggtaatttgtgtactgctgctgaacggcttggtaatgttgctgttgttgctgatggtatgccgccggctccatcggttgaccgtgcgcagcagctgtcgacgtgggcatcccaacggcgtagtacggcacctgcccagcaggcggtggcatcattccgccactctgcggcggaatgtacgcgcccgtcggtgtgccggccttcatggcgttcgtcggcgccaccgggtaattgccgcgtggtggcatcgccgctgccgagttccagtccatccaattgttcattgcggctgcgcccggttgaacagagcccatcgccgacggtggcatcatttgttgctgttggttgtgagccggaccatatggcggcatctgtgccgagtaatttctttgatactgtacctagaattgcggaaatcctcctttttctttgttgacaatttggggaccggactcaaagggtcgaaatcggtaaaaaccccaacgcgtgcgtattgccccgactcgtactgtttttcggcgccaaatcaaacattctttgtatcattagatagcccttaaaattccatatctccatacaaaattcaagaaaattttattgtttttctaagtttgacaaaaaatcacaataaatttttttgtgttcgtaacctttcaaaaatgataatttttttaaattacaaaatatgtttaatttgattaaatttacaacattttttgtcggaaaacatacaaaaggactagttcatgtgggattcgtccgtctaaatcctgctagattttacccccccccccccccgttgatccgctatttcccccccccctcccccatacattttgctccatcatcatttgctgttgctgctgcggttgtgccatggacgacggttgcgggtacacggccgggtgcggctgtgtggcgctgaacaacagcgaagcggcggaggatggcatttgttgttggtggtggtg

SEQ ID NO: 5645 - DNA, 4204 bp, Heterodera glycines
cctgcccagcaggcggcggcttcattctgcccctcttcggcggaaagtacgcgccccgtcggtgtgacgggccttcatggcgttcgtcggcgccaccgggtaattgccgcgtggtggcatcgccgctgccgagttccagtccatccaattgttcattgcggctgcgcccggttgaacagagcccatcgccgacggtggcatcatttgttgctgttggttgtgagccggaccatatggcggcatctgtgccgagtaatttctttgatactgtacctagaattgcggaaatcctcctttttctttgttgacaatttggggaccggactcaaagggtcgaaatcggtaaaaaccccaacgcgtgcgtattgccccgactcgtactgtttttcggcgccaaatcaaacattctttgtatcattagatagcccttaaaattccatatctccatacaaaattcaagaaaattttattgtttttctaagtttgacaaaaaatcacaataaatttttttgtgttcgtaacctttcaaaaatgataatttttttaaattacaaaatatgtttaatttgattaaatttacaacattttttgtcggaaaaccttacaaaaggactagttcatgtgggattcgtccgtctaaatcctgctagatttgaccccccccccctttatccgctatttctccccctcccccatacattttgctccatcatcatttgctgttgctgctgctgcggttgtgccatggacgacggttgcgggtacacggccgggtgcggctgtgtggcgctgaacatcatagaagcggcggaggatggcatttgttgttggtggtggtggtgcgatgacatcatccgtcggagcacaaattcaatgtcgaacaactccttgacgcccacaaaactgtggaaaaatacaatatacaggaattgtggtggcagaatgggaatttattagaaagaagactacggattggacaaaacaaaatttcagcatttttattttaccattcgaagcgcaacaccgaaagcattgtgttgatacggcggagctgaaaaacaaaactgcggagtaaaagaaagctaaaattagatatttttaattagtaattcagcgtaaaatttgtgaatttatttgcccttgattttggcggtgaacccatttagcaagaccatttaaaattctgatcacaatgaccaaccatcgccgggtcggccgcgtatttgtttagcgaattgtgcaggaaggcgacaaactgctgcagttggcacaccttctcgtagtagggtcgttcctcctccccaagtgccttcagttgttgcacaatttcgggtgccaacgttggcgggtagtcgaaccccgcggcggagccgccgtactgctgggccattgcagcggcggcacccggcacaatggcatgttgttgctgttggtgtggtggtcccatgaatgggcctccggcactgaactgttgctgatgaagcgtcgttgtcggcatgttggccggaggatggtggtgctggaaatggaaaatgttatgtacacacacaaagtttcaattgggagcagttcgtttgccgctcccctaaagatttattttttgttaaataataataataaaaaaaaatttgcttataagtaacattttttctaactaggacaactttcaaaaaagttgtttgtcttttaaacagaattttagaatgcgatgacatttactctaaagacgacgacattgaaagtcgagaataagtttgcactccacccgcatggtcccccccccccgagaaatttttttataaaaaatttactaacagaaatttttcgagaaaaaatctcagttttttataagaaaattctaaaaaaaaaaattttttgttgagaaattgttatttcttaaagactcgatgaactagtggcaaaagtgaatcgtgttgactccctcctcacctgcatctgctcttgctgctgctgtctttgccagtgccgttgctgctgcatttgttgcgcggtgaggacggcgttcggcattttgccaccaccgccggcacccgccgtgcccatcatcagttgaggcgtggcgaccgggtaagcggctgcactcgcactgcttgtcgccattgtgatcggctgaccaacggacggcgctgtgctgtctgaaaaaaaaaagttttaaaagttgacagggaaaaatgaagaaatggattctgccacaaattatttcccatgccaattgcaaattagggcaaaatgcacgagactctcgagaaaaagtggcttaataaatttggcagtcgatggcaaaaggccccagaaaagtacagtgccaactaccaatacacacatgggtactgttgctgctggtgcgctggttggaagttgctgctgctaattacacccgcaacatctctcgtgtcgacgacggtgccggcatgtgacgttgcgcctaccattacggcggcggcggtcgtgccggacgccgccatggccatggacggcgcggaagacatcgccggcggcggctgtcccatcggttgatgaaaggcatcggcggcgccaatttgttgctgctgatgttggacggcggcggccatcctttgctgctgctgttgttgctgatgcgttggctgtgggtcgggaggcacctgaaaattttgaggaaattggttgaacaacagaaccgactctcgctcatttgagaaaccagagcagcggaacctcaaaatcaagtgtaaaatgcatgctttttcaatcgcacatagcataagcagcattaattgattggtgtcaggaaaatagctaaagattttataaccgaaacttcatttttaatgaattcttggaaaaaatgaatattcaaacatttaatttttgaattttttatacttattgtatcacaagatgttgttgttttcttaacttgaaagcaatcaatgctttctttgattgaaaaaaacatgaatttgaacccgatttttagtgtttcggtggaaatacccaaggcgcaaatgtggggtaaatccattggaatattctgcgcgatttgtggccaactgcgccaaatagaaaatggggggtgtgtgagcgcttttttggcaaaaaataaaataaaaaatatataatttcggagacgatatatccaaacgaaaaccccatttttttaaaaacagtataggaaatggcacggctcggattcgcagcatcaattaagattgcgctgctctccgtcccccaccccaaacaaatacacactttgtaggcggaggaagtgaccgccgaagcagcgacaaccgtgccgcccgtggcagtgactgtgcccgttgccggtgagccctgcgactgggcaacgctttggggcgtcgcggacggttttggcacaccgccgccgccaagttggtgctgttggaacacgggagaaacggcgctgctcttcgagttgcaattgatagcattgattacctatacacaaaaaattacggcattaatgtgccaaagccaaaaagcaggatttacgaaatttgaaccggcataaaattggattaattcaatagaaattgctttgaaaaatacaattgactcactttcgcaatcgttctcatgtactcgtctttgctgctgcacttttggaagacgtaatcctccacctggaaagtaaaaagtaaaaaaatatttttaaaatggcaccaccgccgacctgtcgggcatcgccagggacctgtaaaaaattataagtgaaaattcgagcaatcgtgaaacgatgactcaccggtaaattcggcgcattctgacgattccgtgccaattccggttcactgtaaaaggatgaagtactgcaaaaatagctatcaagaaaaatgtttccgttaaggttttctttattggtaccccagatatattccaagaaaggtcgtaaattttgccaaaaacccacaaaattagcaaattttcagcgaaaacatgttaaaaatttcaaaattttcgatggctgcgcctaggcaccgctgggttcgcaaaaaaataaaaggagccacaaaaacgccgtgaaacgttgaatcatcgcccgagggcggtaccaccaaaagccaaaatcttccctgcctgtattccttaaaatgctttcaaatttgtccaccgttaacttacagtcggttgatgacattgtcccggaaggactgcgacggccaatcggcttcggccaccaaag

SEQ ID NO: 5646 - DNA, 1426 bp, Heterodera glycines
tgctgctgacatttgctgctttacgtaatatataacaaaaacaaaatttaagcgcgttaaattttaagatagaaaaatggaaatgaaaattggcaacgccaaccgggcgaaaagccggacaaattgttaccattccaacaagaaaaaaaaagtgaaaaatcggctttaaaagtcagtgttttattcgcaatatgcaaaatggaggagagcgataggggtgaggaggggggattggtcacatgacaactcgtgccattttctttaattttcaaaaaaaatttccgagaaaaaccctaagaaaattttttaataaaatttcaagaaaaatttttctcaatgttttcggtgatttttggaaaaattagtattcatcatacaatttcataaaaaaaaatcgtggaaattttttttttgaaattttttattaaaaattttctatttttttttataaaaatttctaaaaaaattcggtggcgggattttgtcccgccagagagggttcggctttttgcatccatcacatatcggcgggcaaaaaaaaaatatggacgagtggggagaggaggacataacattaatttttgaacagcatctcgtcctgccttcgcttctgcacaattgtgcccggcttgttctgcgcttcggggtggttggccaactccagcggacagttcgacacgggactctcgagcagacactgcttcaggtcgtagaacacctccttatcctccggcgtcaaaaaggtgatcgacttgcccttcttgccggcacgaccttggaaagaaaagacggaatgtcaaataatatcaaagaagaagaaataagaaatttccaactacataacaattttgaaagagtttgaaaacggggcttttcgaaacgataaatttaaaaattttagagggcaaaaaaaacatattgtattttgttttttgtcccatttcctgcaccgtttaaaaaaaaatttgtaaaatgcgtagtccatggctatcaattacgttttattgtccgaaatttaaaaatctaacataagcgtagaaattacgaaattttaccgaccttctgaatccaatttaaaaagtgccccgcaaaaactacgaaattgtagtctcgagcaaacaaaacccgtatccagaaataagttttaggaaaggcacccgttttttttctttgaatttccgaccaataattttttaattttctcaaaatcttcggcgtcatgggagaaaaattgggtattttagccaaattttgcattttgggatcaaatcttggagaaaatatacaaaaattgggattcagtgatgccgttaggcgccgcaagggaaaattaaaaagaaaacttgtccatttttcagtaaaatcctttaatttttcgttccgggggaatgggcagtgaccccccccccggatgtgggcctggtct

SEQ ID NO: 5647 - DNA, 8104 bp, Heterodera glycines
ttccttatcccaaaatcaaaatgaatttaatttgcttttcgttcttttttgttgttcttgtgacaaatgccatcggtgaagggtaattaaatgaattcaaatcaattttcaattgctttctgtttctttagacttgccgaggacaaatggaaaaagtgcgaattgaatggaaacggaatgatcagaatgggaaagaaagccaaaaagtaatttgcaaataattttggtgataattaattaatgttcccgcattaattagtctgctgatttgctacaagagcaaaatggccgataattttggatggaaagtgggaaaagtgttcaaaaggcgaaatggaaataaccaattggctgaaagatgtgttggcacagacggcacgaagggatggcacgcgctaatgatcgaacagaaggaaaacgggctgatccttaagtcctcttttgggtgagtgatttaatttaaaattaaaaagcaaatttaattttagaaaggatttattcgtggaaatgggccccgaattttttattcaaggctccgactttttggacattaacatcacaaagggtacagttctacaacaaattaaatttaattgatcgagtcattagcgttaatgagttcctcttccgctaaattggacgagttccaaaatgctcttccgttcggtgtttttttgaatgatttcgacggcgcagcgcttggaattgtcgcatttgaaattcattgtgccattggaacaaatgacgtgaacacttgcaaaacgatggtaaagtgaaacttaaaaaaataaatttgaatattttgaatgaaaaaaatggttggctacggggggaatagaacccatggctacaaaacaactgagatttgaatgtattaagaattttttttaataaaaattataattttgtaggctaccgaagaaaaaagtagaaaattgaccactcggggaattcgaacttccacaaccactcgggcaactccgccaaaaacaaagctgaaaattgtaactccattcaaaactgaaacaccacgcgttgtaatcgttttcattttttaaaaatttaaaaataatgcctttttctagtctgaaattgaaaaatcaccgaaactgaccaccctggaaacccatacaaaaacaaacccaaatgtcggaacttcatctgccgtaatcatttccctcaaattaaattaaattaaaaattttttagccgaatctgttcactccacgtgattctactgtgaagcatttcggcacaaattgcgtccaaattgattttccagcagaaattgcccagttttcgctgaacatttccgcctcattattcggcattgcctgtaaacaatacctaagaaagtacaaaattggacaattgccaaaaaattacgacgaaaaaatggaaatgaaagacaaaatggaagcgtgtggaaaagtgccgacagagacaaattgcaaaaagttaaaaaaatggaaattaaaattaaattaacacctaattaaggtcatatgagctaattggatgttctgaaagcaaaagtcagcagaaaattgccaacgaggaaattgccgaagtttgccgaaaacacctcgcaaatgccaagttttcggatgggtttcgaattcggaactgtgccagtcgtaaaccagggacgaaagtgatcgttgtcgaatcaactttggaattttcattcaccgagaaaaagtgaattaaataagaattgaaaattttttaatttttttatcaaagttataccatcacccgaaatgcttcaattgatgatgtgaaggaatttgaagctgcaacaaaatcaactcaattatttttcatcgaatttggccaccaaattgggcaaagtgcgctccgtgggaaaagcggcggcacggatttgtcattggacgatttggtcaaaaaggcaaaaattatataaaaataatttaatattgttgtttctttaaatttagaatgaaacaattggccactttttgggctcaatcgctgagcagtcaattgatgagggttgggcgaaatcaattcattttattccgccgtctgacagatttctggatgtttttttccaaatttcgaacccgccattttcaagactgatcagtaacgagacaaatttgatgccatatgaaaatgacccgaacaaagtaagagttgggaaagaaaatagaaaaaggttaaatattactagacgattccgacgagatgcgatttgctgggaaatgattgtgaggcgacacgcgaaattctgcggaaaactcggaaagttttggagtgctgctccccctctaatgctgctggtccatgtatttgtaaacttccgaagcccgacctggtaaattaataatttaagctaattgtactgtcattttctgttagagtgaatttgcggtgcctaagggtacaaatccgtctcagccacaaaagtcacgcttcagcagtaacagccaatcggacgacccattggattggtgggacgatattttatatacgaaagagcaggcgcaacaaagatacgactatttggttctaatttaagtgtgcgcaccgtgtttcccaccaaaaaagaaggggaaacggagaaggaaaagacaggcagagccaaaattaaaaaaatggaccaaatttccaattgcgatccatttcagtgacgaatgtatgcattaagttttataactatttcttaatggtattcagtgggcgacccgactccgcaacaatatgttgaagctgttgaacaagggataaaattaatcatgtgggatcattttatcaatcattaaaccgataaatagtgagataaatagatactttagataaacttttgtccaatattccttgctttctgttaaaaagccgaaaaataaaacacttctcaaaattaatattgtttaaaaattgtggattgataggattatttagtgaccattttcctcgggtcttcccgcattttatagttttgatcatttaaacaaaaatatactagggacaaaacttgcgtaacattcaccacggatctgagccatgggccggacgaaggcattgaaatttacgataagaaggacggatactgcggtctatcttgggttggacatattaaggaatggcaacgtgtttcaattaactgtaccaatgtttgtttttattatcgttatcaatttaattaagttcatttctaaattatcagtccgacactgttgcccacgagtttttacatgcgcttgccctcaagcatgagcaagaccgggacgatgccaacaaatacatcaaatggaatccaacgccacgaaatgttagccaggattacaagaatttttttttgcaattttacattaaaaaacactggcataatttaatattttagcaaaaagaaccgtcgaaaacagaaaattacggctttccctatgattttcattcaattttgcattatgctgctgtgaaaacaagcgggtcagttattttaaaggtataaatgaaaagaaaataatttggcaatgaatcagctattacgacatgattacgctgaaccgtttttaccaacgcacaatgttccgccaaacgtatgaactttcgtttaaagacgccgccattatcaacaaaatttattgcgacggtaaatcgaattaattcattataaaatagagtgaattaatttaagaaaattgcaaaaacgtcgaaaacaaatgccaaaagggaggatatcccaacccaaagaattgcaatcaatgcctttgcccggtgggttacggcggcgaaaaatgcgaaatggtcgaaaatggtaaaaaaaaaattaaaatgataaaaattattaatatttcagatggaaattgccaaactgacagggcaaatgaaattgaagcagattggcaaattcgaacgttgaagccaaaagtgagctgcacaaaaaaggatgagtcatgcggatgccattggcaaataaaggcaacatttatatgaaatattaaaaataaaattaaaaaacgaaaacaaacaaataaaattaatataatattactaaaaattaatttaaagaaaaaaaacatatttacagccacaagatggcaaaaaggtgatcatcaaattgaaatggctgcatgaaaaggtgctcacctgtgatgacccttgcggcacttatcgagtcgaaataaaataccgaaaagacaaaagggcacggggtaatttaatttaattaaattaaatctatttaaattttgtaaagttgcatttatttgctgttcttcccaaattgaagaagatgaaacaaagaattggattgaggcggacgcacgcggcgaggacattctcatttcggcttatcccaattcgtctaattttgaacaattgacggaattgttcgaattgacttacgaaacgggtatgggcacgtaataattattattttatgctaattgcttttaaattacttagacggcgccaaaattttgccagcgagcgattgtccggacggtgtgaattggaagccggagagatcacccggacatgctgatgtgcaatcatcccgacactggcgagaaaatcgagtgctgcacgaaggggcacaaatgtccattaagggccaactcaacattcggctgtaaactaattgtggtaaaaaccaagaaattattaattttttgatcaaaaaaagattttagcgttgaccatactcttttagacagttttggcacactttgggaaaattttataaaaattttgtgaaatttgggtgtggcctagtctcagagagggtatgaataagtaaaacctgtaatgttgatagaaaatgattaagctaaacggccaataccgcgagatcagaggcgtaaacgaaagcaaagtcttcttttttgagtgttttgtaagtgacattaaataatttaattaattaattgtaattaaaatacattgtcaattaattaaaaattaattgattaattggttaaatttatttttaaagaggcgagaaggagagacgaaaagcttttggggttattggaaggacaaaagcaaagacccaattcgcattgacgaaatgcaatgcttgagctacgaacaagccggcattgtaaaaccgccaaacaaaacggtgattgattacccattgcgcttcaaaagtgccaacacaaacgaataatgatgccaaaaagatgaaccaactgcggagaatggatgtgatgcatagggcgggtgtttttatttaaaagtttttctttttataatattttattttttagtgtatttaactttggttttgtattttaaatttatttgtattgtaaataaattatttaatcatagctctgtgtcctatttcggcactaatgataaatttaagagtgccaaattctttcattttatgttccttaacatttaatcaatgaaaaacaaaaaataaaaagaaaagaatttattattttttagataaaagatactttcgaacaattttaagagatttttcatttaatttacaccacatttattttttacattttttcacacattttaactttttaagaaatattaattcaagaaaacctttctttctaattatttttaaattaaaaaatggaggattcatttatttgttagcataactatttgctaaaagattatggagaaagaaaatgaaaaagtttacccaaaaatttgtgaagagaaataacatttaaaaaggaaaataagttttgaagaaatgaatgtgaattaaaaagggatggaaatttaaaaaattgtcaaaaatgatttttataaaataaaaaaataattttttttaattttttcccgtcattttgttttcctttttctgaaaaaaatgtcattaattcttttattcgttttaataatattttttggctgtccaattcatcagaaaataaaatattaaatacaaatcatttgatgaaatatttagaggaaattgagaaaaataataagaaaatttggacgaaaaagaaaaataattgggaaatattcgctgatctttctaaaaaatttacatttcttttaatgcgtagtttattttaaatattgaagtaaatttcaatttgcatttattaaatcataattactgttgttggtcgaccgacgaaaaaaatgcaaaaatctagcattaatttcttctgcacataatttgttgaattcgaaatgaaagttaactacatatgtggaggaaaattaatttttctgattttcaaataagcatatatttttttgctgtgtccagtgaccatgaaaaagtgatcagatcaatttaatgtaaaaacattttaatctgcaaaaaaattacattagggcattttcaggactttttgcccataaaatttaaaaggcaaaaagtgcataggtttttaggctaggcttaagcttgcttgggcataggcttaggttttatattgtaaatttattattgtatattttacctttttgtttttccattgaagcataatttgtcggttagataaatattttaattattttacatagcaattttcaatgaaatttactatttttagcatttttttcatccgggaatcaaaatgatgttaaatagtcgtcattatgtcatcggaaatctttttaattttttcatttttataaacatttggcattatatgtcacaacaaataatgataatgatgcttaatattgaaaatgtttaaccaaccaaatcaattaaaatggaaaaaaattaatgttgctcattaaaaattactaaaatgatcatttcgttaaccataaaaatattattattcatttgatgcttaatattgaaaatgtttaaccaaccaaatcaattaaaatggaaaaaaattaatgttgctcattaaaaattactaaaatgatcatttcgttaaccataaaaatattattattcatttcaattacttttttaatcgtgcggaaaaaaaaattggaacaaaaatcatttgataaaaagaaatattcaaaaaaaagaatgggataaaattgaagaaaaaatagcaaaaaaatgagctcattcgaaaataataaaaataaaataaattcacaatgtaaagagattttagaaaaattaaagagattttatgaaattttattataccagaaaattggtgtaaaatggccaaaaatgaaattttagcgccgaaaaatgttgctgttcacgaaaataatagaaacttgaatatttgaatttcttatttattcaaaaataaaaataaccaaaagaagggcattgctgccgcttacacttgaggtggaaatacgagaggtcaaatgggtagaagtgacatgattgttgaaattttaaaatttttaatttgatattttaaagtatttccttccaaacaatatttttaattaatttggtcatctaaattgacataaaagcaacttaatgttgagtgggatggaaatggaaatttcgaaaagcgtgaacaatactaatcagacatttgccaatgcttcttcatctcctgcccaattcatcattgtcctttactttcggatttcacattttgacctttttgtccctcctttgccctttaatttgatcaataatttgacccgggaacggctgacattggcactcattgaccaaggcacttttttactcgtccgatgtccgctggtgcgtgacgagcccaaatgggccaattgggagagggaggcgaaagagtggccaattgatggacaaatgaacagaattgtcattggtgaacatgaacaggaacaggaggaagaaagcgaagatgatggtctctatttggtcaatttgttgaacaccggctgaacaaaagggtccgactgaaatggcatttttgaaagtgccaatgccaatgccgcccatctcattaaggggtggggaaaatggtttttttcgagaaattggtaacaatttaaaaaggtcaaaactttaagctcagcaacaccaatatgatttgtctttgattctttcaatgtttgaattaaaactctaaaatgattcatttttgggcttattttttcgctttcggtgcctaattgaatgcattttgcaaaatgattagaggaggaaatttgtgcttaattgatgagatgagaggagaacagcaattaattttttgtgatccagtggaac

SEQ ID NO: 5648 - DNA, 754 bp, Heterodera glycines
tttcggcaatgtttgtcgctttgtaaataaaaatttgatcttttttaaataatatttattatttttagtaatatatttatatgataatattcatatcatattattaatacacgggatgtctattttaacattaatcgtaccactaatttttttaatgcttttgctgattaatgacaaattatgtgccggaatggacacaaaaaggacgacgacggggacggctccaacgccgacgcatttgagggaaatgccaatgccatcgagtgagcaacagatgacaccatcagcatcaggaacaagttcagtcactgacgaaattgttagccaacaagcgcaaatgccatggcatcaccaaatgtcagaggcagaatttggacaaatgccaacggacgattatccattttatcaaaactgggaacaatcatttgtattaccaaatgttgagcaggaatttgagggattagatcacttttatcaaaatgattttcaaatgccagtggaaaatgaatggcatcaatccgagagagaacaaccgattgacaataatgagccatcatgggatgggtggcaaagacaagacagagaagagaacgaagaagtcaaccaaagtgatcagaaagcgcaaccattgcaaatgacaaaaaacgtgggcaaattcgacgccgctaagctggacaaccaactgagtccgacgtgggctgaactgatcacgattttcggaagcccacgcccaccggcggggattggcccaaat

SEQ ID NO: 5649 - DNA, 6836 bp, Heterodera glycines
  misc_feature (1709)..(1709): n is a, c, g, or t
  misc_feature (6749)..(6749): n is a, c, g, or t
ccaaaagatattttaaagaaaccaaaccatatagataaacgcttttttttacgcgtgctttttccaaaaaacttcgagtacagggggcaggtggtgccaataggcgccaccgggaaaaaatttgtaatttttaatgcgatttgttagcagattttttccaaaaaatgaccaaatttatgtttttgagccaaatccccgatcattattattattaggctgcgattttaggcaaaaaaccccgaaatcggcaagtttagcattataaaagtcatgtagacggcccaaaccaagcggaaaacgcgtttttcgtgcctatctatgcgtattaatttgtaagtgcgccgaaattttaggcatttgcctaaaaatcgcagacctaattcgtatatatgtataaatttacattagcgaataatcaaatatatttttttcttttaattatttcattatgtttttcgcaattcatggctttttcatatgcgtttaattgattatataatgaaaaataaaaattcgatgctacaaattgccttttataataaagggaaactatcaatcccatttttattatacaatataatactcatattttgaaaaatttaataaaacgaattgagttttttccactcaatccttgtgaattttcggcttttcattcattgaaaaggcttcattttcttttggtgtgccctcccaccgaattcctgaattatcttgccttttcccgccctgcaaaaaaccattgccgaaaaatgtgtaaaaattggcacttttacgaaatgactcagcacacgctccctgactttgggtttttaattgtaattttgtaatattacgcattccaaatccttaacaaaagaagaagaaaaatccctaatgattgtgaaaatttggctttttctttaatagaaaacttttttaattcatatctttttccccgaaaatttacactctttaatatttcggcaatgtttgtcgctttgtaaataaaaatttgatcttttttaaataatatttattatttttagtaatatatttatatgataatattcatatcatattattaatacacgggatgtctattttaacattaatcgtaccactaatttttttaatgcttttgctgattaatgacaaattatgtgccggaatggacacaaaaaggacgacgacggggacggctccaacgccgacgcatttgagggaaatgtcaatgccatcgagtgagcaacagatgacaccatcagcatcaggaacaagttcagtcactgacgaaattgttagccaacaagcgcaaatgccatggcatcaccaaatgtcagaggcagaatttggacaaatgccaacggacgattatccattttatcaaaactgggaacaatcatttgtattaccaaatgttgagcaggaatttgagggattagatcacttttatcaaaatgattttcaaatgccagtggaaaatgaatggcatcaatccgagagagaacaaccgattgacaataatgagccatcattggatgggtggcaaagacaagacagagaagagaacgaagaagtcaaccaaagtgatcagaaagcacaaccattgcaaatgaccaaagacgtgggcaaattcgacgccgctaagctggacaaccaactgagtccgacgtgggctgaactgatcacaagtctcggaagcccacgcccaccgggcggggagtggncaaaatatgccagagaaaagtgccaatttatttggaggcggagcaaccaaaagcagaaactaacacattggacctactcagtcctgactcctgggcacggtgatcagaaactttgaacagctgagcccattgactccaccggcagcaaaaattgtgccatcaaatgatcagaaacaaaaggagccggttgtcattattattgatgatgatgccaataccaataatcatcagaaacggatgaaccgcggaatggccgtggcaacaaataaggggaagaagccggccgaatcaccatttagtaattaggcgttgatctaatcacgacaaaaaacgccaaatctttccaacaaagacgggaccgaattctgaaatctctgcttgcttatcaattcattcagttccggtctctctaattaatttctcttgcgtttagttggtcgcagcgatgccattgtgccatcgtcgaaactcactcccattgtgccatcgccgcaacttcgttccgccgctggcatcggagtaccaccagcaaaactcgatttgtccacgttgccgcgcacactcccacccgtgtcacccatgaaaggaatatcgccgcgcaccgccgccgcttttccgattgcgcggaaacgacgcccgccgctgccaccgattcgggtgcccagccagacgaatcagtcccacggccaatccatcgtcgcaccgctgaatttcaggcaaatcatttccgaatcagaccgattttatttaagagctttttttgcatatgtcataatggtcataaattgtactgaactgccccaaaatctctcttcccatttcagcgccggaaaagtgttggcgcgcaaaaaggcagcaaaatttgagcccggacaatcctcaacacaatcagccggacaacagcaacaaaaaactgttgttgttggtgttggccacggggaacacatgcaacaaaaaggacaaggacaccaaggaattcaagggcaagaacaccaagtaattcaaagacaaggaatttacaacaagggcgcaattgcaggctttttatgtgagttagggcaaagtttaaaggtaaaaatttagcaaaactcagaaatatgacacaaaatcttccaaaatgacaatttaaaaaaaattaatttacttgcaataattcatagccaaataaaactattggttcttcattacccatttttgagcaaatgcatggttaatacgagagaatcttttttaatgccaaaataagggccagcaggcgatgcgatgccaggaatatgcttaaaattatcatggccaaaacagtcaaagattaaacaaatattcgatcaaaatatttgtcggaaaataaattgaaaaaaatgcaaaacccaaatattggaaaaggtaaaattatcggaaaaatttagtgtattgcgtccgtcatattgttctgatgagtctccgctcgttgcaaattgcttcgcccgactcttttctcgatggcacaattcaacaaattcgaaatggccacccgctggaaatggcattgggtcccccaaaaatggcattggcacaaaaattgagccaaatgaatgccatggaagtggcaaaagggatcaaaatgcatttgttgaacgatggagagatcaaaaactacaaaatattcgccgaaatcatggaccaaaccatggaaaattgtgtcgcggtgctcggccaaacggcgttgacgttggcattattttaaaaacaaatattatataattttaataccactttggttgggacaacttcttataaaaattcagaagaaatatgtatataaaaatattattttataaaatcttttagaaagttaaaaatattttaagtttgacaattttttttggggggggggaaagacgaattcggcattttcagcatttgcttcgtgacttttttttaaccaaaatatatgaataattaaggaatggtgacaatgtaaatgttaatgccaacagcaatgacggtgatgatattagcccttccgttgtgctgtttttcttttctcgtttattccggaaattggccggctttttgaatgcgccatttatggaagaaatggcatttagtgtaagccaaaaaacgaatttagggataattaagcatttaagtgttaaactcaaatataagtttaaaggaagcagaaaaatgtatagatttgggatttaaatatttacctattagcaatttaaagagccatttttaagaattgaaaaatatttaaagaaacagagataacattcgagttttatttacttctttttaaaacaaagtatcaagaaaaatgaatattttttaaaaaatgttagattttttgaaaacttcaagaaatatttttcatagaaaaattttcaataaatttctcaagaccttttaaaattctatttgcaaaattttctcgaattttttaaatgagtttctattgttgactgttgagatttttatgtcatttttctaatttttatatataatcgaattaattagcattattgaatgatgatattaagaattttaattttgtttttgagcatacgattttatagtttcattattactcgtttttcagagctcgtatcatttttccaaaactcattgacccaaaattaagttattattttttaatgtgtaattatgctaaatatatcggaactaatgcgcaaaaaaggcatatgcctcaaaatacattctctattaataaggcaaagtcacttaagggaagggtacggatcgaaaatttttcaaaagcagaacatcgagcccaaaaaccaatggggtcgaaaatcagaacattttgtgaaattgcttcataaattagcaaatcgtaaattttaatgcattcgggaccaaaaaatcagattttatttttgcagtacaaatttttaataattttctcaattttaggccgaactgaaaggaacaagtcgcgttgcgatgttcattttgattagagagattagaacactttttgtatcacaatttgacgcatcgttcaaattcattgttcacaagggacagaaaattgtgagttgattagactttcttagggaaaagcaaagaaaaaaattatgaaatttgaaaaaacttgagaataaacataaaacctccattaaaacatggcgattagggattttttatggcgtttgcaaaattcaattaatgtggtaaaattggcactttgagttttttcgtactcgacaccaaaaaataattttaatagcatatacgaaaaacattgaaaacaagtacttaagtagttgaggacctaaactaagtgatttcatgccaaatgaggattttttagggctctatgagcattttcaaatagctgatctgaaaagaacgatcattttaaattgccctaagttttccgaattcttttttcaatttaaatttaaaaaacaattttgaacactgattaactcaatccaattcagcaacaggcaatggaattgaataaattggacgcttttgaaacggccatagaacacttttcgttggcccatttggccatctgttcgacaatttcggcgttcactgacaaaaaaatttgccaaatggatttaaaaatttttttcattttgttggcaaaatttttgcatagaaattttgcgtgtttattactgagcaaagagaacatatccaatttcgtgcaaatgttcactcattatatgacaattgagtttggcaggtgggcaaaagaatttaatcaaaataatttggtgggatgggcggggggagtgacctctgatgactaattagtaattcgttaattacataattctttacataagtattggcgagcttgaattataaaaatttccccatttgttttgcacagattcggcatatcccaaaatctgcttataattttacaaaattggaaaaatgaaattaaaagcgaaagtaacagtgcgatgccaattaacttaagccgatacgtggccaatttaattgtcaatttatttactattgtaagccaatttctgccaaaaaatgccaaggattcgttggccgacaaccaattcatggcccacggatgggatgagatgggccattttttgagcactgctggaaaacagttgacagagttggtccaacatttagacaattggagagcagcagaaagtgccaaactgggcgaaaatgattacaaaaatgaggctgaacagagtgccaaaaaagatttttggcacaaaaattgtactaattttgcatcgagcagcggaacaaagcaacaaaactgatcaattgaatagaaaagaagcggaaaagaagactttgatgaacgtatattttattgttgaggaatttattcatgagaatttggcattatttttttttggttttttcgtctaccaaaatattgctataagaccaaatttgtaaaaacattttaaaaatcaaaataatgaaaatatttctgagaattaattagacaagaaaaacttgcttaaaaatgcgacgtatattaatgaataattagtggagggattttctgcaagtcatatccgattagggcgatgatcaatcattgggcgatcatccgccaaatccgccttttgttttgcggctttctgatgcatctgctctgctgaaagaggacagatcaaagtccttctcccgcaactaagacaatgctaatcggatgtataatgaaaacaagtcagccgataaagcagctttttgtgcgaacggaagcataaatggtcatcatcctcatcgaactgatcagcgtgtgggtggcaagagtgatcagaattttgatggataggtgaattggttgaattttcagaatcattattaaattaccgaactaatgacaaatttgttagaagttctcttgattcgtttctctgaacagaatattggtgaaggcgccatctttgatcatgatcagaattaagcattttgtcagggatggtcagttgcctgatatgagcagggagagaaacgaggcgaagcaattgtgatcagcagaacggtgaagtgatcagaagccactatcttcatttctcagattgngcagctgcttttttgcagcaggcagagaagcagaagagaagttgaagcgcaggacacacaaatttatgatcagatcagctgcgcata

SEQ ID NO: 5650 - DNA, 1562 bp, Heterodera glycines
  misc_feature (24)..(24): n is a, c, g, or t
  misc_feature (59)..(59): n is a, c, g, or t
agctcaaaaatccccttgattttntaaattaactcaaaaatccccgaaaatattagacntgtcagagttttttgattttataaaattggtccaccatcccctgatcggcgtcactgacgatgcgacagcggaaaattcaatttacggagagaaaaacaaattttttgaattttaggaaattgaattaaaaaaatcaaaagttggttaataaaagaatcaaaaaattaaacgatttttttcgatttttaagtaagtaattaaaaatttttgaaaaaaaagtctcgggtcacggtctcggggtaaagtctctgtctgggggtaaagtctcggtctcggggtcaagtctcgatctcaattctcgggaaattttcgatctcgaacagcactacttcataggcccctaaattgggttttcgtccctaaaaatcctctcaccatttatttattcaataaaatttaagggagaaaacgcgaccctcgaagaaattgacaatttcattgagcaaagaagagatgcagcatccaccggacaacgttctcagcgacgtccttgtgtgctggagacgccggaggcaccaccaaagcctctggtgggtcaacttagttagaaccaacaaattaagggattttggtatcaatagatagcccttttttctaatttcaatatataatttcaaaaatttatttaaaaaaaaattattttagcaaagttatgggtagtttttatcgattaaatgtttgataaaaagttgtcaaaaacaagcacaatcatatttatttccgaactgtaaaagaactgaaattttttggctagaacttttgaaaaacttaataaattttttggctagaacttttgaaaaactcaataaaattttttaaatttggcaggctaatagagaactcttagggctatcgtatgatagcaagattgtacaatttggttgagtctgagaaaagttatgagtggatttagtcaaaaaattagcaaattttgcactttttgtcctttgacctaacaccgacgtcaatccttttgcccattcaaccctaaaaagtccaataatttattttatttggttttccgcggttgtattaatatgagatatagtacttttaaaaaatagatacagtataacaatgaattctgatatttttttactgtattactgacaactttagatggtcgtaggtatttttttactccacttaaaaaatgttcaaagaaatactgagctgtagacctgaaaatataaatttacacaattttacaatttttagaactttccttgcacgaacacgaactgtgatcgatctttcccctcaaaaaaagcactttcaaatcataagagggcgtgcagtgcccctgctcgtgtgacgcctccccctgctgctcagatgacgccccgtcgacgcgtgctcaatgtaagttttcggtggtgaaatttaagccataaaaaatgttcagcgattttttcttttgcgcttcggggctgcaattaaattttaagggaaatatccgttgtttttttaaacgattttgaggaattttttctgatttaaaa

SEQ ID NO: 5651 - DNA, 2222 bp, Heterodera glycines
gtttaaataattgataaaattagaaaaaaattaaattaaacttaaaattttcattattttgtaagattatattaggttcatttttttaaacccaattacagtttgacgaatcggatgccgaggatccagctgaagaggtgccgccatgcactgttgaaattggccttcgctcacttggtaaaaaatgtttcatattgtacggtaaatgcctaagaatagtgattggaaatactttcctcatcagatcattgtttttaattatttttgcacattttcaaggattttctaattcgtgggaaaccatccggaagcactaaaataattttttaccgttaaaattaggaattcacaattcaaagctgaattttgttttgactcacagcttggaatgtaattttgtcggatttttttgactgaaaaagattgaaaactcgaaaaaatgcggaaaagtgttttaaatgcttttttaactaattaaaatatatgatcaaaaatgtttttttcaatttaattctatgaaagaaatttaattgattttgtaaatgagcagtttaagagcttttccactgaaacttttggttttcaatcaatttagtgtctaacaaagaagccccggacaatcagtccatcactggtcaatcaatcagtggagaaaatccattagcaaaattaaaatttaaaaaaaattgcaaggcttttacaatatttccacatattaaattttaaaatcttttatttaatttttttaaaataataaattcttcactaaacaacataaattattattttaagttttatcaaatttattatattttcataaaattttaaataaaaaaattgtttgtttattttttggatgatttcagacacgccaaaggcgcaacggacgcgcagcgccactgtccaacggaagtctcgtcggctcgcggctgtcaacaatgccgcttccgctggtcaaagtgccgacaaagcgcacgctcaaagtagggatgggattttccgaggcaatattataggggaagtgtggacgaaaatggcaattattaaatatttttttatccaacagaaacgaccaattttgtttatttttgtgtccttattaaaaacaataaaaattttgagcagtgtgccgatagtcacatcagcaggagggaaattttggcaaatttaacgaaatttgtttaaaaaaattttaaattatttctctaatcgtgcattccaaattttacaataatttcgtctgactcatttgatttatatttttacaatattaaactctcaaaaaaatgtatttatttgattgttgtcccaaactaaaaagagcttttgctttaattaggctcaattactcgccgtgtgtcaaatgggacaacattggccgatgtgatcccacccgatcacttgcaaacattgacggacaatggcactgatgcattgctgccttcaacatcggatgcgccaaggaggtctcgtcggatcgcggcaaatgtaagttttgggcgggttgtaaaaaatgaaatttgattttcaaaaactgatttattttttaattaattttatattttttaatttaccgattgctttttgattagtttaaaaaaattaaaaaacgcccattaaaaattttaaatttattaattaattgcatccaaaggcattttttttatttcaaaatttattaaataacatttaattcatacataaaaaaggtgtggggggggtgtcaaaattttttggaaagggaggtcggccgtcgacgatccttttttttgcttttcaaaaacagttttttcggcgcggtttttcctaaaaattttcttttttatttttgggctttatttttttattacaaaaaacccataaattgaaatttttgctctttgttgaaataatgagttaattattttccaattttttaggtgcgctgcgcggacgaaccgctgctggccaaggcgccattcaatgtgccagggcggccctacccaccggagccactgtacaccaccgacaaatcaatcatgctcaaatgggaacgaccgtcgctggacagaggcacgccgatcactgactacgagctggaaatacgcgagcgtggcaccaagctctgggagaaggctaccaccaccaacgcttcgctatgggagaaggaagcatttggcaatgtgccggacacacgaatcaaggtgggggaaaacatgagccgttcgtccccctccccctcg

SEQ ID NO: 5652 - DNA, 5522 bp, Heterodera glycines
ttttattacaaaacaaacaaaaatagaaatttttgcttattggtgaaataatgagttaatattttccaattttttaaggggtggtgcgcggacgatcgtttgctgtccaaggtgtcattaaatgtgcagtgctgcccggcccgccgaagccactgtacttcaccgacaaatcaatcatgctccaatggacacgaccgttgcgggacagaggcacgccgatcactgactacgagctggagatacgcgagcatggcaccaagctgtgggagaaggccgccacaaatgccgaccccaaagccaacaccaaaaagcagtgggagaaggacgcatttgccaatgtgccggacacacgattcaaggtgggggaaaacaggagccgttcgtcctcctccccctcatttcatccccccccctcgccgtaaattttttttaaaatttacaattagaaatttaaacaaaatcagaaaattttttataagacgtttcagcaattttttgcaaaaacagaaaatcgttagtttttcaaaaaaaccaaaagaaattttttttggtattttcttataaaaaatttttaaaatttattgtaaattttcaaggtttgaatttttttttcaaaaattttccgggggtaacgatgatacttgaaatttgtccaaaaaccactaaaaattggcatcactgaaggtgaccggcgtcaaaccgcagcacacctacgagttccgcgtggctgcagtgaacgcggcgggccgaggcgagtggagcaagaactctgtgccaattgctgccacatggttcccctgtaagccgttgatcaccatgggaccgttggcatgcgacatgactgtgctggtgggtgaacaggccaagctgctggtgccctacgcagcgaattcttcacggccgaaattcgtttggagcaagaatggcaaaccgatggatccgcgtgacgacccacgcgttaaggaggaaaaaagcggtaagtgagcgcgcaatcctggcacttaacagggtggaggcgcagagccatacaataaaaaaagggaggggggttaaccaaattttttgctaaaatggtctggaaagagggggtcgacagggggggggggtcagcggccaattttgcgaaatggtccagccttgaatttgacgacctttcaaacagatttttttgcagtggcttttttaaaaaaaaatagttaacatattttcactaaaaactgccaaattgcgattctttagcaaggcgatggctttttttgtttttaaaaaacgtttttttcgctgtacacttttttaaacaacttttttttgcaatttgttagaagattttgtctaaaaaatgggcaaattttaaaattttggctaaatgctcttttaaaatttttttaaattaaattttatttttttatattcacgttttttttctcccatttttagacattctcatccagctgtgctatccgaaatgcgaacaatcggacaccggcacctattccattcgcattgtgaacgacttgggctcggattcggtggacttgcgcctgaaggtggtcgatcgccctgcaccgcccgaggggtcattgaaggtgcaaaacattgggaatatttttgtaaacagaaaatgatgagaggggcatatttgtaaaacaattaggaatggatttttgaatttttttagaaattaattttaacggagtatttttcgtttttactgtattttttttttacaaaatattcttttaaatatttaatgtataaaaatatgaacaggagcggaccgcgtccagtagcggaaggcgacgcgttggcagcacagcggcggatcggtcggcacaggcggcagcagcggcttgcgctgcggacgaagaggcaaaggacgaggtgtacaacaacgaggaggagcgacaggacatggcggtggtgacaaaaaggatggcaattttggtaaaaaaaaaatttcaaaattattgtgtatgcttttcgggatttttgtgcttaatacctaggcgccttttttgtgcctatttcgccatttttggcgcctattttttggattttttatttattaatatttttccttgagaaaagcagcacaaaaacaaaaatctttcactttttaattgtttttttcaatttttgggcaccccttttttatttctattttttaaaggacctggaaacatccggcacaccggcacggattgtcgaaatcccagaaaatgtgacggtggttgagggcgaattggccatcatcaaatgcgtcgtggagggcaacccggcaccgacaattgtgtggaaaaagggcggccgaaaaatgccattgaccgacgaccgagtgcggtgccaaacggacggtgacacgggacatgtaagtggcaacttttaaatgaaatttttaaacacagaaattaaaaaaaattgctgttttttggaaaaaactttttttgtgaaaaagtcatttatcataaaactgagaaatcataaaaaattttttgttttaatttcaataaaattacatttttcataccgtagccctcaaatggaggacaagaaaactttttactgtagttctaatcttggaagggatttttacggcactcaattaattaattaatgtagctcatttatttctaaactaaattcaaaacttagcagcaaatttaataaaaaaaaatttatcaaatcctaaaataatgttaaaaatattttatcaaattaaaataatgttaaaaatattgtcaggtttctctgatcatttccaaatgtcggccacaagatgggggcgagtacacattggtggtgaagaacgcgcatggcaagcacaaagttggcgccaagctgcttgtcacgccagcggccgaagtgaaaaaaaattgccagccaaatttaaataataatatttacaaaaaataaatttacagtcaaatttggacttccgggccaagcagaaaaaacgtggcacgggcattagcaattcggaacaggaaaaacagcgccaacggagtgatgccgagcccaaaagcaaggctgaacgacggtgagccaaaaacagctaccaccaaaaaattttgcaccgaattttggaatggtgccaaaaaatcgatgccaaattctgcacttcgcttattttctttttaatttgactgaaatttcaaaaaaaaaatttcagtgcctcttcttttttttttgatggtgacaaaaatttaaagacatggcaaaagaaattattgaaattcaatttttcgattaaataaaaatctcgaacggaaaatgggtcagtggaaaatgcgtcagtgaatcaggatttctttaaattgagatacagtagtaatattaccgaaatcacaacttgttttttagggatttgggaaagtttcaattattttgacttttaaaaacttaattgataaaattcagaacaaaattattagacaattttgtccttttgtaataatacaatacttaatgctacagtaactttattttaaaaatacagtattattgacaccttttccactgacgcatttgccaggagccaaaattattattatttttaaaaattaattttcatttaaattatggcacaaaaatttccagcaaacgccaagtgtatgtggtggaggagccccgtgacacatttgttgtgccgttgaactcgcagcatgccaacgaaaaggaaaatgccacttttgaatgcgaagtgaacgacaaggagatcgatgtgaaatggttccatgacggtgccgagatcgggatggacgggcggcactttaaggtgggaaggagggggcaaatctcttgctaatcaaagaatacattcatattttgtgttatgaaagatcaatttaaaaaattgagtaggagtttaaattacctattttgggattcctttaatcccaaaaatccctaagtatggatatttccaaaattcaaaccaaaactagctcaaattcttcaattcaaatgcctatcagaaatttaaaaaatatattagaaaagtcagaaacaaaaccatttttttaacaatattttttttaattttatatttttttacattatctaaaatttgtttttatgccaaatttcattttgttttcctattgtgtattttattgatgcttcttgttttacaggaacgggctggatgccgtcgtcgcctgctgatcatcaatgtactcattgaagaccacggggagtacaaatgcacagccaaagacgacgaaacaatggcccaactcattgtgcaccccaaattcgtcaaaaaaagcggagcgcaagccggtgaccttctggttggacgatgagttgtattaaatttttttgtttttcactgttcctgttttatttgtgcccatctcttttttaaactctgtgaattgaagataaaattttattttcctttaattgtcctattttatggtatatcccaaccagggctggccgtgattgaatttccaatcacggaaatccgtgagccgtgatcacggggctttaaaaaaaatccgagatcacggcaccccaaaaactccgtgagccgtgatccttgattaaaaaaattttttctaatgatttttttaatttaaatttatttagaaaaacggaatttaatcgctggaaaaatgggaagtggcggaacatttttgaggagagatttggtgaaaaatgaaaaagaactgtcaaggcaaagagactgtggaaatgccaatgtgaaaatgccaatgatttaatttaaaaaatgatggcaccacattcccaacgaacgaaggacagacaaaactcttacaaaattaggcaccaaaaataagaaagtctttgtgaaagggaagtgatcagacgggcggaacataaggcaatgtaaaaaacggcacggaatttagtcaccgacggaagacacataaaacgccaaaaacgcccgccacaacactcatttgtcaatttgctcgcggtcaaccgcccttcgtcgcctgttgaaattaaaaaagattaataatttatgtaaaattgtgagaatttgaaggccaattaaatgctatacaaattattaaaattctgcctcaccttcaaaatctcaacatttaacaatgcgaggaccgcaaaaagttgtatcttgacctcttcgtccgaaaaatgtgcaggaaaaaataagcgcattctgtcttcgggctaatttaatgaatttaaatgagtgtcaatgcacaaatcaattataatttggcgttctttatccataccaggcccgtgtcgagaaaaaattttgggatgagaacccgaagagccattttaattggatgccgtggaaaaactatgaaattttttaaccattttagccaaatttggccattggggtaaattttgcaaaaaacatggaatgccggggatacggctgtgcccttacgcgccaccgggaaaatttaaagaaaattttatttaaaaaatagtaagatttaaaaggattgcccatttttcctgtaaaaataaaagaagaaagaaaattaagaaaattggtagcactgtaaaactca

SEQ ID NO: 5653 - DNA, 4046 bp, Heterodera glycines
  misc_feature (2191)..(2191): n is a, c, g, or t
aaaaaaaacattgttaagcgtctggcatttaggtaattcaaaaaaaacgaacggttaaggcacacgaaatccttactttaaaaaaaataacaaagcaaatgcgattttggatgtgcataaatggtacaattttggcaaaaaatgattgtcccgggcggtcccaaattttggtcgggcgtccgccggccgctgggctttttcaaatttatgaaattttgattaacaaaaagcggtttcacttgccaaatttaagtccgttttaggctgcccggccattttgaccgggctcgggcttgacaaatagaccgggtccgggcggcccggccaaaatttttcaaaatttcagggccggcaaaagtccggcaggtgcccgggtccgtccgggacttttaaggaccaaaaacgaaaaatatttatattattttcccgttgtcaggtgctaaaagatcgttgcacccacggctacacaaagaaggacccgatccaggggctgacacgggccaattaccgcaatctcgaaatgccggaaagatggtaaaaatgaaccaagcattttatgggataattagattgtatagccaaatccattttgatacttcatccattttatttgataccaatgggcaaaacatcgccaaattttcagctattagaccataaaaacatttctgacgattttcggtgtctctgaatacgacgaagtctgacttctactgttctaacaaaccgggcccctgcccgaatttgaacaaaaaatcattaactcaaaatttacaacacatttatactaaattgatccaattgcataaaaatttagtgaaaataggctgtagatttcgtatcccgagtccggggttttcgaaatggtcagaataaatattccgattcgtgttcagtggccccgaaaagctcaagaagtgtgttgttatggcttatttaatgctgattttttaagtttttaaaaaagaggattggtctaaataaaatatattgtaatatcaaattgtctaattcaactctttgtccctcttttcaaggactgaatacttctggaaagaggaatggattggctcttcctgttcccttcacacactgttcgacccgaccgccaaggactacgacccggagtatttgtccaagcattagcaacgcccatcacgcagaaagagagagggcggcaccacaaaatgccggaattgaattgaaatggagcagattcacatttaggaagaacaaaacaaaaacactcttttcgctgccgcacccattcatgtgttcctttttaggaaaataaattgtttttattgtattaaataaaattgagggtaaatgttaaattcaaaaaagaatttattcgttggtgaggtatacccaacttttttgttgtggatagagagcatctaacaatataaacgtggaaattataatattggtggtaggattttttggtacttttcccttttgggccagttttaatttttttttttttaatcaaaagcgggcgattagaattgcagacaccgtatcagaagcacaaccaccactgagtttcaaaacatatgcgtgcgaaacagaaggccaaggggtcatcctctgtgattccatcgtaaaaaatatacaaaaaataatgggaaaatattttaatgtgattagagccgggaaaattaacggtgctgtgcggtgggcgataatgcattggtcagagacatgccgaggccccaaaaatttttcggaaagtgcaattgcgaccataaaaatgtcggaaattggaattccatgccaccctgttaccaagcttcgtgagcagaaattctattgaattgctctacctgtgaattgtatgtgtttttgactcaaaacaaaagggcttccacgctgggaaaaatcatcaattaaaaatttgagataccacaaagccgaccttttaatgatttttcgtggcttaaattcccatccctattaatcattcatgtgaagttagaaaaacaactaagattttaattaagaaaataatattctattcgggcaccgtgccctctgtcgacgccaaccaccgccacctcaaaaactgcggccacagctgcacctgcccgccatcgccgaccaccactggtgcaccaacatcgcccggcgatggtaataaacattgctcaatcaaaaaatttaggcattgttttggtgaaaacctatntaaaagacgtattgcaaaaatcaattagttttaacgaaactacgcgaaaaaaccgaaccaaatcacttgacaattattgaagaatgcccaaattcacctttgctatttgggataaaaattcgggggcactgatcttgaatttgacaccagttttgtcaggcttacaggaaatgcaccagggtttgcattttttgggattaggggaggtggtattgtattgaaataatttgtcggttgcccattttcgagtttgtcaaccctgccacagctgcggtcgccagtgctagcagttggcacagcgctgtcaagtctcagtcgtccttccctccatcaccaccatcaccaaatctcaagccggaacggtaatagttcagtttgtcgcccaccccctcccccgtttttgaagtttttagatttataaaaacatgctttaaaggatttttggggtagctgatcacgaatatggcatccattttgatcaattcgaacgaactccgaacattaattcgaacaaaaagtcaaaaatttaaattgttgaatttcgcgctttttcgtttaaataaccgccataattttttttatttttcagtcccgcgttttgagtcctaatggtataagaaatttcagtaccgtctcgaagacagacttatttttcggaactttcttcgattcccatccctagtcatgacatttgctttccggctttttgtgcctatgtccaaatcaatttcagaaatcaaagtaggcatttaaatcccaaaataaacttggttcaaaattctgcagttttggttttcgttgtttgtatgtaaatttatgtgagtaagttctttgtttttctctctgtcttttttaaatcaataaatcgattaatgcttatttcacaattggtaacgctaatgcattggttaccatgcacttttaagtaggtacctatatcgatcattataatttcataattcctttgttggattcattttcttacattgaattaattacctaaaggagttttagatttactttttcgcaaaaagctcacacgtaaattttggcaccaaataattttatttaagaaatggcattgtcaacgaagttgttgcctggcctttttcttcgctcttctgcattttttgcaccaatttcttgcagtcggatggcaaagtcggacgtgccggcgctgagcacgacgaatcagccctacccgtacaaggaacagactccgaagggtattttcgagaagatgggcttgcagaaaacgccggacggcgcttcaatcggcgaattcgcagtgatgcgtatggacgacatgatgaacttgatcgggcgtggctctctttggttagcaaacatttttttaattcatgcattgaacgaatgttttatagccgatggctaaagacaacgcagatgcccccccccccctcctttttaaccgaaaaatttattttcaacagttctaaaaacattttttggtgccttttatgagtcgctgattacggatatggcatttatttaggcatattccggatccaaattcgaacaagaacacaggcgaaaattcgaattttttaaagatgaaacaattaaaacggaactggacattgaaatgctttatacatacacccaaattgataaaacttaacacaacacttagcactaaactgttcaaagatttaggccattgaccttcggtttggcgtgctgtgctgttgaaatggtttgtttgtgcttttctttttgcattattatgccatttaactgcagctaaattcagatgcatttcgccgctcctcgttatgacatgatgcggtttggcgttgtttttcgtgcaactcctaggcaggtttgtgtattt

SEQ ID NO: 5654 - DNA, 1646 bp, Heterodera glycines
atttgtcagatgggtgatcagcatgggctcgtgtgccaacggtggcggttattaccattattcctattcggtgttgcgcggctgtgaccgggtcatccctgtcgacatatgtcagtcattctcataaaaagaattttcttttaaatccctctcgtccatcaaccttccttaagttctttttggaaatgtccccctattttgacagtattaaaaatttgtttattgcatttccaaattgtcagatgtgcccggttgtcctccgtctgccgaggcgttgctctacggcgtgcttcagttgcagaagaaaattaagcggctcaagaaagtgcaaatgtggtatcgcaaatgagtgcagttgcaacagaccaaagaggagggaggactgcctgattagatgattttttgcacatccaccaattttatcgtgtataaaaataatattaaaaagtgttattttttcagaaaatgaatttggatgaaggtcgttgtgcccgttgaaactctatctctgaatgctcacagactaatgatgctcatttaggtgcgatgtgtttgtgtttggttgcagcatccaacaaaaagtggcaccaaaacgccgtctctgagtaaaaaattgggacttcgtatcaagtcgattttataacattgtctctcttttcctttgggttcattgtgccaaattttatctccgttgattgatgaataacgatagtggaacgaacgggacaacctcatcaccaacgtacactaaacagcaaatccaacagtgtcaggtgaggtccgtccgctggttgtgtgttggttggttggagtgtgtggcttcacggcacgcgcatccgagcagagctgttggatggcacaggattcgtataaacgaagggtttagtcgatcaccaattgtcttgttccattgaaaatttgacaaaaataaaatttatggcctaaaaaagcgcggcggtcaattggtgggatccgtaaaatgtaggggaccatttgtttgaccttttttcggagtgcatacatttgtggccaaatgctcattaccatttatccactgatttctgctattattgtacattggattttctcccgtctttctttttttatttttctgcataatacacgactaattttcgattcaacatttaggaaattgtcaagagttttcgtgttcacgaacttcaccaactgttgagcattttccactacccgaagttgggcaaaaaggtggaactcgtcgatcgagcccaagccgtgttgtcgattcccaaacatcaggttttttacagttattactggcaatgtatatttattaattcaatttttgtttagaccaaagctgcgcaaaaggtgttcgaaattcaggtgagcaatcgcgttcgtgacaacatgcatccgtactctccaaccggcaacatcaacggtaatgatgcaataaatgatcctcgaaatttagtcgttttttacttccagtcagtaaagtgttaatttcaaagtggggatttccatggccttaaatttaggagaatctagccaggattttggagtgccatggcttggtcgctatcgatacgcatggtttccagccccggcaatgagtaattttattgtaaactagtttttgtcattgttttaaccgttttcat

SEQ ID NO: 5655 - DNA, 1065 bp, Heterodera glycines
cgctaaacagcagtcatcagcacctgtgcaacagcagcaacagaaacgtacgacttcgtcgtcagcatcggctgttgccccgacgcccgacattgacatcatttgtttgagcagcgacgacgaggaggaggaccgtcagcagatggcacgtgccattgctgccagctcacgtcaacagcagcagcagcaaatgtttggcgccgggagcaccgaaaatgggaaggaagtggcccggggcaacagcagcggcgggggtgagggttgtgctgctggtacttcttcctcatcgtccgcttcgtccaacggcggtggtgctgctttctcgtactccgtgtcctcgtcgtcgtcgtccgtcaacaccaacagcagtgccgcttcaacaacggtgagacaattgagggccaacaggaagaagacggtacgatgggggtgccaggcggatgatgatgatgccaggtcatcggatgaggaggatgattatggcaaaaaatacaagtatgacgatgatgaggatgatggagaggaagaggaggagcccgtcatgatgacatgtgatgacgatgaagaggatgaggaagatggcgataacagttgggtgccatgggcggtcaccacttcacggcaccaaaaccgccacccgaaggcggcacccaaagagcacaaagcgcgctccaataatcataaacggcacaaaaaatcatccagatgagggagaaaattgtggtgccatggggccactgattatgaagggctcaattgtttcgaggatgtgtgccacacgggacgacaaaaagctgcttatttctttttggcctaccattcattttcttttgctattctttgagcgccattgacacaaaaaactcacagcaaaccccccgattttcaatttgtccagcagagaaggcgaacccagaaaaaagaagaatcaaccaaaactagaatttacgctaccaaaactttttaggactacgaattttctgggtgcgccgttgggctggctcaccacgattatgtgttacggtcaaattgggaaatcgttgtggcataaaacaatatgcctat

SEQ ID NO: 5656 - DNA, 5934 bp, Heterodera glycines
  misc_feature (25)..(25): n is a, c, g, or t
ttttcggtgaacgggatcttaacgnggagcgggatttttacgggattcccgttcgggactctcgtcccggaaaaattttgaactcccgatcccgctcccggaaatttttacccaaaaaacgggagtaaaaatgcactggtacgaattgagttttttggtaaaaataatgattttttattgaaaatctgttaaatatatagccaaaatttcaaaaaaaaattttcccggaaccttaaaatccttaattttctttaaaaaatgcctcaaattttaaaaaattggctatttttggacataatctaacaatgtattgtatttaaatattcaattttttttccctgcggcgcctatcggcaccgccggcctccctcttccaccctggtcaccaccaaaaagttttttcaaaaaataagccgcaaaaaattgttaaaattttctgcttactaaatttttctgtctatttttttctctaataaaaggattgaccttaaaatttgtgcattaaaaatattttttgagtaactcccgctcccgcccgggactaccgtaaaatttctgcgggattttcacgggattcccgatcccgctcccggaaaattttgaactcccgatcccgctcccggaaaattttgaactcccgctcccgctcccggaaaaatttgaactcccgatcccgctcccggaaaaatttttttaccggactctaattttattgcatttttatgcgttttaaggttttggacggttcagtccctaaggcatttggccacttcagtcccgggtctgtaactcttcagggattggaatataagctcaaatttgtggccagcaatgcattttttaagcctagaaaaaatgcctgccaaatttttaacattttttcgtcgggacatcaattcttgatgattgccaaatgtttcatttaaaaatgtaaatttttgttaagaaaattagaattgtcagtgcgaaaataaatgattttgcctgaatttaaatactccttttggtgctcacaaaaaaaaaaagatttttttgtctgttgacagatttttctatttaagtgctgtctcgttgctgctctttgctcattcctttggcaatttctttgcccattcaccactattcccgttccgaattttatttagtcattcattttcattttaaattttatattttttgtccccacaatttagcacatgtacataaataaataaacaactcttctaatgactgacagggaaaagcatttgcattttgttcgtcttgcggaggaagcggcgcgttacgacgaaatggtccaggggatgaagcaggtgaaggaaggaaggaggagaccaattcagaagaaccattaattaaactttgcatgcttaaggtgattgaattggatgccaaactgaacgaaaatgaacgcaaattgttgggcgtcgcgtacagaaagtcagtcactgggcaacgcttcgcttggcgtgtcattgcgtccgtcttggcacgagggaaaggcacgaagagacagctggagatggtcaagcagttgctgaacaagctggagcgcgaggtggaagagaggtgccgtgaaatattggtcagtggtgggtgggcgcattcttgtgccgcgaaattccgcactaatttgcgttacttttcaggatttgttggaccgggttctgatcaaggaggctgcagatgatgaagcgaaagtgttctacttgaaactgaaggctgaccacttccgctatttggctgagacacgggcggtgaaaaacggtaaaaggacagacggacggaccatacatgcacaaggcgtgtctcgacaccccccccccccccccatcgttcgtcgtaaggggggcggctgtaaaagaggggggtcgtcgtggagggaggcgttaacgaagggagaaaataaaaaaattttggaccttcgtatgaaaatcggtcccgagacacccccctgtcccaatcatccgtcgtatggcccttgggctgagacaccccttgtgaatgtatgggacggaccgaagcattgaacaaacggtggatcaacaattggtcaattttcaggtgttgcggagaaggcaaagcaagcgtaccaagaagcgttcgacctcgccaagaacaaactccggccaatgcatccgattcgtctcaccgtggcgctgaactttgccattctccaattcgaagtgcagaaatcaccagccgatgcttgccaaactgcccaacgggtgatgaacagaaaatttgtttttcaagtttaaccgctccaattttttttacaggcttatgacgacgcgacttccgatgcgcagacaacgggcgagagtatttgcgcggagtccgtcacgatcatgggactgttgcaggacaacatctcgtactggagtggcaacacctctaagacggagtgaaaaacgatcgctgtatattatacgacataatttgtccttgtccattgtgttgttctaatgagccttttaaattatatgtatgtacaatttgtatataaaacagaataaatgttaaacgctgatataaaagtaataggggtcgaaagatgaaagcaaaggtttgggggccttagggcagacttatagtttagagtccctcaaaaatggtcagacaataaaaaaggactgtgagctgtttgggtcacagatcttttcatgaatttgatattcattttaagcacccgaaatcaccatggacggtaaaaaacgaaaaaaattgccaaaaaataatttacttgtcagttttactaaatttatttccgcgattcggtgataattaatcttccatcatatactattagctttggcaccaaaagtgccatatttgtttgtattttcttttctccttttggccatcccttcccttttattcgtttttcatatcagctgaccgaagaatgagtcaaaaaagctcgagaaatttctcattcgggattttcagcagtatttgtttcgggatcattaatggacaaatcgcacattttgacaatggcattaatgccgtcgtccacctgctgctgaatatctctggtgagtggcgctgttcctcccccccccggcgccatcaaataaatatttgcaatgcaattaagtttgccccattaatttctgtcctttttataacacttttccccggctttgctgaattcaattttccgttatcagtgtatatagaagttcaagcagtacagcaaattttgatgggaaaggagatgaagatggacaacagcaaaaatggagaaacaaggcaagaggaggaaaatagcattaggttaggaggagagacggaagagaaagagagaaaaaggaaaaattcggcggaaggaagaggagagaatgaagctgaaaagagaaaagaacagcagcaaatcggcacttaatgttgccggtgctaattgctaattttgtgtgtcgtaaatccatcgtcaaaatcccgaaaattaattgtcacaagtttcaaggagaaattcatacattcgatagataccaaaccatttttatacatccgatttatttaccgaaattgagagttttttcttcataaaatgcatttgatcacggatgaatatgatcggtcgatcaatcattcttaattaattcatttcttcttctgcggttgatcgctgtttttgttgttttgtccgtcactcatttcgccctttttcgctgctttgtcccgtttcttctgccggtggaggagacaatggccttaattaggcgcaatttgaattatttaaacaaaattaaatgcctttttttaattgctcacccaatgcaattagtgccatcataaagccaaatgagcacagtgttataattgttgtcccaatttccgtctttccaataaaccgccgcggtttccccaattttgcagcgtttcattatccaactgttgtcctcaaattcattttcgtcttctttggccaatgtcagcttttcctttgtgcattcgttcaccaattcaaatggcacaatttgcattgacgtcgcacgaacataaaaatgaatttcgtaactgacggaagaaatggcattggcacggagaaaatgctaaacaatttgagtggggtcggaattccaatttccgaaattttgggcctcattttttcgaattttatagaatatttttttcgaaggctagagttgggttcaaggggtaaaccaaaaatacgtttaatggttcttaaatggcgtataattaaaaggtatgatcattttttggcgtaaaacgggctgagacctcggaggaccgggaattcccgccccggtccgtacaaccctacttttaattgttaatttctttcattattttttggtacagaactgtctatattcaatgggactcagttgtccctgtgcttaggtggctcccgttttgacatttttctttgatttttagacttaactcaccaagagctttcgaatgatactaaatttggtaatactacccgatggtaccacaacttttttgaaaaaaaaaattttgttttcaaaagccgtgaaaacatgttccctggggtttttggggttgctgatcatcaatatgacatccatttcgactaatttcgaaccccggacccgaactcgaacaaaatttcgtaagttcaaattttgcatttttcgtctaaaaatgggtaatcacatggaaacattctgaagtggtaccatcggtagtattaccctaaatttgtctgaatttgacctttttaaaaggctaaattgtccaattttgtccattttttcggtaaacaaaaaattgtatttcactctgaaatcgttggttttacgccaaaaaatgatataccttttaattaacgccatttaagaccattaaacgtatttttggtttaccccttgaacccaactcatgagttcaaaaaagctcgagaaatttctcattcggggattttcagcagtatttgttcctgctcccccctccctccgcaccacacctccttgaaactgttgacccaatcgaagttcgtttgtttgttgtaatttgcgcaatgcaatcgtttgggttggccatcttttctcggagagtgcaaccatttggacaatgcttggccagaagaaattgttgaatttggcccatcaaaatcatcaccaaacgcagcgggcaacaaagcaccggaatggattgaagtcaattggttgagatcggtgagaattgtcggcgaaatgcgacgaagcaaattgtccaaatgatcaccatggggaaagcccaagtggcgaatgtttgccgaaaaaattggccaaatttcacgaacaaaaacatccatggtgtatgataatggaatccacaaatgtaaattggtgcctcttttgtcgaaaatttggtgatttgaacgaagaaaagcgatcacggaatgatcgatgtaactgaaaatggaaggaatgcttttattgtcatagctctctgatttttaattactaaatccgaaggcgcttaaaacggattttgctgggcaacggacggtccggcaatggaaatggcacaaatttgtcacccatttgtacagacagcttcggttctggtcctttgtccttgcgacgaatttcgatagttctccaaattgtcaattcgcttttgccatcgaaatgtttgtccaccaacgcatcgaaacgtggcgaaagaagtgccaatttgaggccgagttgagcacggtcaaaggatgggaaaatgtccatccaaacgtcgttgcaaatccaactgaaattatggaaaaacagtttagtcaaataaatgatgaatttgtgtgacttttcaaattgcttaccgtctgttcatttttggcagcaattagcacaattttggccgagttccgaatgatgtcacacaaatagcagaagaattaattgcgttggaaactttatttttttaatgagagtcaaagcggaaaacaaaagatttttatagtca

SEQ ID NO: 5657 - DNA, 1490 bp, Heterodera glycines
  misc_feature (38)..(38): n is a, c, g, or t
atttcacgaacaaaaacatcccaaatccgctggccatncgtggtgtttgaataaggaatccacaaatgtaaattggtgcctcttttctcaaaaatttggtgatttgaacgaagaaaagcgatgacagagtgatcgatgtaccaaaaaatggaaggaaagcttttattgccataaatctctgattccgaattactcaatctgaagatgcttaaaacggattttgatgggcaacggacgatcgtcgggcaatggaaatggcacaaatttgtcatccatctgtacaaacagcttcggttcaggtcctttgtccttgcgacgaattacgatcattctccaaattgtcaattcgcttttggcatcgaaatgtttgtccaccaacgcattgaaacgtggcgaaagaattgccaatttgaggccgagttgaggatggtcaaaactgggcaaaatgtccatccaaacgtcgttgcaaatccaactgaaattatggaaaacagtttagttaaataaatgatgaatttgtgtgacttttcaaattgcttaccgtcggttcatttttgtggcaattagcacaattttggccgagttccgaatgatgtcaaacaaaagagcagaataataattcgttggaaactttatttttttaatgagagtcaaagcggaaaacaaaagatttttatagtcatgaaaagggaattgtattttttgtatatgaatagagagagccctgatttttttttgatttttcctattttttacggatagtacttgatgaaagaaacacgaaaatcacattttattaaaacaatttttgaagttttttgccttaaatggggttggacaatgtttaaatgggaaacgaaaaatcattgacaaaaacggaagtgaaggaatcattttggcataaaatgacgacggatcggaagaggaagaaaaagggaacgcaacataagaggaccaccaaaaaggagaatattttgcaaaatgatgacatttgccgggcgttttaccttatcctcaacccccaaatcaatcaaataaatcaattcgatggataatttttcatttgtaaaggttaaatccgcccttttcaaattttgaaaattggcaaacgttatgattagggatggtaattattagggatgccacaaatatggatataaaatggcaaaaatctcaaaatatggacataaatttttcaaaattgagttcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaaccattttaaaagaaaaaaacataaaagctaaaatttattaatttttttagcgcaaaatcaacaacaaaagcgaaattttcgcttttttgcttatttttgacataaatttattaatttttaagaaa

SEQ ID NO: 5658 - DNA, 4490 bp, Heterodera glycines
tggaacattgaaattttccaattaattcaaaaattttataaaatattactttaaaactatgaataaatcgcataaaatttccaaaaccttctcggcggtgcatatcgatcgcgccagagcccaaattctaatttggttttatggtctaaaatacccaagataatttttttgtgaaggcgtccatttctttaactctattaataggaaaaaaacagaacaattcgctctatagaacattttttctgtcaacattttttcaaatttttataccgattagaaacgggattgtcaattttgtttgctccaaaactatttgcaaaattgttattttttaattttgggaaaataaataaaaatattagtgtaatggagcgggttcgaagttcgaacctccaccctttttgcccaactgagtttcctaacaggagctcattttccggactctttgtgccagaattataaataagagatgcatttttctctgcactttctatttaatggttcacctctggttttttgggactgtatgggcaaaagcagacatagttttgttgtatttagggttaaatacttaattattcatttattttttaatttttcattaaaatcccaaaagtcggatccccaaatgttgttttgtcgtcaaatgtcgttttgttcccaaatgtcgggtcaaaagcaacaaaaaaaaaatcaaatttcatggattgaaaaataataaaactcatcaattttctttaaataatttgctcaaaattaagttatttttggcaaaacctgttaaaaatgattttgggccgagggaattgattcctgcactaataaatacggaaatatacaaaaagcaaataaaaattccaacttttggatgcaaaagatgagttttttcctactatttagagcatatattttagaaactataatccaataaaaaatacgggattccgggggaagcccttttggttagtcgcacaaaatttataaaacctacagattctaattgggatcgaaccagtaaattattcaaaattcgaaaggataatattttgtacttaaaaacattttgcaatgaatctcattgagaacggataaacttggctttttacaaaatcattaatattaaataataaaaattaaataaaaaaattggaatatatgaaatattatctcttctcactttttaggcataatttatatctcaataataattttagaaacaatttatttaaagagaattttgttattcaaatcaaaagttgccaattgaatctgtaccaaaagggaatttcctctgcgcaaaattttttttttaataattttagacaaaatctctgtaaatgtaaattggttaatttatacacaaaattttgtgaatttgctgccatcttttgacttttaaatgtgtgcccatttcggcaatgttttcttttttgcctccgttttgtccctttcacttccgccgtcgctctttgttcagatcagtgacacgtgctcatcgccgatcgaaaaaatgcgattgccgggaaaaggcagcgaataacgcgagaattgcgggtagaaaagccgacgttcgaccggcccattttggacgagttggcggaagagacggatggactccgtgttggtggacggagttttgtagatgaacgagtcgaacttggcggagggatcggggcccgcaaattggagcagaacggcacggagaagagccgaggcgacggacttaagcaaaacggaggagcgtaaagcgggggcaaagaccgactgacctcactgtttgcatagaacagactgatgccgagccgatcgccgagcaaatgccgcgcttgacataagccgaccacgtcgcccgtctccctgcacacggctaccttaagtcattaaaatagcagcgaatgccaaaaactagtcgctgctgacctttgcggcactttggggaaggcgaagtgcctcccgcaaatacgacgatctgtcaatgcccaccgtctgctgacggtcaaaaagcaacagtttgtcgaacgaagcttcacgccagtccttcagctccacgctcgagtcgtgatccaaccgttcgggtcgcacgtcagcacatttcgcaccgaatgaccacagtcgccagtccaaatagtgatggaatgcgtactcttcctcgtatttgtgccacatttcaggaacttgaaaagaacagggatactgacaaaatcaatcgattggccatcaatcaatcgatcagtcggcaaagcgatcgatgggccatcaatcgattaatcattctacggagcaatcaatcggcaaaaaagcatttgcaaaactgccatatgttttctgacctgcataaccaaatacgggtctgtcccctgcaaattccagcgctctgcgagcgagcgcacggccgagttggtggccatgataggggtccctcacgtagaacatgctccaatgtgccacttgcgggtacagtgccatgctaatgcagcccatcggcactcggttttggtcgaggacaaagaacatgctgaagttgggcccaaatgccttcttccacatgtcgtagtcgtgggcggaattgtcccagccaaatttgtcgacaatctgtcaatttgagggacaattaatttgttaccggcggacaattaaaaattaattaatgcccgtctgatttgagaaatacctcttggacaatgttcaggaaaatttggttttcggcacagttgcgctcaattcgaagtccggccttttcccatttgggcatcggtcgctgtgccatcgccgccgcgtcctcgtcgaattcgtccatcgttttcagcgaaaagggcggcggcggagagtgcgccgcattttgcgttgtcgcagcgatgttggcacagtggcggagaggcgaaaacactgcacggaaagaacaggaaaaaatgagagaagagacaaaaaaagattaataaataaattaattaattggtacttgtacagtttataattaattaattggtacttgtacagtttataattaattaattggtacttgtacagtttataattaattaattggtacttgtacagtttacacccataagcattttttaatgataaaaattattttccgtggtattcggggtcaatcatcacgaaatatgacatccatttcgatcaatttcgaaccccggacccgaattcgaacaaaagtctaaaactcatttttcaccaaaattctattttagtgtccctaaaaacgattcaaatgcatagaatactcatgaataccaataaaatatttttcaataaaattttttagccaaatcaataatattaaatgaaattttggggtcgtttattaggggtgcatttttaaaaaattcccaaaaagttgatcctcgcaaattaggggtgtatttttcgtttttattacatttttgttaataaattttatgcaaaacgccaaaataggttaaaacagggtttttacaaaattttctcgacttttaggctctaaaaataaaatactcaggaaaaaaataggcaaaaaccaaaaatatcatccctcaaacaatgaataataatgaccggaaatcagaagcggcgagaatttgttgaccaaatgttgctgaaaggccattgttaatgccgaaaatgcaaatgcaacaaaaaatatttgtccgatttgatcagaaattttgtttcgatttgatcagaaattttgtctgatttgatcagaagttattgggaaagataatgtttttattggcttacaattcgtcccattttaaatagtcaattaattgagtggggtgagcaaaaaagggcaaatgaactttcgataagtgaagaagcaaaggaagggaaaatggagtgtaaatgttgcactttcgtccacaaaaaaatgagtaggcattatgaaacatttggattttatgtttaataagacaggcggttttcctgttagataaaataggcttgtatttttatgaaatatttggaaacatttggattttatttttgatgaaaataggcgttatgaaacatttggattttatgtttaataagacaggcggctcccggtaaattggacaccagaaaattggacaccagaaaattggacaccgaaaattggacaccaatggaaatttggacaccggaaaattggacactgttgtaaataaaaattaaaataaacaaaatatattaataaacaaaaattttggcttggcctaaaagatctttatcttaatctgcacatatgttgtttataagcgtaaataatatggaaatgaatttgttattatttttgtaacattagcaggagaagaaaaacatcatatcattttcctaaagaaaaaagtttattacccatttttcgtgcattatttgggacattggaacaatcgtcacccattttgtgggtcctttttttggcaaattgatcaaccaccccccatttttggtagattttttggggaattgaccaatccccccccaatttttggtgcatgttttgg

SEQ ID NO: 5659 - DNA, 587 bp, Heterodera glycines
taaatgaaaaaatccgccaaaatgcgtcccctaacattgtattagaaaggaataaaccaacggaacattgttgagggagctgaaattactgttgaagaaaagaaagacggcttttacacttgctccatgtctttggttgtcaatccttgcaaaaattgtttggcacccgccccatggaccaacagcaaacttttgctaaccaaacgcagctgccgttgaggcattagcatctttaatcaaaaagaaattgtttttgttttgaattaaacagcaaaaaataaaattaaataaaacttttaaaaagatttttttttaattttgccaaagtcagttttagcttttaagcatacaaaaatttggtatttcattggcataggtaatatgattttacttacctatgtacatatttaaaaatcattgaaatgtttagaaatgatgaagaaaaagaaagcaaggagaagaataaataacacggaaaaagagagatgggaagagaaacacaaaattatagcccaaagaagggcaaaggcatcgcccgacgtgccatccctcgcttttcatgtgcggctgcttctgctattcctcca

SEQ ID NO: 5660 - DNA, 2185 bp, Heterodera glycines
catttggggaaagtgccaatttcacttttctgtgctcagtggtggcaaaagcattgccagcgcccgtgctcaaatccattatattgtaataaaatatatttaaaaaattaaaaaaacattaaatcgaagcgcggaaatgtattgcgcaatatctgtccaacaccgaccgcgtcgaggaggaggacgagcgggcggtgcttctctgcaatttgttggatttgctgcgcagctcggcggacagcacccagcgattggtggatgactttggcagcgccggtggctttcgctacacagcggaattttgccggaggaggttcggaattgctttttttaaattcaatggcacgattaaaccgagattgttgtccgctttaagcaatgtcaagaatgcggagcaagtgctgtccgcactgaccgggctgatcaccgccggcgaccgaactgttcaattcggcatcccccagcaaagtgccaccgcccatttccatgcccaaaaaatggtgtcgacaattgcgaggagtaccggcacagtccgcagcatggaggcgtacaaagtgttggagcaatgctttacagttggagaatttgaaaaaaaaagattttaattgaaaaattaaaggaaggcgacgacgaactttgtctgttggcattggaaaaagtgggcacaaaaacataaagcatcaatgatcgattaaacatttatattttggcattttggttcagatttcgcaccttttccgtgccgaacgaatgaattattttattgttgacgaatgttcgtctctttttgtgctttgcgaagaaatgctcaccaaaggattcgatgtgcaggtggcaaagtgccgtcttttgctgttcccctaattatttgtttaaaattgtcaggacaaaattctcgaattggtcgagagttgctcccgactgctcaattacgtgccctacaaggagctctcctcgctgaattcacatctcaaaacggcgatggttgtcacaatgacacgcaattttgaggccgccgagcgatttttgtactttttcctcaaaattatttctgtaaatgccacaatgcgcgacgcatttcgcgaactgctcattttggagacatttctgcacattatgcaacagcacagctcgggtaaaagccacttggaagagcacaaaatcctttttctgatcaatttacggacttttatcacggcattgataattattaataaatatcgcacattaaccccaccccattcgttgttctcacgccaatttgattttccgattcaaaatgtgccaatgttttacgtcgttcagaagcaactgttcagccgcatgtccgtcgtgtggttcaactctctttggatttgctgatcaatgcgactaagggaaatgtgttgaacgcccaattcatcaccggttgattaaaaacgaaaatacatttgaaaaagcatttaaatttcgcaacagaaaatgttgacataaaaattgcgaaaacgcttttgctggcccaacagtcggacaacgacgagctgaggacgtccattgccattctgatcaaacagttattgtatttggccaagaacgaacagctgttcagctcgctgctccaattgttgttctccgagccggaaaacatcgaactttgcgcggtcattctgaaggtgcacaatgcaaatgacgttctgtggatgtgtcgaacttgcctttaatcgttctccatgaagtgattggctgtatttcacccctttttttaaatttcaatccaccaaattaattcccccctcaactgacccatcccccccaccttaatttcctgcccgccgagtcgggtgcgcccatttgcgctctggcttatcttcttttgatttttgtttctttttagggcatcactgggccattcattcaatgcgaacgattagacaataatgaaatcttttgggtatggacggcggagaattggaaacagaggacggataatcaaaacattgagcggaggatgaacgtctgtttcatcaaggcaccactctttttgacttgcttttgtgcatcggacgcacgcctttttccgaggggggtggacgtttattggggtacttttttggggttacacctcaatgatgaaaaaaagtttcacgattcaataatttacacgcaaaactcctttatcgctacatacgtttatgctatgataatg

SEQ ID NO: 5661 - DNA, 3116 bp, Heterodera glycines
  misc_feature (3106)..(3106): n is a, c, g, or t
gggaataaatgattgatcagacagaaattagggacggaggggagggaatgatagcactgatcaaagaggcacagagatgcaaagtcaaagtgtatgatcgatcaatggtcaaactcttcacgcgtttaattttttgccccttcaaattcattctcaaaaatccaactgtttgataaggttcgtcccgccattatcaactcggttctgctcaatttcggctgtttcggcaaatgcacaaaagtggactcggaagcacccgtctgggccacagtcactttggccaattgcgggcccaaattggctgccatccaccaatgctttcggatgggcacggatttgtacagagcggacaacaaatggttaaaaatcggacgaattcaaatgaattttgagggaaaccgaaacttaagcaatggcgggcaaaacggcgcattagccgaagtgccaaagggaactttcaacgcacttttcctaatgcgacttctgttcgatttggcgtttgacaactttgacaagtatttatttaatagtctttcgcagtttaaattgttcattaccaaaaaatgaaggctttcaaatgaattgtgctgggcaaatgccgaagaatggcttcagaatgccgagaattttgaaacagtgccggttctgacctggtccaactcgaccgtgttgacccatccgagtgcccttctttccattgtcgatttgctcccggccatttgctttccgtccaatttgcaaccagcaggggacaatgagaaacacagggattataccgtagagggggagctgtcattagcggtgcgtacggtggcacaattagacgaatggtgcgcactggcccaactttacatcgcattggtcctaaaagtatttattttgcttttttgaccaaattcatctgggattcgctttatgctgttcttcgctctgaacgcaatcagcagacgatgtgccaattcgacttgcccgccaaacttttggcggtaggcgaaaatctgttcaaaacggaacggcacccgctgctttcgtcgttccattatttgttcgaaagactcgcttatcagtcacttcgaccatcggaactcaggcaagaaaaaaaccaaagagtgatcaaaaaggcaaaaacaaacagcaaacagttaagacgatttcttcggctggacatgccactttgctgcacaaatttagacgacgaaaacgaaaagggacggagcgacgcggcgatgaagccgggaggaccaattccgacccatcggttagcttaaccggcgaatcattgaaatttgattgactttttaattatttattgcacttaattgtcgatcgtttttgggtactgtactgtaaccttccaagggttattggtttcgcattggtcaccccttccctcccccatcccctcccctaaaggatcaaagcgttcgtgtcgatgctcaccccgcgtaaccattcgcttctgctggcgccgtccttcgtggaattcgatttggccatcgaagggttcgccgctttggtcattccctcaattgtgcgcagtgttcaacaactctcgcagctgccgccttcgctcggcagcgccggaggagcggcgactctgccggcgacgggcgccggcgattcgtcggacggcggcggcgcgaattttccatcgtccgccggattcactttggcaatgtccgcaatttttggggacaaagtatggaaaattggccgttcaggtggataaacattgtcgatttcgtggacaaaaaagagccgaccgtcgccccttcacaattcgccggcactttgccctccccgtcggcccaacccaccacaatttgcttgttcagcatcgttagggtgtttgacggcagcccatcaacaacaatgcttccggacgagaacacttcgaactcatctcgagactctcggccggtcaatcccgcgtattatggccatcaactggcggcaaacattgagaaccaccagaactgtctgcaagtgctgcttcagcgagtggacagctgcggttggtcgctggtggtcagtggggcggagcattccgtggcggacgaactgcgcaaggacttcagccgaggggcggagcagtgtctgcaagtgccgttgtccgagcagtacttcccacccaaacagtgggctcatttggccatcggttggtccgttcattcgccattcattcattaatttatcaatttctgcagtggtcagtcggccctctctgctgctcaagtccagcaatgtgtacaactgcgaagtgttcgtcaacggacactctttggccagtcaaaagttgcaactttggtggcattctgccgacagcggtggtcagcagcccgggctcaacgcgtacatcggcacattgccattctttcgccggggaagcatccaattgcgctggcgattagcctcgctgtgtttggtggaggaggcactcggggcagatgttttgcgcaaaatggtcgcacttggagtcgcctacacgggcaattaccaggtgccgtgccttttcggcactttccgccacctttgctctttttcagactgatgcttttccctcccccgcggcatcgtcccgttctgcgctaatctctgaagagagggtgctgctctcgctaaatgcttctgcgagtgcggagaccaccgctctttcgctgcgttcgatgtttccgtgccggacggacgccgaaatgattgctgcgctggtcggcatttcgccaaatgatcaaagcactccgttgtgtatcctctggaacatcacttcctgcccaaccccgtgccgtgcgcttccgctcggtgccgttctgatcggttacctcggtatccgtaccttctgcccgtgtccggtcagttcgctgctcgattctgtcggcggaatagctccgctgctcggcaccgttgtgatgagcagcgacttcagcggactatatgcctcgctgaaagtgttggtgtgtgccgtgcgcacaaatcgctcaattttcgccgaaatgcaacgcatgcgtggctttcaggtggacaaatgccatgccaaaaccaagcacggcaacgtctcacccattcatttcttcgcacagagtctcgcggttctgttggaggacaaaantatgcctgat

SEQ ID NO: 5662 - DNA, 2713 bp, Heterodera glycines
  misc_feature (5)..(5): n is a, c, g, or t
  misc_feature (2631)..(2631): n is a, c, g, or t
atatnaaggcctcacctcgaatacgcaagcgaagtttgaaatatctcctcaaaagaacagagtaaaagaatggaaacggttcaaaaatttttcacaagaatcgtatacaaaaaatgtggcctcaaggcaataccatatgaaaaaagacttgagatttgcaaattggagaaattaagtactcgaaggtcgctcactgatatgaatatgactttcaaaataattagaggcttaactcatttagacccaaaaaaatatttcgaattttcaacaagatcgcaacgaaaaacatttaggattcaaaataaaagattcagtaataaatctcggaataacttttttattcgtacaattaatccatggaattgctctttgaccgaaggggcaccaaattgacattgcaagtgtccactgaaacagcgatttgggatgtctttgtcaggcagacttggcccatttttgcgccaaacattcgccatttggcattctatgtgcctgcaaatttgaataatttgcgcaatttcgtttcgcctacaattctcactgatctcccgcagctgaactcgatcagttccttcgtctgttccccgctccaattgcttttgatggtaggaatgcaactgctggcgaggctttatccaaatggttgcacacgccgaccaccgatggacagccgaagcatttgcgttgccgattttcaagcacttatgcatcaaagggcaaagaattggtcaacaagttcaaggaggtcgtcaaatcatttttaatttcgggggaggaaggggaaggagttcgaccgcgattttcgacatttttttccgcgtttcacgaccgcggcaatttgaatccgcaaacgcgggattcatcgatattttaatttcaaatttttatatgtattaggcattccatcgtgcctccaccaccacttcggcctgctacaatattgaaattttgttggacgcggcctcgtcaatggaccaatttgaattggtgaacgaaacgacccaagaaaagttgacattgcaaaaagaagtcggttgtggaaagaacaaatgtaaagaatgtgagaaaatgaatggttggctgttgaagaagcgatgtttatcgtcgaatgttgttgtttttggggaggcggttcagcaccagcagcagcggaaccacaacattttgaacaattcacaaaatgtccgaattgaattgcgtggtccaatttgcattgggtgggtgagcagcagacgacctttttttggtgtcatagcaactcgtacaaaatgcaacagctcatacaatttcttaggctatgcctaggcttaggcctaagctataggctagtccttaactttggcctgctctggcctaggttaggctttattttcctaatacatatttgttgattttcgtacgagttgccattgactccttttttattaattaaatttattggtaattgtttagcggtggggtgaatcaaaatcttcacccaaaaatgcgagattcgaaaattttaattttgagtttttgctcaaatccgggttcgggattcgacgtggctcaaaattaatatcagattcgggttctccgctctttaatttttattcaaaaatttatttaactaattattcttcgaattcaaattttaggccattgtctccgcccgccgaccaaaacaacgaaaaaggcgccaatttgtgaacgtatggccattgagaaaagaagaaaggaccgaccatttgattacctctgctggacttgatttgatgatattttctctttgaatgtgcttactttttcttttgtttaatggattttcattcaaaatcaaaattagatttttcgcggctaaatgttgatatttaataaaatcaacaaacattatgccatcaaaacaaataccaacgcaaatttttaaaatttatttaagtggcttataattttatgtagagcgataacgcaaaaatgagttctgctatctctatccccattttatttttgcgccaaaagtcatttgaaaaaaattgctttaaaatttcaaaaattatcgaaattttaaaaatgatgttgagcctttctctaccctcgagcccattggcaacaatttaaggcgaacagatttgaaaattgttttgatagaaaatgcgattctcgtgtttttctcatcaagtattatccgtaaaaaataggaaaatcctaaaaatccaggctttatccaacgcattaattcttctgctatatattgtgtgacatcattcgaatttggccaaattgtgcttatttctgccaaaaaatgaacaggcggtaaggcattttttaaaagccacaaattcctcacttatttagcctaattgtttcccatttcagttggatttgcaacgacgtttggatggacattttcccatcctttgaccatgctcaactcggcctcaaattggcacttctttcgccacgtttcgatgcgttggtggacaaacatttcaatggcaaaagcgaattgacaatttggagaccaatcgaaattcgtcgcaaggacaaaggaccagaaccgaagctgtctgtacaaatggatgacgaatttgtgccatttccattgcccgaccgtccgttgcccagcaaaatccgttttaagaatcttcgganttagtaattgaaaatcagagctatggcaataaaagcatttatttcatttttcagtacatcgatcactccgtcatcgcttttc

SEQ ID NO: 5663 - DNA, 3131 bp, Heterodera glycines
  misc_feature (47)..(48): n is a, c, g, or t
aattcatttttatgttcatgtgcgtcaaatgcaaattgtgccattgnnaatggtgacgaaatgacaaaaggaaaagctgacattgccaaaacaaagggatgggacaaccgatggataatgaaacgatgcaaaattattggggagaccgcgacggttcagcagcaaaagaaaaatgaaaatttggacaacagttgtaacaatgtgtccatttggctttataatagcgccaataattgcattgggtgagcaattaaaaaaaagtgtttagataattcaaattgcgcttaattaaggccattgtctccgccaccggcagaagaagcggcacaaaacatcacaaaggggccgtcttctgacaatgaatgagtggtgggcccagcaaaaacagtggtcaacagaagaagaaatgattaattaagaatgatcgatcgatcataattcaaatcagtgatcaaatgaaattttatgaagaaaaacctctcaattttgtaaataaatcggacgtataaaaatggcaaaaaagttgactctattgcggttcacacgaccataagcttttttttgcaactttgatgcaccatagctttttcttattaaaaaattcttacacggaaatgaactaaaagtcatcactgcttcagtaaaatggtaatttgaaccatttttagactaacaagtgattccaaaaaattgaattttcgactttttgttcgaattcgggtccggggttcggaatagggcgaaatggatactggattcctgaacagcgacctcgaaaaccacaggaaacctgttttcatgtcttttgaaaacaaaaaatatttttttcaaaaaagggggggcaccagctttactattaccgaaaaacattttccttcgctaattttagagacaggcactatacatttttgattcagtctttttcgattaactgatcaaaaatagaaaaatttttgtatttcgaatttttaatataaatttcagaaattctttaacaaaagcaacaattttttttattgacgcgtgacatttttgggacaccttcaaaatttcaaagtttcgttaaataaattctgttgaaaaataatttctccgtctccattttttcgagttttgaaccggttcaaaaaccgttttttggcatttccgcaactcgagacatatttttccacggtagggggggggtcagttgcatcttgggccagttgcgtctcaaacattttttatagagtaaaatggattaattaagttttctgtatgctatattttcattttcacagatacattgacaagaaatattcaaaaatttatagaaaaaataaaaagttttaacaaaattaacaaagtttcatttacccatttggtaattgctcgaaattcccctgagcatttcaataatcaaatttcggttattttggttttggccatattggtgatcatcgtcgatttgcggctgcgttttttcctcattgtagcgctccagaatcctcaaaattcgtctgtccacttcacggtaacgctttgctttcagcggcggagcatttccggcgaggaaatgttcgaagtccacgtcgattattttctgatgctcgcgcaaattgttgatgaatttccagatcggtggggtgtccttgtccgatcgaaagttgaagcgtgcaatggtatgcttcggcgaagttatttgtgcggtcggtgccgttcattgtgcgctcatgcacacttcattcttcgggacgaaacaatggaggactgaagcgttagcggcactggcggcagcaattcgatttcatggcggactcgcttcactagcttaaccaaaaatgtgaacgtaaaaaaatgattagattttcacttttttgtggcattctttgttggaatgttcgccattactggcgtggcaatttgctgatgtgtgtgcgccctggttgccgctggtggttccatcgtctcagcggcacgccgctttatgccagtgacgattttttgtgtgatgacatttgccgcactgtggttgcaattgtggtcgccaattgtcttcagaacgacatcattgagcgctgtgtgaaggcgtcccctgcacttgaattcatcacgctgatgttcacagcgccaaaattttacgtcacggtcagcattgaacatatggaagacatagaggcatccttcatgttcgagttttttgttgttttgtttcgttataatttgattgttttccatttttggggctaaattaaaagattaaaacaaataatatataaaactacgtttacaccagggctggagcgcgcacagaaaaaaccgcggccgcgcaccgcgcattcaaattgccgcgaccgcggatcgcgcaaaaaaaaacgccgcggatcgcgcatcgcggtcgcgctccagccctgatctgaagggctttcgaatgatataacaattgttagatttggttgacaaagaaaaaaaaaagttatagtccaaaaacatggctggggccgaaccgtgcggggccgaactgacgtagaccgataatttctgtaaaaatttttataaaatgattagtgtgcaaattgctgagtttattgattgttcgacgagttataccttaaatggctttggcaattgccaagatcatttggtcccacaaaaaagagggaaaccccaaaaataaagcaattttaagggtaatttgagacgctgactgagtacgaatttgatctttttgcgcagtttcgaacccctaacccgaattcgaacgttttttgaaaaattattttttatttcgtacaaattttaatgggaatggagaaacaaaagaagaggaggaaaataacatttgggaaggaggagagacggaggagaaagagaggaaaaggaaaaattcgacgcaaaaatgaggaggagaaaagagagaggaacagcagcaaatcgacactttaatgttgccggtgctaatattgctaatggatgtcgtaaatcccccgtcaaaatcccgaaaaataattgtcacaacttttcaaggaaaaattcatacatcgatagatagcaaaaattttggcgctagttacaagaaggacgtttttgaaatttttttccctttttgaaagagaaattttgttttatttactcataatatgaaccattaa

SEQ ID NO: 5664 - DNA, 1091 bp, Heterodera glycines
tttttatttgtgtttttctttagaccattcctgtgaccaaggccaaacctccgacggtgtccgagtcgagcagttcgggagacgacgacgaagtgccggccaaaaaaccggcccagaaggcacagccggccaaagtgcctccgaaggcaccgaattttcttttaaattttttttatttgtgtttttctttagaccattcctgtgaccaaggccaaacctccgacggtgtccgagtcgagcagttcgggagacgacgacgaagtgccggccaaaaaaccggcccagaaggcacagccggccaaagtgcctccgaaggcaccgatttttcttttttttttttaattttttaatttgtgtttttatttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttaatttgtgtttttctttagaccattcctgtgaccaagggcaaacctccgacggtgtccgagtcgagcagttcgggagacgacgacgaagtgccggccaaaaaaccggcccagaaggcacagccggccaaagtgactccgaaggcaccgatttttcttttttttaatttgtgtttttctttagaccattcctgtgaccaagggcaaacctccgacggtgtccgagtcgagcagttcgggagacgacgacgaagtgccggccaaaaaaccggcccagaaggcacagccggccaaagtgcctccgaaggcaccgaattttcttttaaatttttttaatttgtgtttttctttagaccattcctgtgaccaaggccaaaccaccggtggagtccgagtcgagcagttcgggagacgacgacgaagtgccggccaaaaaaccggcgcccaaagcacagccggccaaagtgcctccgaaggcaccgaattttcttttaaatttttttatttgtgtttttctttagaccattcctgtgaccaaggccaaacctccgacggagtccgagtcgagcagttcgggagacg

SEQ ID NO: 5665 - DNA, 1848 bp, Heterodera glycines
aaaaaccggcccgaaggacagccggccaaagtgtttccgaaggcaccgatttttcttttttttttttaattttttaatttgtgtttttatttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttaatttgtgtttttctttagaccattcctgtgaccaaggccaaaccaccggcggagtccgagtcgagcagttcgggagacgacgacgaagtgccggccaaaaaaccggcccagaaggcacagccggccaaagtgcctccgaaggcaccgaattttcttttaaatttttttaatttgtgtttttctttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttctttttttttaatttttaatttgtgtttttatttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttaatttgtgtttttctttagaccattcctgtgaccaaggccatacctccgacggagtccgagtcgagctgttcgggagacgacgatgaagtgccggccaaaaaaccggcccagaaggcacagccggccaaagcgtccgctaatgtacggacatgctatcgttaattattacctatttgctgtttaaatttaagcccgtttcgattcaaaatggcaaggcaaatcccgtgaatggaaatgaaacggagtcaaacagttcggatggagcgcctccggctaaggcgcctcgaatggtccttcataattattattattattattattcgtaaaataggattatgtttttcaaggatctcgattcatggggtaaaaaggccgctgccgattttaatggggtcaagggaaagcgttttcgccacgagaaaacgaagaagaaacgtggcagttacaatggtgggaaaatcaacacttcggctaattcgatgaaatttgatcactgatttggaaaatctttcggtgtttgttgctattttttgtttgttggttgattatttgttttgttgattttggtacatttgatttgttgttcattaaattgtgtaccaaaaattacccgaaaaaagcaaggaacatggttaaaagtcactcatttgatgtggttgtctctgtttaatttttctgtttttttgtgctgcgcttaccactccaaaaagtgctgcgtggaatgcccgcaggccgatttcctggccatgggcacgaaattcgaccagttcaggggacaggcagaggtggcgcaacgcgagcagaggcaaatggacggcgatgagcagaaacaacgagcgaaaaaggatgagcaaaaggaactgacaaaatgggaaaagtgccattaaaatgtgggaggggggagagcggagtttggcaccaaagagatgatttttacgactatataatcatatggaatggtgcctggcagggatggcattccgagttccaaaaattttacggaaatcggaattccgtgtcatccctggtgcctgcccattcaacaaaattccgaacaaaaaattaaaaacaaaaaaaataaattaaataattgtccgatttaaaat

SEQ ID NO: 5666 - DNA, 1624 bp, Heterodera glycines
tggactgtgtgattgggacagagacatatataattgagtttcatgtaaaagacaaaatattttatatttaaacaatacttaaggtgagatcatttcacgggtgttcagagatgttttgtactttggacgatagctccaaaggaaaggacaattgaagagaataaatgtagatccgaaattcgcatggaaattttgagggaaaagtgcaaaaatatttcaatcggtgaagttagggtagaataaaacatgtagaaatatatattaataggtagtattaggagtgtgatatcagagcggaattgaagaagaatgaggagatgaaaaagttctttgtaattgtcctggacaagggaccaatcaatccggggggtatattaaagaaatatgttaaattttaaaattccatttgacattaactgacctttgccgattggcaattgttgtcggaccatttgaaacggcctttttggatcacttggagggacagaacgacaaaagcggtgacgagcagtgcaccaataactgaagaagagatggtggcatcaattattaaattaatattggccaactcggcaaaggcgaaagtttacgggtcaacaaataaaagtcgtaaaattcacgaccgaatgtctgcaaataaatcaaaggcacattaaattcatttaaataattttaaattgaaattaaaaaatatattttataattttatattttctgtacttccggcatttcgcaaaatgaggagatttggacggttgaattatctgcttgactaatcggatgaagccatgccgggaaaaaggtggctgaagcgagcagcaaaagtatgacgaaaacgcccgggtggaaataatattccgaaaacttaaataaattaatttaaaatatttttaattcaatttttaacacaatttatattcacctctttgtgccgttttgtccacactaccgaaataaattggtcaaaacaaagcaaaatgagcagaatcaattgagccgaatcagtgtaaatcttttccaaatggaaatatttgaatagtaaatgagattctcacggcttaatggccccctaatggaaccaatttcacaatgacaaacaaacggagtcattaatcactgggccaatccgctcacccaaatgtgcaaatggagtgccgtgaaaaggcaatggacgggcggcatatgctgagcatcctgttcattaccgtatttgaccgacagatggataccgtagaagccggcgaagaacagcgaaagaccgagcaaaaggtctgaggaaaaacggagcgggagagaacagtgggagaagtttggtacgaagaaagataaccgaagatattgataaattcgaatgttggaatcggcaccgggaatcaatcccgacaaatgccgacccgaatgggtcccaatcccgtccaagtctctcgtttcggaaaaacatttgttgatgattaacatggaaaactgctgattttgagtcacactttttctttcccgctttgccccatttttcacgctaattcgtaagcctaaccacgggaagggattaatttggcctaatctccgcccggggaagcggaaggggtgatctcggtcggattaacgagggacaaaatcccgaaaa

SEQ ID NO: 5667 - DNA, 2839 bp, Heterodera glycines
aaggggggcatcggtcgacgatcggatgggccaaatttggccaagaattttcggaaattcactcgggtattttgctctgacgatgaacaataattgaaaacagttaatcgaatcggtccaatgtaaagttgtgggacggatggcccaagggcgctccacattttccttcctttccaatttaattaatgagattgcactaaagcattaggggagatttgcgcaccgacgcctcttcgccctccagggtggcaattgcgccgctccttttcaaacgccgacacaccccctcacaatgccaatgtcgccaaggtaagaaagagtgaatgccaattgggattggatggaagtggggcatcatcaaaaaagaaactttgagccttttaaaacacatttttttggatgaattgaaatttcataataaatgaagcggattaagtagtgacatcacttacgcatttttttgtatttgaaaacaaagaaaaacgacaacaacaaagacgaaactcatataaataaggaaaagtcaacggagaaaaaaacaaaacaaaaatttgaaattataagtcaaattgtctggctaaacaacggcgcaaagtgattgcctatgccaaagttgcggacgacgattatttaacgccacgaccattcttcgccccggacgactcatttgcggacgaaatttgtttgtaaatggccatggcctgaacagaagaaaaaaatggatgtaatgaagttcgttatatggttgagcaaaagaaacaaagaaatggcaaatgtatttaaatacaaaaaacctcttaatttgggtccaaaaataatgacataaatggaccgaataatgagtaaatagcacccgacctgagagacgaaagagcccactgagcccatgtcagtcgggagcagcacagtgttgttctccttggccagctcgccaaacgctttcacatacttttcagccaccagcaaagaagcggcatccgatccaccagcctaaactggggagaaaaggtaaaaaagcttcatagtcattcccaagtgactgaatagagctcaaaacgagcatttcgtcccgttttacgagtactagtatttcgacaagtccatcaatcgccaaggtgcaaaatgtcggattacgtaatgcgccatgctaactgattgagtgtttggttcggaccttgttcaacgcctcggccaccgcgtgtagtgccttttgacgtgcctcggcctcccgaaaaatcgcctccgcctgtcccttggccaaattgatgcgctcctgttgttccgcttcggaggctaaacggacgagcggaacagatttaatctactatttttgcatgaattaaaaccgagaattttcgcccttttctcgccctccgccacattaatcgccgcgtctcttttgccctccgactccaaaattgcggcccgttttttgcgttccgcctcaacttgcatctgaaagaagttcgctagtttggctaaaattgtttatttacttaatttaattagataattgcaaaaatagtcaacatgattacctgcatggcctcctgcaccttcgccggcatattcatattgcgaatttcgtagcgcaagcaaaccatgccccagggctcagccgctttgttaatggattctgagaaagaaaaaagaatcacgaaataaccaaaagctaatcagcattctacggataagctgtatgaatataggctttacggaaatgggatgcattttactcaccccttttcagaaaaaagtataagcattgaaattttttaatttttgggggaacgatacggggaaaaagggcggtggaggggggcgggccgcaccctctgcaataagatttaaaaaaatcaaataaaaaagttaaaaatattatattttttgacggaacgtaaaaatacagaggaaatattggacaacccaacagtccattgacctttttgaaggtttacgggatggtattttccgaaaataaaaactcttgtgtaattcccgtaaagctacaaaaattccacaacaactaaaccgaaactctgacccacaattgccacgttcagctgctcgcgctccttgaacaccgtgtccagtgcgattttgcccacctccgatcgcatcgtcgtctgtgccaactgaacaaccgcgtagcccgggtcttcaacgccgtaagatgcctaaacgagtcggaacggaagtgaaaccaaggacaaccatgcgtgtttgccttgtaagggtccacaattttcacataaagcactccgtccaggttcagctgcacattgtccaacgtgatggcactttgctgcggaatttcgatggcacattccttcagcgaatgccaatagggtatccggtcgatgaagggcaccaaaacatgaaggccctaaaccgattttcgacatagtataccaattaacaagacacaaataacaccaatttcaaaaaattttctcgctttaacaataatttgtttacattcgattgggtttttttctgacttaccgggcccaatgtcttggcgtaacggccaaaccgttcgacgatccacgcctcctgctggggcacgattcgaatgattgtgttcgcttttccctgcggcgcaaaatcgggcaaaatgtcggagttgtaattgcgggacgaagtgtgaaaaagggagcagggcaaagaagaaagatgcctttaaaatcaaatggaaaaatcagccaaaaaagacaagaatggccaaccatttgtctcgggtcaaaagcttccaaccaatcgccatgcctctgtttgttgtcatatacatggagactaagaaagtcaatagaaatattgaaaaaatataattataaaa

SEQ ID NO: 5668 - DNA, 3909 bp, Heterodera glycines
atatatttactaaatttctaaatattaaaagaaagtgcctcccggttattaattaaaattccaataatacaaaatgaattttaaaaattaaataaaagctaaatataaaatgaaaaaaaaacagaaacctaattgaaaaagaatgaaaaattctaaaaattattaaaaataaattgaaaataaaagtgcccagtgagcgaatgacacgaatgacacacgatagcagtagtaaagaacaagatacacgagagaatattattaaaataacattacatttaatcaaaatataaatttaaaataccaaatttaaacaaatattttttattattatctaaataatttaaaagtcaaagctcataaaaaaatttagattataataacaagaagctcgttttgatgggacaaattttggcaaatgtttatataaattcttaacaaaaattttgaaaatctgtttaaaagtcggaagatttactagaagcttttgaattttacttgatatttttgtacatttttgaaaagtaaaatcctattaccactgaaattaaaggtcaaagaatgtttgagagcaatataataggaaaatattaagcaacaataataatacaaaatttaattattttcccactatttaaattaaattattggcgttttgcccaaaatttattaacaaaaatgcattaatgataaaaatttaataaaaaaaattcataataatttggtttatgacacgaagaaaattacatttaattaatgtaacaaaatctcgaatgacgattttcaaatttttaaacattcatatatttataacaatatttaaaagaataagaagctaaatcagaaaatgcaaaacgcactatttaataaattataaaaatatattttaattcaaaaatacaaaaatgagaaaaaaaacaccatttaatgaagctgatacaatcaattttcctatataataaagctgagtgtgtgtatgtatgtgtccgtgtttgaatttgtgtggcgttttgttaattttaattaattataattagtgatacgatttttaggtttttacctattttcctgagctccccgtggtaaaaattttaaaaacttattttcacctattttggcgttttgcccaaaatttgttaacaaaaatgctatctcattaatgatttggcataatatttttgctttttgagaaaattttcgattttacaccccaaattcggaactttttggcttctattttcccatttttagcacctattttgggggttttttagaacctaaaacctacttattttggcagtttttagcacctaaaaatcgaagccctaataataatagaatacatttttgatcgaataaaatgtaaaaatatttgaagcaattttgcaaaatgttcttatttttgaccctaaaatcttatttttttagcctttattcttattttgaaaattttgaaatagaaaccctggatttagacaaaaacacccataaaaattgactattctggcataatttataatccttaaatttggtcatttttagacaatatctgtgcaattataccaaaaaagaattgaatcgaggcgatacatcgaataaaggaatgtggagccaaacacatcattcaaaaaaaaaataattttttgtgagattttttggagctaattaaaaacaaacccccgcccccgttcccgggggcgagaaatttctcaccccgcccccgcgactctgaccggcgccgtatgcattctgctgcgaacacaatgcataagtgtcgagagagccgccaccgcccgtgaagaagcaagttcccctctctgagtggctgttcaaagggtcggcttcggccacctcgaagtacatcatgccgccagcgcttccgcttcttgccaagccgacagaaacgccaaccatttttgcacagactacagtttttttataaaattcaattttcattttaaaaattttgttttataaaattgccagaaaaaattatgaattttttcttaaattttgtcttcttatctagatttacttgtaatcatgataagcatccaaccgcttaaattcccctgtgtatattgcaatttttgcctgaaattttcgtaaattttttgatagggaaacggccatagggaaatggcctatagggaaacggccacagggaaatggccatagggaaacggccacagggaaatggctcgatccccttctaaaggggcggaagcaacttgatacaattttaaattgttcatatgatgtaatcccaacttgccgtctctctgtggttggcagaaatcactagccgtagttggtttgctgggggtgcacttcatttcccctgtcgaaccacccctccacattaaaaagcaattcttgacaaaaaaaattttgaaaaaataccataaaatttcaaataacgctagaaagcttcaaaacaatttgtttagcggcggaaccgatgtacgacaagcttgaccaaatttgtcgctgacacggaaagcaacgctgcaggccatttatccagggaggggagtggggcacgtgcaaactccccccgaaaattaaaattttcacgaacaaaagtcggtttctcttaattacaatataattattttctttttcaagggtgaggggacggtcacttcataccacgcttctttaattttgatcacaaaatcaaaatgttataacgtttggcgccaaaatggccggcgaaaatgtgggcgggccctaggagaatgatacgtaaagacaagcgagggtcgggagaagggggaggaggttgtattcccttccaccctgaaataaaatttaaattttctgccgacgggattgttgccgattagtctggtgccgggcttttattttgacaaaatcccgagcaaccgggagtcccgccttggtcgattttcaggtcccgaaataaaaagagagtgcagagaaaatacatctctcattttgggagtcgcgcccaagttgactttcaggccatgacatttcaaaatttccgggctctaattcccgaaaaagtttctaatattttagtgctctaagcaacacaaaaagacaaaattttcaacaagagtcttttaaattaggggtattttagtctcgtcttggagggggggggggggggggggggggggggagtactccgccttttcacctcaaactttgcctgcggaaactttgccggggcataaactcgccgacaaaattaaacaaaaatcattttatttgattttgaaaatcagatttaaaaaaaaattattaatatgatcgaatgttgtaccctttttgtaaatcattgtttttgcaaatctgatatcattttgtgatcagaagccccaaaaaccccgggttagtcttcataacaaaaaaaattttgggtggaatccagattctccagtattacgtatcttatatttcatttaaattggttattcaacttacattttcatgcattttttccccagcgcttcgtcgacgaaaaaattgaaatcggtgaatttacgttcacgtaatagtcaaaacggtggctgatcagtgcaattccgaggccaagttgtaaaggctcaagcaaatcgaaaacaccgagccaacaatcggcagagatgaagctgaaaacggaaaagcaaaatgataagccatgggcatccaacttagaatattacatcgctttttccatttcactctcagcttctttcgggttgtgcgacattttttttgcaggtaatcaaactaattttaaataggtaggtgaatgaaacgaattccttttaatttaatggtaattttaaattgaatcattaaaaaaagtgcggaaaaatgcgctaatgaattcgtggtaaaaatggaaatttttttaatgaaaattcgaatgaatttaagtatccaatgactggtgac

SEQ ID NO: 5669 - DNA, 3026 bp, Heterodera glycines
ggacctgatttttaaggaattcattttaaaaaccaaacgaatttttaaaaatcttattttattacattaacaaaaaattgtattgagtaaaattagttaagccattgttttttgaaatatcggaattgcacatggattttcggtaaaaaatgtattgaaaggatattcagagatttatcccggactgatagaaaagtccccaagtttgaactccccctgctggaggaatgttagtatcctcaggcttttttcggcctcctatttagctcctgttgtttacgaatttaaaagtttacatcgactaaattaaatttttggcgtgaatttgaaaaaaaaatgccattttgcgctcaagccgactccaactgaatgcaagcgccacatggcatcattgccttgccggacttgtgccggacatgcccaaccctcgacctaggccgatcggctggcacaccctttacaatgcgaatgggggcgcgaaacagcgccggcgagcagacaacgaaactgcgttgtcagccattatatatgctgaaaatttgttgttcttttttccgttggggtgtaaaagacgcgaggaatgggtggcagagggacccaagtcatgcactatttctccactgcgctgttttctttggttctggtcggttttatgcgtcccatgaatgttcatcctcagcttcgtaggccataacttttttctaacttagtcaaatcttacattattggtatcaactataagaaaataaataattaagacattaagaaagaattacggtaatagttacggtggttgcccccctttttcgaagagttttttttttgttttctgaagtcataaaaacatgcttccaatggttttcggggtcgctgatcacgaatcttgcatccagttcgaccaattccgacagctctacgtatcctctattatttatgtaatttctaaaaaattagtaaaaatttactaaaagttgtaactaaaaaagcgggaaaaatttagactcaacaattttgaccctaacttttttgaaattcaatataattttttgaaatttaactgaataatagagaaatctttgggctatcttttcatatcaattgcgggtgtaaattaattgatgtttgaacaattttcatacatttaaatttgaggatttccttgaattagaaattaatttaggcccgatactgtcccatgctttttatggtcaattaattaatgaattagtcccttgctcaattaattaacggtgggggtcgattgggcgccgaccagttgggcgccaccctgctttttgaggcacaactcctttcatagttgaccgaactgaatgtatttaatatcattcaataggtctaaatgttctctattagcatgctaaattccgaaaattttggtcaagtttcaaaaaagttatgcacaaaaatattcggaaaaccgcttttttgaagttttttgtccataatatttttgaaacttgacgaaaattttcgaatagagaacatttaggcctattgaatgatattaattaaaggctcgcggtcttttggacagtggacatttggacagtggacattacgacagtggacatttggacagtggacatttggacagtgaagtcatttggacagaagtggacatttggacagtggacattacgacagtgaatgcaaattttttactgataacaaacttttgcaaacatatgctaattccaataactgaccattaataatttcccaccgatttttttggttcttgataagaatatttgcaaaacatcgcttatattctctcccgttaatgcctatgtgttttttgacggatagtttcaccaagaaagaaacgtttttcataattgtcagggtcgggattttgctcttgagcctgaatattttgctggggttcgtggatttccccctcttcagaagatgaggaggaatgcattttggtaagaatgaatgacccataggcattacgggagagaatctttgggctatcttttcatatcaattgcgggtgtaaattaattgatgtttgaacaattttcatacatttaaattaccttagattttttggtgaccataaaaatattacactattaatttcttcataacttttttcagaaagaaccaaatttaatcttgtttatataactagatagcccaaagatttctctattattagctaaatttcaaaaaaatttttattgaatttcaaaaaagttaggatcaaaattgtttagtctaaattttttgagcttttttagttacaacttttgtaaatttttactaattttataaaaaattaaataagttattaaaattaaaataacttaattaaattcatttgtcacttcggctcaccacgatttgaatacacggaaacgaactgaaagtcagcactagtgctaattttgcacatatatgctgaaatttttgctaacttggggcgtgataataagcattaaaaacttctttctaatttgctttgagacttctaattccatttttttcatgctgattttaatgttttctagattttttaatgtttgtgctgatttggcattttggtgcttttttgtgctattttatcattttgaagaattttctaaaattttttcagcaattttcaaaaaatttattaacaaaatgcaataaaaatgatgtaaaatacacccctaagaagcgatccgaaaaatttcagaaaatacaccgttaagaaatggaaaattttatcaaaaattcatctccgaaatttatgtaatttatttttttgtcaagaattttgatttttaaaatcatatatctcacattcccattttgcacctattttggtgggttttttattatcagggagcaaacaaacgttttttgacgacttttttcaattttttgtgtttttaatcccttaattttatgcttttttccaattttttgtgcttttttatgcttattttgtgaaaatttggtgctgtttacattgattaatcggtgattttttgtgttgaaaactgagcattcta

SEQ ID NO: 5670 - DNA, 6975 bp, Heterodera glycines
aacaattgcattaaacgagtgtccatgtacaaatttcctttgactttgaagaggaaagtgtaactgtaaatggcaaccaatgtgtttcttgtgattggggtataagttcaccttttcccgtccgatccaatcaaagataatttcttgggtcgtgttttggtaggtagcacaaaagcaattttgtccattttgtgtacggtgactgcttgattaaaactgcacaactcttgaccaggaacaggaacagatgttgcggagaggtcgccaagatgagttgaaattttggaaaggttcaaacacagcgaagtccttttcaatgcttgcttatttaacatggaaatcagctgaaaagagtaattagaatgctttaaaaatagaaacacctttctgaaaggttcccaagctttgcgtggatcgttgagaatgttctgttccataatgacaagcgaagattgaatttgctcaccaaataaaagcttaaattgccgttcgttttcactctccccactctctttgcaagtcatttcttccaaatatttcaacgatttaaggaccttagcaaaaatgttcattttgcattgaagtgacccactgatgcacctgctccatgtattcccgtaaacgtccatcagttggcggagatgatcgtccatttggcaaatccggcaaaaccgaagcatcacttaagcccattgatgaacgaatcagacgcccaattcgatggtcaaattgggtcagtgtgtaaagccatttctcctcattaagctgagcaatgcgttggagcgaacggctgaattttaattggtaaaagcgaatgatcctactatagagaccagaattcggtggtatctcgaacgagggcagggaatttggcagcaagagaatcgattagacattcgcacgcattcgaagaaaccgaaaatcaaatattttaaataaacaatctatggatgtattgaaattacaattaatctttcgctgttttcttttgagaactccgatagcaatggcattgtgttggctaaacagcaaaataaatttaccgaatttttatgtgtttattttccacctttttcatccgctgccccagcaatgacaatggccgggtagcaaacgacgtgaggcaaattttgaccaatttgctccaaaagcatgtgaatggcatcgaccacaatggaatttgaatggttgagacaggcaaaaagttgtgggatcattcctagacatttaatttgaagagaaaagaattcacttaaataatgaggcgaaattagaataaccagtccaaacgttgacaggaattcggtccatccatgccaattttttcccagaattattgccggcagaagtggcggttttatcatccggaaaagtcacaattcgttgaaaccattcaggttgacgagaaagcattttcaggaatcgcagaatcacttccgcagtttgtacgtaacttttttctgaggactaaacaaattaatacaaacaataaacaatactaattgaaaatgaaaatttataaaaataattaccaaattttcaaggaaacgcaggtgagagttcaatgccaattcatagagacggtattgacggtgtttgatggacagccaaaattgagtgaagtttgactggtcaagtacccttaaaagaatgtataaattgcttaaaaagttaatattcgaaatttcccttttaagccctaatgaaaattaataaaacaaataaatacattaaaattgccgtcgaattcatggaaacatccgtaagaggaaaatgttcgactatttgagaacggaactcttcaaaagttgagcaacttccaattaactcctcaaagtgacgtccttgcggagaggaaatgtcaatgccaaactaaaaggaaaagttggttggtcacagaaaggaaagccataaacaaagtgaataaataaactgtacctgttgcatgatggctaattcgttgggcaacaaacgaagagaatcaccgtcaaagtcctcagaaaggagactcttcgtcgcttgaggggtcgcaggagccgtgaaggaaatattgttgacggtgaaatgattgtgagcatcttcagtttgaaaaggttgattgccgagtaatgactcgaagccaggcggaattgactaaaagataattttcgttgcatttctcatgtgttccacctgaaactgcggctgggtttgttgttggatgtacaaatttgaaattcccattggcaattgatattctggcaaaatgtctagctgccggtgcatttgatttccatacaaatcatcaattggccacgaattttgggtccctccgttttgaactgagagtcgaaaatgcgtgttggccaagtttggatttccaagtttttgggcctgaatatcaattcaaaaaatttttttatataaaacttttccaaattaactaattgagcaatttgtccatgcattctcttcagcacaaaactgtgctccttctgcgctccgtacaatctgtgcatccatccgcaatacatttgaccaatttccaaactatgcaaagcattggagttgcaattgtgcaacagatcagcaaagtcaacttctagcaaaatctaaatagtaccataaaatttagtaattctaaaaccatattaatcagagtccatgattaatgctgcaaaaataccggcgttgaaacggagtattttggtgggcttctcatcatttgcttggcgctttgttggccctttggtggaaagtgctgctgaatttgagctggttgtacgtggtactgttggttcggtacattcaaatgctgaatcccagtgcaaattgcgtgaagaatggccaacttcgaatgtgcaagtccgtcgctgttttcgtggccaccacacagcagaaattgtgccaaatcactcagctcatcctaaacgattaccaaagtcaccgcattataacaagatggtatttacctgttgtgaaaaaagtatttccccggtattttggcgaccgattgaatttttctgccgtatttcgaaaatgcgcattattttcgcctctgtctctaataaatggttgttcagagcccaactttcatttttggtctccgtggtcaactgagtgggcgaagtgtacggagccgaattggccaattggtcccaggaagagagtttcaaaacactggcaaaaaggggagaaaaaaggcatggacttattactacatcggtataaaaaaggttttattcccacctctcccagctttgaagtgaaaaaagcgcagtcattttggcaccgctctctccgctttcgtcgtctttaacttcttctctgtcgatgattgcttcgcgaattctttaattaaacaatacaatagaattcgcaaaacaattaactttgtttcagcttgtgggagacgtaaaatcccagcggccatcagtgccaattcgtcaatggcatttaacacgtggtcacgaaccttcggaacattctctttggattgctttgcacaattcaaaaagtttaaacatccatcgagtgcttcctcaactctaaaaaaaaacatttttccatatacaccttttattgttaatataccgtgccgatgcaagtaattcggcataatggcaccacgaaaaatcaaccgcaggtccaaacattgtctcggaaaacctttgaaccccgcggattgcttgtggtgcgcctaacctgaccaaagcacgaatgacccaagtaatggcaaattgaatggaaggatcaagccggattttcgtatctgcaaatgatagtattttaaaacccacaaaaaaagaaagaccgttcgaagcatttgaagggtgtttccgctcgagttcggcgaaaagaaaaccaccaaatcggacaatttgagcataatgaccgttggcataggcagtgctcattagtggaagtgcagttcggaacagccaatccatgcaagttttgaagttgacggaaaagaattgacgtgcattctgaaataagaggcaattatcgaacaataatcattgatgtttcagcattaccaatggaagttcgtcgtaaattttaagcatcgacccgcgcaccgcataacacatcattttctcgaccatgtcaatgcaatggaggagcatccgaacgcggaaccattcctcctccgggtacaaattccgttgttcctttccgcagttaccgccttcaaaagcttcattactgtaatttattccgttacttactcgattgattcattgataagtggtcatcatcattagaattggaatatgaaatgattcccttttcatttgaagccaaattttttgaacgcgaagcaatcagttgtgaagtagaagaggaagccaatgctcgcaattgagctggaaaatgcataatttcgaggagttaggggaatttgtcaaacggaccttcgaatttagtaaatgtttcaagtggtgtcttcccaattggcgtcttcattcgattaacggcacaataatgtgcaaattggccaacaataaacaaccatttttgtaggagagatgcgctgtcaccgattcggttattttgcttggcattttcgttgaaagttgtcgaggctttctgtgacttgtcattagcagtgcacgacaaactttcaaaaaggtattgtccagaaatgaaaagccaattttgaggcgaacaactgcaataacaaaacaataatttgtttttttcatgaaaattgaccaatttacttgtcttgtaacatggaaatgcgcttgcgtccgaagaggaaatcagtcacaaatcgaaattcattcggttccatgcacatttttccaagcaacttttgagttctcttcgcaatttccaagaaagagagacatttaatcgttgatatttcagaaattctaaacaaaaaaaatgaaaaaagtatgtagatatacaaaccgtattaaatatgtgatcggaatgcgattccacagagtacggaactgttcaacttcgagatgttcagcacactcacgcaatttggcaataaattggtgggaaagtattttacacgatggctcatcagaaaggaggacattgaacacatgaattctaaaataaataaacaaattaaagaaaaatcagtcaacgaagaccgacctgtacaaacacttgacgagactctttcgcatttcgaacgattttatggaataaagcgaaaagaatggaacgagcaaaagcgaagaacgcaaagcaaacatttcacgaagctgaacaaaaagaaaatttaaattaactaaacacaaaaaattaaaggaaacctcagagactactttgaattgctcaacaaccaaattcgaaattttggaaagccaatcgattagtgtcgcttgcgcgtggttttgtaatatattaaagaaacggaataattcggcgagtgaatcgaggattttggcaaagtatttgccactgacgctgcttgagaaagacagcggagctgtcgtaccgacatttgacttttgtttatcggaaaagccggattgaaaaatttcacaattgtggaaaaaatggtcatgcctaaaaaccaaaatgactaaaaacagtaaaaaatgttagtgtgaaaaagcttacgtcaatgcaaattccttggccatttgaagcaacagataatgaaaattcggcaaaaatgtcagaacccatcggtcggcaaagggaagaagaccgaaaaacagcgaaaaaaggcttggttgaagaccatgtagcttaagtttattgtttttttactttttcttttttttaagttttttttctttttttggttttaatttaatatttttttttacatattttcttccctaaaaaacatcactgactcaccaagaaaatcgagtttttgactttaatcaattgctttactgagcacaacataaccataatccgcttttcctcacttttaaatttgctccattcaatttttgaatgcttcaattgtgaaataagttcttaaaaaataatgccatttattgcagatttacactattatttaatgaaaaactaaccacatatttcgctgacaatttttggatagacattttgcaattggtctaaatcagttgcatccaatggtcggtaatattttggttttgcaggagaaggcgattgaatttccctcccttcttctgcatccgtctcaactttttgctgttgtttcgtctcatctgctacgaacattaatttttctaaaaatgaaacaacatttatgaattgtaattagcagggctgccaaaaatatgcacgaaaagtgaccaaaatatgcaaataaagtcgtgaaatatgcacaaaaattgcaaaatatgcaccaaataggcacaaaaaaaacttgaaaattaaggtgcaaattcaataaacaatttttcataatcaatttttttctaagggatattaaaaatcgaaaaaaatcaccgaaaatggcaaaataggcacaaaaaatggcaaaatatgcatgaaatatgcagaaaaagctaaaatatgcaaaaaaaatctcgaaatatgcaaataaaagtcccgattttttacgcaaacacaaaaaagaaagtgtttttcctactatttagagcatggagaagccaggaaaaaaaatgcatttgcatatttttggcagccctgctaattatcaacgctgtcatacttaagcagatgacgaatttgggcttacttctttaattttggaattgttaatgggaagggcattattgaaaatcggcggaatatatcatagaatcactttttaaaaatgggccgcatacaaaatcttagcaaatggatttggcccatttcgccacattcactcctcacctctgtggattatgtgtttgagctccttcaggtcattcagtgcattgagaacctggccaaaaagaaacacgaagggtgccgtgtattaattaatgcctcccctcgcttggtaccgtaatgccggtaattccgagtacggtctcctcaaagtgttccttggcaacgccgtgcaccaat

SEQ ID NO: 5671 - DNA, 1672 bp, Heterodera glycines
caggtctctcatgattcgtccattgctgtgattgacaagtccaattctcaacctcaggaaaggccaattcagcacaaaactgcctttttgccgttcacttctgtccgatgggtcaatgagacgcatattgtgacggctgtcagatattccgcttttcctccaacacattgtctctgtctgttgtttagggtcacgactgttccccaatgcttttcactttcgacgggacggcgttgaatttgaaatgcaaattggtcaaaaacttatatttgatgcttaaacaaaatgccattttaggatgtgccgccagaaagtaaaaacggttccaacgtgagctccgctttcgccatgtttcgcagcatcgacaaaaaggcgttgtccgccgactctccgttgggttccaccgcactgaaaacgttgcatcaaaattcgattatgtgtgttttttctttctgttccaatttattaaattttccgaatgtcttacaattaggcaaattcaaccgcacactgtctccagccaatcggggacaatcagcaaattcacaacttgtggcctcgacggggtcgtggctctttgggatgttcaggtgacattcgcacacatttctccttattttattgacatcttttgagttaattaaatagattgtatcattgcctttttaaattataggatgttttcgaattttgtcaggtacgaagcgcgtgatttggcgtgctatttgctttgatactctaacctaattaacattaagaattattgacgtgattttcggtatttaatatccaaacaaattttactgattgtttcataaaattcatttgcaagtcataaattcataaattgatctcattttttaagaaactaacagtgtttttgggtttccctttctaaccttaaaatttgttttttcccaattattcgtgtgtttcttttcagaagcgtctcggcatgcctttggctaatggcgccgcgcaaatgagttaatttggccaaaagtgattacctgatcaacaaatgctacaaattattgtgcaaagtcgcaaactgtggtgtgtcgcggactccgtcgcttttcgctcgctattttatttttaatcccttccgtaatttgtaatttgcgctatctcttctcataatattatcgatgatttcaaccacatgtttttattatatttcgtttattataatttaaaaaaatgagtgataaacaatcactttgatagtgaaacttagagggcaaattcctcatttgtctatcctcccgaatcgtctccaccccctttggttgccgggtaaccgaccgatgtctccggggtccatccgcgcactaatcgcccgtttcgtttcatcacagttcatcctcaaattacgctcattagtgctccattgtcctcaattttccgtccttttgttccaatgcgtcgccatccctccgtcccaacaaataatttcaaaaaacgcatcaaacgccgcgtgcattccatcgccgatgttttggtcggtcactttttgttgtcttttgttgtgccatggacacaattcagacgaatatttccaccaatttattggactccgctcgcagcgcaacgagcggcgatttgggtacggcacggcaaaccctgggggcgacagagagagaaatggacggagagaaaagggcactgc

SEQ ID NO: 5672 - DNA, 7271 bp, Heterodera glycines
  misc_feature (95)..(95): n is a, c, g, or t
  misc_feature (7248)..(7248): n is a, c, g, or t
gttggtccaagataatcgatcccaatgctttcaaatggtgccgtccgcctcacgcggtctcagaaaagaggaggcatcgtcggcaatttatatgncggggcattggatccggcgacaacgaccgcatgctcgaatgaccttctttattgtcagtctcgctctgggtgtccaatattttcccataaattctgtcagagtggattcaactccagaatgggcaagggactcatgtaccgactgtgcaattagtcgggttattggacaattctcaggaaggataatgggattaaccatatcttctgatgcattgctcattgcgagccgtgttgacagtcggacaagaccatctttcctcgatgtctttacaagttcttgtggttgctttttacacattggccaacatttttgtgccatttttacgagtaagatctcggcgtactggtaatcttcactgctcataggaacaccctctgaaatctcgaatattcgagtcttcctcatcttgtttattgcacggagaaaccaaaccacagtgcggcgtagtttagtccaactgctaaatcgacaagggtcaatccatggattgtcttcactcgttgttgctggcactgcaactacattgtccaattctgaactttcttgtccatcattcatggctcctgttggggtgacctcgaagtcgatcggccaacttttcattggttctcggagccatgttggtccattccaccaaagatgatgggatctcagctcttctggagtgcatcctcttgatgctacatccgctggattttcgtgcgttctgatatgcagaaatctggcattttctgatatcctccggatttctctcaaccgattctccacaaatctgggctgggaatcttttgactcaatccagctcaagacgggttttgaatctccccaaataaatttttcatttattgggattctcagctgattttccgcaaatttcagcatcctcgccccaattagcattgccaagagttccattcttggaattgttacttcagctttccggggcttgagtctactctttgcatagagtaactgtacattggtttcttctcctttctgagaccttatgaaaagtgccgctgcataatctgatgacagcaaaccattctgctgtttcatcagctggtaagatttcgtcccatccaagggttctgtcccacaatcgttgtaggaacaattttgcttggagaaggcaaggtgcgaccattcccaatgggtcaaatatgcttgctaatgttttcaaaacaatgcgttttgaaatcttcccggcttcattcgtcggtgggaatccaatgctcaattcgtccttttgaatgtcccaagggatgccaggtactttagtccctggtttattaagccggtcctcttcgggaatttgctccatcgctttcattgagttgcaaataaattccctcaggttcatttgtgcttcagcaaacaatgctttcccttctcgatacttctttaagacttctccagcgtctttgcatgaagtcattagattgtctacaaaggcattcccagcgaattccaacgccaagggggaagctttctccttcagatgcttctggacaactgcagccaaaataaatggcgaagaaattactccgaagggaatccgagcccaacggaagatctgtaaattgtctgtcgacaatttcttcttagggtctttcacccaaaggaatttcacaaattccctgtcttcattgtccaaagatatggcattgaaggccttttctaagtccgcccataatgcaattattgggagacggaatcttagaaggattcccacgagatcgggaatcatcacgggtcctctgaacatacactcgttcaaagatttctctccccgtgggtgtgctgaagcatcaaaaacaattcgaagtttatgagttactactccatgatgtggcaggaagtgttcaggaaaaccctcccttctttcgccaagttcaaagaatccgagattgaactctctcgagattgactcgtggtatttgtccaataactcgggagtcttgcgcagtttttcaaggaggttgaccaatctcctatatgccatattgtaattcgatggcaaatcggacgggaactctttccatggccatcccgaactataacgtccatcagcgagtctcttggctttcttttcgaagatttccatcgctgtgtcgtcatcattttcttttgggttatcttttattcctatcagttgtaggtcccaaaagttttttgcagtgtcgatgcctgtttctgcaaattcacaatcagcttttgctgacatgactgcgcaaatttgtctcgtttctccgatctcctgtgggatatcttttccacatacgataggtcccactgaagtgtaaatgcggaataagttccgatttatctgttcgcgccgctggaagaatcgccagaattcggccataccaatgagtaaatcgggttcttcatcggttatttccacgtttccggtcttccattcggctcgacggatagatttgactatccaatctgcccgataagctactattttttcggatttgccgttttccaatgcgacatgtagctcatactgcggggcatccagcctgaccggtgaatcgctgtggaaaccgctaacttctagctggccatctttcaatttatataagcttaaggctcgcactacagcacttttgatcatggttacttgcgaacctgtgtcaaagaagactaaaatcctaattctctttgtaggatttcttctggagaaaattgtgacgtatttcgccatcagaagcactctttttggatcagaaaccatcgtggctactgttccattttctgttgaaccaattgtcgtcatattgacttctgcatgggttctcttgaattgtgctttcggctttgtctgccattcacggccggatttctttgtattcggacaaataactttgttatgcgctcctttgcatctcgcacaactcctatttgcccgacaatccggagctctgtgccctctgcgtaggcacagagaacacctattttgttcggcgagcattttcgttcgttgctgaacgctgaccacttttctgcaatcgttgacccaatgcggtccgtcgcagaagaaacatggaagttttggcttcccacgaggcgctgactccattcctcgtttatcttgtgtggctacaaaggctctggctctctccgctgattgccttcgttgctcgcgctggaacacctgtctgttttgtgtcggacctcgattcacatctcttcttagtgatcgagagcaacgctggacctcctctcgaagtgatacgacttctgctagtccacgtctcagatctgacatctgccaatggaacccctcttctcgctccattttaatcaattcggtgagaatttgcttgggcagttttgccttgactgccatgcacatgagcgaattctcgggatgtcccaaagcatttaattggcgacatattcgttccaagttctcggagaacatctggagggagtccgggctatgttctacatttggaagattgaaaagttcggcttgcaaggcttcgacgataacttgcggattgccaaacaatcggcggagtgtttccaccatattttcgtaattttggccacctctgtagcctatcactgcacgagaggctttccctttaaggcatcccatcaaataattcattttgtcgattggctgcaggtgagcctgattgtggaccgcattctcgaaggattgccaaaatgtcggccactctaacggatcgccggagaatatcggcatccgtaattctggaagtctgatccttggttgatgcaggacttctctgacgggtgattgcctttgtactcgaaaagggagttgcctttcctctcgagcaggtgattgccgttgcctttgggcattttctcgcacggcattgtccccgttttgggaaccatcgtattctgactctcctgcaagtgccacttgtatttcatccatcgtagcatgtgcgtcggctagcaaattcgctacttctctttcgttgatgaatgtctcgagtcgttcttgctctgtctgtttttcttgtccttgaagtccagaaatcacgttttcccatttcgctagttcagcttccacacgctgcaatacttttaacagcaatacttttgcttccatcagcgcagcgttgttaacttcttcatcttcctcacggtcgacatgtgtccgtgccgtgtttactcgttgacgaagaattgccacttgtgggcccagtaccatccggattaggttgctcatgatggtcttttcgggaggtccacttgttgtgtggtcgttttacaggagcgccagttatcgcgttcccaggagcgccacttgtcgaggaggcgggtgaggtgcaggtttgctggactggtcggttgcgcttcggctgtcggtttgcacacgctccgcgacaatgttattgaacttagcgaatgggacggggtttccgctcttggaatggacttgtgggatggacagcccctttagacttagttggactgtcctggtggacttcgggacaatcgagcttagacaaatgcaaacacggaactctgagttccgggaatgtcgaaaccgtagagaaaaaggaacaccttcggaacaaaaaacttcttagacaagaagtagtttatttgtcggaatagcgcacaatcaaaggatggaataatgatttttcgagagggattctaaagggaaatattcgggtttatatatgagatttggacagggagggaaaattctaaaacacacctgaaaggaaatgaaaaatggggaaacttcgggaatattaatcacaaagatcacaagggaacattcgagaatcttcttccgtcctccacaggacttcctcatttctttcctccgggcggtcctccaaacggtcctccgagcgatcctccgggctgtcccccaatttccacgcgttcagtcgccagcggcgacaaatggcaatccggtcacgcggtggccaacatgttcaacaaggtcccaattgatgggtgcccttaataagtgctgacttgtcttggctccacaaaaaccaacatttattcatagacggtgctccccattttttcaaggaaaattttgttttttattcgatttataccatcctggggttttaatggtcgcagaatccaatgataatagtaaagtttgcctcccctcgccccttttttggttaaaatttttttctgttctaaaaagtcgtgaaaacacgtttccagggatttttgatgttgcaatgatttttactaaatcaaaactagacaaataataaataaccaacatgtggatccaaaatcaccaaaggtaattgagcaaagggacgcgatattttcgcctttttgggtcaaaattccaaacacttctcttattgcttatcgacgcccgctgaccccatgcgggtggcggcatgacctccccccacccccagcctaacccttgtacattatatactttgagtccacattaactcacatccgaaactgcccgccgcacccagcaggatatgtgcagaatgcgtaaatgaatctgattccatttggatggtggcgcggcgcgccttcgtcaacgcaaaattgcaccgcagccgaacgggtcccaaaagtttgcaccaattcccagtctgcatggtcaacaaagggcataaaaactggaaaagaggaattacaccttgcttacaaaacatttgtttgagagggttttcggtaatcgtacgctttactggtcccacaaaaaaaggtcgaaaaaaggaattccgagctttttttgttgtgaactcaggggttttcgcaggcgctgatcacgaatatgacatccatttcgacctatttcgaatcccgaacccgaattcgaacaaaagtcggaaattaatttttcacaaaaattcacctgtattatccaaaaccgattcaaatgcactaaatgaccttgaatccttatttgctattatattcaatgtatctgactcgattttggaccataaatatgaattttggtgaaaaattaattttagacttttgttcgaaatcgggtccggggttcgcaatcgatcaaaactgttcttaggttcgtgattagcgaccccgaaaactcatggaaaagctttattgacaattttttgaaaatttttacaaaaaattgttcgaattcgggattcgaaataggtcgaaatggatgtcatattcgtgatcagcgcctgcgaaaacccctgagttcacaacaaaaaaagctcggaattccttttttcaccttttttttgtgggaccagtaaagcgtagattaccgggttttcggaaatcgctgattatgtcatatatttacaattagaccaaatgtgaaccaggtcccgaattctaacaagtcgaaacttcgaatttgataacttcttattatttgtctacgggctaagagattttttgtttaaaattttttttggaggtgaactgacttggaattgcgctgatcagccaccgaacacttcaaaagacgacaaatgaaaggaaagcgaaaattcaagacttaaaaattgaaaaaaattatttaaaaaatttgttttggacaaaaaattaacggagtcgaaagaaccgtaaaagtggtgccgataagggcaaacaaaatgttacacatcaaccttatatatttaaaaaatgctacaactgcagaggccatcaaaacatgatcaatttcaattcgaacgaacgtcggctgtggaaggaccattcccttctgttggcccggggcggggttcgaacccgttttcacccgaccacaaattatttttttaaagacaatgtgccaaactttttttaaaatttttctcagtgacgaaatgatctgttattgttggaactaacctataatggactgcagttaatcactatttagcattttgatttttgagaaactcattaacaatcataaacaagcacattatgcattaacagttttattcttacctcgcaaaaaaaacaattaattaattatatattataagtgcgataaggtcggcatataaaagatgacacaatgaatcagtgaattcagtgttgggcatgaaacaacacccgaaaattaatacaaaatcataaaaaggtctgacaaaaaataattaaataaaacagcaaaaaggaaatttaaaaatatacaataataaggaaagtcagttgctgaacaangtaaaagagagagactcacaaaa

SEQ ID NO: 5673 - DNA, 2034 bp, Heterodera glycines
gtaaatcgaccttgctctacatgataaaagtggttttaaattgatttgagcacttacagtttgaaatgttcccttgtgagcacgaatgaagctcatttaaggtttcataatttttggaattttttaaaaaattttcaaggtttggctatttttgctcttgagaatttggtcgaattttccaaaaattcataactaacatcagggagggtcgatttagtctaaaaattgagaaaaaaagagaactttgtgactttttatcaggtttttctaacgtcaaaatgaagaataacattaattctattaaagaattaatttaggcaaatattatttgcgacggagataagctcggatgtactaatgtccctccaagaagaattttttcaaagaaagagctttttgctcgattgttgggcctcagcggtaatctctaattttaaatggttttagcgtaaaacaaaaatttataggcgctggcgttttcgagcagtttttcctcagaaagccggcagtattaaatgtcacggacaaaatagtagcaagaaaagtggcatttaaactggtttgttgcttaggaaagaagggattgcccgcccattaatgaaagagttcaattaccaatttttttggggggggggtgaaaattttatccaactctaaatcaatttattaaggccgaaatggagtgcaccagggtggcatctgactattttaaccccatgcatgatattaaagaaaagcctgagttgaaacgaagggaagaactcattgaattagcaagaagggaagtttttcaaagaaacggctgagacaaaaggcgcggaagaaaggagccaagaggaagaaggtgaactgaacggaatggaaggggcaaaaaggaaacgaaaattaagggaggaggtgactcatcgtccaattcatcggaaggagaggaggaggaggcgaacgaagaagaagagaagggacaaagtcgggagggagacgaatgatcgtgttggtttatgggactgcatttactcagtttattaaactcattatttatgagcaaatatatttttgtcactaatttgtctaacttacctattttgagttttttccccatatatctatatttttttctgtggtcttttattcatttaaatttcgtcggacttatttgttaggaaaatgccaaatttgctccaagttctgttcggaccggttgtttaccgcccatatcaacccaacctattggaatcgggcggtaacaagctgttcagcatcggtgctggtgcctacaacacttgtgttgtgctgtcgcccattctcgtgccgtacattgccttttcttggacccactcccatcacttttcttttgtcggtttgcatgtttccaattcagtcctctcacttttgtccctttttcagttgcgcttcgttttggtgttttatgccattgccttttccttccgaacgattggtcggctgacaaagtgagccaaccaaaattctcactgattgctcattttcgttgactgttcctcacttttgtccgtatttcagtgttgactacgtccgttttatcaaattgctcggaaccgtgcgcaaatctccgcagaatgtcactttgctcgacacactcaaagactacgattttcaagtgaatgtcccaccgttgctcttttctcatccctttccttattttcggtgtacgctgcgcccgctgattttaaagcatcgccaggccgaacggccaaatggcaccctccgcgtgaacgccttccggacttgaatcctccgctgaattttctgcgtcaggctatcgcgtggacggccgctaacacttttggacgtcgaatgcttttccctggttcgatggcacttttcaattcaatgttgaacagccaactggtcgatggacggcgcaaattgttgacagaaatggtgaatagaaatgagattagtttttggtttatcgtttttaatgaaaaattttctgtgtcttttttgagtctaaaattaaaacagagaaattcctaaaacatttggtcagttcct

SEQ ID NO: 5674 - DNA, 2225 bp, Heterodera glycines
tcttctgtcttcaagcctcctatttctttacttttagggttggaaacggaaagtcattgagacggaggatgggggcaaggtcgattcggtgttcatcgacaaacgcgggaagggcaagcatggcaacattttgatgtgagtctttgtatgtttttgcattttcttagcgtcgcgtttttcagcatttgctgtgaagggaatgctgggtattacgagatgggcatcatggtaagcgggcagcacgtctttccccccccccccccacggtcgtttgttgcatcgtttagctcaaattaacttttctatttcgtcatagcatatgcttccgtttacatatttttgcagtgataacaaacagacaaaacttttccgtatttttgcacatgtttatcgtttggtgaataaccttttgatgtcctccctttagtaaaatttttgtggaatgacggattggggggggggggggagaaacgtgcccttggaaagaaattcctcgcttaaatcctagtaaaccttcacttttcattcagtcaacacctgtgaacttaggctattctgcgttgggttggaatttgcctggtacgttttcccgccattttgtccgattcttttacccgtccgttcgtaggctttgccgaaagtaccggcactccattgcctcatacaattctcaattccatggaggcggtcatgcagttcgctgtaaagaatcttggcttccaaccgcaacagattgtgttgttcggctggtccatcggcggtaataatttgaaggccttttacccgagactttaaaaagcattccctcgtccaccgcttaaggatttgctgccacgtgggcagctgccaattatccacagatcaaagcgctgattctcgacgccagttttgacgacgtggtacctttggccagtgcccgcatgccagcggtgttagaagggttggtccgcttcgctgtgcggacccacttggatctgccggtcgccaaacaggtggtccaatgcttctgtcggttgcttttcctgaattacaactcacaaccagttacaacgctacgaaggtccggtgctgctcattcgacgttggaacgatgaaatcatcgccacggataccctcgctaaagacgatgccaccagacgcgcttcaaatcgaatcaatcatttgttggtcagtcttttgcgcagccgccacccgggccttctgaagacgaaggcggacgaaaagtgtgtgttcgaatggtaaaagttatgctcatgaacgcttcaattccatattttcttattgggtttaaaggctttcccacgaaccgcaagaacgtctttttgtctatccgccggaggattcgctggaaccgcaaactttgaacgacagtgaaatgaaaagtgaacaaagccgacacaggtgagttaaaatgggccattgggtatgaaatggggggacgattccgccgattggaacattgggcaactcatcaacacaaatttcattttgtttctttattaattaaaactttaaaggtttatccgacaactttgcaccaaatatttcttcgactttatgggcgccactcacaatgttgcgcttgacccgcagcactttaaaattccgacggctctctgaattgttccgatcgatctctgctcacttatttagaaattatctttaccatattgttgtttgattaaagcatatgtaataaattttaataacagaaatggatttccctgggttccacacaaagtgccatttgtcatggacttcgaaatgatttgttatggatttagaaacgatttgataaagcgtatccaatctttgcaaacaaattgaatgcatttcatgtggtcgtttgatcatttaatgtttttcatctgatcagacatagtaagccgttgaggagatcattattttactgttgctcccgaaaatgtccgacacaacacctgatttattgagtagagatcttctaaaagcgtttatgcccaaagtttcatccaaaacaaaaaatgagtcaaaaaagaagagaacaaaacgacaaacatgaaattatccaaaagaacataaagcaaagaaataagaagggaataaaacgagcaaaagtgacacaaaaataatttttctgattacatcacaaaaagttagcccaaaaaataaatagagttcccttcagaatatcgaatattggagaaaaagccgaaacaatgaaatcgagtcagcggcacatcaaa

SEQ ID NO: 5675 - DNA, 4224 bp, Heterodera glycines
  misc_feature (2598)..(2598): n is a, c, g, or t
cgaacaaatgaaaatcggagtcagcggcacaatcaaacggagagcacacagacacaacggaagagaagggaaggaaggaagaggaaggcgaacgaacaacgaacagaatcagcagcaaaacggagggacacacgaagaactaaggctggttagaagctgaaagggacagcggaatcagtgaacaatcagtcagaagacggattagcagcgaacggagggaggcaaagaaaaccaaaggcaaatgggaaaagcactgaccgttcacagggcgagcagtgccatagtgctgaccaggacggatgggtttcgctgaaaagaaaattgattatcccagtggaaagggacaaaaaaggatggcacaccaatttgcagccccctcctggccaaattcctctgtcggaccgcctctttgatccgctccacttcgtactggtacttcttgcggtccttcatcgcgttctctttggtctctcggagggcgacctccaggcttttgatgcgttctgaactcgcacggtatcgcttctccaattttggcaactcgcagcggagttcggcgttgtcgcggacgagctgaacagaaaagggaacggttgttcaaattccatccaaatgaatgttccacctgtttgtgcacactggtcaactgctccaagttgttctccaggaagatgatcttctgcttttggatcggacttgacaagaattcttcgtcgccctcgggtccggtcggcgtctttttcatgcgctgtgccaagtcttgcacgaatactttgcgcaaattgtgcaaagtttgcaattccttgttcaccgtctcttccaacccttaatcattacggattattcaattcgtttactctctcatcgcatgccaaattacccttcaaatcctgcttcgcctgttctcttttgtcagaaagtgcggacagtgacttcaggcgcttctccttttcagtctcgtcatttttaaggcgttcaaagtcttgctggagctgttcacgagacagctccagctcttgcaaagattcctaaattagtccaataaagtgacgcctttattttcaatgccaaaattcaccgtcaactgtttgatctgactgttcttcagtgcgatctggtccctgagctgcatcaccagcttctgatgctgctgctgcagttcgctgttgtcgtcggccgagtccgaatttttcgcgtttgccaacttcgcgttgagtccgtccaattcgttctccaactgtcttttctgcttttcctgcccatcgatcgtttcccgtagtgatttgttcttggcgtccatttgttggatttgcaatcgacagtccgccaattctttcgtcacgtcgtccaactttttcatcgtgtcgtcagtgcccgtctccaacaaacttagtttctgaaatattttttgtaaaaagtgcaccaaaagtcaaaaggtggtacctgtcgattggccctgaagtcgctggcgagttttgaaatggaaattctcgcgtgggtaagcgtttcgtcgtcgatcggtttgtttttgtccgcaagatcagtttgcatctgtcagtgaagggaagttgtagtttttttaaaataaattaccttttccgaaaaggcgaaattggtctcgcccaagtcggccatttctttgaccatactttgaatgctatcgtaaacacgtttctaaaattgcgaagtgaaaaataaaaagcaaagtaaaatcgggagaagaggcaccttttgtgacacacaaagttcacgcatttcttccaatttggtgttgatcaaagtcgactcgaggtttttcttggagatgtcgtcagcaagtcgttctggtcaaatgagtcaaaagcattaattataaggaatgagaaacaacaaccattgtctgtcaccagttgagtacactctgcctttttctgatcaagattcagtgcgagttcttggatggccgagaacaactcctccccttcctcatgggttttgttgacttgctctaaaatgattaaattgaaaaagataaaatgcaaaaatgaatccatggtgaggaattagttacaatagatgccaaacatccatggttcgaagtgaatatgcaaactcaaaaaaggggcaaaccctgtgccttctgcaactctgccatcagcgtgtctttgtcctgcctttgctgtttgatttccttctcttgctccatcagttgctgcttcaaactttccgccatttgcgactgcacttggatttcgtcgtccttctcgtccaattgggcgtacagtttggaccgttcctcctcgtatttgcgcctctcttcgtccacaatgggcccttcgcgagaggacagcaacggctgctgagtggtggacggtggttcggagaaggtggccatcgaatcggtcatcattgacggagtcactgaacaattgccatttaaacaatcgaaaatgcctgccacggaaaatgagaaatgctttgcccactcgtgtccgtctgctgcatgttcgctgataagtccgcccagtccgactcgctcactctgtcgcccgccctccacctgcgcagctcctgctccatttgctgtgcttgctggcgcagtcgcgtcaccttctcccngtctcgctcgtaccgccgcttccattcctcggccgtcagttcctcgttcacaaccacaacatttttaatggttttggcccttaatggacggccaatttagtaattattattttatttgtattccccgagctgacctttgtccgaaaagcagcgtcgactttgtctccccttcgttgtatgaagcgggagaacaacaaatcacaatggtcgtccgcgaattgccacccaacgattcttgcaaaatgcgcgtcagtttgctgtcacggtacggcacgtggcttttctggagtttatttcgtaaattttcatttttgacgtgtaaaatgaaccgttccctccgccagtgcggagatgacattgcccagtgcggacagtgacttgttgatgttcttcgcctcttccagcaccgctccttctgcacccgttttgctaaccttaaatccacctaataaagttaaaaattcgacaattgtgtcagccgaccttttcactaccagccaaatccaccaaatacaattttccggtcagttttttcagcgttgttttgttgtcctgctgcacctgtatttggaatacgctgtgcgatcgtgaagaatgctcgttcatgtctgaaattggcctgtcattccgatttccccgaatttcactcactcgtcaccgccacttgtcggttcgtctttccttcttcgatgtaagccaacacttcgtctgggtttgtcacaaacatttcagtgatattcttcacaaatggaattcggtttttgtcctcgtgaattgccaaatttgttttggtaatatccaaaaggtcgcgaatccgttcgttgtaaatttcgaagtaagacactttgatcagaaattccatttcggtgtccacctggaaaataaataattaccaccatttaatgtcggaaaggagggagattgcaatgaaaaataaatttagcagctgctcacaaaattgtagatatgagtgaatatgtcgttgacaatgcgtggaattatgccctgtttctcggagtcgccaataacaccctaaaagagccaaaaggatcgtaaattttccgaattagttttgtaaaacctccatagtgtgcgttttgcccgacgaagtctgtccataggcaaaaattgtcccgttgtacccggtgagtacgtcctgcacaatgtgtcgggcggcagtgctgtacacggcctcttggttggaacttggctcgaacacatggtcataggcgtacggttttcccttggaatgccgctttgaacagaaattatcggtttgtaaataccccaacgacgatggtgtctttggactgaaacttgacgatatttgtggagctgttcttcttctcgctctcattcaaaggccgaacccgacaaaaaaccttgaattggaaaagatttgaaaaaaacatttaaataaacgaaggaacgacctgtatacaacattctgaagccatggaaagaagagagaaggggaataaggagaaacaaaataagtttgtggcttaattcgcaagaaatcttagaatttgagtgtttactgcttatgatttatgatgcatttacataaacaacacgaaatacatatatgtaattttaagtcaaataagaatatgcaattgaggt

SEQ ID NO: 5676 - DNA, 1502 bp, Heterodera glycines
atctgactctcatttcggtgagcagaagacaccgaaagtaactcccacagataagaaaatctgtggctgttacataaaaaagaatggtgttgtgagccattcagttttttccattcgtattaatcgaatggacaataaatgggaagaaactcttcctaatcgaacagagcaatcaatcatagcattgacgctttgtttttacatcagcataagcctgatggttctctcaattttaaaagccctttctattgggcgtaaaaccattgcttggctaatgatccaactcaaagtatcattactttcttttgaggatcagagcacgccttgctttcaagaaggaaggcaaagaggggcaatccctcaattttgtacagcgcgccatattttgcaaataatggcgtttactgtaattttagcatgtttgttccctcttcccgttaaggggggaacagaaacaaatgcttatccaaccaatcaatgcaatgagtgcaaacttctttgctttaacaaaggcgttaaagcaaagattccaaaagaaatcaataaagttgagctctgctgtgcagagaactgttacattcatgagaatgtaaagcagctcacttacgagctaccaaaggaaatcctcctaaatgacttccaatgtgaaggtcatttttggatggattcgaaacacatgttcaaaaaggacattttatgtccagcagttgatgagtgcgaactcatcgaatgctatttttgcattgaacagttagcgaatccaacctgttacccattgatttcatcaatgttagcagggggactttgcttatcactcactcataagcattagctttatggctttttccatattaaaagtcctgttttcaggattttatatggtcatttggctgataattcaatttatcaggccaataatttacttagctggcccaaatcggcttccgaaagagaggaggccaagggcaacagcttctcaaaattggacatcacgccgtgtttacagaacaatggcgtttgttgtccttatggctaactctctccagaatttgactggagcagagaccatagcagtcatggccaaatcggaaaaatgcattaaaaatgcgacaagcatgagatgcattgtcgaaaactcagcaatgctgacgttgctgccagttggccaaacaaacactcttcttctgaaaacagaggaaggtgttctccttggctcaattaacgttttgctgaaggctttagctttggaatgccaaagcttcactaaagcctggcaacgttcatacgcaattaatgtgttggccggtaaaaggtgccctaagatgggatcctgtgaaggaaagtattgtagcgaagttcgccacaatacttccattcctgagctaaaagatgccaacgattttccgggcgattcgttttgcctggacggcacggccttttggggcgacgggtgccgcggtgagggtagtgcgtgccttttttatcgttggtatgctcaggaa

SEQ ID NO: 5677 - DNA, 2734 bp, Heterodera glycines
atcatggggctgtaattcctagggaatttattgtctatacaataattacgcctaggaaactttagggcgaaaaacccaagtcaactcaggtgtttctttatccaggaagaaccctgagatggaacaacatcagccttactccgatcggagtaacctttccgcccgcccccgtcttaaactcagattttgtttatgacgggagcaacatggctctaaccagagagccattaacaattgactttaactgtaaaagtcggcaagaagcaattgatttcaattgcagtcttggagttcaggcatgcactgattgcatacctgaccattcatcaggtttagtgaactgcaattgccgttcacataaccttgaaaagttaatggaaagtccagagaggagacttccattaaacatcaaaaattaccaactcagaaatactgggagaaaggtaattgccttgacaggatttagtcctgtccaattaaaccttcaaatcgaaggtctccaaatggctttggaacttcaccaaagcctttgcacaattttgccgttgaacatatctgggtgttacagatgttaaacgggagcacaattccgttatgtgtgctcgacaaattttggcaattctcttgccgaaattaaatgcgatgatggaacacatttttcgacaaaatgtgattccaacgcatcaatttaccagacaattttggcttttgataaagccagaattgacacaaaatgccaaacaaaatgtttggctggaaatacttcttttgttctaaaagggacattacactatgtccagcccgaacaaatagaagattacagtccaaatcactccgaaagagtgataaacagccaatccagttggccgaactggaattttgattggaaggcgaccctttggtctttgattggcatccaatcatcagttgccttcataatgattatttgtgtaggcattgtttgcctaacaattttcattaaactttctcctttctatagactttggaaattaatttcctggtctttaacgagaaagggttatggtaatgtgcctacagtattggcaatactgtacttggccgggggaggatccttcggatgtggtgttgaatcacgtcctatcccctcggcattcaaaagattttgtgagtcacccctcgttcaggggaatgattcatctcttccattgaatggtggtataaaagggtggcggatttgccacccaaccacactcttcaaatcatccttccacggaatgcctattcccatacgagaagggccttatttctcggctcgccgggtggtcatacccgaaaattccgaggtcttcaatgatcgcctttacggacttggcgatccacgatctgaagaggaggagagagttcctcgctggcaggaacctcctattcctcgccaaattgagtcattgagctcatggattgagcggtcttatggaccgcattggtatgaaacagcacgggagcgccgtgctgtcgaagcccgccttcgcggagaacttcgcgaaggggccaatctcttaggagaacattttggcagaattgccgagatccattttgatggattcacctgttatggtccggagggtctcttcatctctccgggcataacacttttcgatcattttgtacggttgggtcttcaagtagacccagtaaaaccgtgcatacaagaatatatagggtttagccctcgcgagcaagggatgctgcttgtcgacatttatccgatcgaactggtcaacatccgaaccagaatcggagttgcttggagagcgccagcagttttggaggaacctcgccctcctccacgtgaccaagcacagctaccagatggacgtttggagaatcgtcctcctagggtggctcgtcgacttccaaaccgacgatgaaaagaattttggcaacgggacggcaacagttgccgccatcctcgaggcccggagaatgtcgccaaaagcgacacaaatttcttggaaattttcatttattttttgatacttttcgtcgatcaattttcccattcgctcgctccttttttatgactcagctctttttctcttcatttttcactatgagtcaccatttttaatggatttttgtccatctgtttgtgcacatttttcacgtgcctggccccgcccccatcgattgtgagggtataaaagcccggcccattctccattttcttcactgatcactttttgattaagtcagtcgggacagttttctgtccaagcatttgcattaaattgtaattgtgcaattgaattgaataaagattaagaaagagtcttagtcttttctctatctgtaaaagggacgctcaggagccctttcatacagatcattaagccattgacccccgttgggtcaaagaaaaggcttacaaaaggaaaggagaagcattttcctcctttcaaattgtcccttcagtaaaggagaggaatttcctcctttaatttatccctttggactctgtgagtttgtcttttggacagaaattcgctttgcttaaaagactccccccttctgccgggagagtctgcttccccttctgccgggaagtgcaaatttttgtggccctttgcccacaaaattagacaatttttccattttgaaaacagtacaatttcgtcggtatttttcttttttgtgtgaatctcttttatagccccccccccccccccctccattaaaaacaaaaaaaccgaaa

SEQ ID NO: 5678 - DNA, 2068 bp, Heterodera glycines
ttttggtgctgatatgaagctgaactacctaggttaaattttcgggaaaaaataattggctgactaatgtttagcaaatttttcacaaatttggcttctttttcaggcttttcggaaaagtctttaataaaaactcaataaaaattaaaaatacacccctaagaatcgacctgaaaaaatttcagaaaatacacccaaaaaaagcgaaaaaaatttccaaaaagatcaaacaaaatttcgttaattcccacaaaaccgaacaccgccggaatatttggaataaaataaataaattatagaaatttgaattattattgcggagatcagatgttgtttaacaaaataaatttatcagacaattttgtataagtcttcgtattaaattttaaaaaacggtgtccaattaccctcttcaaaatattttgtcacttaatgcgatttccttttttgcctaaatgctttttttgtcacatttcagctcttgggtcgtcccattgcctattttgtgtgcgaatcgaatggaaacgcggagaattttcaaatttcactgcttaaacatttcctacttcaaattgagccgccccttccgaaggaggaggagaatgtttactttgttgaggtgcaatgccacggcttcaaaccgcacacattcaaaacaatcaccagggccaagacggacgtggtgctgcaccaactcagctgcaaaacctacgacatttcggtgcgcaaagtgccgttggaatggatccggcgactgaaataccatggggtaagcagaaggccgttagggaagcgacgtggggcgatcagagaacggaatttctaaaaattcctggaccaggatcctgggaaaaccctgccaagacccggcactgttcagattaatgggtaaataaggcaaatttttcagtttttgctccatttgttatgaaatttaaatgaaattttttggggaaagattttggttatgaaaatgtttcttcagcgaattacctattttaatatacatttaaaaaagagcaatttttcgtgtattaattgtagttattgtatttcctcaattatatgccccccctcgattatatttttattggttgtgctccaaacactgggtcattaatttcattgaaaatcctttaaatcttttggaattttccttggaaagcattttagttataaaagtatttcttgaacgaattacgtattttaatttttatttaatatttcatgtattaattgtacatgcgaatattaatatgctttacaaattaagtataacggaatgatccattcaacaaaaccgtttcatcaattggatattaatattacgatgggcgcgacttatgtgttggaatttccggcaagatttcagcggccgaaacaagtcaattatagggtaaaaaaaaattttactttttggcactttctcattagtgacgaggcgagggaccggcacggagttacccccccccccccgcttttccccgggaattttttttaaattaggagaaaggtgaaaaaatgcaataattaaaaaataaatgaatttccaattacggaaacccgtgaaccgtgattgtaaaaaaaaatttctgaatgatttttttatttaaatttattaacaaaaaacggaattttaatcgctggaaaaataaacaataaacgctttttttgcggcatgctttttccaaaaaacttttcgagtacagggggcagaacaggtggtgccaataggcgccgtcgggaaaaaaatttgtatttttaatgcgctttgtaagcagattttttccaaaaaaggaccaaatttatgtttgagccaattttttgaggaaaataaagggctaattttttgccattttggggttaaagtttcaaagaaataagttaaaagggggtccaggcgccgccgtgaaaatttttgaaattttgagtgaatttattaacagattttgtcaaaaaatgtccaatcatttgttaatttatgggtttaatgctgttttaaaaaataacgaaaaaaatctaatggaaaaaaagatttattttaattaaatttcattaaagttattta

SEQ ID NO: 5679 - DNA, 998 bp, Heterodera glycines
  misc_feature (950)..(950): n is a, c, g, or t
  misc_feature (980)..(980): n is a, c, g, or t
ctaatgcgaaacgaatcggttcgctcgagtccaaaatttctggtcgagccgagagggcttttaaggcggcgtgctcaacggagccatttcgctgtgagattattaaacgtgaaatgctacgacagcttgaagaaaccgatgcacgtgagtggaatgcttttgaccaactgatgtcaggcattcgacgaaaaaacggtgaaaatttgcacgatttggcggacgagtgatcactctagtgcgacgttcatatccggggctgactgatcatctcgtggacgattatgcaatcaaacatttcatacggacgattgatagctctgaattagcattgagcttggaaatgggacgaaaacccgggatgacttttgatcaatttgttggaatggcggcacgagccgaggccacacaaagagcaactcgtcggatgattccaactaatggcacatttagaagtaataccggaccaaccaatttcaacaatttcgattcgacggacagagctcgacaaaacgaatatcgccctaaatgttctttttgtggacgagaaggacatttgtcaagaaattgcttccgaagaccgacagaagagggttatcaagcgcggaatcatgagcaaatgatgaatggaacaggtgcaaacaaaactccgttgtcaccgcaccaaaaccaacattttgtccgtaaaacggaacaaaacaatttcaaccaaaatgctagaattttttcaaaaattatgggcagaacacgacggagattcgacacataatgaaaaggaaacatcaccaattgggaaaataatggcaatcaatgtcaagatttttgaccaatcagcaccatcgatgctggatggaggcgcacaagtttcactgatcaaagccgattttctcaaagaaatttttgaaaaggaaaatttggacactgaaaattttaaaattagtccgaaatctcanaatatcgttgacattaatggtaaacgagtncgatggtatggagtgatc

SEQ ID NO: 5680 - DNA, 4403 bp, Heterodera glycines
  misc_feature (12)..(12): n is a, c, g, or t
aacgattgttanatggattaaaaaatatttttgccgtcgatgacagtgaactgactcagcaagcccaattgtgatcgttccaaaaaaggacggatcattaagattttgcgtcgactacaggggtctaaatgctataacccgtaaagactgctttcctctcccgaatatcgagcgaacacttttgatgttaggtggacgaaagtttttctctactttggactttctttccggctactggcaaataaaaatggccaatgattcaatcgaaaaaacggcgtttgcaaccgaattcggcttgcatgagttcacagttatgccatttggcttatgtaatgcggttgcaacttttcagcgctttatgtcgcatttattaggtgacaagctgaataattttgttttcgtctatgttgacgatgttcttgttgcgtctgagtcctttgatcagcatttagagcacctcaaatttgtgtttcaacaaatcaatgaagcgggcctaaaactaaaaatttcaaaatgccatttttgtgcagagcaactgccatttctgggtcatattcttacacgtgaaggaataaaaatggacgaggaaaaagttaagccaattctagaaatgccaatccctgtctctaagaaagaacttcattcctttttgggtttcatgacatattaccgaaaatttatctattcgttcggttccatcgctgctccactttttcagctcttgaagaaagacatcccatttcgtatgggtaaaactgaaattgcagcaatttccaaattaaaggaaaaagtcttaagtgaagttatcctttattttcctgattttaaagctgccatggaaaacccatcacggaaattcttaataatgaccgatgcatgtaagaccgggatttcggctgttcttttccaaccggatttgaaaaaccgaattcgcccaatttattttgcgtctaggcaatgcaacagatacgaatcgcgctactgtccaacagaattagaagctttggcggtcagatttggcgtcaaaaaatttgcgcaatatatcacgatgattcccactcgagtgctcactgatcacaaagcgctaatttcaatgtttagaagtaaaaatgagacaggaaatgcacgcgtggataaatggatttagaattaaattcacgatttattttggaaatcgaatacaatcccgggaaaacaaatgtaatcgcagatgttctttcccgttcgggagcattaaaacaaaatcagtccgcagaaaatgcaattttgatcggagaaattttgccaggaacgatcaatgtgaaattgaaccccaggcagaaatgaatgagtggattttgtcaacgaaagaaagtgaattccgccaaacttatgaatttttggaaaagcgaaaactgcctcaaaacataagggaatcgcaaagaattttggacaccatccaaaaatttactttgttaaacggtcttctttatttctgcgattcaacttttgaaaatcttcgcctttttgtaccactcgagcaaaaatcattgaagaaaggcaccaaggaaaatgcgccggtcacttaagcggaaagaaaatatttgagcaaatctctgaaaaatttagaaaatttaatttttactgagattaagaattttgaccatgaaaatttgtgggaaatttcattggaatcatcagggacgatgaaatttttagacgatggggagaaaatggacaccagcgaagcgaagatcagttggacagccacatgcgagagtggggagcatattatatgcaaaaaactccttgtcggcgacattgaccccgtcctcaccaaaactgatggcattggagcgatatcgccttgttcgaaatgcctgaagctgaccgaattgtgtggaaaaaactttttgattgtggcagctgggccctcgaaaaagttcgtgcaatggcgatccatggaaagacgactttggttgatcagccacgagtgataattggcgattcaagcggtgcgcagctctgtggtgacgcaaaaaaccaaattgcagcacactttatcgggacggtcaatggggcgctgggcgacgtgatcagaacgttgaacaagacgattctgacctcaaaagtggtgtcagcgctgatcattttgggccgtgacgcgttgttgcgaggagagaccattgaacaaatcacgggggaatgcgcgaggatcaaggcactctgcgctcaattcaaacatgtgcgcttcatatggttgccgccaccatttgttcgtgaacatcatggacagtacaatgagcttttgccggcattggaaagtgttgctgctgaatggttcgtagcgatgacagtgaacggaagaagcttaattgagatatggagatttggggactctttcgacatgtcacgggtgaaggccgacggaagaatgctgccggagggcttaaaatgcctcagagcctggatttttacgcaagtgccggagtttcccgatgatcagtctcttggtctccgccgctctttccgttccattccatctgtctctcatcaattgtcgaatctgtctcttaatcgctctcacaatgctcgcgttcatccttacgccgttcgctattcacctcataattctcgggaccctaggggtgggaaggagtattcctctcgccgccgccattaagccaggatgacctttgcaccaccttctcggatgccgaattgccaatctatttttttatgttaagccgaggggaccgtcttttgagagggcggggatgtggtattggatttatttggacccttctttttatttttatatttgattggcgttttgtttatttgaaatgacctcaattcttttgatttgatgatggtgattattattttttttgctggtgattattcggtaattgtggatattaattttggccgtggatttttaattattggattttctttcgtttgtgctttgtcttttatttggaattgttttttattattcttgttcacataaattattttctttgtcgtgtttattctaaagcaggtattctccgattctcagacattttccaatttggtcttctcgcattgtgttaaaattaataccaaaagaagaagaattggtttgactttccaacatggcgctcctggacgacaaaggtctggctttatggcattttcaattgaagggaaacatcggtcgtaaaatttgttgtgaaaaatccaaacaaaaaatttttgacaaccctcgtgttgggttgactccattcggatttttgtccgagcttacaactttcttctcgccaaaagcactcgtgttgtgcttcgccaaattgaattttttttgtaaaaagctcgtgctgctttaaatttggaaattctcaatttatctcgtgttgaccaggactcttccaaacagttctccgcgtcggcaattttacttggctcttctgccactgcaatttcttagttttccttcaaaattaccgctttttccgaaaaatttgtgattgctgccataatttttgcgtttctgcccgtactcagtgcaggttcgactcttacgctgttgtcttcgtcatttgcaatgatgagcacatttgtatcattaaaaatgggtggaacagaaagttcaacaaacttggttgaaaacggttcaaccactgtgttgtaaacgacacgaaccgaatccgatttattgtttgaacattcaaattcaatcaattcaccatttggggcaccgaaaagtttgaaaccaagaggccctaaagcattggttccgaataaaatgggtaggccaataggggcatacgtgatatggaaatcgatttccatttcttcgcaaccttttctgaggacaggaagtgagacagttccataacattcgacgagttttccatttacgtccaccacattccgtgatttggggcaaatgttaatacttttaccctttaggcctaggcgctttaaaatttcccttagaaattcggccttaataagcgaaacttgggccccgctgtccaacatcgaaggggttgtttggccaaaaatttcaacaataatggcgacaattttcccgattgttgaagtctcagctttactctcttcctcattttcgcatttggcccaaaattttttgaagaattccagcatttctgagtcgctgctcatgacggctccgcatttgaaaacatcttcatctttcacttcgttctgttccaccaactaattctgtttcagaaaattgcgtgattgcggaagttgtgagcgattttgactggcaaaatttagctctggttttcgcgcaacgctggtgttctgatttatgggcattggcgtccggtttgcacccgttgcattttgagatgcttcatagtttcggttttggccactttgctcagctcttggtctgaagcaat

SEQ ID NO: 5681 - DNA, 4178 bp, Heterodera glycines
ttcccgatgacgagctatttgtcgcatttgttgaagacgtttcaattttgagaaccattgcattgaaacggaacgccagaatttgttggcgcacgtcggattactatcaaagcgaaagggcaaaggcaggtacgatattggagagaccgtacggtatttgaaactacagtatgaagcataccttggcgttgtgcatttgttgaaaaagaaatggaattgtgagaaaatgcaagatcctatgttaagagaatgcaaaaaatttaaagaatatttgcttgttttatatgaatttttgttcaggaaataccttgaaggtaagtaagaaatttttcttaaatgccaaaaaatccaaaatttcgctatttttttcatacataatttgtgtattttttataaattataattttgatatttttgagatttatagaaatttcttatgagatttaaaaaaaatttttcaaaaaatataattttttatttacatattttggtacatattgggagatttacgtatatattcctatttttttacatttttacttaatattttatggtttttcttaattataaaatttacatccctaattattagttaattgtccatcgttccaattcgccaccacagtacaaccaatttttgtacttggaaacagcaaaacaaatgcgacaataattgacgttttggacagtcttggcattatttgggcattcttttttgattatgcgtatggccaaaaatatgagaattacttggaaaagttattcaaagaaaaggcagcagcagaaccaaaatggttgaacgaagaaacaattgggcataaaattgtgaacaatttacaacaaattaccaaatatggcgcagattttaagcaaatctttgggagagaaaaaccagataaaattgacgatgagcttaagcaaagtttattaattgatgatgctacaaatcagcattcttcaaaggcaaattcagacaaagcaattcagtcattccgtgaagcatttgatggcataatcaaatcgatggcggaaacggcaaaaaccatggaggaatcggaggaaggatttggcaaaactaaaaaaatttgcgttatctattcctttgagatcatttcgagaattatttctttctctatgctttccaatcgtgagtggaaaacctgctgattttacgcaagccgatttttcatatttttttttgcgtgggatttcttgaaaatccggaaaattcagaatcaactattcttctgtccaaacaaattggcctttaacatgttaaaaatgaaaaatcgaatttatgaaacccaaaataatcgggtattgaagaaaaaatcaattccgctcactgtttttaaactttctcaaattttcttacattgttatacccttttttttcacttttcgggggggtcatcagcagggatgcaaaaaatatgcaaatgtatatttttttcctggagggggggggggggggcttctaatttagaggggtgggttctaaaacgaggtaagtacggtaaacaaatgaatttttgttaaattttcttttgttagtttattgttattctacattttttagcgaaatggataaaaaatgagactttttgagaaattcacttattttttgaacaatttttttttcaatttttggcacatattttggccttttttgggcttttttgcacctattttggggttttttttggcacatatatatgtacatatttgacgttttttagcacatataaatccgttccctgatgataatgaatccgcgagatttgaaaattttcgacaaatacattaaaaacaaaaattaataatataaaatttattacattttaaatatgaaattctctgcaacaagtgattaatactattctttatcacgtaaaatttttttttatatacacataatataaattttattacgaacattaaacaagagtttttggggtccggcggtcgataggcgccgccgggaaaattttttaaaacttggttgcaaattgttaacaggttttcatcaaaaaatttagcctttttgttagagtccgtgcctgggattcaaaataggtcgaaatggatattatattcgttattagcgacccagaaaacctcatacataaggcatgtttttacaactttttaaaattttaaaaacttttttcaaggaagctgtgataccatctaaactattaccaaaatgagggagggttgcgcgacaaatttcccattgcatcttcctttactttattttactctcgtttctttccccattgtcattgactctcccttattgaatccgcgatgcgcgatccgcggaatttttgaatccgtggcaattttggataaaatttttaaaaagaaaaatatattgaagcgattgttttatatttaaaattatttaaacgacggtgggggtcggtttagtctggccgttttagtctggccggtttagtcagagggtcggtttagtctggccggtttagtcagagggtcgttttagtctggcaagctgtttttgtcctacattgatccaattctgatttgtttctcgaaaattctttaaaattaacaccataacagatttatcaatgtgttaacaacaaaaaaataacaaaacattgaaaatattacgggcgcatctcataattccgagaaataccaaggagaaaattgatgatgttataggggttaacattgataagggcatggtaattgtgatcattttggtgagcctggttattgttgatggcattgtagctctgcaagagtcgaagaattctcgcatcggcggcacgatatttgggcgccttttgaggagggagttcaccagcgatgcatcgggcgatgtctgcatcaattgatttttgctcacatcgaattgtgttgatgaagcggaagacagttggatgtgtacaatcaaatgcccgttgaagttttctatggtatgcttctgcgtaattgttggttctgtctcctccatccaacgtccgttgatgcacactccattcatccggtgcgaaccgaggcgctgtcaaaccaccattgaaccgcggccttccggtgtaattgtccgtgaacctttaaaaaatattgttgattttccattcctaaaaattcaccaatcgaagacgccaataagctgttgagggagttgtgcctccaaagcattgaggacagcaggaagatggtggacaggaagaaaagccatagatgtgatcattttgctcttttcagcaaatacggcgtcgttgttgtacgtcttaatatgaaaaattttattggggaaaattgtaacaatgcaatacctgtgttaaaccctctgaagcaattcgcttcttcatacttctcaccaagtgaaaaaagcagaattgcacacgacaaagtggaaagactgtgcggacagtagcgaccatcgcttgctcgaagtccaacgatatggtgtcaggtgcaaaatttggccatctttggacaatcagttgaagcatccgtgtgtatatcacttcacattttgaagtgagaaggcagtacgcaatcggaaaaccccatttatcacgcctaaaaagaccaaaaaaaagtggtaaaaaattaaggttttactttgcaaggagaacataaatttgactgaacaaaggcggcgccaaactgaaagtgccatctgcgtatacatttttcataataccggcccattccgaagtcgaagcgcgagcaaatatcaaaattcttaacatggaattttttaaaaattaatgggtttattatttttacctttgcggtccagcctgtccctgaatttgaaaaacgccggtgtccgccaataagaaattctcctcgtcaatctctgttcgattgtacattctgtacgcgggcggcaattccaatgcttccaaactgagtggtgcagcaggtggtacatcttcgtcatggcgaacacgttttataacctaaaataaatgaacaaatcatactttggcagaaaaattcgtaaaagttgaccttttttgtcgctgctttggtaggaaaaacagccaacacgggggatgctgtgttctgcaacacttgcgcacggattgttgcaggcgcttcgcacgtgtcaacttgcacaccgcttgagctgggtcaaccgcctctgacactccactggccggggctcatgtcccatggatggcttc

SEQ ID NO: 5682 - DNA, 2323 bp, Heterodera glycines
ttttcaacatttttggccataatttttttgaaaccccttccaattttttgaaatgcaggataatagaggacacataggtctatcgaataatagcaagaaaataaaaataagaataattttaactaaaattttttaattaaaaatataattattttgatcatcaaaaattctgaccaaaaccaggattccaaatgtctgaatgaatgcatagtataaaagggagttgtttcagcatttctggcgaaagcggaaatgtttttgaaacatttaaaatttgtttctttttaagcggcactttaaacaaccaaatttggcttgacacgttggcatggcttggacgtggagaggtcggcttgtacatggcgctggtcaacgcccgcttcttgcacatctctgagcgcgaaccgatagggacaggcgccgaaacgatgatcgtgaacagcgacggctcccgcttcccgtcgccactgcccacagcacagttgccggaaaatgtcgtcggcttcaacagcatcaacattcggtcgacatttcttcaacaatttcacaatttaatttaaattgttccccatttttgcaggtatttcgacggtgaagtgatcattttcctgcaccgaattcgccgcctcttctccacggacgtctctctgcagttcaacattcggccgacggaatctcgagcttggaaaacgatggcacgtcacatttggcccctgctgaagaacggactcatcattctggtcaacatgaagcggacgcacctcgccaggatgcacaaatacgtgtcgccgatcgtcctgttcgattgcccagaacttgtccaaatcagcagcactgttttgcccgagagtccgaccacttacagcacgtcgcctgacttctcaacccgttgcctgtacaattggctgtacacgccgcgcccagatggtcgtccgctggtgttcaaattgaccaaatgggaagcgggatgggagaacttcgtcaacgatttgttcgcggtgggtgtggggtgggtgatgatcgacggatggattttttcgttctgatcaaattttccgcttttagtccttcagtcgtgcgatcgtcccggtcaagtacatggtgctcgcttcgttcgacgtcaactacacccggagtgaacaaatggttaacactctgacggaggaaaagctgacgctgtcgagcgatgtgcatccaacgccggatggtggttttgtgtcatctgtgaagattctacgttgtccagcggagttcacggaagcgaacgtgatgtcctggttgcgtctgccgcgtgtggccggcgaatggcacccgaatttggtgaccattggcttctcagatgacgaaattgggtatggacgagttgaacaaatttaagattcagtgttcttatttccttcattttcagaccgatgccttcgaacagaggaaccgatcgggctgagaactgagaaggataactgcggatcaacaacagatgagccctaagcacaatggccatcgaatgaaattatctctgatcattatcactcaaaaatatattgtatttgacttgctaaaggaagtaaagcaccgaacaatgctgtatttggcatcatgtagattgtggtccctccgcctacccatgattcgtcgggacccatgcgtttcggcgccagctcgtttttccactacagcttttttctatggcatctaaatccaacattttggtatcattcgaaagctcttaacatgctctattatccttaccaaaagcgaaaagattttgaagcctggaaaaaattttaagtaaaaacttcagaaatttcgatttttcgcaattttcggtagttgtctaatcgcgaacaatagcttagaaaaagcttctaaacatgttaagatttcgagtgatatcaaaaatttctatttggttgacaaagaaaaaaatatataaccagggaacggatttttaggttttcaactattttttttgcggatagcatatgctgagataagcgcaaaaacggcgacatgatgtttggtcaccaggaagtttgtgcaccagaaatttgggcaccgggaagtttgggcaccagaggggtgtccacctcgtttcggcgccgctcgttttggcgccagcccagtttttggactataacttttttctttttccgccaaatctaacattgttggtatcattcgagagcccttctgatgctctattattttgcataattctaaaaaatttgatcaattttgaacaaagttatggtcaaaagtacacatatggactggttttttgatttcttctactattatttttttgagcattgactgaaatttt

SEQ ID NO: 5683 - DNA, 2569 bp, Heterodera glycines
aaataaaatctcgaattctcaaaaagcaaacatttaaaatgaatttttttgtcagaaaaacgaaaaattctttaatttttgttttttaaataaacttcagaaatatcaaaaatatatttcaataatgagaaaaaaaaatttattttctagcgaaaaaaattctgattggaaatttgcaaagttttcggtgcacgaattggccaatttactcgcttaacccaaggaaagggaaatgcgcaaatggatactgtatttttaattggtacagtagggccgtaaaattgtttatcggcccaactttgcacttttcgtaaacattcacgcggaaaaacatggactaatgaagcatttaatgattagggttataagttgtgaaatgaagcatttaatgattagggttattagttgtgaaatgaagcatataatgacggttattagttgtgaaatgaagcatttaatgacggttataagttttatactttttttttctttgcatttaaaaagtgattttttgtgtttaaattatttggtttggttaaagtttttgtccgtataaatccattagagctcgacattttgaaaaaagcctggacctggatttcatgaacaaaaacccagaatatttattattattattattattgtttttaaatatatttaatctttttgataacttgccataaaaggggtactcaaaaaaacaaattggaaaatattatccaggaaacccagagttggacttgctttttctggataaaaacccagaaaaatccaggcccaggacaaacccagtttgccgaaaaatagcctggcctggaactaagcctaatacaccgcctaagaattgaattttttgaatttttaaaaatacaaaaataattcgctttcaaggaagtaaaaaatgctggtccagggttcgaaaaatggccaggtgcaaatgccatcctgggaaaacaacatctcaaaatcgcaaattataaaatggtggttattcgtaaaaaaatcacttaaaattaatatcagaaatttaattttaaaaacaattgaatttttctttataaatgttgagcgtttcaaccgcacaagacctttccaaacaatttcattgtttattgctttaaaataaaaaaagaaatttctattttagcaaaaatgggtacgttccaaaattaaaaattttaagattgcttaattgctgatacatttttcaaatgtcaacgaataacgaggtaaaaggtgaaatatttaattttaaggacaattcaggggaaagggtcatttcggcgccaacccaaaaataaaaacacacaataaagggttttaaaggacggtgaatcagattatgacacccatttcgaaccccgaacccggactcgtacgaaaactcgaaaattcaattttcaaaaaatccacatttatgcaacaaaaacggttagacctagttcgacccaaaaactcaaaaatttaactattcgaccttttgttcgaatccaggttcgggattagaaattggtcgaaatgaatgctatatccgtgatcagtgacctcgaaaacccctgcatacttgttttcaggacttttaaaccaaaaaaaaaagtttgaaaaaaatttgacaaaaaatatggacccaaataggcatagtacccaattttcgttaaaaaaaatttctagctggtttgattttttaaaattttggcttagcgccgaaacgtgggcgccgaatcgtgggcgccagaacgaccccgaccaaattcggcagaggaaaaaaattattggaaaaattaattaaaatataatatttttttatttaaattttccagctcattatactttgggattaagaattattttcaattaaattcagctgtacgatctttacaaagatgctggattggtgccaatcgaaattgtcaccaatggcattattgctgtcatctgtttttccggcatcactctcaacatgttgcttgtctatgtcaccgtcaaatcaaagtgaaatgccctcagatttttgatgccataacttaacaaaattaattgaaaaatgcaaatatagaaattaaaaaatatatatatatgatcttaaggacgaaaaaatttgaaaaacacaatttttggggaattttctttataatattaataaaaataataattttcaaaaaatttgtaaattcaccttaaaagtatgacaaaaatgcaaaatttcgatttttaattgattttttaaaatttaataagttttagccttattttatttttttccttctaaaataatctttaatacctttttagccatttttgataattttactttaagttaacgaattttagagaaatttgaagatttgtctacaatctgtaaaaattttgggtcaatagcagttcgtacaatgggcagttcgtacaaaaaaaaatttctaagaattttcaactaaaacttagaatttttcttgtaaaaaaatctaaatggattttctagcctagaaaaaatttttaaaacacttaaattttcaagaatttaaagaaatttaaaaaaatcagctgaaaagttggtaaaaaattttaaaga

SEQ ID NO: 5684 - DNA, 3003 bp, Heterodera glycines
aggtgtctatccgactctttaaaaaattgtaaatttcttttaaagatttatgggggacaaaccatataagagccgaattcttaaataacacatagataggcatgtacttaatcgcattttcttaaaattacatgacactgcgtaaaatattaattgtcattttagagattaatttaatgaaggccgaaacatttaacgaatttgacttttacgagccatcttcggtgtgtcaagaagaagtaatcatcctttcttaatttttttttctttgttttgtaacatagaacaaataaatttaaatgttatgtttatgcatccgtctttataataccgaatctgtgtgcagaatcccttctttttaccttaagaacggagtggcagttgttgtgcgtaagcgaccagattatgtgctgatgtacattcttaagctgggagaactctgtgttctgttgcggagacatgccaaagttgggaggttctcatttttaattagtttcaaaaatcaaaaaaatctgactttagcatagccgaatttgacgcaaagttcgagttggctgagttttatgacatttcctttgtcccggtggcggaacaaaaggaatttggacgacggaccatccaatggatgtgcacggatgacgattttcagctgaaccaatcggattggatggaatcacgcgtttttttgggcggttttgttcaggttgagtatttttttcggctccgattctgggatttcgaattatttatccgtgatcaaagctcggaatttttttcgggggttgtaaaattcatatatttaaaaaattagatgtgatggataactaattaacatgacaatacacaatttatacatcatattttacattaataaatcagttgtaggtctccgtttgctgcaatttcatcgacgaaaatctgacaaaattctccggtgattattggacagtatccaccggtttgtacgctgatgttctcattgcttatgtttttttgtataataattcaattgaagaaacccttctttttggcatttgttattctaatttcattcattttttagatttgggaccagttgtatgcaaaaaatccttctttaatggtattatatacaaaagctttttaattgacaatgtatagtgttatcttacaattattaatccgttacagaattctatggcactgctgtggttttgtgggtcacttttgtcaagagcaaagaaggatatcactggaaagtattcgacactgacaaccatggtgtcatccccgaggtcatttcgcacattcctttcccatcattccattttttgtccaaaatttgttccgattaaatttgccaggcaaaagtccaaaagttggtcaactcaatgtacgacagtttgcacaccgaaacaacgtccactcctccccccttttcttcgctactccctcatttggagcatgcgttcgaccaattcttcgacggaatgtttccggtgggttttggcacgcccaaatttcggcattaattttgcctgtttcttagcgtcgcgaccattcggctcaaatgaatgtgtacaacggcaacttcactttcactgtgcaaatcatagcgattttataaataaatgattttttggatttcaggtcgacgtcagcggtttccgccccgaggaaatcaaaatggaaatggacaaaaatgtgatcgtaatcagcggggagcatcgcgagcagaaataccgtatgtttcgtccttttttgcaatttaattcaacttcagacatcattggtcaccgatttttcaatgcatttaaaccaattttgcgttgacaatacgtacctaaaaattttccacgaatcaacaaaatgttcctgtataggagagcaaattaaaaaaaaatttccgtcaggcccgtatccagaaaaaaatttcagggggccgggcggcatccgtatagctttttttcaggccaaaatttttttcgccggtgttttttcaaaactttagcgccatgatacgggcctactaattaggttctacattaaatatttaatttcgcattgtccttcataaacaggcgaatcggtacaccgtcagttcacgcgtcgtgtgctcatcccggagggcatcaaatcggagaacatcgtgtgcggggtggagaatggtcggctgtgcatcttcggcacaactgaacgcggacgcacaaatgaaacagaaacggatgagttggccatgggacagccgtttatgcagaaacattagagcgtcttttcttattttattttatttttatattcattgctgctggttactgtgtttttacgatccgctgttgccattaattggttactgtatttcccatttttacgaccgtttccattgatcactctgtctttttgttttttttatgatccattctttgctataggtcatactttttaaaattaatcctacgtataaatcgttccaaattgacaattgtttttcgaaaaatttctcacaggagtcatgtgttttaattattttcagcgcctcttatttgccatcctaaaattagaaaatcaaatctctaattctctcgccatttctccgtcccattccctcattttttggtggctaattggcgcgtaaaactcttctgacccgccgccgccattcatctgtctgtttctttcgaaagatcgctttttccctccgttgcttttctcattccttttctctcgcatctctctctctctaccctttgatcaccgactgactctaatcctcactctctctctctcttccttcctctctctcatccattacatatctctctctctctcccccccaatcattaaaattgctgatgggacacatttcagttggacaaatattgttcaacacttcgcatcccttaaaatttgataattttttcaaatgttcatttgttggtttgtcgacgttcacaacaaccactttctctccttcctttccctttaattaaacccttggcaatttcattagcaaaatattcaatt

SEQ ID NO: 5685 - DNA, 2581 bp, Heterodera glycines
  misc_feature (2575)..(2575): n is a, c, g, or t
ccgccgccattcatctatctgtttctttcgaaagatccccccccgctccgttgcttttctcattccttttctctcgcatctctctctctctaccctttgatcaccgactgactctaatcctcactctctctctctcttccttcctctctctcatccattacatatctctctctctctccccctctccactccctctctctctctctctctctctctctcccccaatcattaaaattgctgatgggacacatttcagttggacaaatattgttcaacacttcgcgtcccttaaaatttgataattttttcaaatgttcatttgttggtttgtcgacgttcacaacaaccacttctctccttcctttccctttaattaaacccttggcaatttcattagcaaaaaattcaattaatttttctaaacttttcaattttctgagaaataaatttcattttctttcctcaaaatgagagttttcttttgatttttttaaatttctattgaattcctttcttatttatcatcgcttttgttctacgcttttttttcttcgtcggttttcttccgccgtcgccgcttttgatcatttgttttgttctctcacactttgtctccccaaattcctttcttctctctcccttcccgcactctctcagtctttcctcgtctctcacttctatcccattagtttgcttttttattctttttttttctctcgccctatcattttatttttgctattaacttcattttctctctttctctccctctatcccttcgttgatcagcatttcctatcctccattttctctctctctctttgtccttatttccttcaccctgatcctctctccccttaccacattcactttctcccctttttctatgtcctctctccttttaggcacccattctcttcactttcgttcgtttttctcttccctctcgccctctgcttttactcatccatccaacacttctcttctcttccctccctttttgcttttgcctatctcttccccaccttctcttcattttttccttcccatcatttgtctcatcagtgtgaattgtttttcctctgactgtccctttattttcccccgtatccctccgagtgaatgccattctctctttttcccacttgtccaaatataaatcccttctcaatatcattccatcatttcctccctctctcatcctcgccgatcttttcggtcttttcctgctgtctattagacatattttccatgattgttttgttgataattatgatgataattatgatgctaatgatgtgctgggattcccttgccgccgtcgttttcagtcctcgccgctctctaatgattgagaatgaattgaatgctgttgatgatgaaaggggaaggcgtgtgcttgtgctgcgtgtgatgtgatgtgattttgttgttggtggtggcgtgtgcggccggcgaccaccactcgcttatttcgctcgcattcattcgcccccggcagtttttatgtgggcagctgcgccgccgacagccaatcaaaagcaaacggcggcggcggaaggagcaaaaagcaaaacaatgcgatgcgattgagcggcggcggcgatccccaaaaacacacacacagaacaaacccattaatacgtcgtcaaatcaattgaccattaacaaaaaaacggacatatccggtgaaaaatggacccaaaaattccattgatcactcattcttcatttattcatcatttacgaccggcgggtccattttgaatcatttcttaatcaattctatttatcacattcaatcctttattaattgataggcaaaattgatttttgaatgaaaaatgtctgggaattacacgtgctcctttcttttcttccttaccaattcattcgctgctttttccacttccgctttttctcatttcttccgctttgtttctgttgcatttcctctgtgtttttctcatttctttccgtccgttcgcgcattccccccccccctcgccccctccgctccctctccgttaattgttctgttttattcgttgcttgttcaccaccggttgattaggtaatgcttttgtaatgatctttttaatgagaatgctaattgggcgtgcattttgcatgtgttccttttactttctaattgtatatacaatataattattgtatgtgcatttattacttatagaataacacactaacgaatgattgattaatcattagtgtcttttgtgttaatttatatttatttactccttttgccacttttccaccgtctgtaaatgtctattttttcaaatttcactttttgattgcttttttcatgccaattaaatcattatttcaatattatattccaccttcaaattatgaggcatccattgctcattggctttgcgagactcttgagtttttgtcctcatttcttgagtctcggaagggtaaaacaactcatattatacatttttctttcataatattggtgattcatctcttcttatcatcaacattaaaagaagcacctctttcgtctgtccgtcttctgtctgtccgtttgagtcacaangggtta

SEQ ID NO: 5686 - DNA, 1254 bp, Heterodera glycines
aaaaagaaaccctttctttcccaattccattttggccttattcatcattgattacttaacaaaaactccccattcattttatattggttgagcatttctcattttacaatttttgtaagaaattccatgccttttatcacgcgcaattacccaaaaaaaagaagaattccacaaggcaaaccctccccgatggaccaactgactgattgagcgccgcgaaaaatgaatggggggggggggggggaacgcaaaacgttgcagcaacgaagcagcagcagcagtatgcttaacataaatgttgaaatgggtgtgctgctgctgttgctgcgctgggctttgctttgacgctgatcacttctgacggcggacgaccgccgccgcaaaactctgacaaattaaaaggaaaagaaaataaaaataaatatttgcaaattgcgtttttgctctctctctgctgattgtgagttgagtgtgtgatcgttgtgttgttgtgtcggggataataagtgatcggccggacggcgatttgtttttcgagtgatttgatcccccccccccccccttctcccatttcgtacaaaaatctctttcggcgaattgcgtacgccacagaaacaaacacacacagcgaaattgcgcgactcttttctacattagtgcgctatgggtgatttatgaatgaatgtatcatttttggttgtcgtcgctcatttgttattattaaaagtaattagtacgggcagagtggaaaagaaaactgacaaatgagagggatggatgtgtgaatggggtgcttatcattaattaccatcatcagtcaccgttttcttccctctctttccctatttctttttttatgtttcgtcccattttcatcacgatttgtgatcattcattagtgtatcattacggatgaaaaatgcagagcggtcggtggccagaacagaaagagaggggaagaaggacgagagtcttgactgttgactgatgaatggacgtgatgggtgggacacacaaacagaaggagaagcgaaagagagaaggggagaggaacagaagtaagagagagagagagaggagaggaaagggagagaagtgagagaggaggagaggaaagagatagtgcgtgtttgtgttatcttatgttctctgcttttactgctgctgctactgaaggagttcatccgtcgcattcattattcggtcgcttttcaagcaattatgagggaaaataacgagaaaaattccctctcc

SEQ ID NO: 5687 - DNA, 3976 bp, Heterodera glycines
tttggtcgtttgccatcgtcgtaaggcattaaaggcaattaattaatgaattgttgccgaaagatacatgctcaaaagaattattgataggatgaagctggctggctccatgttgctcatcattctgccggcatttattatgataatgtccgcgcctgttgtgtccattttccaccctaccgtaaccaatgcgttcggttcccgcgttggcaatgattacggtagacaagataaaggtcaaacagcaacaagatttttttttcattttgaaatttagccctaaatctcagcaaccgacgagcatcggcaacgggtgtccgacgagctgcggaaagtcgccaaaatattgacggagtgccgatgccatctcaaaatggggcaggtaatgttgccattgggtgtccattagctaataaaaaaaaatcctatttttagtaattaataatgctaaaattagggtcagattacattttagtgccaataacatttaagcagagccaattaatttaaaatttcttttgaataatttctgagaaacaaaatgctttcggtaattgtgattttaaaaaaatcattgaaaacgcaagcaaaaagcaaattatcgttttcaaatcaaatttttttgaaatttaacaaaatagtaaaattctcggatgataactagaatgtttcttttaactggggatatgagaaaaattatcatttaaataaaattaaataaaactccaatgcacaaaaattgccactcccaaagcgcaattggtcataaaaagcaattaattaagtaattagcaaaacaaaattgttccccattcccaccagcagaaaatagtgccgtcgttgatgcgccacagcttgaagaagagttgttgctcaccggctcatccccatccgttgaggaggagcagcaacagcaactgcagcaggaggaggaggagaaggaggtcgaaatgctgcacatccacggcatggaacagccaccacatcagcagcaaattgttgctggcactgcttcaacttttgctgctcatgctgctggtgccgcttctgtggatgatatggggccggccgccgcttcaaatcggcaaaaccgtcccgcgagtggcagcacgctgccgcgcagccgggcacagtcgcaggacgccgacgcgggcccgccctacgcgtcaacgccgacactgtgcccaacggacgaaaacccgacatttttgcgtcatttatggcttccagaagagcccgagggcacggagcggactgcgaattttgtgcgcaaaatggactcacttgaggtgcctacaacaagcaggattatcattagtaaacttagcaacaaaaaattagcaaagctcgagccctttttaacccaaaaaggaaatttgtctctcaagtcgagactcgtgactttcgagagcactaatgtcagggtattcgagggaattgggtgttactttcccattattatagttggtccctcttccctgtcttatttgttaggcatgtgctcggctatgtcgtgacaacgttgagccgtttgggggacggcattttgcgtgccacggcttcacttacattggccaacgaaacgcgcgcaatgcatgcgaattctttgacgaccatttggcggcggcacttgagaagaagccaccgctgggcgccttccaccaacagggccaactgctgagggccgacatggcaccgcaattcccaaaaaattgtaattagccgcaaaataatggaaaatttttcaggggatttaaaaaaaattgttgcaaagattttgagcgcatttgccttggccttccgtcccgttgcgcgcgtttgccgttcgcttttgacgtgcatccccgcaaggcattgcacgtcccaacggaggcgaagccgttgggtgttgagcaggtggacgaccggaagcaatgcctgcagcaatgtctgaacacaaagggatgccgatcgttggactttgacacggccaatttgtaagcaaaggcaacctaaatcatatcggcttaatcaaattggagtttttaaattggctattttttcttgtgcctttttaggatttaacgagttttaattatatatatataaagtaaatcaattgattccgctgattctgagctaaagccccgcttatgactagcaattaccgcatcccatttttaaaaatatggtttcactaattgccaaattttatgatgtcttttccgtcatgtccgtatgaacggagtttgccattctgtccaaaatgcaccaagaagtttggcattttggtcaataaaaatggcatctcaatggatacctgttctgtcgagcatcccaataatccccgttccccgtcaattggcaggacctgctcactttatgcacattcgctgcacatggcactcggagcacccgaagaaagcacttggcccctgggacaattggtgaaaaacgtggacttggaccattacgagaacacctgtctgactggtcagtcagtccatttgccgttttggcattttccgaaacattttggcactctgtaagcattggaccgatgcggaagccgtcacctggcctttgttctaatccgaaatgccgaactcgcgggcttctcggtcggtctgggcaaaatgtccgtcagcgagtgcctttcccgctgtttggactcgccgcccgccttttgccgtgccgtccaattccgaacaccgggcaatgagtgctttttgggcacggagcgcccattcgcgccgctgccatccgacgacatggacatcttcgagcccgtctgtctgccggacccgccgcgcacatcaattttggagtgccacggcgaacacgtgttcgaacgggtgggccatcgaacagccaatttggggaaatgttttgagcgtgaccaattactgactttgtgatcacatttcagaaacttaaacgactatcgatcagttttaatcacttttaaataacggaaggattttttgtgctattttgaaatgcgaatattgctttcaaaatattaaaatgaaaagcaggtgccaaacatggaattgcgcatggacgaggctgaagacggtccaattgttggtggtgttggtggcatggaacaacaacagcaaagcgaaccgggattacaatatggaacaggtaaaattcaatgaatatatttttagaattgagaattatcttcgacaattcaaaaacttgatttaataaaaatgacttggactgagtccaaaatgccgcttctttgcttaaaaaacttgaggctcggggtctagatcatggcaaatcccaatcgagatcatacgcaatttgagactggtaccattcccatttagacatgtcgggactgacattggagcgctgcttggatgcgtgcattcttggtcaactacattctgtccgtcactcggcacattttccctgttttcagatgagtcatgtgtgtcgctcatttttcgtccattttccggggatgacaacgaacaacggaacggcacaggcgcagtccccggcgccacttccatgtgccgactgttcccatttggcaaaatggacaatcgtgggtttttattttgattttaaatgttcatttattcgcgtgccattttcgaatcaaaatcaaccgaactttgaggagaggcccaaaattttacattgaagagctcttaattaacatttctgagaatcgccataggagtcaaaatttaaatttttattttatccattttcggtactcaattttccgtacaccaaaacttccagttaccttagctattttaattatgatcagcccaaacatcttggcaccgtcgttcaggcactctctctgtcatccatccaaacgtggattattttgagctgagctgcaaccgtatgccattatcgttcggcgaatgctgcgaaagatgaatttaccggtgcccatccactgcccgccggccaccgattggaggaaaatgacaaccagctgaagaagaagcaaatgacg

SEQ ID NO: 5688 - DNA, 2880 bp, Heterodera glycines
  misc_feature (35)..(35): n is a, c, g, or t
  misc_feature (39)..(39): n is a, c, g, or t
  misc_feature (95)..(95): n is a, c, g, or t
gcaatgcgcaaaatgattacggtgccatcactgcngccngcacaaatggagggaaaatgacaagcagctgaagaagaagcaaatgacgacgacanaagccaaggaaaagcagcagcaacaggtggacactgctgctggagagaaaggcaaaaccgaacagggacaaatggacacggtggtggccaatgacagtaagtgatcaaaccattggtgatcggggtcaatggcaactcgtacaaaggcaactcgtacaataaaaattttcacaaaattaagcctaagcctgagcatatacctagcctaaagcttaggcctaatcctaagtctaaagcttagggctaagcctaagcaattgtgttgtcatcacagcacatcggtgatcgaatgttaagccaagcggaaggcattttggagatttaaaaaagtaataagcaacaaattgtcaagaattgtccccacaattttaattaattgttgaagcaaaagttggagaaccgaaaaacaaaagcagcacaatgagagaggcagaagagggagaagaagcacaaacaccaaatattgtcacttcgaattggccaactttggcatcgtttggccaaacaacagcttctttcgcttttggcagttcgacaaccgcactagcatctgttgttttatcggaacaattgtatcatgccacgggtggttccgctgatcatccaaactcaacactgtcaccattgtctaccgtatgcattttggaattgaaaagaaaattaaatttacgatttattattaaaatctatttcttggactggaaaaaagggttttcaaaaaagaagtaagtaccttgaaccgttttcacgtgtagtgatatcggtttttgtaaaactgataattcccttccgggaaagcgtttttaaagagagaagtaccgaaaccgttttcttgtgccggtggtatcggtaaaaataccgtatgcatttttggattggaaagcaaaattaaatttacttatttattttgtatttttttaaacaaaatttgagcttttgtggccaattatttttttgtagttttccattggacaatttctttgttaaattttattaaaagtcccaaatatttccttcgctgggcctttcgctatttgccggcccccaaacccttttaaattttatacacttgaactttccataaattatgacgcaaagatacataaatgcaggaatcagacagcaaatgttctgcaaaaatgttgcacagtttgctgttggagcggggccgcacgctgaagttggagcagcgtcagcaacaccaccgcaacgtgacggacgcgttgcactgcgagcggttgtgcgccgacgcggacgatgtgccgccatcgttggccaccagcgcgtcgtcgtcgtcgttcacatgtctagcattcgcgtacagcggccggtcgcacgaatgtctgctctcgtccacacgaatcaaaggcggagcagcgggagccgccgagttggagctgttcagccaggcggacccggactttgacctatactcattcgttgatagtcaaatggatgaaaattgcggggacaaatggtcgacgacgacggcgagcagtacagcgagcgtagcagaagtgaatggtcagtcttgttattcaaattgataaatttgaggtgaggggtggttcaattcccagccgcagcctttcaagtaatccagtcgaaatgacaaatgccgatcactcggcaatggatagtattgtcggtcatgtcagtggccgcatttcgagtgttaaatatgaggcaataaaagtcaggattttggtcttgttcgtggaggcacaaatccgggataatttagcattaaattcaatcacaattttttaaattttggaaatctttgacattgaacgaccattcgcaacaaacgaatcggctgctgccgtcccttccttggtgacgacaactcaaaatgcaacaaccgaaacattcatggaaaatgccttggacaacttagacaaaacattgacaacggcacaacatttggaaaatggagttcagcaagcagtagctgcaacacaaccttcaccacttcaaccacgaaccgccaaaatggtcaccattttggcagaaaagagttcaacaaaatttgatgaaccggcgatggctcttcggcactcattgatcacagccccgacgaaagtatcaaacaaaagcagacgctcaacaacaattagcagcagcaccagcagtaggacaaccatgaggacaacgtcaccaacgacgttggcaagcagtaacagcagcaattttgtgcatcagcagcagcagaggtgtgaaaaagcatatgaaattttattccattaaaataaatctattgtacaattacgcgttacatttgattttcaattatcggattggtttgtttctgtctaaactgacccggctcagtcccggtgtcggcttttgccaaaatttccggctccgtaaatgcgtattcccccgtttttgcatgtcagcaactcgtggatggcgccgccggctccgatcagtgtggacggaaatgttgtgccgtctatggaggtgccaaatggtctaaccagcggtggtggtgctgctgctgctgatcgtctcagtgccgaacaaatccgtgccggcgtcatctgcgacccgcaagggcttaacgttacttttcgcctcgtcggacgggctgccgtggtcttggcaaaatgacattgtgcgcgccaatttattttttttgaatttcagcgatacactggcgttgtgtatgcagccgatcgcttcgcgcactgccgcctttttgtggaggaagcgaccgaatttgctttttatgtgaaccttaggagggtgggacagtcctaattggtgcaactccgttgaa

SEQ ID NO: 5689 - DNA, 1993 bp, Heterodera glycines
gctattgccaattttcggcttttttggctacggagccaaaaataatcagaaaaaatcgatcaaagttccgaaaaaccgataaatgtgggtcacagtactttttatacttatttttgaacacaaaaatttgaaacactggtgttgatcggttacttctttggcattccgtaatttccattcaaataatccatcccttggcatggtgcagaacgaggagttgaacgtggtgttagtgatgtccaatgacgaggtgttcccgcttgacgtgacaacaagtgacgacctgttcttccacgtttcctgtgacttccgcggcattggcgtgccaacggcgattggcggtggcaccccgccgcaacggcatcggttgagcgcatggcccggatcagtcaggcaaattcaatttacaaatggccaaactttggcattgtttcagtggtcccgagccgggcccactctttgcatcggcggcgagacgtcctcaaaaaaacggccaactgctgcagcgacgtccgctggccgacccagagacgggccaacgacgcgaacgcgtccatctgaaaattttgcgcgacggacgccccgtgagcagtgtgtacattggtgaacggcttagcgccgtggtggagagcaccgacgtggaaggtactgctgctgctgaatcctcttgactgaaaattccgtgagaattgtcgccgagcctagaaacccgatacttttttaaaaatttttttacagtgtaaaaagtctttcggtctcaaaaatcaagaccggattctcgagtatcttatggtaagcatagggatgtttggcctataatttcggaaacattcggtttcataattaagcctttggtgctgtccgaagttgtaattccagacgcttaaacaaagtgaaaacttgcgagctcgagagtctcgagcagcattcctctaaaactctgcttactatgcttacgtcctcccgccccgttccaatcgcagttgagcggcttcgggtcgcggattgcaacgcgacgcgtgtgggcggacgagtgccaaggcccagctccatcccgttgttggaccgtgccggctgctcgctgaacccgcacatcatcgggcacatgcgccgctaccccaaccgactggaagcaccgctgagcgcatttcgcatcgacggaagtgaccaaattgacattgtttgtgccgtgttggtgtgccgtagccgatgcgcgagccgagaggtgagtgacactttacagagagcagagagtacagtacatggccaatgagtacgataacacgaactgtgactgattatactgagggcaaataaagtgatatcttaccgacttttaagaccaaaaatttagccggtaatttaccattttttccccttccatccatcgacagaatcaatgccccgccgaactcgaccatcgccacaccggcaccggtgctgccgctgcgtctctgcgcgtttacagggcgtcgtcgtccgctggccgtgccaccggtggcaaaataacgctgcaagagcgcagtcttgcggatttgccgtccgtggccggcgattttttgacggtagaccaacgaattcgtgtattggttagtcaatcattactgttgctgatttgatcacaatgatgagtgatcagcagcagaacatgctcatcagcagatcacctttttgtcaaaaggtcagcgaggaagaggaggagatggagcggacgctggcggtagcggacgcggaagcgattgacgaacgcccgctggcgccgcgcgccggtgcgggcggcaatgttttgtccgcttcggttgccgacggacccgcggcagggcccgggacaacggacattctgctgggtggcatggcatcctctgcaggtgcggctgtgggcagagactgggcttgatcaagcgttttacgtgaagggcgccagcctggtttttggagtataacttctttcattgttgtcctaattgaatgaatttgatatcattcgatagcc

SEQ ID NO: 5690 - DNA, 3490 bp, Heterodera glycines
  misc_feature (73)..(73): n is a, c, g, or t
tcagcatctgtctaatttattaaatatttttgtaaatttatatttagctttgattgaatttgcgatggcattnacgtgaatgtcaaaagaggatgatagtatttatttaggagtaagtgtggaaatggcgaattttgaagaggggataatcattaaataaatttacacatcttacaataaaattgctggaaacaaaaagccacgaaagtagttttttattttaaataaaaatattattattatgaatgctaagttaataatttattaagaaatttatttaatattattttgcatttttttatacatttccattttttattttataatttttccaatgttacaaaatttgaaaatataaattttacttttactaaacataaaattatttttattttttcggccggagaaaagataagtattcaaggtaattaaaaaataataaatatatttttttaaatgttaaatggccaatttaggaaaacttcatattcaaaaatatcttttggatttggcatcagatgtctatttaaatttgaataaacattcatatgaaaaatttcaaacacaagctcttcaagctttctgtagtgaaaattttttgaatgaaaatgaaatacaaaatttgataaatcagaatttttataaaaatggcaaaaaatgatagacattttttgtatgcagatgagtcaaggaaaaaacatagaaaattttgaaggaacgattcagaaattgggcattgaataaagggcaatccaattataattaatcaaaacctaatgttttcaaaaacaataaaattataccaaaattggatgaatccgaaattacttcaccgaagaaaatgtcaattgaaaacaaaaataaacttttacaacatttttatttgggagtcaacgaattttttagagcatttagcggtaggaaatttaaaaaatcaaagaaaaaattattatttaactaatgtaaatttatttgaattattgttagcatataatttaggttaaaggagatcattctgatagggcaagctctaaaattattattatttttgttgaaataattatttataaaaaaaaatattttctaaagctcttgtgtatcagaatgtctgcctatccctttcatttaagcagatttttagagttcggtataccaacttccaataatttattgttatcggaaattcccgacttttttcggcatctgttgacatccctattgtattcaaaactcttaaaaatattattaaatatttttaaagaaaaaattaaaacttagaccatcaatcggaaactttggctcacaatagaagacgaagaaaaaaccgcttcaacagcctccacaaaatttgcaacctgctgatttagaacagcgaaaattcaaattttgcacctttcttttcattgccactctcttcacactaaccccagtaatttacttcattaacaaaatgtccacgggaccgagtgacgtcaatgtttggtgttttttggccattagcattgaaaatttttccctttatgcgcctacccatttgtgcaaaaattcaggagaaacttgacatgccggtcttaatcctacaaagggtctgcatcaatgtttaaagcgtaatttttcagtattttaggacacagaagtacgatggaattcgatgtttcaaatgcttaatcgtttcttacaatgcaaagctgccgttcaagtatttatgacatcggatgaagcaaagagaaacaacaaaggaaaaggcattccaatcattagcaatatcgaatggaaccaaattgagcaaatagtggatgttttaaaaataattaacgatgcgtcaaatgaattacagtcaagaacagccacaattggaatgataatgccatattatttcggaatttaaaaaaaattcatggagggaaatccaaacaccggtttttgttctatccgcaaatggtatttattttcaatttagacacatttgacattcgaatcgcaattattgggaagttggaccaaataatggacaaggaaaaaaccgaaaacaacaagttgcttaagaagtaaaaaatttcaaaaaaagttttttttagatctttgatcattgcaactgtccttgacccccgttttaaattgaagttgtttgaacaaatgaaggaacaaattcgggaatggatgagagcggatttacaaaaaatgttttccgggtttttaaacacgacgttggttcgccaatcaagtacatcgagtagttgttccacggaaaaacctgttttttctggtcttttagaagttttaattttaatattttccataaagattttaatgattttagtcatccagtgggtcatccaatctctcaattaccgatgatcaatcgaaatcacaaaatgaattttacgatgcgcttcaccaaatggacaaatatttgagagagccgcgagtaaaatacaatgttgatccttttcaatggtggaaaaagaatgaagcggaatttccaagcttgggacggcttatgagaaagtatcatagtgcgccgccgggaagtgttgagtcggaacgcctgttcagctgcgcaggatttattttgaatgacctccgaaaaagtctctcgcatgaaaatctcgaacggcttatttttcttcatcataatattatcctttacaattttgattattgataatatgggaattttctaattatgcttttacaaatgtgcgatccgcggcattttttgcgcgatccgcggcgttttttgcgcgatccgcgaccgcggcaaattgaatccgcgaccgcgggattttttttgcgcgatccgcgacagcggcaaattgaatccgcgaccgcgggatttttctgtgcgcgccccacccctgttttgaacattggacttacaattagcctattttgtataaaaattatgttttattcgtgcaaaatttcaaaaatttttacctcggctcagaagtgtctgccttttttcaaaaaaaaacaaatttctctttttaagtttgaaatgccatgaattactatatttctgacttaccgtatttgctctttttatccccccggggggattatttttcaacctcctcagaaacggggggattattagatacggggggaaaaatggagaaggggggattatttttcgacagatttatttgtctaatatttttgaaaatttaaacatatcgacaaaaaatatcatcgcgtcaaaaaaaagatttttatttcatttttgttaaagaacactctacttttcacaagtaaatatttaatatttccattggaaattaaatttctttttaaatttcattttcatattctcacaaaatcatttacatctttctaaacatttgttttcgtaagaatacaaaaaaaaaatcttttgcccatccaattcatccttctgctgctgctgattcaccttcatttttgcatcttttttcttaccgattcacatttttgtgccttttcatctccttttttatgaataatgttt

SEQ ID NO: 5691 - DNA, 916 bp, Heterodera glycines
atgccggaatgaagtcactcaatgatggatgatgtccgagctcacgctgaaaataccaaaaataatgctttccgacggcaattttttactgcaaattgtccatgcgcccccttccatgccgttgctcattcactcaattgccatttgagccctggagtagacattccaaaaccgagatctgggaaacgtgcgaggacagtacgatgtcttcgttcccagcgtgagaataagctgcatgaacaggctcacagttttcttcatcatcgcttgcagcgacgtccaaatcattcctggttgaagtgtcttccatttgttgttctgcgtctgtcctctcagcattcagtacgctgtcttcatttgttggaattcggggccttttaattggcttttgcagactctcaagtatttcgcgtacagttggcatttcttgctagaatctgaattacgctagaaaagaaattataaaaaagtgaaaggaattcttaagctttgattgatccaaaaatggttggaatgaacaaatatgaaaaaagttaggacataagaaatgatgatggtcactgattggacgtataaactggaatagggctgtatctgatattaaaacagcatttttttactctttttacttttttttctttgattcttttaactattttttaactatttggcgaaatgtcagttggcaaaatgtcagattttggcttagtaggcgaaatgaatgtttttggttgagttggcgaaatgaatgtttttggctgagttggcgaaatgtcagttggcgagatgtcagttggcgagatgtcaagttggcgaaatgtcggtacaccctaccgatagtccccccccctttttggaaaatttttttttctgttctagaaagtcgtgaaaacacgtttatggtgtccttagggtc

SEQ ID NO: 5692 - DNA, 2799 bp, Heterodera glycines
  misc_feature (15)..(15): n is a, c, g, or t
gcgatccgcggcgtntttgcgcgatccgcgaccgcggcaaatgaatccgcgaccgcgggatttttttgcgcgatccgcgacagcggcaaattgaatccgcgaccgcgggatttttctgtgcgcgccccacccctgtcacacggtctgcacaaataagagtcattacataaaatctaaaccaaaagaaaacacctaattatcatttcgaacattatgccgttgtgctgcagcgcaacgcactgtcaccgttgacgtaatgtgtagggctgggaattttaggttttaactattttttttgctcaattgttttgaagaaaggaggacaaaaaacgcatttctgcattaaaaattttcgattatgttgtcactatcggtcactagaaatcactattttggcgtttcgtcactattttttaactatttcgacattttttgggaaatttcttaacaaaaatgcaataaaaccaaaaaatacacccctaagaatcgacaaaaaaatttcaaaaagcactcctaagaaatgaaaaaaattttctcaaaaaggtattttcgtggcaagaattttaattttaaaaattatttttttatgtacctattttgtttttttgcccttaaaaatcccagccctactcatttgcaatgcaatcagtgaataaaaattatttttgcttaatttttggctgaaaattatgtcactattcgtcactattttggactttttgtcactattttggcatttttactcactattttagttaattatttcgagatttttcgtcactaaaagtcccagccctagtaatcaatagacagaacaaagtgatgccagcatatcaatcgattgttatacataagtcacaaacatttccgatcaatcaattccattctcactttcaaatcgtcttacaaattgggccagccccgctaatccgtcgttgttcagccgccgccaaatcagattccacgcatgaatatctgtcaacttcaagatcaaaatgctcctttgcatttaacggcacaagccatttgccctgcgcgttgcaattcagcgcgataaaattggtggcagtggcgtcatagacgctgtagtcagtacagcgatttctgagtatgacatgtaaggcaatctgtggaaaaaaatttagtcggagttagtaagcacacaaaattaaaggtcttgaaaatttttaatttagagactcgaatcgagatttttatttcagttttactttaagttggcctttttgttattatggaaaatcaagtcctagggatataaaaaagtcatggtctcgagtttcgaaagacgaggcagagacgacaaacccgagacttgagaccgagacccgaaaacgcaatacatttctctagtcgagactttatggaataatgtttaattcaacttttttaaactagcataatgttaattcaacttctttgttcaactcttagggatataaaaaagtcttaagtcttggtctcgagtttagaaaatcgagacagaaactaaaaactcgagatttgaagaccgagacccaaaaaacatgagacttctctagagtcgaaactctcgaacagtactgtcatctgttacacctcttcactcaccacttgaccatcaggacatcggagcggcagtgttgagcagccattagcatctgtgaccaccccggtgattgacggcgacacagcccttgcgtcgaacaggcaaacaatgtccgtgttcacttccgacacttggacccggggtaatgaggcgggatcgcatgaggtgcatcgaccaaccgactgagccgcggttgaggtcaccgggtcacctgtgtggaaagaaggggacgggtcgtcactagcgtggcgcgattttttgggatttgcaacttggggacaagacgtttggggacccgacttttgaggacccaaattttagggatccgactcttagggattccgcatttgggaccgatttacgacacttagggattccgacatttagggacccgacatttggcgacaaaccgacttttggggattcaggtgaaaaaatatattattttttaaaatattttattcagccccaaaattcgactaacttacatctgctttcgttaataaaaaaaacagaatttgaattcgcttcgctcatagaattttttttgtcttaaagattttttcaaattttgataatgattgataaaatctttttctatctaatgatatagaaggtcttttcagaaacaagtttgataaaaatttattcaaataaaaatattctatcgcctatatctttgctcttgcgcatcaatttacttaaaaatagtttggtaaaaacttcgtatcatcaatagctttcattgagaatgcttagaaaaatgcatctcttcttttttcaaaatcaagcgcaagtttatcgaattttgaggttgaatacttaatattaaaaaaaaatttttttttttcatttaaagccccaaatgtcggaatccttaaatgtctggtccccaagttgcaaatccccaaaagtcgggtgtagccgtcactagagcccgaccggcgcgggacgggaccccgcgcgtgattttgcggatcccatccgcaaaacccgaatttttggaaattatatctcttcccggaaaaaaatgttgagttccaatcgcgcagcgggatccgcaaatttgaaggaagagagacccagttgtaacatgagagagttagttggcgcatcacatttttggcaaaatgttataaattctcaaaaatttgaattttttgaaccctcatcaaaatatataagaggtgtgt

SEQ ID NO: 5693 - DNA, 5803 bp, Heterodera glycines
  misc_feature (25)..(25): n is a, c, g, or t
  misc_feature (34)..(34): n is a, c, g, or t
  misc_feature (104)..(104): n is a, c, g, or t
tgaaccgctgctgagagagcgcggnaaaagtcancaaaaaatcaatcgaaacgatgtccaaaattattgaccagccaacgtacatacacactgcatcaccagcngaagcggcgctaccgccgattgccaacattggcgcccggcttgcatactgaatggcaggccgatttagctatttttgaccgacttggtaaacaaaatcgtggcttcaagtacttattagtctgtattgatacccttagtcgacaggtgtttgttgagcccgtaaagaccaagacgagcgctaacatgatcattgcctttgatcgtatattcaaaagatcaaaatatatcccgtggaaggtgttaacagatcagggaaaggaattcactgcccgggcagtacagcagttcttccgcacaaaagacgttgaacacttttgtatgctcacttctccccaatttcatgccggaatggcagaacgtgcgaatcgtagcatcaaagagcgcctttaccgctacttcacggagcgcaacacgtacaaatggattgatgttgtgcaagacattgtttgcgcaattaaccactcgacaaattcgtgcattggaatgcgcccagtagacgtgaactttaaaaacgcagaagcattgcgacaaaaattacatgatgcagctgaaaatgttgtacgacgcaagccaaaataccgtgtgggagatcgcgtgcgcattgaaaagtacaagcacgtgttccaaaagggtcacctcccacgcttcaccaatgaacttttcacggtggcagaggtacactctgagcgttcgccagttgtttatcggttacgtgatgacaataatgaaattattagtggttggttttacgcaaatgatttatgcaaaacgctagaagacaaacaacaaaaaatgtttgacattgaaaatattttgaagaaaaagaggcagaacggtgtggaatatgtacttgtgaaatggaaagggtacagcgctcgctccaatagttggattcctgcaaattcaattagcgagaaaaatatataaaaagcattatttaataaaatttatttttaaaaaaatgccttcaaattctttttatgttgttcttccgtcaaacaccaatattgaaggaaataggacaaattctttccgagtgcgtttaccgcgcaaactacaattcaattcggaatgggaggtgggtcttgccgttattgtatatccccactcttggccctcgataggcaccgtggagcaacaatttgtacagattgagtggcagacagggaatacggtacgtatcgaagttccgccatcaaatgtcaccaacccccatgagcttagcaaaaatttatacaggctactgggtgagggaagtgatccgttggcaaaaaaggtacgatcaacacagaattctttcatgcttacgataaacaaggctcgccgctgggccagagaagaatacattaagcgaaagactaaagaaaaacggggcgtccgtgacgaagagctgctcctacaggccatgttggcagatactggaacattggttgacctcaacaacgtggcccaaggccttctgtcacgcgaaaagagtgctgcaacgagcaatctacagttgagaacgtcagctgacgataatgattcgtatcagaaaaaattggatgactacttttcaaaattaagtgacaaaaatttgaccgttcttgatgaattgggcatgacaaaattgaccgccgaaatcaaaaatttgacagaagaggaacgtacgatcctcgaagccacaaaggaaatgggaacggaagcatggattcaggcgtaccgtgagatacgtcttgtttgccaatttaactatgacgtccatagaaatcgctttgttctgaacaccgacccacggtacgttaaaaaggtcgaagtctcgcctcaacttgcctacattctcggtttcaacaacacggagtttatgcagcccgcaaaggaggcaaggttttcgccggacatcattccacgtttacacgccggatcttattgaaccaatgatgattggagatgtgacggccccagtgttgcgcatagtgaccatacgcggaaaccccgaccaagtagttgaagaacaattttttgccatacagtatcacaagctcttatcaaaagaggtttctgaaattctgattgagatccgtaccaatagcggcatcttgatgccattccaatacggaacatgtacattaacattacactttagaaaaatgtcctatttttaaatgatgaacacgttggaaattgacaaaacattgacaagaaacaacgtgactcgccactactatattggctgttttgcggcagaccaaataccagccggggcaattgccaaatttccacactgtatggtggtgaatcttgaccccagcatatctcatggttctcattgggtgtgcatttattgcgcttctcctttgcatttggagtattatgactcattggggatatggccaccgcccagttttcacattgttgaccatttgtcacgctacaaacaaattgaatataattctcttccacttcagtctcccaactcaagtgcgtgtggtcgacatgtcattttctttttgtactgtcgatgtgttggaatgacctttgaaaaaattgtcagctttttacactttggaaagctgcaacctgataagctcgtaaacaattttataaaaagcataattttcaaagaatataaataataacaaaacagcgaaagtatcaattaaagatgcatgttgattttgatcctctacaagtggattggtccacattctcgtccgagtgtgtgcaatttggtggatacaacatttatcgggggttgccctatcagcgtggagcgggagttggcgcagtgttcagaagtcttatgagatatttgctgccgattggaaagcaaattggctccgcaattgacgtcagggaatggaaagcggaaatcgagtactcaccaatgtgctggagggaaaagacctcagagagtctctcgttagtgagagtaaggcaggactaaagaatcttctcgaaaaagcagccaacaacataaacactcagaagggtcaaggttttgattttaagcgatacaaaaaagactcggctccaaaaattggaaaaataaggggaaaaaatataaataaacttcaatcgtcaatcggtccaccaatggttgatgagaccaaaaataaacgtctgcgtgttgactcattaggaacctattaaaaaatgacttgcctacaaaaaatcagcgacagcagtcctctagcaattaacagtggcctaaacattttctcagttccaccgaccaatgtgtccgttgttcgctcattctttcgtcaggtgcttccactcgcaacaataacgcaagaatcgccttatctatttcgtctttacagtgacaatttgtggactgatttgtctcgggtttatctttatctcgaagtgtccattgaaaaaccaggagcaaacgataaatgggttgcaatagaggacggggatactcatgtctctgccattcaagggattggtcaaacatttgtccagcaactaaaagttacggttggcaacacggaagtatacgatagcggaaacctatacccattcaaggcttatatcaccaatgagttaagctttccaataaatgccaagaaaaattttcttggttcaacagggtattatcacaccgtaaaccaagatgactcaacagacgaggggttcaaagagcgttgtaaaatttttaagggtggaaaaaatgcgcaattcctctcccgtctcgactttgatttgggaaaccaagagctttatctcttaaacaatttggatttgctgttcacaatttataaggctaaagatgtctttcttttgcaaactttaaaagcaaatgattcaaccaaatatcgtttgacagttcacgatgtcaagatttatgcaaaaatggttgaggtccaaccctcactaaacatgagcctttacaaaacccttgaaaaacaacccgccacatacgcagtacgcaagaccgaaatcaagtcgtcattcatcagtgtcggtcgatacgaatttgagtacaatgtattcagtgcaaccattcctcgacgtgtgacaatcgcgttagttggaaattcagcatttcatggtgactacaaactgagtcccttcatgtttgagccgtttgatttgcgtgagatttcggtacatgctggtggcgtagtttacccagctgttccttataaactaaatttttcaaatgatcactttgtcagcgcctttgttgacatgtatgaggcactcggaatggccaattcagaacgttcatttgacatttcaatggcccagttcaaaaaagggtggaccttttttgtcattccattgacttcaacgcttgacgacagctgtggatttgagctgttgagaagcggtacgacaaacgtacgagcaacattcaattcaccaattccgcttggtggtgtagagatgattgtcttgggtgaattcgaccaaatgattatggttgattataaccggcacattgtgaccgattcaaagcttggataaattataaataaataaaaatattattatgtaatgttaaaatgaataacaccaacacaacaaaacacgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatcccccgacacccaccaatattttttgcagcaaaatgatgcaagattagagaaaactgacactgaactctctcttcagtatgacaaaatcgataatgactcatgctgatggagcattctcaaagctactcattctttttcatcattcattttacaaaaatgtctccaaatgaatgttctgaccgtccctttcaacaacccgacaatgtacaacagccgcatcaacaaccagatgaagacgccgagttgcgcgcacaaattgaagacgcggaagaggatttgctcttgaattggtggcgtgaagatccgacaattgtaagcttgtttttcaatttagcatttttaatttcttcacgtttcagattcgttttctttttggacatggacgagcccctgccatagaagccgcgcttcttcaacgcgccgaacgtgaggcagaaattttgcgcgaatatgccgagaatcaacaacaatgagaaggggccattcagatatcatgtcgtatgttatttttcttatttttttttttttattatgatgataaaaaattttacaatgcagaactgcggaggagaatggaaatggatgatgggggggggactaaaactcgcgcacccttgaccgatttacttcaaattttacgggcagtcaacccaccaccccttaagctgaacggcgaaaagaattttgcctctagcaccattttgagctgtacattcccgacgccccgccccctcgcgcaccccaagacttgcgcagcaaaactcgcgcaccccttgtccgattgacttcaaatttcacaggcaatctacccaccaccccctaaactgaacggcgaaagaatttgcctctagcaccattttgagcggtacattcccgacgccccgcccccctcgcgcactccgagacttgcgcagttaaactcgcgcaccccttgtccaattgacttcaaattttacgggcagtcaacccacaccccataaact

SEQ ID NO: 5694 - DNA, 1556 bp, Heterodera glycines
atttaattcttctcaaattgtttcttccaattgaaaatggtccattgactaattttcaatatttttgaaattttctcgtcactcatttttggattttctcctttcatttgccaatacattttcattttttccattttttctttctccgtcattctttcacccattccaaattgtttcttccattgtccaattactccttggccaactccaattttcttacaaatttctgcataatttttgtcccattcttttgtcgaatattttcttcctttttgtttatactcatttttcattgcattaaatttttgcacaatttcaattttttgttcatccgtttttgatttgttgtgccatttatatattcccaattctttgatccatttgtaaatgtattttcgatttgtccccaatgttttcgctattttatcattaattttattccattcttttgttgaatattttcttcctttttgtttgattttcgctttaattttgttgaatttttcaacaatttctctctttttctgttcattttctttttcttcccatttttctccaaatatttctttaaatgttttttgttgcaattttttcttttccgctccaatttcaatttgagcaattaaaaataatacaattgaaaagaatattaggcacagtttcatattttctaaaaatttcaatttgtattttatttaatagacagaaatgaaaagcaataaataatgaatgatattattatttctcaaaaacgaattcttatatttttctcttctaaaacctacacattttaaagtgaaatattgacagatttctctctactgattggtcgcaattagtaatattattatttaataatattaaaaaaaatattttcacgattaataaattcccatccaactgatcacaaaaactcaaatttttaattattttttttcatttttacttttgttatgaccaaccagaaaaattaagtgtgtttttcgtgaatattgggtcgaacttattcatcctaatgtatcatagaaattccgaaaaagaattttttttttgcatgaagtggaaaggttttaaaaaaataaaaaaatgttaccgtgggaaaattttctgtttgctcgtttttgacaaccataaaatcaatcaatgttttaaatcacatttaagggatgcaattttttaattaaattgtaaaaaaaattttaaaaatcacttcaatagaaaaaaggatatttaaatttaaaaataatacaaaaatggcgggtccggattcgggattggaatcttgcagcctgggttggattgccgagattaaaatcccaattttggcggaatttgaatcctgccccgggacaatcctgttttttgggatcccaatcctgacccttaaaataaattaaatttgtcgtttattctcgttttcgaccgagaaagtaaaataaataatagaacctaaaaagggcaaaaatatttggcggtttaatttatggcacagctgctaactcccgaaagattttttttaaagatttaaaaatgtcataaatttttatttttttttg

SEQ ID NO: 5695 - DNA, 2972 bp, Heterodera glycines
gcatgaagtggaaaggttttaaaaaaataaaaaaatgttaccgtgggaaaattttctgtttgctcgtttttgacaaccataaaatcaatcaatgttttaaatcacatttaagggatgtaatttttaaattaaattgtaaaaaaaattttaaaaatcacttcaatagaaaaaaggatatttaaatttaaaaataatacaaaaatgacgggtccggattcggaattggaatcttgcagcctgggttggattgccgagattaaaatcccaattttggcggaatttgaatcctgcccgggacaatcctgttttttgggatcccgatcctgacccttaaaataaattaaatttgtcgtttattctcgttttcgaccgagaaagtgaaataaataatagaacctaaaaagggcaaaaatatttggcggtttaatttatggcacagctgttaactcccgaaagatttttttttaaattttaaaaatgtcataaatttttatttttataaatggattaaagaattaggattatacaaatatcacagcaaatcaaaaacggatgaacaaaaaattgaaattgtgcaaaaatatataaataattcggaatgaatggaaaaagattaacggagaaagaaaaaatggagaaagtgaaaatatattggcaaataaaaggagaaaatccaaaaatgagtgacgagaaaatttcaaaaataatgaaaattaatgaaaacgctcagagatttcttgtgatcagtaggattggaattttaattaacgatgaaatttttttatttacactattttttaaaattattgtctagcgaccaatcagtagaaaagagaaaaatataaaaatatttttgagaaataaattattatttatatctctaattatattgaataaatatcaattttaattaaaaaaaatatcaacaatgaaactgtccatattattctttttaattgttcaaattgaaattggagcagaaaagaaaaatttgaacaaaaaagcatttgaagaaatatttggagaaaaatggcggaacagggcgattcattgtctccgtttcggtgccgccctttcattgccagccgtttcattgcagttgtcgtttcattgccaagatgggtctcactgccaatatgtttaactactgcctacttttctctttttctcattattttcattaattttgttattgtaattttcctatttcaaagcagatcattcgttttttgtcaacgattatggctactgaaattctaacaagcgtggaagaaaaacattgttacacgatggttttctgtatatcttcgaaaaaataaacaaacggggtgacgtcaggttttgtaaatgtgaatttttcggaacccaggacatcatatgcaaatgtcgtttgcacacagatatgaatgacaatattttggaggttcaaatattcaattattaatgttagatatgaaaatttttaggcaagagccgaaaaacatcaaagttcaaacacttacgacatcgctgaagaagcgtgcgcatgaaacgatggaaagccattctgtgttacggtctataacacttgacaatattacgactccagttttggctcggtttccggataaagaaacaacaaaaaaagttttttttcttatttttgatttgcgtagcataaacaaattcataggttgtgaagcgcgcgacacaggctgaaaatgtgccttttgcagtcccgactagcatcgcagagctccaaatccctctggcctacagtcaatacgagtgatcagaaaacatcacagaaaattttctgttggacgattccggagtatatgcagaaaacggtcaaattcaccggtaaaatttaactattttctctgaagacgtgcttttaattttataggattcttatttttgggagagcgtcacacagtaaaagggcggcacaaatgactgatgttttcgtagatggcacgttcatcattgctccaccgttgttttaccaagtttacgctgtgttggcaaggtggagttagtattattccaacagacttaataaattctcacacttatttaggcgtcgagatcgatgagtctttcctgttgcatatgcactacttacgaacaaaagtgaggggacatataccaggatgtgggccttactaaaagaagcctggcctgaattttcacaccggacgttttcagtggactttgagatggcagcaatcaattcaattcgtaacaattttccggaagccaaaactcgtggatgtttatttcatctagtgaaaaatatgaagaaaaaacacagaaaataaactttcgcaggtctatcgaggatgtgtatttaataatcaatgtgtttttagcgttatcaaattgatccaattttcgcatcccagtcaagctggatcacatcaatggcatttatgtcaattggagacttaacgcacgctctatctcattggaaatgcatctgttacctgagcttcgaccaattttttgttatagatttaagtaaacagatttacaggttcgccacaaactacactggacgtgttcggcgtgctgaagggactcgaaccgtaccaatgtttcccccccccccccccaattatggagtgtctactctaggacgattaatggagaagatcgcacgaacaatttcgcagaagctgcacacaggcgactgcaaagggattttaactgctctcatccatcaatatggcgtttcattgagacattgcagaaacaacaaaagttacgagattccgaaatgtccaaatgcgttgctggattcgacccaccacaaaaggcaaaaagatatcgcgaagcagaccgtcgaattctcacattgacacgcaattaccatccagtgaatattggtgatcctgctcatgtcaacgttgataattttaacccacaaactatcattgattttcttgctggtgtctcatacaattgttcgatggacccctgattttttg

SEQ ID NO: 5696 - DNA, 1671 bp, Heterodera glycines
aaaaatattggcagtgagacccacctttggcaatgaaacgacccctgcaattaaacggctggcaatgaaaatgcgggcaatgaaacggcgacaatgaatcgcctgttccgccattttctccaaatatttcttcaaatgctttttggtcaaatttttcttttctgctccaatttcaatttgaacaattaaaaagaataatatggacagaaaaatattgaaaattaatcaagggaccatttgcagatggaagaaacaatttggagaagtaattaaggagaactgaattaatgagataaaatttgtttttttgaccgcttttttctttacgataattgtttctttgcttttgtacatattttttaaaatatatttttcaatttttttataatttatttacaaacacaagtacaaattttaaatcatgattggagctacgcattattagagccctggggccgagtaaaagaaggaggttatggttaaataaccacaaccatcatggtttacccgtagcaaatgagcaaccacgggttcatggtcatttaacctggtcatttgaccatgatgttggtggtttgtgaacgcacagtaaaagaacatggtttatggttacctaaccatgtaaccatggtaaaacgccaaccctgccccgaggacgcacttttactggcaccaacgaatgaattagaatcagatgatgaatgtgaagaaaaagatgatttttgagttcctacgattctatggaaggatgcttcccatttgttattggaagcaaatccaaatttaattccaagtctgagaaacaaaaataacacaaaatgagaatcacaaacataaacaaaaggccaaaataattgaacatttgcaagtggtctccactttttacacagcgagtcttacatctatttcgaatcccgaaccaaaaaaaaagtcaatctcaactttaaaatgaacttttattggccaaataattcaactacatttaaatgaacattcatttaatttcgcttctttaatttaaagtctgctggccctggcttttgtccatatctttatttttggaagatttacatttaaatcagtataaatttcgtgtcaagtttttttagtattcttttaataattcttaatcaaaatgttaactgttttcacatacatatttaagcttctattcacatttttataattaaaaattttgagtccaaaaatgtttgaaacggcggaccgggtcagtttagtcgggctggtttagtccggccggtttagtcggagggtcggtttagtacggcaagctggtttgtccaaaatagattctactcagatttttttcgaaaaaatttttaaaatcaataacaatatatttatcaatgtgttaacaacgaaaaaataacaaaacattgaaaatgattacgggcacatttcatagtttcgagaaacaccaacgagacgattatctgctgctgtctgaacaacgacggattatcggcggactgtcgccgccaattcattttattttatttttgtgcatacatacacctttgcatttgttgttaggcccgaaaaactcgcatcgccaatactgaagaccatcgtcactgaaatggtgaagaacataaagtgaaccctcatgttccagcttctgcttgtttcgctttgtctttatttcctgat

SEQ ID NO: 5697 - DNA, 2097 bp, Heterodera glycines
  misc_feature (1961)..(1961): n is a, c, g, or t
caaaggcaaaaatcagctgtggtgtccctccttttccctttctcggcccgtgccttcccaaatggtggggggagggacggacgagccggtggaagcgaaggcccgcaagagtgagagactcctgcggggaagaccgacgaagcggtggtgggtcggacaacgacgacggcgagagacgagagcagcagaatggggaggggaaaccgtcccgaccaaatcccccgaacattcacgaatataaatttattaaagcagcagaaaaaacggatggatggaaattgtggaagtgagcatatgtgagagaaaaatggtgccctttttataggccgaaaaatgcgaggaggcggggcacagggaaaaaacttaattggactatcactaacaaggcgtgggaaaaaacagcgggcgatcgataaaatctgtcgctgttggcgacagaactcccccccgcggcaatcatcgaatttcttcgcggtggtgtcggcgctctttcttcgccttgtgctttccatccaccgacggcgagcggtgagttctccgtgaacagccacgaggtccacggctgccttggtggcggttgcgctttggccacaattcccgcgtcgtcctgggcgggaatttttttgattgcgacaattggccccatgcatttaagaaattaccggtgggcgattacggtccgccttatcggcggtgatctccccttcctcgggggagtcgcgccgtgcatttgaagtcccggggcggctggctgccgctgaccgctccctttgtggagctacatagagggggcaggcctttgccccgcggcgatgcccggagagttggcacgccgaacacgtcggcagacgttttgaggaaggctcctcctttgcctccgcgtcgatgaagtcgcggacggaaaatttccgtccgcttttcgcgtcccgctcaggcgttgctgcggcaatgttgaacagttccaccgcctttttgcggggcggtggcggcgactggcgatccggcgatgatgatgatgatgatgaataggcggacgatgacgaggagggcattttgatgggtttcggcattttgggaagggcaagtgatggtgggatatgccttatccctgcccttatataggttccgctaccattgaaggggcggagtcctcggatcagatttgctttctgatcgtgggaaaatggccatgggaaaagtattcgtgaaaatccccattgattttcacgtgccatgtccgccgcttcaagcggctgatggcaagtccttgtcgaagggaattcctttccctccgccaaactgccgaggcacaaagccaaggccacaatgaataggccgttctgccaacggcgcattggacggttggggaccgcccttcgtgggcggttctcaaagcttccgtccggtgaatttgggcggccattgtcaatggctcgctctccgcgttgaataggcgcttggcgggcattgttttccgccctatcgccaatgttcggattgtctcttcggaagccaatggcctcgaagagacgccgagacggcggtcccctgttgggcccctcttggtcatttggagcctcctccaatgccaaatacgctcttattcggggaggacgagggggctcggccaccctccgatcagctccgatttggaatcggacattgaccatgtcgattgggaagtaatcgacatggattccttgttggctattgctgaagcctccatactcttggaggcatggcaaattcgggtccacctggaacccgcgccgtcgaaagtgttcccggacagtccgtcccggaaacatttgcgtgttagccggtccaaaacgcgaaaacccgtcgaaacggacattcgcgaatggaccaaggtgtgccgcaaaaagcgtgacaccggtgcgcagttctcggcggaggtgttcctccgcgtcacggcgaatggtagccgtctcgtaccatgntggccgtggtgtcgctcaacccacgagttgagtctctccgtgtggtcacggggcgatggttcccgtcagggaggagcatgggctccccaatcgcctcgttgttcgccaatttggcgattttgggcccctgttttca

SEQ ID NO: 5698 - DNA, 1699 bp, Heterodera glycines
  misc_feature (35)..(35): n is a, c, g, or t
  misc_feature (1504)..(1504): n is a, c, g, or t
aaaaataaagcgattaaaattcctcaaatttgtcncatttatttatttatttgtttatttatttttgctgatttctctttcatttctctcatttcttctctttttccatttttcccttatgcttcttggctttgctgctgctttcgatgaccattttcagcactttccgtggcttttttcggctctcttcgcttggcttcttctcctttttcttcttttggagctgtttccttccttttcagccaatttatctcttcaggtgttttaattgatgtaaataaattaattaatttggagagaaaaattaacgatcgatttattggtcaatatttatttattgatttttagatgaaaatatcggtagagaaaatttgcgaagggggaccagccttaaattgagacttttctttctttttatactattttttggctagttttcttcaaaaaacttttggctgcctgcaaattttggaatttttgttcctttttttacagatttttactaaaatatcgttattattatatggttaggtctgttcccctctgcgacattaatattttggcaatcattaagaattggtgtcccgaccaaaaaaaatattaaaaatttgtcgggtattttttctaggctaaaaaatgtgctgatcacgaatctgagctcaagttttgaaaatctttgatttttatctatgatttttcatcaactacatgattttttccaaaattttaagaaaattagtcggacataaaactgatactaaaaagagctttcaaatgagctattaaatgtatggagaagtcaagttttcaatattttcaattttttacgattttttgaaatatattattaatccctaggggtcgtatgagacgggggcctggggttcgagtccgcttggctgcggtttatttttttatgacacttgatgaaaatcatagacaaaatgaaggttcatgcataatcagagcttagattcgtgatcagagtattttttaacccaaattcattgctaaacgttttaaaaaaataactttaaaaatcgaaaaaatcaagtagttgacaaaaaatcttagataaaaatcaatgattttcaaaacttgagctcagattcgtgatcagcgcattacccaaagttaattatttaacaaattttttaaactgtatttttttaagtttttagtttcggttgaaaatcaaggtcccgatctaggcttttctggccccggtaagatacagtccattttttcctaaatcccatggtagagaaaaaggagaaaatacaaaagggaaaaagtaaggcacattttgatgccattttcggttatcgcctgttgcaaatgcttcttcagttggtaagccctcgccgtgctctgatcgctttattccgtgcccccaacccaaccgaacattatttggcctttctcgacatattccgaatcggtgccatctgttgggtgataagcaatcatctcggcagtgaaggcggtctcgatgtgcttttgngacttccgcacggcgaacatttcaattaattgcaacaattaattaaatcactgacttattaattgtttagacagtccgtccattcccttcccatctttggccccattttttggttgtttagagcttttgaaactataattcgttttatacaattaattcagagcaatgatcattcagcagttgtttttgcatact

SEQ ID NO: 5699 - DNA, 3552 bp, Heterodera glycines
tgtgcgtaaattgccctttccattggaattttttacgtcgtccataaaaatgaatgatttctcagcttccatcaacaaatagcagcgaattgcactggagctcagttcttctctttcgcgctgcttctcaacaattggagtcgtcccaattgcttcggctatttgtggcactttggccttgattggcaatgccatttaatcgctccctttctcctccatttgctcttccggcgacaaagcgtcggtttgattgtcgtcgccgttttgatcatcggttcgatgtgtcttcgtgctttcaaatgcgtctccaatggaatatgcaataaaagtgacgtggacattccggtgggttcactgctttggacattggcatactcattgtcagatagcataagactcaatgttatgtaaagaaaattgttatcgaaaatataccaagaaatcggacccattcgcttgcttaaaccatctcttcctcttccaatgcgtcagttcgtctccgtccgtcctgagcatgtgtcccttgtccaaatgtacatgcgtcccatgacaaaatgtggtccttttcttgtcggccttctcctcggtgtgttttctttgtctctcaccgattcatcgccgccaaaatgggccgaaaagctcaaaactcagcaaaaaaagcttttctgtgcgggtttttgtcttgcggtcggttgtgtttatgggattctgccggagtattggtacccaaacgacggagtcactctgtacaacactctctacacggcatccttccgaacactgttcgcttgtggcatcggactgatgatgctcagctgtctcctctccataaaaaggtctttaatatgtcgtcgagtttcccgtgccccattttttatttttgttataaaaatctgtgagctataagaggcatcggattgtttagcattaacccagccattaggtcaatcagacccaatcaaaatctaaaagcagactgacccaacgcagagatctagcagcccctcagggtaattgggtggacttaggacattgggtacagaccgaggagcaaatgacagcaaaacaaaagggaggggacgaggaaacgataaaatatgcaacaaacagcaattaaattcccttttgttcattttttccctttttgggcttattttggaggaattatgttcttataaatataatattacatttttatttacgtagcatcgaaaattttttatttcattctaaagctatttttaataataattaatagtaaaatgtccgctgtcatgatgtccatttgtccacttctgtccaaatgtccgttttctctttcttttcagcttttttcggcctcgtctcatccatcgaattttcgctgtgttcgcccgtctgactttctccgtcgctctcactcacatgcccatcgtttttctcttcacgcgtatcactgccttccaagagacagaatcaccttttagcttaatcatcgcccttccccccgcaattttaatgagttttacggtcgccacaattttctattgttttatccactggccaatttcacaaattatttcccgaataattaaataaattatttaaaatttccatgccgcagaatttcgaattctcttaatttttaaccaacttcaatttcaaagcatcagaaaatgtgaaaatcagaaagtatttttgcttttaaacgttcgttgatcttcttaatttcggccttcgtcttttctgtgacattctttcgtcggatttcactcgcttctcgcctccccttataaaaaggcaattgccacaataaatataatttattagtaaaactgtataaggggtttcggtacttttcagttttgggcctacacctcaaaattttaaaaaaatatcagcaatgggcgcgattaatgtacattttttgacaatttccatagcataaattaaagtagcgataaaggacctctcctcttcggcgttgctcataaattattgaatgtgacttttttaaaattttgagttgtaggcccaaaacggaaaagtaccggggtttcaaggcggaaaattgatgcagttagaattgcctaattatttctatatggagaaattttatggtacttttccgttttgcggccaaagtttgatgcaaaatgcgcgcctctggacaatcatttttttgtaggaaatttactgcggtaaattcatttgttttttttctgaagaggattataaaattatattatcaatcgtggaggaagaatgagggggaggacatttattcataaaaatggtgggaaagcaaatgccctttcgttaatttatgcaatggaaacgaagattattacaattctacgcgcccgctgttgatttaaaaaaaaaaaccgcttttcccaccttttccagtgttctcggcctttccaatgcgtaagccaccagcaaatgtttgaagccaatttgcagactttccatggtcgcccaacttatctcgtcgtatcccttccatttgatcaaatattgaggcgcttccttccccgaattctttcttcgtcccatcactttttccacttcgtacattaccgcgttttcggcccatgcctttcgctttctgacggcttcttcaaactccaaaattgcttcgacgtttccctgaaatgcaatggctttctttcttccgctgcttcgtccgcttttcctaccaacgaaattcgctggtcccaacttctatttgggctttcattgcttctcactcccgcttcatccggccataacaccaaatacgacgctttttctttgtttctgtccaatttgttcaaaactttggccgctttgacaacgacttcagcagttggggaagacgaagttgggaatttatggctgattgtgagaggaaattggccttggtcattgccttcggatggatcttctaaatcctccattggtctctttccttcccccgtgttcttcgtatccgtccagaattgtatatccttaagcgatttgttcttttaataattttgcatacaacaataaagaaagttccgaaaactttttaggcattttcaatatttgggtaaaggatttaggaacggagtgtttgttgtccagttttggttaaatttttgtttgttggagtttcgaattcaatagcaattgcctgtaaaatatttggaaatcacttccattggattggatttgaactcggaccccccccctccccatattatttaaactgtaatttcttagggaatacaactatgtatacaaaatcttgaaatatttgtgttgcttggtactttatgattattattgccatttaaaattgtttaatatcacctattcgaggctggtacgcatcggccccccgacgatgaggcctaaattggcgtcgtcacatccgtcgtaatttctggcacttcattcgcctcttctgtgtgttcctcctcatctcctgagctcgataaatgatgttgttggtgttgtcattttttgctgaagttgttaaaaaatgttttgttgtttttgccgtgaaatttttgttcgaaattttaatggacactaaaattaaaa

SEQ ID NO: 5700 - DNA, 1474 bp, Heterodera glycines
ccccccccccccccccgccccctccccctggccaattccctcgccttcgcatttagttgctcaaagcgttccaccaattcgctgtaatccggcagcaaatatttgaccttctcccaagtgggcactcgccagccaacccatttgaccaaatagcgcagttcgccctgcaccgttctgtccaaaatggcctccacttcgtagtcggtgaattcccacgcttttttcgcgtcttttgcgattgattgctcaaaaactttggccaattttctgcagttctgtcaccaaaattccacgctgataaaaaccaacaactacaattttttgctaccggtgacagcttattggcccattcccacgtcgtcgaaggacccttttcctccgcacttccgcaattccattgcaccaaatagcaagaagcacggtcttcgtagtcaatttttttgagaattttgactgcatgacgcggagtttttggaccaaaaatcgcattcattagtaaatcgatggaaaaactcacttttaattttggcgattgaacacaccgacccaaggtcattttccagcggtgagaaagggcgttttcgattcttttctctgtgaatgctagcatttctgcttaatggagtaaggcccaaatgttgaacattttggagcggggaaggcaacggaacactcaaaggcgtaaaactcaaattctgaacatttatcttaaaatgattaacataaattaaaaccgttatgcatttaaaaatgccttatcaaattgtgtaaaactcgacgaagtttggacacttgacgaaaaactcgttgattgaagcggcgacgacagatatttttttatccatgaatcattcattgtgaaaaaatatcaaaaaaaacatttttaaaatatggaaaatacgaaaagcccagtctgatttttttctaattgtttttttaatcagatttgtgacaaatagcaaaatgggctctattgcagtttacatgatcataaaaggaaatccgaaaaagaaataatgcattttcgatcttttttgttattgtacaggttaatgattcggatttgcctcttggttttttatttaaatttgaataggtaggtaattttaaaataacgcaaagaaattttggctctattatgccttgtcccccataaattttttgaaatattacaatttttagagtcgggtagaacattttttcttatgttttcggggtcgctgatcaagaatatggcatccatttcgacccatttcaaatccccaacctgaattcgaacaaaaaatcaaaaactcaattttcaataaaaatcaaatttattacacaaaaccgattcaatgccacgaaatagccgttcgttggccgtcgcccgcctccaattccaaaatttaccggctttctccattgctgtgcattttgtgcaataaatatgaattttattgaaaattgagtttttgattttttgttctaattc

SEQ ID NO: 5701 - DNA, 1021 bp, Heterodera glycines
  misc_feature (997)..(997): n is a, c, g, or t
aaaaggaacattatccatatagcgcccgaaattttatgcaaataatgtttagatggtttaatataaaaattgaatcatgatcaacagcattttcattgtaaattcttctcagtgagttcatcaatgttttattatttcagtcaaagggtgatccatcatttaatccgttttctttagtgatgttatattggaaaagcactacaaatcgtcatccatcgttcaatttgcgattatttttttgatgtccaaaaacaatcaccaaatgccgaaaacattcctccggtcattgcggcaccgcaccattacctttacattgtccaccacaacagcctgtatttcatagcaatttgcgtcacagaaagtatgaataagtctcattccaaaaaacaaaaacattcagctcctccattaatggttattgaggttctgcacaggataattgctattttcaccgaatattttgacgaatgttcggactctgcgattaaagaaaatattgtcattgtttttgaggtcagtgtggccatgcattatttgttgcttcatcttttacacttttgagttgctcgacgaaatcctcgattatggttacccattgtgcacagagttaaatgtgctgcaggatatgatcaaacctccgaattttttacgttccttaaaaaaccaagtcacaggacggacaaacatttcagaaatcctaccaacaggccaattatcagtgattctaacattgctataaaatttggatttggtatttttgcagaatgttccatggagaagagctgctgtaaaatatgcaaacaatgaaggcgagtgttaattttgggtgggtttgttgtcaaagggtagcgaattggcccaaatttaattccttaaaataactcaggattactaacacagaaaatattaggctttattacattttatgtatccaatcaaaaaattttttcatgaaaaagaaaatgtaatgaaatatgataattgtatggcgaaaaantgtatttaaaaattttgaaaattt

SEQ ID NO: 5702 - DNA, 5502 bp, Heterodera glycines
  misc_feature (42)..(42): n is a, c, g, or t
  misc_feature (137)..(137): n is a, c, g, or t
tccattaaacaccatcttttttgaggcagacaatcaatgaanctcacacctttcggttgtaattagtggggctgttagtggaatagaaatgttaaattttttgcctatcaaatattcgcaataaatgcccatctatntaaaaaatattctattctattaaaatgttctgtattttgctatatattaagaatagccgtacatctaaaggcgtcagtaattgaacaaatttctcaaatttcaagaaaggttccggcagtcgccgtaaaaattgtctatataaaaacaatggcgatacgcatttctgcactaggtcctttttcaaaattgatgtgcttttattgaaaaaacatgtttaacgggccacaaattaatagacaaatttaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacagtcaaaatttaatcggccggctaaaaatgaattcggtaggattttatgaaaataatttgaaaaaattgaaaatttctttcaaagatttaatggaagctagtagaaggatacctttttgagtaatattccagatgttgccaattgtttaatggcaccccatacctcaaaaaagcattattctttggctaaaaaatatcattagaaaatagcgggcgtacatactgaaaaaactgttcttataattttaattttacaattagaaacgccaaaggttacaattatagtaaatgccaaataggttgtaagaataggctcatttgctacaatttagaacagaatgtaatcggcaagaaagggtttttaaactaatttcaatgaaagaacttcataacaaataaattaatgacttctctaaatgaattgcctgcaataaaaatgctaattttctaaattcgcatgtgccaaccttgagcaccttccattaaacaccatcttttttgaggcagacaatcaatgaaactcacaaccttcggttgtaattagtggggctgttagtggaatagaaatgttaaattttttgcctatcaaatattcgcaataaatgcccatctatttaaaaaatattcaattctattaaaatgttctgtattttgctatatattaagaatagccctacatctaaaggcgtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttttttaaattctacgcccgcgattatctgatatgacaatgatatcaataaattttcttctgaagaagcgaagagttagcccaaacgttttcgttcctttctatttaatgatctatcatttcagatataacagtcaaaatttaattggccggctaaaaatgaattcggtaggattttatgaaaatagtttgaaaaaattgaaaatttctttcaaagatttaatggaagctagtagaaggatacctttttgagtaatattccagatgttgcctattgtttaatggcaccccatacctcaaaaaagcattattctttggctaaaaaatatcattagaaaatagcggggcgtagatactgaaaaaactgttcttataattttaattttacaattagaaacgccaaaggttacaattatagtaaatgcctaataggttgtaagaataggctcatttgctacaatttagaacagaatgtaatcggcaagaaagggtttttaaactaatttcaatgaaagaacttcataacaaataaattaatgacttttctaaatgaattgcctgcaataaaaatgctaattttctaaattcgcatgtgccaaccttgagcaccttccattaaacaccatcttttttgaggcagacaatcaatgaaactcacaaccttcggttgtaattagtgtggctgttagtggaatagaaatgttaaattttttacctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcatgcacattcttaaaaaattctgctttttaattagttcatttaatagattatgcttttgctttgtttttttaaattctacgcccgcgattatctgataggccaatgatatcaataaattttcttctgaagaagcgaagagttagcccaaacgttttccttcctttctatttaatgatctatcatttcagatataacagtcaaaatttaatcggccggctaaaaatgaattcggtaggattttatgaaaatagtttgaaaaaattgaaaatttctttcaaagatttaatggaagctagtagaaggatacctttttgagtaatattccagatgttgccaattgtttaatggcaccccatacctcaaaaaagcattattctttggctaaaaaatatcattagaaaatagcgggcgtagatactgaaaaaactgttcttataattttaattttacaattagaaacgccaaaggttacaattatagtaaatgccaaataggttgtaagaataggctcatttgctacaatttagaacagaatgtaatcggcaagaaagggtttttaaactaatttcaatgaaagaacttcataacaaataaattaatgacttctctaaatgaattgcctgcaataaaaatgctaattttctaaattcgcatgtgccaaccttgagcaccttccattaaacaccatcttttttgaggcagacaatcaatgaaactcacaaccttcggttgtaattagtggggctgttagtggaatagaaatgttaaattttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacagtcaaaatttaatcggccggctaaaaatgaattcggtaggattttatgaaaatagtttgaaaaaattgaaaatttctttcaaagatttaatggaagctagtagaaggatacctttttgagtaatattccagatgttgccaattgtttaatggcaccccatacctcaaaaaagcattattctttggctaaaaaatatcattagaaaatagcgggcgcagatactgaaaaaactgttcttataattttaattttacaattagaaacgccaaaggttacaattatagtaaatgccaaataggttgtaagaataggctcatttgctacaatttagaacagaatgtaatcggcaagaaagggtttttaaactaatttcaatgaaagaacttcataacaaataaattaatgacttctctaaatgaattgcctgcaataaaaatgctaattttctaaattcgcatgtgccaaccttgagcaccttccattaaacaccatcttttttgaggcagacaatcaatgaaactcacaaccttcggttgtaattagtggggctgttagtggaatagaaatgttaaattttttgcctatcaaatattcgcaataaatgcccatctatttataaaaatattctattctattaaaatgttctgtattttgctatatattaagaatagccgtacatctaaaggcgtcagtaattgaacaaatttctcaaatttcaagaaaggttcaggcagtcgccgtaaaaattgtcatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcctttgctttgtttttttaaattctacgcccgcgattatctgataggacaatgatatcaataaattttcttctgaagaagcgaagagttagcccaaacgttttccttgctttctatttaatgatctatcatttcagatataacagtcaaaatttaatcggccggctaaaaatgaattcggtaggattttatgaaaatagtttgaaaaaattgaaattatcagtcaaggatttaatggaagctagtagaaggatacctttttgagtaatattccagatgttgccaattgtttaatggcaccccatacctcaaaaaagcattattccttggctaaaaaatatcattagaaaatagcgggcgtagatactgaaaaaaactgttcttataattttaattttacaattagaaacgccaaaggttacaattatagtaaatgccaaataggttgtaagaataggctcatttgctacaatttagaacagaatgtaatcggcgagaaagggtttttaaactaatttcaatgaaagaacttcataacaaataaattaatgacttctctaaatgaattgcctgcaataaaaatgcttgcacgtgccaaccttgagcaccttccattaaacaccatcttttttgaggcagacaatcgatgaaactcacaaccttcggttgtaattagtggggctgttagtggaatagaaatgttaaattttttgcctatcaaatattcgcgataaatgcccgtctatttaaaaaatattctattctattaaaatgttctgtattttgctatatattaagaatagccgtacgtcggaaggcgtcggtaattgaacaaatttctcaaatt

SEQ ID NO: 5703 - DNA, 3033 bp, Heterodera glycines
aaaaagttgtcagtttaaaaccgcaaaaaaggcagaattttcaacgttttttatttttatctttttttatagttcgaaattttctgtaatttttagtaggctaatagagcctgtgaagaactttcgaatgatatcaagattgtttgattcggtcaataacttcaagagttatattgactcaaagttggctcagacggagttggccagacggagttggccagacggagttggccagacggagttggcccgttccgcatattttggagcttttttggcacatataaatccgttccatggcaattacaacaaaaaatagaacaaaaaaaacaaccttcaaacattaatgcataatacttttaactcttacataagcaacaaattggaaaatgaatgaaatgccgaataatatataaatttttaagaaatttaaatttatcaaaacctaacaatgaatggccctgaaagcttaaattcccagtcaatccgtgacaccttcactttttctcttgaattcagatttatatctttctaaagatctttttgtaatatttaaaatttccgcaatttggcgatcgttgagctttgggttttggtttttcaattgataatattgttttattttttccgttttttccgcaaatgtataatgcttctgccctgtaatatattaaataataaaaatttttaaatttaattaataaataacaatttgtttaaaaatttcaccctttgaaagaatttgatttaagccaattttcttgtcccatttttcaattgtctgaaaaatcacaccaaacttttgtttaatttttgctctaaattctttccattcttttcgtgaatgttttccattttgcataaattctttttttaatttaaaatatttttccacaatttcaattttttgctcaaaaattctttgatttttcatagttttcccattttttatttctttcttccatctattcatacttctgatatttgtgcccaaatgttttgctattattttttggcattttgtcctttttccttccaatttttcattaaatttcgtttttaatttgccatatatttgatcaaattgctttaacattattcttttttcttcaactgaataatttttgttcttcatcattccaaattctcttttccatttgtaaattttctcttgactgacgcccaatttttttgcaatttttctttcaattttcacccattcttttcttggatatttctttcccatttgcttaattttctccttaattttatgaaatttttccacaattcctctcttctgtttgtcatttaaaattcgaatttgatcataaatttgttcattatttgttggcattggcaattggtcgcccaattcatcataatctgtggacatttcttcactctcctcttctttcacttccacattttcatcaaaaatctgatcaaattgtcgaacattttgtccaaattggttattctgatcagcaatttctccatgaattatttgatcattttgacagatgttttcttctgctccgtcgtcccatctttggccaaatatttcagcaaaacttttttcttggattattttgccagcctcaatttggttaattgcttttttgaatattaatgcgcataataataaaaatattaataatattttcatttttttgtaaaaatataatgaattatttttataaaaatatttttcgcaatgaattttgtaattattaattttatagcatggcttaatttttcttcaatcaatattaaccacatttaatcattatttcattaatttgacaacatttttataataattcaattattaaattttccttttatcagcgaattgggtagtaattaatatcagataactataattatggaggtttttaaggtaactatcacaaatatcacattttcgttctcatctgatgtattaattcactaatttttttagcacatattttggggattttttggaaattttatttttattttttacgaaagtagcttttttgcactcaaattcttggcaagatatccaaaaatgttcaaaaattttcttttttttctttttgcactttttgaccgttttaatggcttttttaatttttaaggcaaaatttgaattttatcaatgaaaacagaaaaataaataaatatttgaagcgagaaaaatatttacgtcacaaagaattgaaatgtttttgattagaatcgtactagcgaaacggataaaaaacgtgattttttcgataaattcacttattttttcgacagttttttttcaatttttcggcacatatcgttggcctttttgagctttttagggtcgggggtcgttttcgcgtgggtcgttttcttggtgggtaagactctttttttggagtctgaaagcggatgcggatctggcccgtattctagaaaagtaccattgtttttcgttcgtttctgaccattaagcaaacccctaaaatctatccctagtaatgatataaaaaataattagcttacctatatgtattggaatttgattttgaaacaaacgaagcttttgaaatagcaggctaatagaaaattatatattgattctattcggttttttcctcgaacagattttttcaattttgcatttatataaaaagttctatcaaaaatggcgaatgttgatttggcattggatgaaattatctcgaagtctcgccctcctcctcctcctcccgcaccacaacagagaaactttggtggcaagcgaccatttcgaatgaatgctaccaatcgtcccgggttcggtcgacgcaattctttgggtggtggccaacgttttatgcgttccggaagtgacaatgctgtttggattaacatcgtcaaccttcacgacactgtgcttactcaagaccttcaggtgcatttcccatatacctaaattacatttccattctgtctcatttaaggaacttttcgaagattacaatgtttttggaattgtgtgcattacgacaaatttggcgctcatatgggaactgctga

SEQ ID NO: 5704 - DNA, 3550 bp, Heterodera glycines
attttaaataaaatattctgttatcctgttagaaaataaatatatgaacggattgttaagatccgtacaaacaaaccttttttcactagataatcagtaactaggtttttgaaccaactcttagagggttcataattgtacgaaagtaattttttacacagtgactccagcctgagcatatttctacaagaaaagtacaaacaatgacggagttagcccccaaaaattcgattactctgaagggttccgcacaaatggtccagcaattcttccattacggcattcacagcattctctaccagcgcggcatttacccatccgacaattttacgcggttacccatttaattatgcaaaaattgtttttaaatttttcttttagtgacaaaaagtacgggatgacgctgctggtgaacaaagacccgaagttggagcagtttttaaaccctctccttcagcacgttgaggtttcagacaaatttggagcgaatggaatttaattacgttttcgcgcgaagatacgccccacgcgaaaacggcctggcccggctttttagcacatattttcggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaacgttttttatttttatctttttttatagttcgaaattttctgtaatttttagtaggctaatagagcctgtgaagaactttcgaatgatatcaagattgtttgattcggtcaataacttcaagagttatattgactcaaagttggctcagacggagttggccagacggagttggccagacggagttggccagacggagttggcccgttccgcatattttggagcttttttggcacatataaatccgttccatggcaattacaacaaaaaatagaacaaaaaaaacaaccttcaaacattaatgcataatacttttaactcttacttaagcaacaaattggaaaatgaatgaaatgccgaatgatatataaatttttaagaaatttaaatttatcaaaacctaacaatgaatggccctgaaagcttaaaaatattctcagtcaatccgtgacaccttcactttttctcttgaattcagatttatatctttctaaagatctttttgtaatatttaaaatttccgcaatttggcgatcgttgagctttgggttttggtttttcaattgataatattgttttattttttccgttttttccgcaaatgtataatgcttctgccctgtaatatattaaataataaaaatttttaaatttaattaataaataacaatttgtttaaaaatttcaccctttgaaagaatttgatttaagccaattttcttgtcccatttttcaattgtctgaaaaatcacaccaaacttttgtttaatttttgctctaaattctttccattcttttcgtgaatgttttccattttgcataaattctttttttaatttaaaatatttttccacaatttcaattttttgctcaaaaattctttgatttttcatagttttcccattttttatttctttcttccatctattcatacttctgatatttatgcccaaatgttttgctattattttttggcattttgtactttttttatgcaattttccatttaatttcatttttaatttgccatatatttgatcaaattgctttaacattattcttttttcttcaactgaataatttttgttcttcatcattccaaattctcttttccatttgtaaattttcctttgatttactcccaatttttttgcaatttttgtttcaattttcacccattctttcgttgaatatttctttcccatttgcttaactttctccttaattttatgaaatttttccacagtttctcttttatttttattagtttcatttgaaaaacgatcacaactttgtccattatttgttggcattggcaattggtcgcccaattcatcataatccgtggacatttcttcactctcctcttctttcacttccacattttcatcaaaaatctgatcaaattgtcgaacattttgtccaaattggttattctgatcagcaatttctccatgaattatttgatcattttgacagatgttttcttcttctgctccgtcgtcccatgtttggccaaatatttcagcaaaacttttttcttggattattttgccagcctcaatttggttaattgcttttttgaatattaatgcgcataataataaaaatattaataatattttcatttttttgtaaaaatataatgaattatttttataaaaatatttttcgcaatgaattttgtaattattaattttatagcatggcttaatttttcttcaatcaatattaaccacatttaatcattatttcattaatttgacaacatttttataataattcaattattaaattttccttttatcagcgaattgggtagtaattaatatgagataactataattatgaaggtttttaaggtaactatcacaaatatcacattttcattctcatctgatgtcattaattcactaatttttttagcacatattttggggattttttggaaattttatttttattttttacgaaagtagcttttttgcactcaaattcttggcaagatatccaaaaatgatcaaaaattttcttttttttctttttgcactttttgatatttttttaatgacttttcttcactctcttcttctttcacttccacattttcacccaaaagttcgatcattttgtccaaattggctattctgatcagcattttgtccatgaattaattgatcaattcggagttctgttctttcgtcccatccttggccaaatatttcatcaaaattttgttcttgatttattttcccagagttaatttgctcaattacgttttcaaatattattaggaatagtaatgataatattaggaaagaagatttcatttttttggccgttttgacccaaaaaaccggaaaatttttccataaaagacattttttatcaaaattttgtcgtaaactagcggggtcagagcattcggaagaaagaattgtccaattaaaagctggcaaatgttcacagatatggctgaggtattttgatcaattaggcgccaaaatgatcattagctcttggataaattagtcagtgtacgcgtatgcatttgacgcctttttttatgatgagtatcaacggcataggtaacggcggaatgtccgagtaatcgcgacacacacgaacggtctcgggataatttgagaaatttcctaaaaattataaaaaaataaaggctaaataaatatttattttatgatattaatgtatatgtaattcagttataaagcattatattacgcagaacgaaaaaagcactccgattccccttactatat

SEQ ID NO: 5705 - DNA, 1710 bp, Heterodera glycines
aatcactagggactcaacccaacagcatttcaatcactggggactcaaaccaccagcatttcaatcactgggactcaacccaccagcatttcaatcactgtggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaaaccaccagcatttcaatcactgggactcaacccaccagcattccaatcactgggactcaacccaccagcatttcaatcactgggactcaacccaccagcatttcaatcactgggactcaacccaccagcatttcaatcactgggactcaacccaccagcatttcaatcactgggactcaacccaacagcatttcaatcactgggactcaacccaacagcatttcaatcactgggactcaacccaccagcatttcaatcactgggactcaacccaccagcatttcaatcactggcactcaacccaccaacatttcaatcactgggactcaacccaccagcatttcaatcactgggactcaacccaccagcatttcaatcactgggactcaacccaccagcatttcaatcactgggactcaacccatgggactcaacccacaagcatttcaatcactccagaattcaatctcaccaattcttcgaaacccaataaccggaaatgaatgataaaaccgaaagcggctcgaccgcttagcggcctcgcactcttcttttggcattttcttatggcataacagttcttccttgtttcttgacattttcttacgacacaacatttttcttctatacaaatttttcaaacaaaattctcattcattcatttaaaatttcattaccatttacataagcaaaacaaaacctttcatatcaaaatcaaatcaatttataacacaaacaataaagaaagaaaaagaaacatttttaagactgtttttttacacaaactgacaaaagaaaaaaatgtaaaacaaaaacatttcatttttcaaagcattttatacaacacaacagaatgttaatattataggattttcttactgagcaaactaaggagtgcctctttcttttattaaatattttataaaataaaagatggcatataaaggtgctagcgcgtttgttaaaaactgccacccatacgcgtttgttaaaactgccagcgcgtttgttaaaactgccaatgggtttgaaaacaaaaaatgggtaaaataattaaattaatagcttggctcaaattcaaccaaattaatatttcgtggtatcattcaatagctttaattgttctctttcagaatataattttccaaaatttttaacctaagtataaaagaagttataaagcattgaacaggctatgttttttgcaatggtaatgcatatataataataaacatttaaaattttaaagtctttaaaatgaaatttaaccaaaattaatttatatttcgaaaggcctaagaattctctatttatatttaaaattttagaaa

SEQ ID NO: 5706 - DNA, 1260 bp, Heterodera glycines
  misc_feature (1049)..(1050): n is a, c, g, or t
  misc_feature (1143)..(1143): n is a, c, g, or t
  misc_feature (1198)..(1198): n is a, c, g, or t
  misc_feature (1211)..(1211): n is a, c, g, or t
gcaaaatgatgtgataatcagcagtgttggctaccctaagtatcaagcttcatgtcaaattggacaattttcattcaattttcacgaatatactgacttacaaagccttatatgggattttttttattctcgtctgattatcaaattcttatttttctctctcaaatttttacaaaataccacacatcaaaacttttatttaatatcctatgaaattgttcaacaattacaaaatgaacaaaaaaatatataaagttataatccttcgctaaattggatcatttgaagaacaaaaaatgattcgatgcctttcaaatttcctggaaaacgtcagccgtatattcaaaacgtgcacactctgaaatgatgaattattttaaaattttattcaaattaaaatattttcgtttctattgaatgaaaaaattcgcttgaagtagaccaggaataaaagcataatactgatgaaatctgtggcaaaatacacaaaaggcatagcgcaaataaatttggaaaaaaataattacgggaaaacaccaaattggcatgactgtactttggaatgtgacttggtacgatcggggcccttgaaaaaaagtaattgcccccggaaatcgattggaggatttgtctcctaattttaataattctttcattattttttaaattaccaattcaattattaattacttcttcttttaaaaccaagcagtcaaaaggtcttatagaaattttaaaaggaattacattacatattttaattataaaaaaaccttttttaaattttgttagaataaatcaaatagcaaaattttaattattagtcttataaaaatccctttttaccgtttttgcaaattgactttttgtatagcctataattcttgatccgacatttgatgccaattttcgatcagtccccatcaccctctctcacctcatgcttattctgagatttactttttttttgctttaattaaagtctaagaaatagaaaaaatgaaagaatgtaaattaaacgaaatcaggcaaaaaaatgcccgaattanncatcggtatttataaattatttttactcatttttctatatgtataccaaaaataatatttatgcgttcaaattttttggttttgtgtattttnagtgcatataaatgcttattacatatttatggatgttttgttcaaaaaatgacanaattttatgattntgagccaattttttaagagaataagaatttttaggaggcggcgaaaatc

SEQ ID NO: 5707 - DNA, 1508 bp, Heterodera glycines
agtgattagaagaggtacaaaatgattagaagaggtacaaaatgattagaagaggtacaacagtgattaaaagaggtacaacagtgattaggagaggtacaacagtgattaggagaggtacaacagtgattaaaagaggtacaacagtgattagaagaggtacaacagtgattaaaagtggtacaacagtgattagaagaggtacaacagtgattaggagaggtacaaaagtgattagaagaggtacaacagtgattaggagaggtacaacagtgattaggagaggtacaacagtgattaggagaggtacaaaagtgattagaagaggtacaacagtgattaggagaggtacaacagtgattaggagaggtacaaaagtgattagaagaggtacaaaatgattagaagaggtacaaaatgattagaagaggtacaacagtgattaaaagaggtacaaaatgattagaagaggtacaacagtgattaaaagaggtacaacagtgattagaagaggtacaacagtgattaaaagaggtacaaaatgattagaagaggtacaacagtgattaaaagaggtacaacagtgattagaagaggtacaacagtgattaaaagtggtacaaaaattgaatgcaatttattataaatttaaaaaaataaattagtcattccttttattaattaaaaagagaattttgaaatgtacaagaattgaatatttaaattaatatgaaattaatttttataaattcaattaaaaaaaatatgaaattctttatttaaagataattattattttttacataaattcttttattattaatttacaaaaaatctttaaatataaattgatacaacagtgattagaataggtacaacagtgattagtaaattcattaaattaaaatgaaaatatttttaacaaatttaattaaaaaaatacatgaaattctatcaattaaaaaaataattaatttaaacttataaaatttatttatcaaaaaaaattaaattaaatataattttttatttattaactcaacaaaatattttaaattaattaaaatcattgaaaataacgtaaaaatgcacaaaaaaataatgttacaccgtccggattcgaacctgcccccccccctcaaaatgatgcctcagaatccccaatcacacagggattctgaggtcttgacgatgtcaaacgtaaaatctgatcacgtattcgtgatcagcggcccaaataacccctaaagacatgtttttggaagatttttgtcgaaaaaattttttcactcaaaaatcctatgctcacccctttggtcccgaatcccaaaatcacttttatttttgtaacatctctcaaaaaagtgataaaaatgccaaataaaatttatattatagagaaaaaaattgcggatttttgtagtattttacttttacagaatgacttttcagaagggagttctgaatttttttctgaaaaatctaaaatttccagaatttctggaata

SEQ ID NO: 5708 - DNA, 2609 bp, Heterodera glycines
ttagaagaggtacaaaagtgattagaagaggtacgacattgaaaaagtgatacaaaagtgattagaagaggtacaccagtgattagaagaggtacaacagtaaaaaagtgatacaaaagtgattagaagaggtacaacagtgattagaagaggtgcaaccacggaagggaaaggcacaacagtgatttgaagaggtacaacagtgatcagaagaggtacaacagtgatcaaaagaggtacaacagtgattagaagaggtgcaacagtgattagaagaggtacaacagtgatcagaagaggtacaacagtgatcaaaagaggtacaacagtgatcaaaagaggtacaacagtgattagaagaggtgcaacagtgattagaagaggtacaaccactgtcgaaaatgtacaataattgttggagaggtacaaaaattgttggaattgtacaacaatggttaaaaagggtacaatcatggttttaaaattaaataattaaggaaatcgtttattaaaaagtaagattaaaaattgaatgtaattaataaatttttaaaaataaaataaatttccttttattaattaaaaagagagtttgaaatgtacagggattgaatatttatttaaattgaaattaagaaattaatattacaaattctaatttaaaaaatataggagttctttaataaaagtaaataaattattattatgaagatatttggaattttaaaagattatctgggatttttaggccgcttcgcggcctcgaacgggcgctttgcccccgtttttcatattttgttttgctttgacgggcgcttcgcgcccgtttttaaatttggttgggccttttcggccgcttcgcggcctcagacgggcgcttcgcgcccgttttttaaacttgttgagatcggacgtgcgcttcgcgcccgtttttcatattttgttttgctttgacgggcgcttcgcgcccgttttttaaatttgttgagagcggacgggcgcctcgcgcccgtttttaaattttgttgggccttttcgcccgcttcgcggcatagtacgggcgcttcgcgcccgtttttcaaatcttgttttgctctaacgggcgcttcgcgcccgttttttaaatttgttgagctcagacgggcgcttcgcgcccgttttttaaacttgttgagatcggacgggcgcttcgcgcccgttttttaaatttgttgagctcagacgggcgcttcgcgcccgtttttaaatttatttgggccttttcggccgcttcgcggcctcagacgggcgcttcgcgcccgttttttaaacttgttgagatcggacgtgcgcttcgcgccctacaaaagtgattagaagaggtacaacagtgattagaagaggtataacagtgattagaagaggtgcaacagtgattagaagagtgatcagaagaggtacaactgtgatcagaagaggtacaaaattgttagaagaggtacaaaagtgattagaagaggtacaactgtgattgattagaagaggtacaaaaattgaatgcaatttattataaattttaaaaaataaattagtcattccttttattaattaaaaagagaattttgaaatgtacaataattgaatatttaaattaatatgaaattaatttttataaattcaattaaaaaaaatatgaaattctttattaaaagataattattattttttacataaattcttttattattaatttacaacaaatctttaaatataaattgatacaacagtgattagtaaattcattaaattaaaatgaaaatatttttaacaaatttaattaaaaaaatacatgaaattctatcaattaaaaaaataattaatttaaacttataaaatttatttatcaaaaaaaattaaattaaatataattttttatttattaactcaacaaaatattttaaattaattaaaatcattgaaaataacgtaaaaatgcacaaaaaaataatgttacaccgtccggattcgaacctgcccccccccccctcaaaatgatgtctcagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaatcctggtaccaccctttggacccgaagcacaaaatcacttttatttttataacaattcgcaaaaaagagataaaaatttaaaataaaatttatattataaagaaaaaaattgcggatttttgtagtattttatttttccagaatatcttttcagaaccgagttatgattttttttctgaaaattcgaatttttccagaaattctggaataacttttttccttttttagatagaaattccaaataaagtccataaaattctcctgatttttctctatttttaaggctttattcctgtaaaattgatcaacccttctatttgttatgaatttttaaatattaggccaaaatcccgagggccaaaaaattgtcaaaaaataaaaaatttttaaaaaattccaaaaattctgaaacttaaaatagacat

SEQ ID NO: 5709 - DNA, 2140 bp, Heterodera glycines
cccaaatttccaagggccaaaaaatctgccaaaaaataaacattttttaaaaaattccaaaaattttgaaacgaaaaataaacatcatattcgtgcccagcacatcaaaataccccagaaaaatatttttgacccccattttcaacccaaaaaaaattttcgaaaatttctagggggcttagctcgaaaatttttgaaaattttacatcatgtagtacactattcgatagcatttaaaatgctctacaaaaatgttctaagacaatttttcgctaaaatcaacccctgacgagttatgggcctgggactgaaatgtcccgctcaggccaaaaaaattttctatttccgggaaaaaattgaaattttttcaaaaatatcaccaatcgatagagctcgaaaaacggttgcttgaaagtggtctccgtttttctgggaaaattcgttaaaaaatcctaaaattcaaaaacccgaaaaccgttttttaggcctagctcgaaaaattttgaaaattttcgaaattttaaaatctggaaaaatcgagctcaccgagctctacaataagtctgctggccagcctgcgctcaagtcaaagcctaatgagttattcaacggggactgaactgggcaaagttggtactgaatttttgtagaagcacacagaccagggggttagagatagaggcctggaattttttttaacttttagccaacacttcaacttagggccctcacagcgagcattttttgatttgagttttaggaaaaaagttatgggccccaaactgcgagaaaaagtaagaaatccttccctgggactcagtcgtccgcgctgaatttttttctatagttttcccggatgcgccgtgaaaagttgtaagaccgatgcacaactttcagacccctaccgatagccgttctcgagattttggttttaaggatgagttgccttgtcaatataacatatatataactagcgggtgtgtgcatgcgagggtggcgcttgggaaagcgctgcgcgcttcttgagcttcgctacctagacaagctatgggttatgaagatatttggaattttaaaagattatctgggatttttaggccgcttcgcggcctcgaacgggtgctttgcccccgtttttcatattttgttttgctttgacgggcgcttcgcgcccgtttttaaatttagttgggccttttcggccgcttcgcggcctcagacgggcgcttcgcgcccgtttttaaatttagttgggccttttcggccgcttcgcggcctcagacgggcgcttcgcgcccgttttttaaacttgttgagatcggacgtgcgcttcgcgcccgtttttcatattttgttttgctttgacgggcgcttcgcgcccgttttttaaatttgttgagatcggacgggcgcctcgcgcccgtttttaaattttgttgggccttttcgcccgcttcgcggcatagtacgggcgcttcgcgcccgtttttcaaatcttgttttgctctaacgggcgcttcgcgcccgttttttaaatttgttgagctcagacgggcgattcgcgcccgttttttaaacttgttgagatcggacgggcgcttcgcccccgttttttaaatttatttgggccttttcggccgcttcgcggcatagtacgggcgcttcgcgcccgtttttcaaatcttgttttgctctaacgggcgcttcgcgcccgttttttaaatttgttgagctcagacgggcgctttgcgcccgtttttaaatttatttgggccttttcggccgcttcgcggcctcagacgggcgctttgcgcccgtttttaaatttatttgggccttttcggccgcttcgcggcatagtacgggcgcttcgcgcccgtttttcaaatcttgttttgctctaacgggcgcttcgcgcccgttttttaaatttgttgagctcagacgggcgattcgcgcccgttttttaaacttgttgagatcggacgggcgcttcgcccccgttttttaaatttgttgagctcagacgggcgctttgcgcccgtttttaaatttatttgggccttttcggccgcttcgcggcctcagacgggcgcttcgcagcccgtttttaaattttgttgggccttttcgcccgctt

SEQ ID NO: 5710 - DNA, 1712 bp, Heterodera glycines
ataaataaaaaatggaaattcctttaggcatattccatcattgtcaactatccaaaacggaccagcattctgtcatggcttggcattggtctgctggtgctttttcatttgggctgctgcttgggacgcctcagcaaacggacgacgtacaacgagctgaataaccaatgattgatttgtgattgatcactctgatcagaaaaaaacaattttgtttaattatttaccatattttttattaggattaacagaacctgcgattttttaaaattttaaacctgaaaattttttttcaaaatttcgatcagcagcaacatttgttgttacttaacaagactgtactaatagagatacagaaaaggcttttgcattgacaaggaactgatcatgcaaaatctgatcactcccaaaaactgactaggacaataaattattgcaattaatttgtgatcattctcaaaagttttttaaatgaattgtgatcagtcccaataagttttgggttgcgggtatgctcgcactagcaaaaatcgagagtcattgtgccgttgatcagtcttatcggtatccattcaggcaaaaaatattctcgaggatagtctaaaatcgaaaattactcattgctcattgttttaatttaacgaaaataaaattaaaaactgacccggaagcaaattcgaattgatgttgtctcagaaagtgagaaaaaataatttaataatttgcaaaaaaggtaaaatatgcttaacaaaaaatgaaggataaaaagtgaacaaaaaattttgttaaataaaatttgtttttccaaagggtcaagaaaatctttttgaattcgaaagcgcagcttcactctctgattttaccgggataaggtgtaaaaagcattttagtttgacttttatagccccattttgccttttttggcattttgtgccgaaaaggtttttagatttcttaacggaatacaataaaacgtaaaattggcacctcaaaagatgactttaaccattaaaaatgatggatggataaattacttaaaatcaccaccaaaacaaatttttcttatgaaatttgattttcaggttttttaattaaaacaattaaattgtgcctaggaaaaggctttatatgtgcttttaaagagaatttgcgatgatttcaaaatttatataaatcatttttaattttagccgatttgcagttgggaaattagttaaaaaaagaattcaaaactccgaatttttgctctttcatttcgaaaaaaactatcgaatttttcttttatttttaccttatttaagtgaattctaaattctttatcgatccttgttttggttaatgataagtcaaccaaagagaaaaaaatgcattaaaaattgactatttaattgctttcaaatggagcactttcgcttacgaccataccacgttgaaaacacgccatcccgtccgatctggcaagttaagcaacgttgggccttcttagtacttggaacggagacgtcctgggaatcgaaggtgttgtaagcttttttcttttttaattttcatatttaaagaaaataacttattttttgttgaatttatctgctcagcattatatgtttttattctgtataaaatctatttttcttcattattaacatttatttattgtctcagaaagtgagaaaaaatattaaataattttgagaaaaaggtaaaattgctaa

SEQ ID NO: 5711 - DNA, 5154 bp, Heterodera glycines
ataataactagggctgtgaattttaggttttaactaaattttttgctcgattgatttgaagaaaggagctcaaaaaacgcatttctgcattaaaaattttcgattctgatgtcactatcggtcactagaaatcactattttggctacttcgtcactaaaatagttaaaaatcactattttggcgttttgtcactatttcgacattttttggaaaattccttaacaaaaatgcaataaaaccaaaaaatacacccctaagaatcgacctaaaaattttttcaaaaaatacacccctaagaatcgagctaaaatttttcaaaatatactcctatgaaatgaaaaaaagttttctcaaaaatttactttcttggcaaaaatttttaatttaaaaaatttttttaggtaactattttgggttttttggtcttaaaaatcccagtcctactcatttgcaactgcaatcagtgaataaaaattatttttgctcaatttttggctgaaaatttgtcactattcgtcactatttcggactttttgccactattttgtcactattttaacatttttactcactattttagttaactatttcgggattttttgtcactaaaattcacagccctaataataactattaggtggaaatattccctaatctgttgtgcacatttgtgtcatttttagttgaatttgaaaaaagttacaacaaaaatttagtggtgcaggacttatttgtcacgctgtataaatttaaataaatatcacaataatttgaaattatttttcttcttttctcggccactcattcaccatcacatttaaagctcatcgtctcattaaatgtcaacattttgtcaccaaccatcttctgcttttcgcttctttttttcagtattttcctcttaaagctttgaaatcgcaccttaaaaagttcattggatttgttgaataaattacttaattaaaaaaggacaacaattttaattttgtggatttaaaaactaaaagaattattctctttgagtttcctttaatattttgccaatttttcactttttattttttttccaacaccaaaccaacgaacattgggcagttgttggacaaacgatttgttcaccaccggtgtcattttggccaattgttccgcgccggtgtacaaatgggtcatgttgaacaaccgttcgtacacacacaacaaagcgccaaaatcgaaggcgggccaaaatttgttgaagaaaaagtgcgggaatttggcgagtctggccaaatcttcgacgccaaaattgcaaatgccatgacgaaaatggccagagggacaggaagtatccggagcccacaaagtctccctgaaagcttggtaatggggttatgttcggcattttttagagactgtgagtgatccaaatgagaatgcgaacctcgtcaaatattttgtgggccctgcctttttttggttgaagcatgtctgcgtgtatccgcccggcgcgttaagctgatcagccgaatgcaaagtgacgagcattgtttcatcccgtccatagccgatcagattcattcgtcggacaagttcggtcaggttcagcttcaatcgaatgaattggaccatggcacgggacagactgatttcaaaatagccttttgaaagcagcaaatgtggcgaaaagccatggacagaagcagcagccggaacagcagtattcagagtgacttttatgtaaataatttgaagagtaaaatttatttgttatttattgaattaggttttatgactttaattatccaaattggtgttttgtaaaatgctcttaatcaaacaaaaatcaataggtttccaagccaaaaaaatttcttaagaaaaaacttcaaaaatttcgatttttcgcatttatgtataaaattgttaatttagctaaattgaaaattaaaaaagcattgtattcttaagaatttatgtaccatttttgaacaaattcagtgcctcaaaactccagtccattcctgtaattttgtcaactcgtccaggcggtggcactaaaacttgaacatcgtttgctccgtccatccaagcgaaaatttgtgccatttgaacacgcgttttgattgctgtgtcgtgattctattaagaaaataataaaaaataatgattaattgagttctgggttggtaatatgataataccttctgtttttgggtcatagatttcataaaaatcagacgagagaattaacacataattaaaatcaaaaattatttttgtgatctgttgaaaccctgtgctaatgtgtcttgtcatactgtacatgcacatataccgtagtacatatattatataagttatggccaatttattcacttgcaacagagtgacatattcccatttgcgttttggcgtgtccaatcgctcaaaacagtccaacaccgcttccatcatgccctccccgtcacttttcatcgggcgctcgtctcccataattacattcggaaagcatttggccaacgcgcgcacgcggcgcttaaacagcgcgggggacgcggcatcgacgacgaaacagtaccaattgagcggggaaaatgtggcggcgaattccaactcaaccaccacatagtcctggggagagaatggaatagggaagggtaataattagtgatggccaataatgacagttgccgagattaagactgagaattggaccagaaaaattgagacaagaaaagcccgagagtaaagagaattttaaccctgagagaatcaaatccaactaagaagtacaagtcctgctgacagtagcgcgaataattagccgggcatttttcaaaacgaaagggattggttcgaaatttgagttgtgagccggaaatcgtaacataaagaataagcatggaaatgtaagaccaaattgacctttgatccatttacacccattgaaaattgaattcttttcgaaccaatggccgaatgggtttcagactatttgaatattcacatccaatattaatcccaatttcaccatttcttgccttgtacactgttcgaatttgtgccattgggtaattggcatgctccttctcatccttctccccctgttcgtcatctttggcaccgtgccaaaatctgtttcggctttgaattgccgtgcaggacatatccaggtcattttcagccgggtcctcctcgcgacgaatgcgtcgtttaatcattttgccaatgtattcttcgtcattggcaaacagacgagcacaatccaacggcgcacttcccttcggcagagcccaccaatcgaaacgtttttggggcgcctaatttaaatgattttttaaattatccaattagagatatatataattttcaaaatgttaacagttcataaaaataaattttgaatttttccgggccgcgcttctggcaacgccggccacgcgtttaagtgatctaaacctgctccttcatgcccgttgcgttggtggtcaggcaaagcagaaaaacggaagacaaaagcagccaaatgcgtgttaccatggtggtagtttagcaccgtcttaaaaacaggaaaaaaagaacggtaaatcgagaagaatcaaggaccaaaataaaaaccaaaagtccaaaaatccaagaatttctcaaaccgaaacactgttctcaaattgcgctcgctaatgccaatgccaactgatgagaaatgtttgtggcgaattgccttttaaactcacttcactatattttagtctttggctttatttgcgctcattcatttattcatatattatgtatttttctgaatcagctaagcaacattccaatgcaagcctcttaatttagcattgctttttttacccaattaatttatatattttattttattacttaattaactaattttattaacatttgccaatgcaacattccattacaagcctcttaatttagcattgcttattttgctcaattaattaattaattaaatttattttgttgacatttgccagtacaacattctcatgcaagcctcttaatttagaactgtttgttttgcttaattaattaattatatttttttaacatttcccaatgcagcattccaatgcaattctctcaaattagcattgcttattctgctcaatttattcattaattatttttatttggttaacatttgccaatgcgacatttttactgacttcctaatttagcattgcttaattgtctcaactattaattaattttgtttttcttttattattttattaatactcactgaaatttgtgacaaaaaagctttagtaatttattcaagtgaatttttcattatcatatatcgttatgttcattgcattttgtgggctcatttactacaaaactcagctgaatcattagtccattttcaatttgttctcactgatcggctgaataatttttttttaaatttaccacataatattagtaaattgctttagaagattaaaataatgcacttttccactattaatttaatctatttcataattgctttaaatgtttcacatggcaatttgtcgccctgcctgccgtaagtttgaaatttaatatttattaaattttttctaaattttaaagtattcgtctgacaaatggcactgacggcggtgtgcgagtgatcaaattatgcacatctgctgagaaatgccccgaaaacaatggaacggatggagccacgaaaaaggcctatggaattgaatttcgactttcacaaaacagcggaaattgtgacgatgggtgggaagagaaattacaataacaaataaataagcatttttaaatgcctctttagacttttgatttgttatccggcattgcttcaacgaggcaatcacttggacattgcagccaatttcaaagtgaaaagaacattcacaattggtgatcaaaaggcaaattattcaaaaaatatgaacgcttaattatttattaatcaatcaaggacaatccgattacgaacgaatgcgcggaagtgatggccaagaatggccataaaaatagttcaactcattggcgtggcattaaactgcgcacagtgccaatgccaaagtcagcagccatcggtgcgacaattttgatggaggcatcaattgcttcaaatcattcgtttatatttttcttattttttaattaat

SEQ ID NO: 5712 - DNA, 1318 bp, Heterodera glycines
ccattgttgttcactgttgcgtgtcaccgcccaaatcggaggttgtctgattggcataatttcaaaaatttcaaatttcaatttccactttttttagtttgctcgtttccatgtcgcccgttcgatgatcagtgggcccagcaatttccgtcatgcatttgaccatttgatcaaaaggttttctctttttttttaacgagatctcatggacaaattttttccaacccaagaaaaaatggcaaaagaaacatggcaattttgtagcattttggccggtgcctaaagcaagaaaatatgggaaagtcttcaaaacctccgcgtttctaacaaattttggcatttacatagagttagggggctaagaaataatggaattttccaacttacaattactgggcccaacaagaacacgccatttggtcatgaacaaagttattgaagctcattaaacaaattgcaagtcacaaggcccactccccttatacaaacttattgttttgcctcgtgtccactaaactggaaaagtaaaaatgccaaaaatttgtttaacgggtccttgagtctaaaaaaaactggccaacgagtccgggcaggacaccggtattaaaaattttggactcaatttgtaggcctcggcggcccgtcaatcccaatattccggcctcttgaatctttgaatttgccccttcccaaatgcttttttttgtttttgcatcaaattttaaaatttccaataatgccatttcttccaatttatgcttcagccagcagcggcgccactacgccagcggtgccatgccaaaatacacttacaacaacaggaaagctgacgcccttctgccggacaaatggggcgccattttgttttttggcgtgttctcaatcccgatgatctacctaatctttggccgcaccgacgccacagtgtggtggaagctggaggatgacgacaaatgagaaagtggactgatcgatatacatacaaatgatccaactcttcatttacaatttggaaaaattttcttgtaaaaattatagggaaatataaatgaataatgacttttcttttctttaagctatggtattcaggtgtccagacatttgcgtgccggacatttgcggcccggacatttgcggctcggacatttgcggccccagccaaatcggacatttgcgttccggacatttgcggcccaacatttgcgtcccggacatttgcggtgcatttcttaagggccattttcggacatttgcggcccaaatttttgctgaattttgcggtccaagccataagcctacagtggcgtctttgacctac

SEQ ID NO: 5713 - DNA, 1365 bp, Heterodera glycines
aaaaaattttttttttcaaattaaattttttttttgatgccttgtctacaaagaggatgtgctcaagtgcggaggcaaaatcgccgcgcagcatgaagaagtagccatggaccaggcacagatggtccatcaaccgttgccgtcccatcaattcccggcccatttcctcgctgaccaccgcgtgcatttggcgcaaaatggtggccatgcgaccgatggcggacggagtgcaccaaacattggtgggcagttgggcacagagcgattgttgctgctcattgttggcatgggcgggacgcaacattttgagaaagtgcaccttaattgaacttaatgtaccggcgggggtggggtaattaagagcaattatttgtttccaaataataacaataggttgtttttgaaaaacacaaaaaatttgaattttttcgtcatattttcaaaaaataaaactctcaacgagtcatcagtatgaccaaggaattaaaaaatatattatttatctgacatacctttcgtccaatatccatgatcttaaaaataaaaattattttttttaaaccgagaaaatttttgtctgcgtaattgacccattttcagacttaaagtaaaattttttttagttaaatgttagacaataagaaaaaaaattttgctgaaaatttcttaggtttttggtaaccttttttaaaactttctcacgggaggggactcactcagaaaatggcggatcgcaaataatcaaaatcaaataactgaccatgttgagaagctcctcgcagccgtaaaacggtgctggcaatacgtcagtgtcaagctggacagacaaaatcaactgctgctgctgtgaagcccatccaattctgtcctcaacaacagcaccagcatcatgcagatgctcccagaaatattaattttttaaaatgacgctcgttgggccttgagcaagccattggaaataaaaaatttatttctgtgtattaattgatgtattgaaaaagttaaatattatgatgaagagaataaaatatcttattcttaaattgataaaatctaatagtaatatttattcaaaattacataaaataaatttaaatgaaatgtagggcaaagccgcaaatgtcgggccgcaaatgtccgattttggcttgggccgcaaaattcagcaaaaaattgggccgcaaatgtccgaaaatggcccttaagaaatgggccgcaaatgtccgaaccgcaaatgtccgggccgcaaatgtcgggccgcaaatgtccgatttggctggggccgcaaatgtccgagccgcaaatgtccgggccgcaaatgtccgggacgcaaaagtggggtaaccacatcgacacacggggcag

SEQ ID NO: 5714 - DNA, 3730 bp, Heterodera glycines
aaatgaccggccaataaatccattagatctcgttaaaaaaagaaaaccttttgatcaaatggtcaaatgctgacggaaattgctgggcccactggtcatcgaacgggcgacatggaaacgagcaaactaaaaaagtggaaattaaaatttgaaattttgatgttatgccaatcacacaacctccgatttgggcggtgacacgcaacagttgaacaacaatggcgaatttcgaggaatacgaagccccaacatttggtgaggatgaagaaaagtgacgagaaaaatgcccaatcaaatcagcaccaattgaataactcgggattttttgcttaaaattttttgagcaaaaaataaggcgcaaaaaagtgggttttatataaccgtttaagaaaaaaacttttagaatttttttgttacattttgtatttcctgctgttgctggatttgaatttggctgcgataacgaggagtgtcgttcccttcgtcttttagtaaaatttcattccgaaaagacggaaatccaagaagaaaaaggtgccaccgttttttgatcaccccctttttcacaaatgaattcattccttttttagcccaaagccggagcagcggtgccaacgccacaaacatcggcagcggacggaccaccgggagcagcggaagcgccctcatcagtgaaatcgtcagagaaaagcggcggcacaaaaaaaaagtggacgaacgaacgactttttgaataaacaaatttgctggctttaaggaccagcaccgaaggactccaccatgtcgcgatcgctaacctacaaaacgcatgtggtatcgaaggacctcgccctccgtaagcaaacgaatccgaaatggcttagacaaatgattcattgctttttcccccatttcagaatccgagccgaactatggaacgcttgccggtttggacaaggaaattttcgcgaaggaacagcaggcgaaaggtgggggtcggaaacgaacggcacggcgcaatcgcaatccattgaaatttgtccacctcccatttcaggaggaatgccaccgccaccgatgggagctccacagccgcaacagcaggcgcccggaccggcaatgactccaagtgaaataaaaaaggcgcaaatctcaaatgtttgactttccatcccaatttcagcaactgatccgaactactggaccctcaacaacttggacgccgacatcttcacgaagaacgcgccagcaaaaccggcagcggcaccaaaggcgggaccagcgccacacggaggcggcggacaggcactgacaccaagtgaaaaaaatgccgaacattttcaaattttacgggcttttccttcccatttcagcgactgatccgaactacgggacgcttcagaacttggacgcggaaatttttgtgaagaaatagtgccatcgacagcgaacaccccggcaaggcgtaccgatgtgtgatattatgaggaaattggattgattgatgttaaatgtttgcctgtattgcttattgtaatctgttgttgccgtatattcgctgttgtacatatgtatgtatattgtgttgtacacactgtaatgttctcatcatactataaatgttttggtctgtaaaaatgttcaaaatttcgactttttgcaatttatgttatgacttttatgataattgtctaatcaccagacagtagcatagaattagcttctaaacatgttaagcctcagaatgataccaagatttaacatgttttttttcggaaaatgcccaaattggtcaaccgagttttcgaatatgtaagcactgtttttgataatcaaatgcagattatgacataattctcaattttctatttcccagccagcgaagccctataaaaggaggcattttccaccgaccgacccacacatttccctcatttgtcacaagtacatttattgtgcctaattttatttgtgacgtcggcatttgtacatattacgacagttcgtcgtcgactgctgcatattattatttgttgtcttcaccacacactcgtcaagctgctggttgagcgcaatgtccaagagacggcttcgacaggtgtcactcatttggggatgacgttgtttttcaatttgaaaaagtcattcttggcggcatctcatgaatccaatcaaaatttgcgaatccgatcaaatttttgggtcaacaattaataaacagttccgaattcattggctatgtttttccatatgcaaattttttcggagtttatgcaactgccaaaaacgaaatttttcggaaattgtaattccgagggccaaaaattcgccataaatttgttttttcgagggcccggttcagtaaattgtctgtcactcaatcaatgctaatttcttttttccttttccaggaactcaaggacatggagaagaacccattgcctgagggatgcactgcacggccacttgatcaacggatcatgaccccctggacggttaccatccgaggccgggccggcacaccgtacgaaaacggcaacttccaactgagcatggcatttccgagggactacccgttcaaagcgccgcaagtcacgttcaccacgcgcatcttccacccgaacatcgacacacggggcaaagtgtgtctggacattctgcaaacgcactgggcaccgacgctgaccatcgaaaaaggtggcgtggatttggtggtggatttgatcatgttttaaatggattgatcactttaatgctcgtaacttttttcaggggcattaagatccgctttttttgtgtttgattagcaaattcaaaagatttcattgcgtttcatcagagttagcgaaaaagcgaatttttggaatttatggtcttaatcgggtacgaatttgatggcgttggttttgtgtggtatttgtgcagtttgagtagtgatcaattttttcacatacaatttttggctgcagaaatcgttaatttgtttctctgtctttacagttgtgatctccatcatcgttctgctgaatgacccgaacccggacaactcgcctctcaatgcggaagctgccagtttgtaccggactgaccgtgcggagttcaacagacgcgcccgtgagatgacgctcgcctatgcacgacgatgagatgatcagcacgtctttctgattccactaccaattatgtattactcattcattgtatatattattgtactgtatgttgtaccatatttatttgtgtgccactactgtgtgtctatttttgtgttgtatttgtgtgcattttcaaatccggtaaagaattttgtgctttttctattggcgtatccaaccttcaggaattttttttcgaaaactttccttgaaaatgggccctcccgcttgaaattcaccctataaatgagctgatcactgatgaatgtcagtcaactcagattttgtgaaactttcgctaacattaagcattcattacacatgcacaaaattcggtggggattctttcaaaaagatttagcaaattctgcataagtccaccgttaaaattatgtaattacttaatttcccgtccaattatattcattagtcgcagaaatttgaattgaatgaatgacatgttctcattcattcactgacatataacaatcgattggggtcatctcacagtgcaaatgtttttgaactatcaaggaggatgtgatgatgatgatgagtgagtgacaattgcaaatgtcacggctcagaaatggctg

SEQ ID NO: 5715 - DNA, 915 bp, Heterodera glycines
tatagattgatggtatttatttttgtgaatcaacagtaaatcagtgaaaatccatcaaaaaaaaattcttgacgctaaatcactttaacaaaaagcatagattagatgatttatatgacaatctgatgtcagattagtgatcagcgccctcgataacccccgagtagttcttagaatcgaaaaaacaaccttttttgcctttttttttaatgggaccaatgatgtgaaccagggttgttccgggtcgagaaaaatatcgggtcgggtcggccgaaaaatcatcgggtcgggtttcgggtcgagaaaaaggccgggtatcgggtttcgggtaacccggaacaaccctggtgcatgggtgcggatgccactgcaatatttgcagcgaattgcgccatttataggacgatggaaataaaaccaaatggaatcagggttttcagccatttgctttgcttaaattcaagaaattcatacaaaatatctttagaaaaaggataataatgaacaaaaacaaatacaaaattttcgattccattgaacacaatcgtttcaaaaaaaattctcaatttccttatctaattttcacccaccttcacacagccggagaagtccacaatttgttgcaactgctgttcaagtgcaattgaaaatgacggacactcgaaaggaagcttaaaattaaaacgtaaaaacggcaaatttttggggtgataaaagttggttttaaaacaaaaaatctgaaaacattggagttttttggatcaggaaaatggcatgcatttcagagaatgccgaactccaaaactatttggagaaaatcaaaaatttcagttttttttaaaagtttcatttttgctccgaagttttgacccgaggtccaaaattcccttttttgcaagaaattgtccccccgcc

SEQ ID NO: 5716 - DNA, 3591 bp, Heterodera glycines
  misc_feature (3550)..(3551): n is a, c, g, or t
ccattgcccgaccgtccgttgcccagcaaaatccgttttattcgccttcagattgagtaattcggaatcagagatttatggcaataaaagcattcatcccatttttaggtacatcgatcactccgtcatcgcttttcttcgttcaaatcatcaaattttcgacaaaagaggcaccaatttatatttgtggattccatcaccacacaacacggatggccaactaatttgggacatttttgttcgtgaaatttggccaattttttctgaaaacattcgccacttgggctttaacgatggtgatcatttggacaatttgcgtcttcgcacttcgccgacaattctcactgatcttaatcagttgaattcaatctattcatttggtctgtcgcccgctgcgtttggtgatgattttgatgggccaaattcaacaatttctgctggccaagcattgtccaaatggttgcactctccgagaaaagatggccaacccaagcgattgcgttgcgaagattacaacaaacaaacgaacttcgattggatcaacaatttcaaggaggtgtggcccaacatttttgtgatttttgtttttccaatcaaattgtttagcattttcttcgtgccaatgccatttcttccgtcagttaccaaattcatttttctgttcgtgcgccgtcaatgcaaatggtgccatttgaattggtaaacgaatggacaaaggaaaagctgacattggccaaagtgaaaaatgaatggaacaacaattggataatgaaacgatgcaaatttggggagacggcggcggtcaattggaaagactgaaattgggacaacaattgcaacaatgtgttcttttgcctttttagtggcactaattgcatcgggtgagcaattagaaaagacatttaattttgtttaaataattaaaattgcgcttaattaaggccattgtctcctccaccagcagaagaaacgggacaaagcatcacaaaagggcgaaatgagtgacggacaaaagaacaaaaacagtgatcagccgcagaagaagaattgaattaattgagaagaatgaccgactgatcataattaaatcagtgatcaaatgcatttatgatcaaaaacctctcaattggtaaatcaatcggatgcataaaaatggcttgctatctatcgagtgtatgaatttctctctgcttgaaaattgtgacattaattttcgggattttgacgcgggattttttccttttcctctctttctcttccgtctctcctccttccccagtgctatttccttccgtttccacctcttcccttgtttctccatttttgctgttatccatcttcatctccattcccaccaaaatttgcttttgttgttgctgctgtactgcttgaacttcttgcttttgttgttgttgtttctgatggtgttcagctgcaattttccttttcctctgcttccgctgctgctcctttttctcctcccttttcctctcttttccccccattttctcttccttctcctcccaattcgttgtttcctttttgctgttgttgttgatttggtgttttcttccgattgtttggcgccggcactgatagtccaccaccagcagtggagccagttgaatgttttgatttcgccttaaaatgccatttttaaatgtgtatgccatggaggtgttcggcaagccataaatgccggaatgtgtaattccgtcgcaaaaactcccggaatgcggtcccaccattgacggtatccggattccggacaatccgtcagtggataatctttcggaagacaattctattagtgacggacaattcatcagtgaagaacaattcgtcagtagactgacgttccgtcaaaggacatttcgtcagagaattaaaaaaaaaaaatttgttgacggattgtccactgacagattgtccataaccgacggattgttttactgatggattcccactggcgcacatccagtagcaactttttccaaaaggcccaccgcttactgtatgccaactagctacagtatattattgttacaaaaacccatcccaagctacagtacccttcccctgctaccgccgccgtcctcctgttggtgttgttgtgctgtcctttttgtgccgcatgaagtcgatcagtctgtcctgcacaatgtccggctcggaagcagcttcatcttcctcatttcgtgactctgtcgaaatggagcgaccaccgccgccgccagcaagcgatcgaatctttttaaaaaaaaattttctagttagaaatattaacaagttttttataacttttttgtatttgttaaaaaccttaacttttattttagacttgtacgctttgctatttttaatgctaaataactttttttattataacttaattataaaaatttcttaattaaaggattaatatctaaccccaaaatctatccatcgctcttaaaaatgcattatcccatttttaaatattttcttttatctccgaatgctaagatttggaaccacaatttgaagagggctgctgctgttggccagcccctttgaggcccagaaaattgggcatagataatttgagactagacatcgagactcagaccgagattgaccccccgaaattcgagactagagcctgggagggatcgggaccccgctaggatttcccgggaccacgattcaggcttttttgaaaaagggcgggggggggggggggatcgagatcccgacaaaacggggatttgaatgaatttcggtcttgggattcaaatcccgacaaacccaggattttaatcccgctatcttatcgcggcctgatgccagtcccgaaccccgatcccaactatatcaatggcactcggttgagtcctttcgcccccggattatgtgcgctttgccatttaagggccatgtaaggaaagatgaagcagaaaatttgtgccacaccgttcggtcctaatagatggagtgtgtgccgtatcaaataaatcctcctccctcctcccccacattccctcactgtttgccaaatgcggatttgtggccgatgcccgcacaccgtcgaatgccgtggcggatgctcgctgatccttggccaactttgcgtcgtacacgcgctgctcccgcggcactttgctcatgtgggaaagtgagcggggcgtggaggagccgaaggcgtatgccgaccccactgctcgtgctgccccgtcccgggcttctgtgccaatatatcaataacactagggcaaaggcaaaaaacataaataggcaattcgatcggcggaacttgaaacttggcaccgtgccaaaaattgctggtctaaaaccctccaatgaaacatagcaacctcggccaatggaataatgccaaaaatccagggctgcacgtaactggattttccaagtacaggaagccgtaatccgtaattacgaagctgcaaaaactatataatttctataattagcagtcccggattttcaaaaaaaaattttattttttaaaaacaaaaatcttcaaggcggcgagattttggggtgcacccgnntacgggtacaaaagccgcgtaatttgcgtaatgccgtccc

SEQ ID NO: 5717 - DNA, 3544 bp, Heterodera glycines
  misc_feature (3511)..(3511): n is a, c, g, or t
  misc_feature (3536)..(3536): n is a, c, g, or t
atatctatccccaaaatctattcgtcactcttaataatgcattatgccatttttaaatattttctcctatctccgaatgctaagatttggaaccacaatttgaagaggcctgctgctgttggccagcccctatgaggaccagaaaattgggcatagataatttgagactagacatcgagactcagaccgagattgacccccccgaaattcgagactagagcctgggagggatcgggaccccgctaggatttcccgggaccacgattcaggattttttgaaaaagggcggggggggggatcgagatcccgacaaaacggggatttgaatgaatttcggtcttgggattcaaatcccgacaaacccaggattttaatcccgctatcttatcgcggcctgatgccagtcccgaaccccgatcccaactgtatcaatggcactcggttgagtcctttcgcccccggattatgtgcgctttgccatttaagggccatgtaaggaaagatgaagcagaaaatttgtgccacaccgttcggtcctaatagatggagtgtgtgccgtatcaaataaatcctactccctcctcccccacattccctcactgtttgccaaatgcggatttgtggccgatgcccgcacaccgtcgaatgccgtggcggatgctcgctgatccttggccaactttgcgtcgtacacgcgctgctcccgcggcactttgctcatgtgggaaagtgagcggggcgtggaggagccgaaggcgtatgccgaccccactgctcgtgctcgtcctgccccgtcccgggcttctgtgccaatatatcaataacactagggcaaaggcaaaaaacataaataggcaattcgatcggcggaacttgaaacttggcaccgtgccaaaaattgctggtctaaaaccctccaatgaaacatagcaacctcggccaatggaataatgccaaaaatccagggctgcacgtaactggattttccaagtacgggaagccgtaatccgtaattacgaagctgcaaaaactatataatttctataattagcagtccgggattttcaaaaaaaaattttattttttaaaaacaaaaatcttcaaggcggcgagattttggggtgcacccgttacggggtccaaaagcgccgtaatttgcgtaatgccgtcccccccccctccatttgaaatttgcctgctctgctggacctttcgcgtcaatggactttgcctgcctcatgtagtagatgatgtcaccccggcgcttcgccgtgtccccaccgccctggtccaacttggccttcagccccttcttggcacattcgttgacatggtgggagatctcgcggggcgtgctggagccgaacacaaacgaaattggcaccgcttttctgcctgataatgctgctggcggtggtcgtgccattggaaaatggaataatttgttccaattggggaagtgattaaatgttaattggcaggtaattaaaggatatattggagttcacgagttttggaccacgaatatttcactctgtttattgcattgatctcagtcagtcaaattttgaaataaatcaatttttggtctcgagcattgtaatgaattttgggaggatcccgaaccttgccacaaatccttggtccccatggcatttgaattttagggggatcccaatcttggcactaaccctttatgatattcattcttgcttggcaatagtcgtcctctactgctgttggccgtgttttcacccaaaaataataggcgttgctaaatggttgcggctttcggccccatcggcggagtctctcctccccccggggcgccgccgttttcaattgactgaacacagcgaggagtacggggctacctcgagcagcagaggagcgagccaaaaaaccattcaccaacaattttgggcacccgagggaggcggggggaatttcgaaattggtggacggagaaaaaaggatgggacgggggacaaatgaggggcttggatggacaaaaatttaccggcataacacctccagcatagggtaagggcatggcatggaatggcattttgaatgttaggccaaagaggcaaagggtgtagccaattgtgggcctaatttttttttttaggggggggggcggggcaaattattattttttgatttacacccaatcaaattaaacattattggtttatcatttgatagctcattgccagtgctctattatcatgtttttgaagctaaaccgttataaatagtcggccaaaaaagtgatgtgcttggttagttttcatcaaaaccattgcgccgccgggcaaaggtacattaattaaaaaacggggcgggggggggcaatttagggccatggaaattgaaattttgtcaaatgcaattaattgactccacataattaggcgctcttctccgcttctttcgttgatggtggatacaatggtctaaattaagtgcaatttgaatttgatgatgaacactttaacaatggcaaatgtcgttactgctcacccaatgcaattattgccaccataaaaatggaagaatgtgccgttcaaattgttcggcggattctcgttagtccagcgaaccgtctccccaattggacaccgccggattatccatcgaatagtaaatccaaatgtgccgtctttggccattgtcagcttttcatgggttcgttcgttcaccaattcaaatggcacaattggcaatgaggcggacacatataattgaattgtgtagcaggcagaagacgaagtgatggcacagagaaatgcctaaacaattgaaaaagaaaatcaaaatttgtccgaatcccgacatttttctcgtcccggaacaaccctggttcacacgaccacaaaaaaagacacgaccataaaataattcgacaattttaatgcaccataacttttttaaaagcatccaaattaaagattcttatttgtttcgatagcgttaagagtcatctaatagcctgcaaaatttcaaaaaatttcgttgggtgggtttaaaaaaggttatgatttcaaaaaactggttttctaaatatttttaaccataacttttttcgtaaccaaaaaaaattctttgaaaagtacaacgaatttggtaactcgacggaagaaaatggcattcgggacgaagaaaaatgctaaacaatttgaaaacaaaaatcagtgatttttcgagattatggccacacctccttgaaactcggttgacccaattggtggttcacttggttcgttgtaatctatgcaatgcaatcgcttggggttggccatctttttgtcggcgtgtgcaaccatttggacaacgcttggccagagcgaagttgttgcatttggcccatcaaaatcatcaccaaacgcagcgggcgacaaatcataggaataaattgaagtcaattggttcagatcggtgagaaattgttggtgaaatgagccgacgcaaattgtccaaatgctcagcatttgaaatggtcaatggncaatgtttggcgcaaaatgggccanatttcacg

SEQ ID NO: 5718 - DNA, 6033 bp, Heterodera glycines
  misc_feature (5920)..(5921): n is a, c, g, or t
  misc_feature (5978)..(5978): n is a, c, g, or t
tttggagtctctgaaaatggcgggtttttacattttatgaaggaacagtgttttattgataggtactaatattttgttagagatttgctaatttgatcagccatatatttttatttaaaaaatttgcctggcaacacaggttttcgttgaagcacattggcgaagtgcatttggcttgtttgggtggcgcttgggtgacacgatcttaaaaattacaataaattaattaaatttataaaaaaatttttaattaaattactaattgaaaaatcaaaataaaggaaatacagatttgaaaagattaaaattaaaattaatttgtactatgcattcttgattatcttacaaattttcagaaaatttcttcagcagatttcaacaaagttattacaagacaaaaaattcttcaattttttgataattaattttaggtaaataaaattatttttgaaattattaatttatttcaataaaataaaaatggcatttaaagtttcttactgtgatttgctttactgccagctcctccgccacacacctgggctcgtgacacaccgcattttgaacaagattttcgacaattttctgtctttaaattaattattttttttaaattaataatattttttaccataaaaaattggtttttgttacattcgccttgccgtgaccattggccacagtttttgtgccgatcttggcattctgcaaaaaaagtgaatttgaatttacacaccaattcgccatactgtggatgaaattttcttaattcacctgcggccaaattatagttgggctgacactgtaaaaataaatttgtttaaaatagaaaaatttttatttcaatttggaattttaatatattttcataaaattaggtgcaaaaatcgatttgaaaaaaagagaaagtctaaattacaattaaataaataattaacgggaacaaataaaagccaaatatgtatgtaatctgcaaaaaaataagtgaatttctcaaaaaaatctctcattctttttttatcagccaaaagtccgaaatatgttttttatttgcttaaaaactcgctctcttattgaaaaaaaaacaagtaaaaatgccattttttgagatttcgaataacatttaaaaaaagtatataaatccagtccatggtaattaaattaatttccaataattatgtttttggcacctgtgcacagctggctttacaccacaggttcatgtaggtcggatttcggcggcattcaccttttgtggcccatgtgccacaacactcgtgttcattgtagcatgacacccaaaattaaattaatttaaattaaattatatatttttagttaattaaattatttttacatggactggcgttatcggggagccagtcgtcgattttggtggttttggcgtaggcgtggcctaatttgttgaaattgggaaaaatatttgcgtttttttttactttctccgtttgaacacattttccggcacgacattcaccgttcaggcacacatcctctccttaattattcatcaattaatagttaattcgatgaattaattaataaggaaccgtgaataatctattctgagttaattgcgttatacaattaaaaaatataaataatttaataattaaagtatatggaacggattagttttttatgtaattagtggatgctaatttatttttaatattttaaatatatatttatatttcatttttttgtaaaattagaattataaattaattacaaatagtcttaccgctacggaatccagtgcaatttccgccaggtttcacctgtgccgcgcaatggggcgcgccatgggaacgatcgcaaaacaaatacctgggaaattttataaaatatattaaaatttatcccaaaattttgcaactttgatccacagttaggccccatcatgcagttcggtcgtggcgcatattcatacaaatccaagtaccggttgctcagcccgtcccgatttgtccaaggctgtcaaaaaagtgccatttttttgcatggaaatgccggatttgatttttttgaaagccaatgggaaagctttcgcgttttgtctcatttaaattttctttcaaaaatttcttacaaatcatttttggatttctaagattcgcattcagtttattataagaaacatgaaaatttataataaattccaaaatttccatgggctttacagtaggcaattaccgtacctggaatggtcgcatactggcagaaccgaagtgagacgcacttgcacattgcttaaatgtcaaataataaattatttattaattttaaataaattattttttaccgtattgtccatggggtacatttgttcgcgctcaaatggcgcttgctgttgccgtttcatctcccaaatctgtgagaaattatttttgctgattttaaatgaaatcttagattatatgggtataatttaagtaaatttatttcaaaaattaaatatttttcggatttattattttgtaaaaacaatttttcggtaagaaaatacaattttccgggtgttaatttattttaataaattttcaatttttgttaagtatattttgcttttttgtgataaaatttttacaaaaatagtgaaaatttaaatattttttaaatttttaaatgtacgaaataagcaaattttttatttacataaaataaggtactttaataattataattgaatttttaaatgtaattaatttgctaacaaagtccacgaaagaatggagaagaaaaaagattgggtcatttgctgccgtcgattgttcagccatatcgccaccgataaacagatgaatgttgccatgggtgtactgatttaaataattaaaaataaattcaaccataattaaataaattctttataaaactgttaattaatgatatcagacgatgacaaaaggcggcaccgccggggaaatttttttttattttagagaaaaatttcaaaaaaaaaattaccaaattttctcttactaataatacatatttaatattttgtaatttttcataaaaatatacttcgatcaggttgtagtttgttgtcactgtgcaacccttgaaaccaattaggcaatcaattaaaaaacgaattgcaaatggaaattaggtaatcgaaaatgacgacattacctgttgaggggcggaatagccaaagatcatttcaggactggtctgttgcagaaaccaattaattcttaattgaatcatccaaatttttaatgcaaaaattcaaaatgaaatatttatacaaattcatttaaaaatatttttgcttgcttactccgtgtccctaaagccatgcccatcagcgcctaatttgcggagcacatttgcttttccctaaaataattaatttaaaaaaattagacactttctcaagcattttcccggaaacactttttgcgggcattttccagaaatactggatggcattttccttatctcccgccgtaatttatccggcgggatcaatccgattttagggatctggataataagatttgtggtgcttccttaccgtcgttgttcgccatcccgcaaaatcgcccttcaccaaattgccagccgcgtccgtttcgcccataaactaaaataaataattatgttataaaatgataaaataaataaatatttttcgcttgcatctgttgtgaacatgtgcgaatctttgggcgtcggcagtcggtcctcaatcgtcgagtcccaatagggcagcgccacgctcgggtccacctggcgaagcgcaatttccaacctggcacaaatgaacggtgacgggtgattgatgaaattgatcagcaccggcaccggatgattgattgtattttgagtaactaaccccccccccccccactaattgtaagcttatgacgctgatcagttgtactgctcgagattctcggtctcgaactccgggaaaaactcgatctcgagcgcagcataaactgatcaagatatcagaaaacaagatataatgtaactgatttttgttgtgagtattgtggatctccaatgatgaaacccgtccaaaagaataatcaaaatatcgttgtgaaaatggttcgattcagtaaaaacatcacattttggaccgaaaaaatattaaatattttattttaaattttttaccgttttatatattcccgatgccatggcaaaaatgccggccctccgtgtgccccaccgccaatggtcggatcagcatgaattctggcaattttgtcgtattccccgttctgttttatcgttttcattgcagcatgctaaatttggttgaaaatattaaatattttaaacaatttatttaaaaataattattttgaattaaatataagaatttacaaatctcgatcgttccatgtcggacaacattctgtactctttgcggatcgctttgttaagctgtcgtcctgtaaaacagcttctcacattatttttgacataaggcatttaaaaatgttttttcgattatttttttgaaagaaattaaataaatttaataagttgacaattagaaataatttaattacgaaattaatggtcattgatctattatctctaattactttttgtaattagtatgtaagctaggcaggcacaaaaatttttgacttcttttttgaaaaaaaatttttttagtggggggttctaattcagggggcgggatttatttttcaacccccctcgaaaggggggctttaattcagggagggttctaattcaagaaatacgctaattggataaacttatatattccaattaagagattttaattttatttttttaccgcccaaatatgaggagagacactgtaaatccatgcattggtacggtgttgcggccactggcgctatttcggcagccaatgttggggctaaattgagctttttaaattaaaaataaataaattgaaaattacctggaagcccagggattgctggaggaagcggaattttgtcgtcaaccggtggagctgcctaaatttttgtgcttttaatgagcggagtacggtaacattagcacggtaattactagggctgggaatttaagtcataaaaaaattcacgagatttaaaaaagctgattttcttattcaaatttcgtagtggtcagaatgactttaaattttgcagttaatactttatgtaaaagctatctgcctgcaaaattccagatttttcgtacgtaaattttttacaaaatctccatgttcgtaaaatttgaaaaatcaaattcgtgacaccgccgtgaaatttccagttttaaaaacatgcagatttttgtaaaaaaaagactctaatgtatgaaattttatgaaattttgcaggcagatagcctttacattgaaactttaagctcataacttaaaattcccagccctagtaattaccgtttaaatgggcaatttttattttgtcgcaaatttggtaatttaccattttttgttttttaaaaacatttaaaatccaaagaacccaaggaaaccccattttaaatttggcacaaaatttggcatttcgtttttattttacccgcgcatttgtgtcccaccgatgcaactgttcacacagtattctgaacgcgctggtcggtgcacttgcacaattcttttgagcatttgtcaatgaaaatagtgccaaaatgagtacaaataataatttgaaaggcatttttttctaaaattttaaaattaaattttagtcttttgcataaaaaatatttttaaataattttttgcgaataataattatttaattagcctaattttaagctaaattaaaattttatgccaaaactaacccttttaaaacaatcttttcaatttatatgcagaaaaaaattgtggcaaaaatttaattactgaaataaattaatggggaaaaaattnnaaattcaccaaatttcagaaattagtaaggaaaacaaaaatggacaaaggtaattanatattcagagagcgacaaagaaatcaaaactaatcattctgatgatgccatttgc

SEQ ID NO: 5719 - DNA, 1962 bp, Heterodera glycines
cgagaatggtgtcgagaatgggttggtgaagaaaaactgcgttcaaccaattttcgaatttttattttgatgattcagtcacagcgccaccatttttttatttacctttctttttgatgcgcaaaagacaaagaaattgaagaatttcgttactttattaatgtgtgggacgacagattaaattgaatatatattaatgttgagtgaaagaaaattgaattaaaaaaaattaattaaactataatcattaaaaaattaataaaaaatgggatgagtttaaatgaaaaaaataattaaattaattaatattgataaatcttgtaccattaagtactttagtacaaaaggcacaaatccataagagcctcggtctgaattcgtaaatacagtttctcgaaaagtttaaatacttaaaattaccaaaatttgttaaaaaaattcgccgacccattttttctctttctcttaccatgagaaaaagaaactttttaaaaacatatttttattttcattattaacatgattaattaatagggctgccaaatatgcaaatgcatgttttttcctggcttctacatgctctaaatagcaggaaaaacactttcttttttgtgtttgcgtataaaaatcgggacttttagacttttatttgcatattttacatattttgggtttttatgcatatttcatgcatattttgtcatttttgtgcatattttcagatttttttgcatattttgccatttttcgtcaaatattttccgattttaatgtctcttaggaaaaaatttttattatgcctaaaattaaatccaaatctgaatggatgcgcgagtgggtaaataaacaggaagcctcactgccgaaaaccgagaaatttttgatttataattgcaaaaacaaccgataaagtttatgagaaaaaaaaatttttttaattaatttgcacccctaatgttcaagtttttttgtgcatatttggtgcatatttcacgactttatttgcatatttatgcgcatattttggccacttttcgtgcatatttttggcagccctattaattaaagtaacaatacattcaaaaaatatgaaaaatgttcatacaaataatcagcagcaggaatggcagttttaatttcataattatttttgaaaattattacagtaaatatttccaaattccaattcttaaattcgagttctgctccatccctgctggcatcattagtgatgctcgagtgtttctgcctcgagcatcactaattagtaattaccataattagcactgctcaatagtcagtctcagagtcaacaaaaatcgcaaaattcacgtcttctcgagcaagactaatttggctaattaggtatgtgaaatgaataaaaatatatttaaaatgaatggcattccgtatatgatccgtcatttttaccgcattataaaacattcacaactgctgggtgtgaatccgaaggcgaatccgcgaattctaaaaagtatttttttaattgggatttaattatttcaattcgaaaaatataaaaaccatttaagttttaaactctttttcaaatttaaaataatttaatcaaaaaatagggtgctatgtagtttcgtaaatccgtcaccttaggaatttcgtaaaatccggcattttagctatttttcgagaaaatatggcataattttgcttaaaatcaaactaattttgcatttttgatattgttcgatagcctatgtttttctctgtcagcctgtataagcttcaaataaattatcaatttaaaatattagttatggcagaaatagtctttgttttaacaactttttcgaaagaagttgaccaaatttaaatttgcacactaattgcgaaaaatcagggctatcaaacaatacaaaaaatgcataatatggttgcttttaagcaaagttatgccatattttgtcgaaaaaatagctaaaa

SEQ ID NO: 5720 - DNA, 977 bp, Heterodera glycines
  misc_feature (62)..(62): n is a, c, g, or t
acaatacataatactacagtactttattttcggaccccccgggtgacggattttccgggatnccgtaaattgacctcctaattaaaaagctgtttaaaaaactatttgaagcaaacagacgcaattatttgactctaaagatattggcagtcgggaccattttgactggcgccgaaagtgattgaaaacaatatttgaaagaggcattgcaattagcggacgttattagaccaatttggcacttttttcaaccatgaggacggatcaggcctaggactcaaaaaaaatggcgctcacttgtctcagttcccggaagttaacacaactctcgcaactgcgcttacaattctccaacatccacccgttcttttggcactcgcccttcatggcccattgacggcattccggatgataatcggaacatgctaaacggcaggcaattaaaaacccatttaaattggtgtaaaaaattgaaaactaattgcattaaattttaaaaaatagggaagtttttcgggatagttatcataattccgacatacatttcgactatttcccagttactaagctaatcaaacccaaatataaaattgaaaacatcgacgtttttcgggatcgctggtcattattcggacatccatttcgactaattccgaattcttaacccgaacataaccctgagttaacattgaaaacatcgaaattcgtctttttttttgttggtgttagagcttaggttagggattcggattggtcgaatgtaacagacacattcatgatcatcgactcgaaaatagccgaaaattttttttcttgactggaaatcatatcactaacgatacaacctttttttataaactggcgccgaaatatttaactaacaaaattaggccgatttacacatccctgacacggctggcattccaaggccccaaaaaagtttcggaaaccggaagtcggaattcaaccatcccgga

SEQ ID NO: 5721 - DNA, 541 bp, Heterodera glycines
gctgttgccaaccctgccaatcagccaccattggtaccaattaatgcccaaatcgtgccaaatttgccggctgttgctgcgcctgcgcctttagccactgctcggttgccgcagctcagtcttcctgttttttcgggcgaaccaatggaatggcccgcattttggcagagtttcgagagtgccgtcgaccgtgccgcccttgagcccgtcgacaaactcaactatcttcacggttgcttacgcggaaagtctgctcgtgccgtaaccgcctaccgtggaggggagaattatgcccatgccgttgccgcactcaggcgactcttcggggatccacgaaaaattgccgaggcacttcagtccgaactgatcaatcttcggtcggtggacgataacgttggatcactgcaacacttcctcgagactttggagcgtgtgtgccgccaacttttgaacctccacatgccggatgacagcccattcatgtaccaaatcattcgcagcaaactgccggcgactattctgtccgaactcgtcaaaatgg

SEQ ID NO: 5722 - DNA, 1734 bp, Heterodera glycines
tggaacgtgcggcaggtattgcatggagcactcctcaggtctgagctggacttgtcgaagttctcggagtcagagaagaggtcgaacgatgcctgcgcgaagccaatgccgacagacaaacacgatttcggcacgaagcaaagccaaatcgacctcagcgaccagaacgacacgaaaatacgcgagttttttccgttgctcagtccgtcagaaactccggtgaaaggcatgttccgtcttgcctgttctgccccggccagcattgggcctcagagtgcaacaaagttacagacgcagagactcgaaagcgttgcctcttgcaacagaaccggtgcctcaattgcctacggaagggtcaccaattgagggagtgccggtcaaagcaagtatgccgagtgtgaaaagagcggcatcattctgcaatctgccctagtgtcaaaggaacatcttctgctcgttcaaagcaacagaagccctcgcccaggaacaaacagactttcggaaacgagcgcaactcaaggccattggtgtcatccgcggttgccaatgaggctgactcaatccctgagccgaaaactgttaacacaatcatggcaattgtctccccatccgttcctcatctcgtcatgctcatggccctccgagcaatttattaccaaatgtttatttttaattgtttaatattattttcaattaagtaaatattattttttaataaaatacttaatcagtttaattaactaagaaaacccattttcgatatatccgattgttaaaggtttgtagaatttcaaacaaattttttttttcaaaatatcgttgggctttaatttaaatcctcacttttattcctttctagaattcggaagtctttaatgcacagtccgttcttttacattcccaaatacagaatcatagtcaaaattatttttattcttattatttttcttttaattatgctccataagaatttaccaatttgtcattataattaattttctaatagtatttcattttgtgtccattttaacatattcgaaatttaaaatgcttttttttttgtctttttatccttttaaaattgattaaataattactaaaaatattgtaaattatatttatttcattataataaatgatcgatttgagttcataattattattttaaaggttattcgttatgcattcagttttttattaatgtttatttttgtatttattcatggctccaaattatttatttgattttaatttcggtgtaaaataaatgaaaacgtctttgattaaagtaactttgactaataacaatagaaactttttttacaaaaagaggaaggaaaaggggaacagcaaatggaagaggaacagaaagaggagaagaaacaggaagagaaagaggaagaaacagagaaacagaaagagcaacaaaggcaaagaggaagagaaaggaaatgggaaatggaagagaaagataaagaggaacagaaagaggaagagaaggtgaaagtggaagaggaagagaaaaagcaacaaagggaaagaggaaggaacaaaaaaagaagagagcaagagaaagcgagagtgatgtagtgaaatgggaaggtagaaaggagggagaaaggggatgagaaagaggaaaagtaagagattttaagtgatcatattaaaaatttgagttttaagaaaacgaaaattgaattcccggccattaaaaaaatcagttgccttcttaca

SEQ ID NO: 5723 - DNA, 3959 bp, Heterodera glycines
  misc_feature (3951)..(3953): n is a, c, g, or t
gatataattgtgatttaaaatatgtttgccggttttgttatttgattttgtgtcatttttgtttgtgatttgagttagttagtgtttagttttttttatgctttcgtcagttctattgattgtcgtcgactattaatttggaattaaacgataattgtatcttcggcattgggctgtattgttttgtgtttgctttgggctgttgtcttttgttgtgtgcaacaacaacaaccattatttgttttttacgacttggcgctcctggcaccggtgaatcagcagtggacaaaaacaattggacgtggcctcgaactgaaaatagggaaaagtaaatccctcgacaagtgtggacaaatcggaaaaaagggaaaacaaattcccagcaagagaagagccgaatcaaccaactgtgaacagctaatttttgtaaaagggtaaagtaaaacccacgaacagacgagccatagcgatagaagtgactgaaaaaacgggacacaaatccctcaaattttaacggactgtcgacaaaaaggggtgaacaaaaacccggaaaacgaatcaagaagcagacgaacaagacggaattttttttgaaaacgggaaaagcaaatccctcttcacttcaaatctcagcaccgggaaaggaaattgtgaaacaaatcacaaaatttgtcagttcggtaaaatccttcgacaaaactgactctcaaacagggaaactaatcccatttcgacatgcagcaacttctccaaaacaaaacatcggacaaagggcatcggatggaacaaccgcagaagcaagaaggacagcaaattggcgcgttggagtttgtccttacattggaaaaactccctgagctgaatggaacggaaggaagcaacaaaattcggaaatttttcagcaaattttcgtccgcaacagaaggttggccggaaagtcgccgcgtttcagcgctggaaagcaaaatcagtggaaaggcagagcgcgcatttgacgccgcgatgaaatatcggctgaaaaatttcaacgaaatttgccgcggaatggaagaaattttgagtgaatgggattgcaccgaactgcgtgcattcaatgaattgtgggaaggagtgaagcgaagaccggaagaaacgttggacgattcgcggaacgactttacgtgattgttgaatgcgcttacccaggtttgccgcccatctttatcagcgattttgcgataaagcacttaattcgtgctcttgaaaaccctgaaatttcggtgggattggaaatagctcgccgtccaggcatgagcttcgacagtttcgtcgctctcgcagtacgcgcagaagaagtgcaaaaggccacgaaatcggctgagtctggaaacaagcaccgaccaaaatttcaacagaaatcgacatttcaaccacaaaaaattttcgcgccaaagacaaaccgaattgtgtgctacaactgcaacaaaacgggacacatttctcgccattgtaggttgccctttgcgcggaagcaatccaactgtgcacgaaaaccgccacaacaaaattttgcgacgaaaagtgccgattttcgaaaaaattcagaaactgagaagaaattgattgatttgcggttgtcgaaccaaccaccggcacaaccaacgaacgtggaagctggaccaaaacggaaagcgtccaaccgacagcgcaattcgtcgtcaagttgcagcgtaaaagcaacaaaaattaaggaaaattcgccggaaattccaaaatggtttttgaatgctatggttgctgccttggctttgctcgccagcacattctcgaatgaaaagtcaaagattggacgaatttggaaaggcaaaagctcaacgagtggcagtaacgacgagaaaaaacggaaagcagatggaaaattggggacaattttttcgccgaaggccgaggagaaattggcggatgtcgcagcaaccaattttgaaaatttgttgaaaattggcactgctctgaactttccaagtgatgatcggaagtgtgcgcaagaagctgctgctgatgaatttatcaggccatgtcaaaagtcggagacccgttttgtccgttgtttttacaggtctgaccttgcaacgcgactccatgccgaaccgatccactgctgacacccttgccgcccctttcaacgccgaatgcactaccgatgagcccaaagcgctgagtacatcgcttcttagagggcgaggatgtgatataattgtgatttaaaatatgtttgccgttttgttatttgattttgtgtcatttttgtttgtgattttgagttagttagtggttagtttttttatgctttcgtcagttctattgattgtcgtcgactatttaatttggaattaaacgataattgtatcttcggcattgggctgtattgttttgtgtttgctttgggctgttgtcttttgttgtgtgcaacaacaacaaccatatttgttttttacgactttaggaaaagcttctacttactcatcaagagctttcgaaagataccaagattatccaatttggttggcaaaaaccttcaaaaataattcccaaatatcgtcattttttaatattttggacaaaataaataaaaatattcatgttgcacaacggactcgaacctcctccctttgtccctttactaccttacaaaaaccacttcgccacacatgcaaatctttttggaactgagaggccaaaattgaaacggtgtgtacatataaaagttttttggcgcgtagcgccctcttgagacagtgttaaatagcgaagctatttcaatttttaaaaaataaattaaaatcaatttaaataaaaatatcgcatttaaattaaattaaaaacaatatcgtttttaaattaattatttgttcatttccaaattctcataatcctaaactatgaggatcgcttagtggccaatacatgctttttgcacgccccaaattatatctcccactagagccagcgttgaaagcgcccccggcgctttcacagggcccgcagggccctggttcttaccaaaaaatttcttattttgtattatggctattctttttccttatatattttgacaataatctaaatgctttaacaatataaattaattaagttaaatgaattaatttttcataagagaaaattcgtctttatattaataagagctgtttttataatatctataataatttataattaaaattattattttttctcatttattcgccttggtcttaggtttaatatataaatattttctttaattcattttctattaaaagttaactactaaaattttttgtactttttaatctatattatatatttcaaaatattaatttgtatttttaaattttttcattaataaattttacagagcttcatacaaattggctcacgttatgtaatggattttataatgaaattattataatatttttttcttccaaaattgtcttgtatgtatattctccagtaatcgggtcaacggaattttccgcgtgatttttcttttcgccataaatctcttgaacttcgtttaaaaattaatctttcttatttagtatttaattagcaacattattctatttttggatttagtttaaaatatctaatagaattttataagagcagaatttatatatcatattttattaaagtattttttgaagctactttacattaaaatttttttatttctataattttattttctgatgattgactaatacactgcgattacacaaataataatattattttttcatgagtttcagcgccaggttttaattgtactctcgcggttacatttttttatcttaatatttgaaaattatttatttattattttttgatgggtgtcattttgctccttttaaccttggcccacgatatgcatttgaattattttgtcctccatttgtgacctgcagnnngcatgc

SEQ ID NO: 5724 - DNA, 4818 bp, Heterodera glycines
  misc_feature (2446)..(2446): n is a, c, g, or t
  misc_feature (4768)..(4768): n is a, c, g, or t
ctcctcctcctcctctcccttttccttcttcctcctcctcctcctcttcctctcccttttgtccccctcctttcccccccccctccccctctccctttcttctcattcgatgatggcactcgtcgccatttccctcactccgcaagtgttccctcctctgtacattcgataatagcctttctcgcctgaacataaacagtgtaaatgccgtgctttctttgccattttctcaccccaattcgttccccaactgtttttaactgaaaggggcaaatttaattcagaaaaagcatcaatccgtcgaaggtggccaagcccaactcactgatccaaaagggctttctcgcttcctcgccaaatccgacgatcagaacaccgtggttcagccacgatggattgcacagccatttaggggggtgggaaatgccacggcggtaaaattgcattggcattgcgtttagaccttcaaaagctcaaaaatagcaaaaagatgacaaatgaatatgaccgatggaaatgggtccgttttgcaccagccattgtgccattttcgcctcgtcttttggcagttgcagcgagtcgtttatgtacgcactgatgcggtcgcttttcaaatggcatttttctttgtgcgcgtcgtacggatagtcattctcgcgctccaaaccgccgatgcgttcgatttccctaattgattattttcacccaaaagtcggcctttccttttgaaaagggctcatgaatggcattcccccctatttccgaccattctcctcacttgtacgcctgcagtgggaggcccccttggcatgccatgtccaatttgtcgcagtcctttcaatcgtttcaattttctttcttttttttcatttccatttttcaaactcccgcctcaccagcagttcctgctccgataactccaccaattcgccctttttcagcttccattgcccttcgatattccccgtcacactgaatgcccagcaacttccacacgtcccttggtttttgaccgttgtcactgcgcctttttgtctccaatcaaaactttcgggaagaatcccttcggcgattttgccaccatcgatcattttgccatgggaattcaaaggccatttgtaagggagataaatctgaaaaagcaaaaataaaagaacagccatttttgctgttgtcattttgagttaggcgaacaatgtccgaagggtgccaaaattggcatttttaaattatcaattcgattgagttgatttcacaccttttggaactctgtgacactcaaatcagaatatttcgtttctccaaattccgccgttcccttctccgccgattgaattcgcctggcaatggccaaattcttcttgaaaatgcggaatcgctttgcaatttccctcttcgtgctgtatttgggtccgtatctgtttgatttgttttttgtttttcgttgatttgtcttccaatcgattgatttgggtggccaacctgcgcacaaattggccaaatcggtcccattcgaataggtcgttggctttgatcgttcggttcagttgtgccatcattctccacaaagtgccgtcgtcgtccttttgcccctcttcgcttcttctctgctgctcctcttccccctcttcattgttttcgacttccttctgccattcttctcgccctttgtctctttcgcatttcctttgcacaaattcctcccctccgtccgcattttcgacaacgtccaccagacatttcttaaaaggaacaaaaaaaatgagttcgatcaaataaccgattaaatcaagtccgatcatatcaatttgacagatgagtacgagatagtcggccaaatcagtccgatcaaccggcctgatcactctgatcacaatacgtattgattagtacctttctcggccctttctcatccaccgcacaaagtccgagcagtattcgcaggtggtcctccttcgcatgcaaagtgtttgctttcatttgccacttcattcattaagcctacctgcttcagacaccccgtccgcattaagcttatctccatgcttttcttccgtgccccattttccaattcctccgtctcagtttccccaattattttccccaacttccaaaaatggctgtccccaatttcggcattcagtgcattaactgcgcgaatggcccggtgatgaagtgaagtggaagaaacgaaggtgacagcagataaaaggaagaaggagaaacggagcaacaaaaataaatggggaaacatttggggtgattaggaaataataaatgattagggggaaatgggagggaggcaacgggaagggcggtcaaatgatgacactttggggatcgataaagcaaaagagcgcccgaggggacggacggggggaaaggtgggggggggggaaagaaaacccttgggcggtatccgaacacagccgccacccccgccccncggcacaactgtccaccgaacggcacggccaatgtccgctgacagacttccgtccgtccgtatctcgcccattaattaattaatatcattttttgcatttccaaaacaacctgtttaaaccatgcacatcattttttcccctttttgacatttttttgtgtaataaattggaattgtcatttggcattttggcattcattccaagaaatgaatgccatttacgaagttgttattccgtcagagaaaatgacaccgttggcattcttccccccccccccctcattaattcactggtcggtccaaattgggcattttttggcgcactcagtgaaaataaataattgaccaaatattttggattaattaaaaacaaatagttgctgctttcccacttcatttcttttggtttctttttcttgtcattcattctttgctcaatgattaaacgaaagggtgccaataaaattttaatcggagaaaagactttgatcaccgattcaatcatcgaagaaaaaaacaatggcgaagaagacaatgccaacaaattcattagcgaagaaggcaatgccaacaaatgcgtgtgccgttttctgtggaacaaagaagtgcacggaatgacggcacttctgaaggtgaaatatgggcccaaaagatcggcaaattgagaacattgagtgcagagggggcgacaaccgtgaattgttgaaacacagggccaagccggtcaacggtacacaccaacagaatgtttggtggccaaccatttcccaaaatttggccaacccaatgtccttaatttggccaacccatttgtccttaattaggagaaccattgaccaaatttggccaatccaatgcccttaattagaccaacccaatgtgcttaatttggccaactcattgactctaattaggccaacccgtttgtcctccttttttggccaacctattacccccgccttttgtttagggtcccactgtgtatgtccgacttttttgggcttttgttatcgctctgtgtgttctggcgtcagtgataactgcattgtacactttcgaacactactttgaacgacatactgtcacttacaattctatcaaacggtaagtcattgactcgcgataggaattggccaatcggcgggagaaagtgccggggaaggggtggccaaagtggcaaaatgccaaccaacgaaaaaagggcatttattttccaaattaattcctttatcaaaaccttttgatttcctcgttaagcttgcaagaaatcaaattgcctgtgatcgttctttgtcctaagaacccggatgcgttgaattttagcaaagtcctaagggacattgaccaaagattgcctgtcgcttccctcgggcgccacaccctcaaacagctgatccgatttgcggtggccggtgccggctttagcaacgtggaaggctttgtgccgacaaaaaagggaaagccgaaaaaagacattgattacgaggtgcaattgcagagcatttttggttgattactcttcgtttcagattcagcagttgaactcgttgtttcatcgatggcttggaaatcgatcattgaaagaattttacaaaaacctcttcgaggattggggctacacatgccaacaagtcggttcggttggcactgtgccattttcgactaatcgcattaattaattaattacccctcccccattaagttcatccaaagatgttatttcggctctaaggtgtctttcacgttaatctgctcctctgttccattcttccgaccattcaggtgattcacaattgctgcagttactttgagccgtattttgtgatgctccgcggccgatgcatgcgaatgaatgtcactttgtatcaaaaggacccggcggactttggccgcttcgacgtttatatggtggggaatgaatgattaagggatttgcctttctaatgaatagatcattattattgttaattggtcccttcagaaccaattgccgagccgactgtccaatttaactccaaaaaatcaggcaatccttcatttatccttgtttagagtgccaccgaatgactcttttcctttccgccgtttatcagcaattttaagccccaagtgatcgcttatctgaccgacaccgaccgaaacgtcggccttttcccccgctattacatcaattttggcactgccgtatcaattcgagcgaaagcccgtaatatcagcatgttggcggacggaaacagccaatgtcaaaactacaaaacggaggaaaaagtggggaatggggagaatttgaagaaaaagcgatgggggggtgtttaaataggngacaaaatgagataaaaaaagtaagttagggacgaacacgtgcgactgag

SEQ ID NO: 5725 - DNA, 2866 bp, Heterodera glycines
gctttcgttcattcatttcgtctttttttggtgccttcgccgatttcattcgccacaatttccaatttccatgcgtttttcctcagttttgccaatttttttctcccattttttaataatttttttcgctgttaattcgctgaaaatccgagaattcgttgcccctccaccgaacgaagtggcaaaaaataaaggcaaaatgaatggcacagcaataacaacaacaattaacagcagcactagcaagagaaccaaaacgacactggcattttttaaagaaaaagggacaaaaagggatacggtacaaccaaatgggcatacggtaacaccgagaggtacagtagagccggttatggaaagacaaaggaacgaaacacaacaaaagggaagagaaacaacggcagaaaaagcaggcgaattggtaatgccactgaaagaagatggaaatggagagaaggaaacggaagaatatggaaaaggaaaagcgaagggaaaggaggaggcgatgggaggagaaagaagaagaggaagcgaaagggaagagaaacaggataaaggcacaatagcaaatggaagcgaaaacggggcagagaaagagacagaaaaaagaaaagaggaagagaaagagacggatgggaaagatggaaaagaagagaggaagagagaagaacaaagagaaaagacagaaaaaagaaaagaggaagagaaggagacggatgggaaagatggaaaagaagagaggaagagagaagaacaacgggtaacggagaagcagaacagagagaaaaaggagcccgaaaatgagggggaagaaaggaatgaaggacagagggaagagcaaaatacagtgaagaaagtgggaaaggaggagaaaaaggaagaaaaagggaaggaggaaaagaaagtgggaaaagaggagaaaaaggaagaaaaagggaaggaggaaaagaaagtgggaaaggaggagaaaaaggaagaaaaagggaaggaggaaaagaaagtggaaaaagaggagaaaaaggaagaaaaagggaaggaggaaaagaaagtgggaaaggaggagaaaaaggaagaaaaagggaaggaggaaaagaaagtggaaaaagaggagatagaggaagaagaagggaaggaggaaaagaaagtgggaaaggaggagaaaaaggaagaaaaagggaaggaggaaaagaaagtggaaaaagaggagatagaggaagaagaagaacaagaagaagaagaagacgaagaagacgaagaagacgaagaagaagaaggaaaggaggaaacaaatttaacaagtgtagagaaattttttgcaacatcagcaaaagcagaagaaacaacggagaggaacgacgggggagagaagacgacgacaattttagtaacagaaagagacggagagggaagcggaacggaagaggaaggaaaggaggaggaagaggagagaaaagaggagggggaggaagcggaagtggaaggaaaggaggaggaagaggagagaaaagaggagggggaggaagcggaagtggaaggaaaggaggaggaagaggagagaaaagaggagggggaggaagcggaagtggaaggaaaggaggagggcacggacgaaattggcattcccacaacgtccaaaagtgtggtgactctgccaacgattgcattgccaacggaatcagttgaaagaaaatgcgcggacacacatgattagtaagtacagtgacagaagggaacactactgtagctgatcaaacagtccgccccaattaattaattgctttcatttattgaacagttgtcgcttttgggctcggaatggcttttgctccaacgctttttacgcaaaagagcaaattgcccaattttgtcgtaagacatgcgcactttgctgaggacaataaactgagttaatttggtcggaaaatatcgattggtcacagatcacaattgattatattgattattttatttggtacaaaattatgtacaaaattctcggcaatatatataatgttatgaatgtgaaatcagcaaataaacaatttaatataactttttgggacaattggcttcgatgaaaggcacagacaaataaataagcaataatatttgtcgtaaaagatgatcaattaattaattatcaattaattagctgatagctttgccattccgttgctccattgaatgatcaattataattgtcttttcaaatgcccattttcattgtgccattctcttacagcaaaatgtccagcagtggtgcgcctgccgcgtccgcgccgtgcggcaacagtcgctgctgcgactcgccgatggttcgttgccgctggccgtccctcgcggcattttcctccgctgtttcggttgaggcggcggacgtcgcgcgtggaggggcggacgcggtggagatggagcgcatgctcgggctggccgaccccacacaattcgctcggcccgggtccctgccgagcatcgatcttcgccctgccggcaaatgaatgtttggcccaatttcaaccgcaaataaaaagggtaaaactgacatttggcaccaaagagtggcgtggacagcgtcgaattgcatctgcccgagctcatcaccgcgaggctgctgtgctgcagcggcgccgtactgctcgaggcgattcggaaagtgatcgaatgctgcgggggcgttccgttttgattggtctgaagggacggacggatggaaaaatgcagcaaaagcatggccaacaaaggccgcggaaacggcacccaccgatgccatacgcaaactgccaccgacgactccgccgaaagcgttgtccacccctcccacaaaatatgtgctctcccccgtgtatttggccctgcgcatcagctg

SEQ ID NO: 5726 - DNA, 6562 bp, Heterodera glycines
cagtaaagtaaatcgtttctaaatgtacagaaattgtacgggtcagtcattgtgggcacttcaaattcaaaggccaccattacgcagggcgagtgatttaaagcaaaatgttttaattttaatggtcataaatttcaaaggtgcgtgtcaagttgcgactcggatggctgcaatttcgcaaaagcaaaaaatatcactttcccatctcaatttttattgttttttgcacttataattttaattgtcttaaattttaacccataaattatcgaaggataatcataaaaaaacattatttctaatactctattcagtaaaactgaaatattctcttgaatggtaatttaataataatacacggcgattcaattttgggctccaagtacaattaagttggttttttcgtcttagtggtctgtgagttagtcaccaaaaagggggtctcaagttcaattcctccttgtgtttgtgtataaatttcaattttttaaagcaaataaataaaataataataaatacagaacgccaaaagaacaaatacaaacagtaaaaggtacacactatattttacccttgattttatgaaatttttttagcttataacttggccaataatagaccaaacaaaaccattttgtgctcattttgaagggaaaattctgaagaatatttcttaattagtcaaaagtttaaaaaattgtttattggcaaaaaaatgaaccatgtgttattttatatgttagagacatggaaatagtgcgtcaaaatgagagaaaaagaaaaaactttgtctagttgaatttttttttctacagttgggattttctttaaattttgcataggcccatattttgacctcctctatcgattctaagtttattttgtgaaagttaagtttttaactcgagatcggctcttctttttttgcaagggaaaatctccggaaaattttaagttttgcaaagttttggcgttctgattactaaataaaaaataagcataattgtactgggagcccaaaattgggccgctgtgtaaaggaacaaattgaataagcggaaacacaatgatactaaaaaagttacaataatttacatattccattaaatatcctataagcaatgaacgaaattgacgatggccatggaatcgacaattcagaagaaacgcggcggttcaaaggaattactacaaaataagcaatgatacagtatacaataattagtatgcaaaataacaatacactataatatcccaacacaccgattacgaagcattgcgggcgtgtcaggcattcgaagcggtccagcgatttcactctcgttgaaaaccggcgtctccagcacattattgccaacatccttcctattcgcttggaacatcgttgtctaaaaaagtaaatattacttgaaaaaatctgggaaaaaacttgaaattttcaattattattacttacatcgttgagattcggcgtacttttgacacaatcaaaggaaaggcccaacaacggagtgttcccatttagacttgcaaaggcccggttcgggtttcttggctgcagctgcaatttgcacgcatggagatggagttgcttctcacggtcagccagtcttcaaaacaatatcaagccttttcaatccttgagcaaattcagggtcatacaaggaatgattcaaaatctaagctctaaagtcgacgaagtttgtctagactgcttttgagtggtcatctaattgtaaggcctctctattgcgccaccttgcgctcttccaataatccattacaaattcctcacttcgtcttcaagttttgggcctgctctttgtatcgttccatctccgctttcatttggttacgttctttcaaagctatgcgctcgttgtccgatgatttgcgcagttccactttcagtatttggatgtatcttgcagcactttgcatctgttactttataaaataacaagactaaatcatttgaaactttgattactttagccttttcttattattactactattggcaaacttccgacaatgcatccatttaattattgtacttttccttatgtcacttaaaattctgactttttagttttgtgcaaccacataaatttaaaaaaatcaacgaaggggtggatggcaatagagcaacaatttggaggcgtaaaagcaaaacttccatcaccttttccatggtttgtcgttccttaaggcgcatgcgattgttttgttgaaagtccaccaccttcttcaattgcatactaaactccttgaaaaggttgaccggtggacagaataactgtttcaactcgggcttcatttggttgttgaccttgatcaatttaatattttgacgctgacagacggtacaaacagacgcactgccgcattctaaaaagaaaacatcagacggagagggggtggtagaggaaggaaattctaacgcaccccgaattttcataatatgcatggaatcgtgaaaattaatgattaatgtgcacaaagccgaaaaatggagacatcaattcagtgctttattgtaccgtggtgattcttttggagtttaccttttcccatctccacacaattgacacacaacaaatgtccacatgaactaaaatgcaaatcatcgtttttgagaaaacatttgctgcctgttaagaaaacaatagtaataagaaaaatatagcaaacaaacatacagcaaatccaagccatccctaatgattaatggaataatctatgaaaaaattgagcttttttatttgattttaaaaggtatcagtcaaataatagaatcaatcttgagaaccaaataggaattaacaaaaacaaatttattaaatctaaataaatgaaaataattaaacaacaatttagaaacaaatgagaaagtggaaacaatttaaatcttaaaaatgggaacaatttaaatcttatgtgggaacaatttaaatcttaagtgggaacaaattaaatttaaaaaagggacaaagggaaatcaaatggtgtacgaagaaattctctcaaaatcaggcattgactcgatgaggtgcaatccaaccggcatgttccagacaaagcttctgattcagatcagcgaacgtttccatgtcacgtggagcatcatagtaattgaagagattgcggccccgttttgcatattcatttgcgatgtaaacctgaaaattgagtaaagaatcgagtcgtaaatatgtttaaatacaggcgcaggcaaagaaactattgaattgatgatctgatggccaaagcacaagtggtaagacatttcctcgaggtccatgagactgaatttgttgtcgtcgtagactacggtgtattttggggtacgtgcagtccccttaaaaaatcttaatgggttttgcacatacaaaaaataaacctgaagagtacgatgagaattgagaaagaattcgcagtttgacggatgcactacagccgtgtcgatgaccgtacccggtttgatgttttgttcagggggcttcgcattaggttgaatctgttgaatttgagcatatcaaattttcagaggaaagaaagattacctgtttgctgaagaagcgaacattctgcagtttgttcgagacaattaatgtcagaccgacattatcacaaccggcagaacgcaaagcgcattgaatcagcggaacttcaaatttcaagatcttaaagtaaatgatacaccagaaagaattaatatccaaaaccattttgaactgtccctcgctgcatccgtttcggtaaatgacgacacgccttggcaaacttcccctgacttctttaaagtagcccacgcacttcccaacgatcgactcgatgatgttgaccttttcttcacgccgagctctctaaaataaagatttaatttaaaaaacaagctgcgacaaaacctgatacataaaatcgccaacgaaatcaaatgggagctttgtcggcccaacgtttgccgcaaactaaaattatggatagtaagaaaaaagcaaaattataataaatgaacaaaccccaacgaccgaaggaggaccagcaacaatggactcctcagacgaaacagaaagagtctcactccgtaatgtttcagcttcagccataggacgctcgccaataccgcctccgggatgattggtactaataccaataataagcatgtccgtactagtaacaaaccttaaaacaatttaattaagaggaaaatagcagcactaaaactcacggagatcgcggaagattgtaattgataccaccgagtttgacgttggtcttattcagaatattgtctacagtgagacgttgctgcttcgcagcgacatttctaacagtaccagccctaacacattggctgataatttggtagtcacgttcgcattttttgataaagtgatgtgccaaatcatccccatcggcatgaatgcaaagcataaaagcaattcctgattgagaagcctcttggaacagcgctgaaatgtccttaaaataaaaattaaaaggtttgtggtggccacgaattagattattacttcttttgatcggaaattcaccagtcgcaaatggtcccttggaagggctggaagtttaaggcttcgtctttttgcctggtcttcaagcagttggataaatttgcttaaataaattgataaataaaaacttttttatggaaacatactgaaggtctggctcgctaagaccgcgaccaccaagttgaacaaagcacgccaacatccaactgtaagtaccgtcagcaaacaccgattgagggaccagcacactgttgattcgccaagcagcagaaccttccaccatcggcctctgcatgttaccgtcgccagctttgacttcaggatggttgagctggtgagctctcttcaaaaaggtgaatgaatcgtttatcaaaacaatgaaaaacttacgagggcaattggctcggtagtcaatttaatccctgcctcatctagatattcactgtcccagagatgaatagacttcgcagtgttgtgaacctgacgcttgaagactaatggtggaatggcacacttctagaatacatatatgcacaatttactaataaaggaaagaaactttgattgactgctgaatcattgtcggagtttgttgctgagtggtgactcgctgattgtcaatgatgtccaaaacctcgattgggtagtaattcactcgcttctcattggcaaatctcgaattcattgcaatcaaaggaaggtttgggtagctaaagatattttcacttcaaccaaacatgtttttttcatactccagacgacgaccgtatttgttgttaaaatactgctcaattgtggaggcgttcccatcaacctcaatttgcatctcattagcgccttttctttccagccccttgattggaaagcgttgaatgttggtagcgttgtgattggtttggacgaaaaggccttaatccaaaaagcattgtattaaaaagtcagaaaataacgcacctttcaacccggtagtcaacgacgaaaccattcttcctttgtccatgtctaaattaccgctaagcaacgccatgaccttctcgaggagagaacaattcgcatgaaacggagttttcttagctgaattttattttattttaatcgaatgcttcttttattaacgtatgaaattacaaatgtccgtggggttcgaaattatttttcaaaaagaatatacgttggacgagcaatcccgcagcacaattagtccttcgagttcgtccagtgccctcgattaggtgggtcgacttgctgcaccccaaagccaaataagttttgttctcatcaaaaacaagggcgtcttcttctgagaacccaaattgttcggggctgtacgcataagacaagccagtcgaaaaatggacatgctcatattgtccttgttcacttaatattttaattgtttcttagtaaatctgtaacaaggagtaccagtgaaagaaaattttctgactcgttgcaatgtccaaaaattgaagaaggtcacgatttcccaatgcaatgtcgggtcgaagtgacgaaagatcttccaatttcaccacatattttccacgctcatcacatattggtttgaagctgactgtgattttgctaacgtgaagttcgctgaagaattgcggattctgcatatcactgccgttaaactcaaaatcgagctgagaaggcttcgatggatcattggtctaaatgaaaaataggttgggcatttcgaaacaatgggcctggaaccatcagtgttgcgaatggcttgcaagagagtggcattatcggtgtgaaggtcattgtagagacatcaggcatggagggcgaaggtctcgatgaacattcataaagcggggaatgactgcgtgtcaacagtcacgacgatggacagcgatagccaggaaaagtatgtaattcagttaatgtacgaggacgacaagtggctcatcaatatatttcttggtgatcaagcctcacgatcgttcgccgcgcacgttcgccgacaatgggcgcatagtatcggtagatatccagcggacccatgggga

SEQ ID NO: 5727 - DNA, 2249 bp, Heterodera glycines
  misc_feature (26)..(26): n is a, c, g, or t
  misc_feature (62)..(62): n is a, c, g, or t
ttcagttaatgtacgatgaagacacntgactcatcccttatattcttggtgaacaagactcncgatcgttcgccaccacgttcgccgacaatggacacatcgtaacggtagatatccagcggacccatgctgatggcgtaaacgttggtatgaacttccaaatcgccttcgtggcctgcacttggtttttccgccatgacagcacgaccaacttccacctagaccaggaactaagaagaaaccattaaacaaacacaaacatttctgagttttagagccttctccgcttctctttcgtaaagagtacgttcacgaggctcgcttccagaaccagattgtgttccagtgacagaacgagcaagactaccaatggttgacattttaaattaaaacaataagcttaagtaatagataacgtagattggaaatggaccatgaaaattcgatttgatatagtttacccaaacaaaaataaaaccataatatctttttagattcattcgatatgattgatatataatcctaagtaaactttatgaatcaagaaaccagaaaaaaatgagatgaattttatggctgtctaaaaggcgcaaattaagatacagatgttacaactatacaattctaggaattcacagaatatttatggtcaatgaatgctgtttatgtattacttcagtctatttgattaaccaattactaaaaaaaataagaagggaaattattaaaagttggagatggaatacgcaaatgaatgtgagcgggtgtgggcgtaacttaaaacatgggctgaaacacggtggaatatgacatgatgttcgtactgcgataccgtacttgtcatttgaatttgattcaattgcccctctctcttgacttaattaatgcttactgtatggtgcttttcgtctctttctttttccaatgcttttcccctgttttcttttatttttttttgtttgccttaccttacaattaaaattgttttctttatctatttttcaatctcatttcaataattaaaatttgttcgaattcttcaccatttttcgggacaacattttgagtcaccccgcccatttcccctaaatttccttttttcaaattccgataaacaattccaaactttgttttcagtttctcgccttttcactttataataattcgcattttgccgctcttttccatctaaaacaataagtgatcatttccaaagagtgagaaatatgaggtcatttctgttctgcttccattgcaacttttatcaatcattgaccacgcccaaacgcgattaattcatcttaattaattatgacaattcgggaggggtcgaccgaccgtttccctccctttcggtttcaatgagcactcattaaatgttcaaatgatggaaacaaagttatgttaatttaatttaaggcataattacaattagcatacataataataaactttaatttttattttccatttattatttattatttttgtcgtttttgtgctttccccccccccttcgaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccattttttctgggataacctctaaatataaaaatcctctggtgaataaaattggcgattgtgcacagccctccgtctcatacgcaagcgcttttgtgagggataaaatttctcaaaaaagagatagacatttttctgggatagagaataaattttaaaattcccctcaaaaataaaaggtctattgcgccacgcccctccctatcatgctc

SEQ ID NO: 5728 - DNA, 691 bp, Heterodera glycines
gagaagacacagccaatggcaagggacggggctcacagcaaaggtcgcccactgagttttgggagcaacagtaccctctgcataagcacgcctttgatgggaacgcggagcgcatacggtatgatacggtacagtgacatttgtcccaatggcgccggtcttttgttggtggacaattcgctcctttaagggaactgcttgcccagggcgatgaccccaatgagcaggacaatgacctttggactccgctccattactgtgccttttacaaccgattggaggcgtgcgaaacattgcttctccacccacgcaccaatgtgaatgttgtcaatggcactggggcgacgccgcttcatttcgccgctctgaacggcatcatttacgtggccgagttgattttgtcccaccaattggccgacattgtccgtccttgatcaattaatattgtaatataaaatggcattccctgccttggcagaacattcgcgacgccgccggaaaaactccgttggacctttgcgttttggtgccgaagtccgactggcgaggggtcgcctttttgctgaagcagaaacagccggcgaaactgaccaaagtggaagtgcagttaatcggtgcaccatcgctgcaagtggaagttgacgatgcgcagaaagaaacggcaaaagagttgagaacgaaagtgtgcaaa

SEQ ID NO: 5729 - DNA, 4157 bp, Heterodera glycines
tccattttggatttgaaaaaaaggaagtgacgattccgaatgaatgtgccgaccaaacacttcctcatttaatcagtctcttttttttaccaggaacagcttaattacgtaataaatactaattggaattgcaccaactttcgcttaacagtcagtcgcccagacgaggttcttcccgagaaacattgcaatgccggcgatcgttgttttggcgccgaacaatgcgatgagcaacggagaacggccagcgtcgtggaatgtttggtaaacttcgctttgattggaagacattgccaaattacttaatttgcaactgaaattggagaattttggaatcgaaagaaaatggcaagatttaatgggccaattaaataaaactcattaaataatgagataaagagagaaaaccgctgaaattcttaatggaatgggacaacttttctctcctttcattttacacagtttttgttgaaaattggaaaatgctaaattaataatgcacaaatcatttaataattggcaaaataaaaactaattaaattgcttctatcgtcaaaactcataaaacaaagccaaaaagtcggcaaaaatttaaccggatgataaaccaaagatacaaacattagctgagaaatgagacaaacattaagtacattttcacactttccacctgcggtggcatttggccctttttggcattttcccatgtcatttattagaacaatttctcccattctccgtcatttttcttctgcttgcatcacagataaattcgttaatacatttggctaatttttccaatttattctaacagttaattttcctttaatctggttataagattttaaaaaaatataaaatttaaatttttgaccttgtatagttgtgaagcaaaatagcaaaagaattaatgataaatagcggcaaagccattggccaattgtcctgggaattccccccccccccggaacccattaaatttaattaaatttgaatgccgtatttccggggcaaaaggcaaccatttatcacatcgataattgcgttacatttgtgaaaaactgttaaatggttaaagatcaaattctatcattttttgggcataaattatatttttgattcattttcgttttttgtaataataaatatttctttttcgtattttcaaaataaaagcacctaaacacaataaataagtaaagggaattatgatgaaatgattaattattgtaattaatgaatatttaattgcgaatattcaaataaaaattttagtatgcaattgcacagttcataatgatatcttatcaattcattatcattagcatttcatttgcatccatcatccatttgcattgcccatttgtcagaaggatgcgattgtgagcaaagtgtgcgcgtcaaattcgacgcctttggcgtacattcgccgaaagggccgaagaagcgcggaaagattgaccacggcaccggaacggagcagaaagggcagcacgagttgcatttgcaccgcgtacatggccagcaccggtttggcggcgtatttgctgcgtcgatgggccaaaagtgccaaaagcagggaacagagacgggcgggggacagtgccgggcgcgggacgaagaaagcggaggaagcggacgcggacgacggccgtggcatttcaggacaaaatgggacagcaaaaaaaaagagatcggagaagaagggatggcgggtaatgatgaggttttggcaacaaaaaaaccaatcaaataattagatgaattggcactgatcaaaaaggggaattagtgcccccaaaaataatagtcaaaattacgaatgagtggcttatttttctgtttttaattggtttttttttattaaaaaactgaaaattgaagggaaatgacttctcctttaagcaattgtgtccaatttttactctgttgccaaaagaggaaaaaaaatgaacaaaacagaggtgaaaaagccaatgaatgcattcactaaaaagcatcggaaaattggagttgacacgtgccattcgcatttggaaccaatgaaatgccaacaaactgggacaaaagtgaaaatttcgaaagactgacactatggcaaaacaaaatgtatggcaaagagaaagttggttgaaagatgcagcagagcaattaaatgcatttaattggtttaattgccattggttaattaatgccctccgggcaagactcttttcctccccgctgggctttggcgagtgggaaaacaaaggcaatgaatgcataataaatgagtgcaaatagtggacaaatctcaactgaatttaaacggtctcccactgaaaatctttgccttaatgacgtgtcccaatttgctttctcccgtcgtttggcggcagaataaaattgtggcaccaccagcagtagccgcaacaattgcttctcactcggaatcatgcttctccctctctctccacattcgttcagttttccctttttgagaatttggcattggcaaaaaagggaacaattggccgagggcacgcaaaaatggcacacactttttaattgcattttgtctttgtctttaattggccctcaacaattctttgaacaaatcgtggggatttaaggaaaaccaaaaagaaacagaaattaataggatggacaagcttatccacaaatattccttttttttgttttatttttcattcctttttaattgttagagaataaaatataatatatgaacaaaatgatttctttaaattattaattattacctcattttatttttttttaattttgtgtcaatttgtaatttatagcagccattttaatagacattttatttaaacaaattgtttttttcggatattgcatttcttttgggtttcgacacttgtgccattctttttttcgatcagtcataatcgtcaattccgtgctgttcgtccgcattttccgggtttggcaacgtcggcttataaaattggaggagcggcgatgggccgcccgaggccgcgtcgtcgccggagggtgtcatttcccttcgctttcgtccactgatcgctccgatgggagggatcagaaagagccttcgcgcgatcagatcctccggccctttgccatccgtttgggcttcagcagcagaagtaacggagccaaggggacgaaatcttttcaaaaatttgaaaataattgagactttcttcattgcccacctctgctgcttctgatcatcttcagatgaagcggcagacaaagacaacacgtctatttccgcggatagtgatggattgtccgttggccaattgtccgatgatggtctgtccgtgtcgctctgtctcgtaaaagcggcgccagaattcttggttttcgattcaacaagttctttagggacgagaccgagaagaaagcgtgccacggtgtaatttcggagtaaattcgggtcaatttcgacaattttcagtttcgatgacggacaacgcgtgcatttatcacatttgtgctgatgccgcgcacattcgttctgcacacattgatctaaacaacaccagctgaacttaaaattacctcaaactggagacagaggccaaaaacatggaaatttaaagtttaacaaacaaattattgccaaacactttcggagacagtgtttaggacaattttattattcttgacaattaataaatatttaaatttttacccgttctaaaatcactgatcaagtgacgtctcactgagataatttgatcatcttgccactttattttctcataccctccactttgtcaccactttacactctcttgccactttactctctcacttttctacactctttcgccactttactctctcactttgctacactctttcgccactttacactctttcgccactttacactctctcgccactttactctctcactaccctctactttctcgccactatacactctctctcgccactttacattctcttgccaatttactctctcactttaccatactttctcgccactcatcgcattgccttttgctcaatttttggcatcgtttttgccgccgttgtgctggcgaatgcatcccgtcaaaattcattccatttgaaaagtcgttgaagcctccgccgccgtgctgagactttcgacggcccgttgaaccatcggg

SEQ ID NO: 5730 - DNA, 2023 bp, Heterodera glycines
tatcaatttttaatttacttaaagcagagctgtgatctcaaaattttgaaaatcctcatttcagccgtaaaaatgctcatttgccactaaaatacctcaaaaaatcctcatttggcatgaaaaatcctcattttttaaaacatcataaaatgcgtacaaaatcagttaactgtcatatttttcatttgaaacaatcaaattcatcaatttcttgtcatttataagcattttatggaagtctgagcacgaaaaatcgaagttgcacttcacttgggccaatgctttcactgtgtccatgtgtaatgaattctgttcatctgtccattgagacccacaaaaaattgttttttttgtggcgcggttttccaaacaactttttgggaacattggtccggcattgccgataggcctgccggaaaaaatttggaattttgagtgcgatttgttaacaaattttgtcaaaaaaaatgattttgactgaggatttttcgaaaaaatgtttaaagcaggggtgggatcgtccatgctccgttcccaaggacgggtatgccgatttgcaaggacataatgggggaaatacatgaaatccaaggacatttaaaatttgtattatatgcaaagaaaaatggttaatatttattcaaatggcttgtatttttcaccggaatggatttttccaatttcaaaattcattccatttaaaaagtcgttgaagcctccgccgtgctgagattttcgacggcacgtgttaattgattaatgagtcaatgctaacagttaattaaaagtgtttattagcgtgggaagaatctgtggaaatcaattaaacttaatcaacagtctgcaacagtctgttggctgaccgtacaatcggcacaataatggtcataataccgaaactgcgcttgaccaccgttgcgtccagcttcccaacgcccggagcccttctccgtcgccgtcccccgccgggaaaaaacacttcgccaccgttgccccctctttcaatcgcatccaacagttgctgctgctgttcaatgcgtcgtcccgtcgaaccgtccgggaaaagttcggggccaagcgcggcgtatggtttctacgcaagagattaaggcatgaaaatagttattttagtaatttgtttattttaaaattcataaaaaacaaaaaatagtttggaattttaattacaatttccggtcagtcccaaattgttgcttaatttaattatttgtgccggcggaagtttattaccgtattatcaaagtaccattaagccttaccgtatttccattttcttttttatgctcgcatatttccctttgcaattcccacctcatcggccacgttaattggcggtgccacagcagctgcctgttgagcagtgtttgcgataattcccgaaccaattgctgccgctgtcgccgctgcgccattgtttcggttgcgactgccgccgcaacaaaagcaaccgccgccacaacagccgcaacagtcgcagcaaccgcaataacacgaacaattcgaagatggggggaggagtgcgagcagtacaaggaacaactgcagcagaacaatgcaacgacaaaggatcatctgctgaagggagggagggcaaaagtgacgacgaaaaggccagcgaactgaatgacctaccaaatgggagaagaccgagcagacggaagacagaccctttggcggggtgaccgcccattaaacggacgaacgccggggaagtgggcggagggcggacaatgggacaatgcgaattgcaattcccatttggccacatttgcccaccattcattgtctttgctccggttgcagccttgttttattgtcgaaaatgttgaatacaacaaatgcaagcagtacagcaactcagcagcagcaggaggggcggggaggggaaggaggcgatgactcgtccgctggccgaccgatgtttcagttttgcgtcaattttgtctcccgcgcatccctcctccgattcgctgatatctgctgctgtccattcatttctttc

SEQ ID NO: 5731 - DNA, 2255 bp, Heterodera glycines
cgtcatctctttttttaattgttatgcatcgccatttaacaattacaacagccttcgccctgtgaaaaggtcgtcgtcgttggccccgacggatggttaacaacaacagcggaccggatcaaaagccaagcaaacaatgggagggccatgaacagaaactgaagaacagcagcactatgactggtcatgcgacggattctcttccccaaagcaatttttaagtaataaggaaacattgggcctaaaagtctccgttttggtcgtcattttgatcagcgattggttctgccgaccattcgctgcctttgccattctccgtcacttctcttctcctgcactttgtctctcatctctcccccaaatgttggcactttccccattccatcagcagctgctttccccgctgcccctcgccgttcttttgcctttgtttttgccagctttgctttttccatcgatgccacgcgttgttgcgcaatgcaagggcggcggatgcgaatgttgcggcggatgtggttgcgcggaatgcggcggatgccaacaattacagttaggcggtacgtacgtacaaattggcaccaattaattagtggttctctcgactcaggatttatttcctatctgatttaagccttttgaaattctttttcccaaagacattgttttctctacggcacaaaatgcttcttcaaacggcactcaaagcgatacacaaaacagcacaaatggtgccgttaaattgaatgagctagtgccaaaaatggttgttgaagcaaagaaagaaaatgtcaccgcttctgtcccaacgtggcgaagacgaaggaaaagcacaacgccaacagattgggggtgagagaagcaaaacacattttaaatttcccaaatcactcctaatgattttattttcgataccataatcctagtcatatacttacgaccactatttgaaaaaagtattttcagatcactctttcacagtgatcgggatactcctaaaatgttgaaaatcgggaaaatttcgcaaataatccctatggggttggggaatttctaccaaaaaatgagtagaaataccgtacagtaaaccgagagtacccaatttacacgatgaatatggtaagaaattgagttgtgtggtgaaggattggagttttcccttcatcgtttggcagagaaggcgtcattaaactcaattaacaaacaaattaatgcaattgctgtctaatttgtccacttacagctccgagaagttgttgactccgcaacagttggagggcaagttccagcagattcggctgcttcaacagcgtccgctggccccgcttcagcccgaacttccgcccatccaaccgcccgactttccgcccctttccgcgtccgcgggcgactcgccgtcgttcgcttacgccaacgaagaaacggcgggcaaatttcggccgcaagtgaccagcggaattggccaattcattcacgtgaagccgacagtcaacggcatcggcgacgcaatgggacagcgcgcggacgccgccgccgaatttgaggacccgacacttaaacacccatttgaggagccattttggatatgaagcagcaattggaaagggactggactgtttttatgtactttacatgaaaaacccattaatttgtttgaatattttcttaaatttttaaaagattttaggaattgattaaatcataattaaccaaccatccattaaggatgggaagttgcagcgcactttatgaacataagagaacggattacatttaatgcattaaagcaaataaaaaataattaactttttcatttgaaagtagtcaatttggcttaattttctcccctctgtaaaaaatccttccgtgaaccttttaatattatcattaatttacaaaattgacatgcaaaaagtaaaataaggaagggtccctccctcccttctcgatttgctctttctgtttccaaataaacgaattttgccatcgatgcccaaatttggcattgtgccgaagttagcctaattgaaatttttattttacatagaaagcaaagaaacattccaagaaagtgaagggatttcattggatttttctgatgaatatttaaggcggattataaaaggcttcttcttccccgaattcttttggaaaaaaggcttcatcccttcaacctccgttttaatttacaatttctctctttttcggtttttccatttccataaatcatttcttttcctcttccgtccgtctctgat

SEQ ID NO: 5732 - DNA, 4541 bp, Heterodera glycines
ttttgcaaatttttttgagacaaaaaattgtgaatatactttttattcgccataattgtactgttaatgtttaatgttcatattatgagtaaataaaacaaaatttttttcaaaaagggaaaaaaatttcaaaaacgtccttcttgtaactagcgccaaaatttttgctatctatcgatgtatgaatttttccttgaaaagttgtgacaattatttttcgggattttgacgggggatttacgacagccattagcaatattagcaccggcaacattaaagtgtcgatttgctgctgttcctctctcttttctcctcctcctttttgcgccgaatttttccttttcctctctttctcctccgtctctcctccttccccaatgctattttcctcctcttcctttgtttctccattcattcccattaaaatttgtacgaaataaaaaataatttttcaaaaaacgttcgaattcgggttaggggttcgaaactgcgcaaaaagatcaaattcgtactcagtcagcgcctcaaattacccttaaaattgctttatttttggggtttccctcttttttgtgggaccaaatgatcttggcgattgccaaagccatttaaggtataactcgtcgaacaatcaataaactcagcaatttgcacactaatcatttataaaaatttttacagaaattatcggtctacgtcagttcggccccgcacggttcggccccagccatgttttggactataacttttttttctttgtcaaccaaatctaacaatttttatatcattcgaaagcccttcagatcagggctggagcgcgaccgcgatgcgcgatccacggcgtttttttttgcgcgatccgcggtcgcggcaatttgaatgcgcggtgcgcggccgcggttttttctgtgcgcgctccagccctggtgtaaacgtagttttatatattatttgttttaatcttttaatttagccccaaaaatggaaaacaatcaaattataacgaaacaaaacaacaaaaactcgaacatgaaggatgcctctatgtcttccatatgttcaatgctgaccgtgacgtaaaattttggcgctgtgaacatcagcgtgatgaattcaagtgcaggggacgccttcacacagcgctcaatgatgtcgttctgaagacaattggcgaccacagtgtggcaaatgtcatcacacaaaaaatcgtcactggcataaagcggcgtgccgctgagacgatggaaccaccagcggcaaccaggacgcacacacttcagcaaattgccacgccagtaatggcgaacattccaacaaagaatgccacaaaaaagtgaaaatctaatcatttttttacgttcacatttttggttttaagctagtgaagcgagtccgccatgaaatcgaattgccgccgccagtgccgctaacgcttcagtcctccattgttttgtcccgaagaatgaagtgtgcatgagcgcacaatgaacggcaccgaccgcacaaataacttcgccgaagcataccattgcacgctgcaactttcgatcggacaaggacaccccccgatctggaaattcatcaacattttgcgcgagcatcagaaaataatcgacgtggacttcgaacatttcctcgctggaaatgctccgccgcaaaagcaaagcgttaccgtgaagtggacagacgaattttgaggattctggagcgctacaatgaggaaaaaacgcagccgcaaatcgacgatgatcaccaatatggccaaaaccaaaataaccgaaatttgatttattgaaatgctcaggggaatttcaagcaattaccaaatgggtaaatgaaactttgttaattttgttaaaactttattttttctataaatttttgaatatttcttgttgtcaatgtatctgtgaaaatgaaaatatagcatacagaaaacttaattaatccattttactctataaaaaatgtttgagacgcaactggccccttaagtactaagacgcaactggctagacgcaactggccccccccctaccgtggaaaaatatgtctcgagttgcggaaatgccaaaaaagcggtttttgaaccggttctaaactcgaaaaaatggagacggagaaattatttttcaacagaatttatttaatggaaacttttgaaattttgaaggtgtcccaaaaatgtcacgcgtcaataaaaaaattgttgcttttgttaaagaatctctgaaatttatattaaaaattcgaaatacaaaaatttttctatttttgatcagttaatcgaaaaagacaatcaaaaatgtatagtgcctgtctctaaaattagcgaaggaaaatgtttttcggtaatagtaaagctggtgccccccccttttttgaaaaaaatattttttgttttcaaaagacatgaaaacaggtttcctgtggttttcgaggtcgctgttcaggaatccagtatccatttcccctattccgaaccccggacccgaattcgaacaaaaagtcgaaaattcaatttttggaaacacttgttagtctaaaaatggttcaaattaccattttactgaagcagtgatgacttttagttcatttccgtgttcttaaacaaaataccaagaatttttaataagaaaaagctatggtgcatcaaagttgcaaaaaaaaagcttatggtcgtgtgaaccgcaatagagtcaacttttttgccatttttatacgtccgatttatttaccgaaattgagaggtttttcttcataaaatttcatttgatcactaatttgaattatgctcggtcggtcattcttaatattaattcatttcttctgcggctgatcactgtttttgttggtttgtccatcactcattttgtcagcagacgacgcccctttttcgctgctttgtccggattcttctgcgaatggtggaggagacaatggccttaattaagcgcaatttgaattatttaaacacttttttaaattgctcacccaatgcaattggcgcaattaaaaagcttaatgatcacaatgtcccaattattgtccaaattttcatctttctgctgcttctcctctttctccccaatttgtccattcgtttaccaattcaaacggcaccattggcattgacggcacacgaacagaaaaatgaatttcgtaactgacggaagaaatggcattggcacgaagaaaatgctaaacaatttggaaacaaaagcactgatttgtcgaaagtatggccacacctccttgaaattgttgacccaatcagtgttcccttgttcgttgtgatcttcgcaacgcaatcgcttgggttgactattttttctcggaatgtgcaaccatttgtacagaatttggccagcagaaatcgttgcatttggcccattaaaatcatcatcaattgcctcgggcaacagaccatatgaattgattgaattcaattggttgagatcagtgagaattgtcggcgaagtgagacgacgcaaatggtccaaatgatcaccaccggtaaagcccaaacagcgaatgtttgtcgaaaaaatgggccaaatttcacgaacaaaaatgtcccaaatccgctggccatccgtgttgtgtggtgatggaatccacaaatataaattgatgcctcttttgtcaaaaatttggtgatttgaacgaagaaaagcgatgacggagtgatcgatgtacctaaaaatgggatgaatgcttttattgccataaatctctgagtttacttacctaatctgaaagcatttaaagcggattttgctgggcagcggacaattggacaatggaaattccacaaatttggcattcatccacacagatagtttcggttctggtccgatgtccttgctaatttcgattggtctccaaattgtcaattcgcttttgccatcgaaatgtttgtccaccaacgcattgaaacgtggcgaaagaagtgccaatttgaggccgagttgggcatggtcaatcgatgggaaaatgtccatccgaacgtcgttgcaaatccaaaatgggtgccggattcgctgcaaacaaagtgctggacacattaaggctgctaaatttcccgacacgaggaccaagactgagaatcccgagcagaattactggacattgcaatgttaaattcatttcaaaaaatttttattttcgaatatacttttaattaaccacaacttttaaaaaaccaggtatatttaggctgcggtaggctgcgaagtaaaagaatttttactttttttctaaattagttattgattttaaaaaatttgagtccaaaaatatttgagacggaaccggccctcatcaacaattacactggccgaccgcgttatttatgttttccaattaataaaatttgcaattttttgggttttttggaattttttttgccgaaattttctgacactgaattgtcggtttttcaacgtacactgaatcgtcgtcactgaatcgtcttaacactgaatcgtcggcactgaatcgtcagcactgaatcgtcgtgtctgaatcgatatgcaccc

SEQ ID NO: 5733 - DNA, 2878 bp, Heterodera glycines
aaaaatgggccaaatttcacgaccaaaaatgtcccaaatccgctggccttccgtggtgtgtgatgattgaatccgcaattgtaaattggtgcctcttttgtcgaaaatttggtgattggaacgaagaaaagcgatgacggagtgatcgaagtaactgaaaaaggaaaagaatgcttttattgcaatagcttttgatttttaattacttaatctgaaggctcttaaaacggattttgctgggcaacggacggtcgtcgggcaatggaaatggcacatatttgtcatccatccgcacagatagtttcggttttgttccaatgcgcttgctaatttcgattggtctccaaattgtcaattcgcttttgccatcgaaatgtttgtccaccaacgcatcaaaacgtggcgaaagaagtgccaatttgaggccgagttgggcatggtcaaaagtggggaaaatgtccatccaaacgtcgttgcaaatccaactgaaatgggaaacaattaggctaaataagtgaggaattgtggctttaaaaaaatgccttaccgtcggttcattttttggcagaaataagcacaatttggccaaattctgaatgatgtcacacaatatatagcagaagaattaatgcgttggataaagcctggatttttaggattttcctatttttttacggatagtacttgatgagaaaaacacgagaatcgcattttttatcaaaacaattttcaaatctgttcgccttaaattgttgccaatgggctcgagggtagagaaaggctcaacatcatttttaaaatttcgataatttttgaaattttaaagcaatttttttcaaatgacttttggcgcaaaaataaaatggggagagagatagcagaactcatttttgcgttatcgctctacataaaattataagccacttaaataaattttaaaaatttgcgttggtatttgttttgatggcctaatgtttgttgattttattaaatatcaacatttagccgcgaaaaatctaattttgattttgaatgaaaatccattaaacaaaagaaaaaataagcacattcaaagagtaaatagcatcaaatcaagtccagcagaggtaatcaaatggtcggtcctttcttcttttctcatcaattgccataggttcacaaattggcgcctttttcgttgttttggtcggcgggcggagacaatggcctaaaatttgaattcgaagaataccgtattttctctaattaaggccctgtctccaattaggctacatgacatttcgcctactaagccaaaaacattcatttcgcctactaacccaaaatcggtcatttcgcctactgtcatttcgcctactattcatttcgcctactgacatttcgcatactttcatttcgcctacaagccaaaaacattcatttcgcctactaattagtaggcaaaatgaatgtttttggcttgtaggcaaaatgaatgtttttggcttgtaggcgaaatgaatgtttttgcttggtaggcgaaatgaatgtttttggcttagtaggcgaaatgaatgttttttggttagtaggcgaaatgtcagtaggcgaaatgtcggtaggcgagatgtcgagtaggcgaaatgtccgtacaccctccaattatgtccccctttctgaggatgttgaaaaataatcccccgtctctttttatccccccgggggataaatggaattattatttttttttaatcttatttttaataaaaattaattttaattaattctaaattgaaattcatttaaatgtttaataaacatgaaaaaataatacagaaaaatcacttactttactcaaatccgaacctaacccaccccggtgctatgtcgttattagagctcggtattttgaaaaaagcctggacctggattccatgttcgacctggacctggatttcctggacaaaaatccaggaaaatacaggtccaggaaaatccaggcctccggagaatccgattctgacatccattttgaagtgtatgatatttatttgccctaatttatttttctgcagtgttttataatgtttggttggatttttctcaattctatccgtgccagtaaccactgccataaaattcgattttttgttccaatcaagatttgggggtcgaattgcgtagaaatagttatcagaatctgattttccgaccctaaaaacccctaaatgagtctttccgagaaaaaaatttttgaattttttttttcaaaaagggagggcgcatacaaaagaacccgacgacgacgattgctgctgattttcaacggcggacaaaagtttttgctttttctcggaaggcggtgccattaaaattgattacaactcaaaaaataaaaccaattaaaacaaattagtgagaaatataagagagttcgcggtaacggtaatactgccgatggccccccccccgccctttgtaagaaatttttctgttttaaaaagtcgtaaaacaggtttatgggggttttcaggatcgctgatcatgaacctggcattcattttgttgatccattttgaatcctggacctgaattgctacaaaaagtcgaaaattccaattttcaatagtgacaaaccattgcaaaacaaaaatggtcattcagtatagatatgaaaaaagaattttgaaaatttggtatttccgggtttcaaaattgctgtccaccatcccagaaatgagctccaataccaaaaaagatttaaatacctgtctcagtggtctgtgagaaagtcaccaaaatgggggtcccaggttcgattcccggtgcatgctatagctgtattttgatgattttaatgaataaataaaaggaaaaatgaccaaaatgattttaaaat

SEQ ID NO: 5734 - DNA, 3713 bp, Heterodera glycines
gaaatgatttgtccggtcgacaattcgggctgtttcacggatttggtgcccgacttcaaagggctcttcgtgaaggatgccgacaaacaaatcatcaaaatgctcaaggagaagggacttctggtcaagcaggagcagcacaagcacagctaccccttctgctacaggtcgcagactccgctcatttaccgtgccgtcccctcttggttcatccgcgtcgagtcgcttgttgaccgactaatgaccaacaatgaagaaacctactggtctttacttgaaaaacgactcctttcaacccaataacatttttagggttccttccttcgtcagagacaaacgttttgccaagtaaaggatttttggcttcatttttgcgctaatactcaaattcaagttggttgcgtgatgcgagggattggtgcgtgagcagaaatcgcttctggggcacaccgattaacctttgggtgagcgacgacttccaagaaatggagtgtccaggatcaatcgacgaattggagcgattgacaggcacaaaagtcactgatcttcaccgagagaagtataattttggaatgtcaacgtagttattctttgctattattttaattgggttatatttcagcattgaccatcttcaaatcccctcaaaaacgggccacggaatgctcaaacgtgtcactgaagtcttcgactgttggtttgaggtgctttgggtttgatttttcctctgcattttcgcttcccttttagtcgggttccatgccttatgcccaacaacattatccatttgaaaactcagaagtttttgagcacaatttccccgctgattttattgcggaaggttaacttttgtaaattctctttcatctttgatttttctggcatttcctttaggcattgaccaaacccgtggatggttttacactttgttggtcatttccaccgctctgttcgaccgtcctccattcaaaaatttggtctgcaatgggctcgttttagcttcggacggaagcaaaatgtcaaaaagcaaaaagaatttcccaaatccgttggatgttgtcagaaagtacggagcggatgccttacgtttgtatttgatcaattcgccggttgtccgtggggagaatttgcgcttccaagaggaaggagttgccgaggtcagcaagcaggtgctgaacccgtggttcaacgcctacaaattcctcagcactgcgatgagcatctatgaaagtgttcgtttgacccaacaaataaatatacattcatttgtcattcattcttttacagaatgacaaacaatttgagctgcgaagcgccggtttttccaatgtgatggacctgtggattttgtcgtttactaacagtttgatcgcttttgtgcgcaaggagatgaagtaattatcaatcagtaaacgggatgaggactaattcatacatgtacaaggggtgtctcagcccagggccatacgacggacgattgggacagaaggggggggggtgtctcgggaccgattttttatacgaaggtccaatttttttctggcgacctttttttgttgctattcagccacacttttttgcggcgtgttttacaaatggggaaggagtgacgggcgttccggcggtgccgataggcgtcgccgggaaaatttttttgtaattttgtatggatttcgctaaggaaattgttcaaattttcccccttcgttaaccacctccctccacgagagaccccctccctcttttacagccgccccacttacgacgaacgagaggggggggggggggcggggtgtcgagacctccttgtacatatatggactaattgccaacgaattaggggaattggttttttgggcatcaatacttcggctttttgaatcaaaatgtgtcgaattttgactccaatccttttccgttccctgttgtcgtttccttcgtttaaaagtgcaaatgcttcctcatcagactgtaccatctctatgctgtggtcactccgctggtcagctatttcgagactctcaccaacacttacattcgcttgaaccgttcgcgcatcaaagggactgtcgccggtgcgtcggccgatgaccaaatgttggccctctccaccctttcgcatgtgctgttgcaaatcactcgactgatggctccgttcactcctttcttctccgagttcatgtggcaaaggctaaaaccgttggtttgtgcgggggggggggcaaaacagaaaagtcaagtccctactttctaatatttgtaaagattggcgatgctgcggaaaagtcggtgcactttacgatgttacccttggcagaagctcagttcatcgacaaagtcgtggagcgtcgggtggcagcgatgcgaattgtggtcgaaattgtcagaacgttgcgggaacggaaaggaatatctgtgaaggtgccatccaaaattgccatttcattaatttttatttcggcatttttagtacccactgaaagaaatggttgtcataaacaggtcggtatttttcgcaaataaatatcaaattgacaatccaataattttttcaggaatcagcagttccttgacgacctcagctcgctgagggaatacattctgtccgaatgtaatgttgaggaaatgaccgtttcccaggacaaacaaaagtacggtgttcagctgaaggcggagcccaactttaaagttttgggagcgaaattgaaaaccaatttgaaagcagtaacaaattatttaaaagtgatgttttctttcgattaaatgtgttccagttcaatgcctactctctctctctgtcattcagaatcaagtaactgaagttgaactcgaagcactgttggccgacgggtcgctgactgtgctgggacacgaattgacaacggaggaagtgaccgtttcgttcactgttaacccgggcaacgcgacgaaatccaatgacaaatgggaaacggcgaccgcaaattcagtgagtcattcgctcacttttgatggtttctttccattggttggtttttgcagtgcgttgtgatggtcaacacaactgaggacgactctttgctttcgcgtggatttgcccgagagattataaaccgagtccaaaagctacggaaacaggtgcttacagtgggacaattacagttttctaagattatttttgtgatggcagggcaaattggtcgagactgacaaggccgttgcatattgtactgtaatgccagaggattcaccgcttggcttggcactcaaagaacatcgcgagaacatccaacaggcaactggcactccgttgttcatgaacgaaacccccaatggggacacttttctggcggaaagctgtgacaaaatcaaaaatttcgatttccaggtagcattgacattacgccattagaaattttaaatgtatgtttatgtagctgaggttgctaagactgaacgattgaagaaatgcactgaagaatttcattatacattaaatacataggtatatgtatgttgtgtaagaatttttggctttcgttgttacaaatgcactcaattgctttatattctattgtttttatttttgttgagattgtttgattagtgtataccagggttgttgtgaatcgaagaataaaatgcgaaatacgaaacgggtacttttcaatttttggcctacatctctatatttaagccagattaaattatttaggtttttcctgggatgaaaa

SEQ ID NO: 5735 - DNA, 2554 bp, Heterodera glycines
  misc_feature (94)..(94): n is a, c, g, or t
  misc_feature (2452)..(2452): n is a, c, g, or t
  misc_feature (2510)..(2511): n is a, c, g, or t
taagatttgtgatcagcacattttaagagggatggtcaatgactgaatacatacactgtactagagccaataccgatcaaaagtggcaacatgnagacgaagttcttgttcgaatccaatcacaaaaaaacaattaacaaggggaatcatttgaccatcaaacattttgtcagcttttatcttctcccccccccccattttttcattggttttccctttcgtttttctgttgtgtctctctcgtctttcttttctgctcttccttcgcctgtctcttcatttccttttccttctgcagttgtatcttccgttgctctttttctctctgcgctgcctctttctgttctctctctttaattagtgtctctctgtccaccaatttaacacaagtgtctttgctgtggtcctccaaccgaacgcccaattccgggaggatttcgtcgcgcagtctgtcacactcctggaaaatggagcaaacttagtttgaaatattaactggtttaaatgtactttcaaaattccaatgtttttctgtgcccgagcctcgcttctgacgacctctcgaaactgtgcaagtatttccaagtacggcatgataatcgcttctctgtcgtcagaagttgcgcagctaaaatgagaatttttttgattccatggcttaataatcattgcgccattcttaaatttttaaaagtaaaaacaaaaagttattaatttggtatggtcgttgcagaatatcgagcttactcaagtaatattttaccagtctttagtaaagaattcgtatttgcccacgtccggctgtacgccaaatatgcaaagcaattctctgacgaaattggcacattttgtcagcagttggcaattaagtacggcttcctcctgtttccggaccataatgtaagtgttcagaagggaaatgatcgtcctgattttgtcaagaactgcgcgtgtgtcgatggagtcgcacatggccaaatgcacggacactttgatcgcgttgaatttgttcagcacttccatctcctcttcaccgtattttttgaagcacttgaaatttttaaatttttcgttatcatttaaaattatttttacctgggacaattcatccacttctttaatttgctttcttataatatccttcacattgaggaagaattcgcagaaacatttttcgaaatgaatggcatgttccatcgtcgattcgctgaacattttgacaataattattttttaggattgcaatttcatttttgccataattgtctaattccgtattttcctccatttccttggtccacctgtagtccaaattgtccgtccaattgtgcatcaggaaaaggaggcgcagttgtcgagcagtgtatttgttcaacgcctcccttatcgtcacaaagttcttcaaactcttcgacatttttagcccttcgattcgtaatgtgccgcaatggaggaaaaagttaacccaatgatcgttgtcattgtacgcctcacacttaaaggaaaaaatattcaaaacggaattttccatcaacagttagagtactcacttgagcaatttcgttgtcatggtggggaaatttgagatcaaatccgccggcgtgaatgtccaatttgtccccgcaaatggccccactcattgccgaacattcgatgtgccaaccgggccgacctgaacagaaaacaaattggaaaacaggtgatgtggaataaatgacacacctttgccccagggactttcccagaagggctctccgtctttggaggctttccaaagcgcaaaatccgacggcgagcgcttttcctacaaaaactgcaataaattcgacaattaattaattggggaaaaaggggtgcagttgttgcgcactttcaaattgtccactgccacgctgagttcgccttccccctctcgcaaatgtttttccgcactttctgcatcagcatacgcctcggggaggagttttgcataggaatggttgggttttgatgcgaattgggcagtgttaaaatacacctaaaaggaataaaattgggtaaaaagaaaggctaaagaaacatttataaaaggatcactgtagagatcaaatgcattcaaaaaaaacttactgatccatcagacacataagcgtatccgttgcggatgatttgctgcacataatcaatgatttcgggaatgtactcgctgaccctggtcaacacgtccggctcaagaacatttaacgcattcatatcgcacaaaaattcattttcataccttaaaaaacatgactcaaataaaggcatattcggatttccttactttctggccaatttcgcgaaaatgtcgtgtttagtgaccgtatttccccgggtaacgtccaaccaatcggagagcacttctttcgcactttccaccaatttgcgcaccaaaacagtgcgaacatcagctgattgcccattgtctggctgngaaatacgcgttttgaattgaacgagatcagtctcgaatttggcaatctgaaaatttnnacgatagaaattggaacaatcaaataaaggcaaggcacagact

SEQ ID NO: 5736 - DNA, 2548 bp, Heterodera glycines
ctgattccctgaaatgggttcaaatgtttctttgtcgcgcgtaaaactattcatcagccgtaaacggggcttttcctcattgttttgctttttgtaggccgtccatttgcaaggcattgcactaacggagcaaatttgagtaaaattaaaaagaaccagtcgctgaaaaacggaatgtgtatggaggaatagaacgaataatttgcataaactaaaaaaaggagaaaaggtatgtatttcggtggattaaatggttgaggaaaattaaaaagaattaaaaatacaacgcatttgcctatagaaaagtaaactataaataagttacaaagaaaaagtgcagaaaatagaaacaaaatccatctttttaaatggccaaataaatgaaagtgaaatcggtaacggacaggcgaaagcatccgatcgactcgcaattggcgcccgtttgttttgggcgcaatttccaaaatgtgtggatgatgatgcaatccgagtgagtcgctcgcccacccatccatcacccgccccacttatatgtaagccatccttatttgatatgagaagcaattccccacctgacgaatgagttgaggaattccaattacgaatgttagataaaattcgatttgcaaaatctatgtacataaatgttttgtccatggacaaggaaaggtttgagatttttagatttggaaaatttacactgcgttgtcaaagtgaaatgtttgcttacaatatgtttcctaccattgttgcatttaattattaattaggaatatcattagttcgcctaattggcttttgcgccccaccaacttccctccctccctcgcttcgcttcttcattcatctatcaacgtgcattcccatttattgttaaatgacatatgtaggtattatttattgttgattcatttgttcgttccctttttctgccaatttccaaaacgactcgcgatgtgtgcgtttttcgtttttctctattcgttccaattgttggattgaattttagggagtgagcgaaagagggacgataagaaagggtagtcaatgaacgaataataaatacaacaccaaaactatcgttgacgttccttcccttttcttcatctcgaagaagtgttttctcgaggcgtttaaactgtgttttacttcaatccttcaaaactcaaaagttcgattaaattcaattttgaaagaagcaaaagaggaaagagacggagagaaaagcggcgggcgaatgcaccggcggaatgagtgaatgcatctgccgtccgtctgccgtccgtctgccgatcagacgatgggcactcactcactttccctcccagcttttcctctttcaactcgccgttcatcaattcactatcttttttctctttcaaacgaagggggaaggggaaggacagctgttatttccacaattttttccattaccaaattttgatcgttactttgtccctttcccttgtctcgtgattcattacaatgaatttgactgacattcataccatcacatttcaatcaatattaaactttgccaaattcaattggctttaacccctttccctcaggctttacacaattttattcttgtattttgtcgatttatggatttgacctcagattctattaccaacattgacattgatcaaatgctgaaacaaatcaaagcgatggttcgttcgctcgtgttcattttggttcaattattgcttaatttttaggttttcaaattggctgagaatggtgattcggaaagattgcacactttgctaaatacattaaacacggaacaattgaaacatttgctgaacgtgaaagaaccgcgagagaatggcagaaatatgcttataattgcggcacgaaacggccatataaaagtggtcgaacttttagtgagtgaattcaattaaaataaattcggaaatgccgttttaagttgaaattgggggctgacccgcatgagactggcacagtgaccttcgacggtgaacagataagtcagtgcactttaatgaatatatttgggtgctgggctaaaaaggcagttttttttatgactggtatgccattttatataaccaaattcagctcgagttcctccgctttgggccgcggcggctgcgggacatttggaagtgtgcaaacagttggtcgccaggggagtgaatgtcaaccaaacgacgagtaccaacagtacgccattgcggggcgcatgttatgacggaaatttggacattggtaattgaaaaaatggacgacattattattcattactttatttgtgaatttaaaagggcactttcacatatttggtttagtcaaattcctcgttgagagcggcgcggacatcgaaattccgaatcggcacggacacactgcgctgatgatagcatcgtaccgagaaaaagtggaagttgtgcgctatttactttcggttggggcacaaacggacagaacatcgaccaaaggttttttttgttttgttttgttgtttatgtaaaatttgaaaattgtaattattattatttaatactaattccatttc

SEQ ID NO: 5737 - DNA, 1287 bp, Heterodera glycines
  misc_feature (1230)..(1230): n is a, c, g, or t
acaatttttaattaattatattttcattattttttatcttttaagaattgaggccaaagaatcgcagttttttgttgacgtttaatgaaaaaaggcgtctcaatttcgccattttcatttgaattggtgcgttttcgtctgactttgagtcgccgagacgcaaccggaaattaaaaaagaaataaattaattgcaaaattaatcatataaaacgtactttttgcgttttttcagcgtgaaataaatcctccaagagttccttcggtgttctgttcacaacgctttgtaaaagttcacagagtgccatttttaatgcgtttggctaattttaaaaattatttaacgtaaatatttttctacaaatgatgatcagaatggcaacctgttcagcaaaagactcagtggaaatgctgaaggaacggcacgctttttgtgcaatttgccgaaggttggcgaggccaaagtgttggcactccgaagcaattatttgggcaaacgcgcgccatgccaacaatcgaatagagggctgaaaaggtaaaaaaaaaaagcaattaacgaagacaaataatgaatcatttaaattgaattgcctttttggcagccaaccaatcgttggttgccgccaaacaatcactgaaggcggaaggcgtaacggagcagaacaaacggcggagagacaaagcgacgaagtggcgacaacgaacgctgtcatcgttgagcagacggaggcacagcttcagatggaccaacagagcgtagcgagcattggcctcctcaaatgggggataaataaataaagggaaaagcaaagcagtgacaagcgaaagctcaacggggacggacgcacctcggtgaactcgctgatgatcgagtggaccatctccagcgcggacagtcgcccttcctccaattcgtattcgcattggttgaggaaaaattccatccatcgttcgtatttacgctgaccccgcggatggacggtgaggtaaagaagaagagactggcgaatggaaattacaaattgggaacaaaacaaacgtaggacagagaaaaaacacctggcgacactgactacgaatgtttgcggagagcgaagtgatggccaattcggacagataagtgacaattccggtcagctaaaccaatgtttgggtgttcatagtgacaaatgccatttttcattcactgacacttttgtcgtcgattttccgcccaatgattgccttgagncaactgaacgccgttgtctgtttgtgcacgtccaaaatgtccgtctccacgtaattg

SEQ ID NO: 5738 - DNA, 4102 bp, Heterodera glycines
taaaaaagagcgaattattcactaatctcgatgccatactaataatacagatcgatgcaaaaccccgagataagaattaaattaaatttcttttattttttttttgcatttagcgatgaaagaggaaaattccacatgtacggggggggggtcaatttttaaataatcatttttaattttgccaacttcttccaaatgccggtactgagtagaacaaattggatggtcaattgcgcagcaacagcaaaagccaaacagaagcggtaaaataaatatgctaaggccaattaaaatggaggaggaaaacaaaactccgctgggtgacggagataaatgcgaagacttaaattagagaatgttaactgccataaaagaacatatttaccagtttagttgagacaactgtcgtcgttctaataatcgatggcattggcacagcggaaattgtgacaggaggagacgatggtggcggaaaagcaaaaactgctgacttaattagtcaggggcttaagttagtggttggagcgaaaaacattttttttaaatttgatcagttttccgaattaaattcacgtttaaagttttatacgggcagccggacaagtgatttctattttttctaatttaccgggtgcattacgtttgcgcgggagcaggacaaaacgtcgccgccgaaacgtcgctgggacataacgtcgccgcaaattttttttctaattttagaaaaaatctaaaaaattgtcatacatttagttagctagcttaatacgaaaaaaattctagaaaaatttaaaaaaaaatttctatcaagaaaattcaagtttcaagttttttgggttttttccggaaatccagcaaatttagttttattaacacttagattttcaaaaagctaaaatacttttaagttttcttgaaatctagaaaatttttaatttttttttgcggcgacgttttgtccggcgacgttttggggtgtaccccctgcaagtacaccttgaatagttgctgctgcaattcagtcacattcgactgtttccccgcacttccaaccgacgaataatcggccaaaagcacaaaaaaacggtccaccaattccgcggttcgttcattcgatgtccaaaaaatttgtgaacatttgaacaaattgagcaatgcgcgaagactgagtgcaattatctgaacaaattgaaaaacaaatcaaaacattgttcatgcttcactttatcatatttttgtttaagcgcttcaataatcaaaggaacgaattgctccaaaagtgacacaatttgttgtctgtcctccgatttttctgacacagatttggctgaaaataaaaaattcacaatcaaattaattaaaatcctcactattttttgtgttttcctcctcagttttgtgctcgtcttcactttcttccccaccatcaccgagtttttcactcttttcgatcaaatggtggcgaataattgcgatttggtcaatcaaaatttgaagggcaaattcgacgaaaatgtgcactttgcttttgagggccacccgttggattacgcccaaccgttttggttcgggtgccaacagcaagcaattgacaggacgacggccaagcgaagagccaccgccaaagttactactagtaaaaagaaacgcaaaatcaaatttgctgaagttgattcaaatttgatagtattgtatccaccttatgcgactgtcgtccgatttcattagacggagattctcgtcaaacagtcgaaatgcccagcggagctgttcccgaacggaaatgaccgaatttgtgcgcagtccgacgcccaaagctcgcagccaatcggccaatttgcgcatcgtttccgaacgtgaactcgcattggcaatgtcacgaatcgcagcaaagacgcaatgctccaaagggtccactttggctacaaaacggccaaccatcgacagtgtgtgccccgtctttttgccgttcgcccgcgcctccggcactccgtacgaatccgaacggcggtccatttcggaggcggcaattccatcctgccattcgttcgttatttgataaattgcatttaacaataagtaatttatgcctttgcgctgtttgctttggcgtgccctccaaatgtttcccatcgacaaacgtccaccacttccttcaaaattggctcaatgtctccgttggttaaatggccctccatcgccccaatcaaagcgtgcactgttacggccatcacatgcatttggtagcccttattcagcgactgtttcacttctcggaccacaaacggaagtttggctggtcccaacaaacggaccatttgctccaacaattttcgcgcattttggcgagtgtttggcgatctgtcgccgcaaaatttattaaggatgagataaacagaaggggagcacctggacatgagcaagtggtccaggaacaacacaagcccatgtaaatgatggcccgacatttcaggtggaagccattcgagcagtttaacgatggacagagtgagcggagcacgcaacagtttctgttcttcctcgtcccagtggttctgtaaaaattgtatgaattatagccacttgtgaacatttccaacccccggcttattgacgccgttccaacggtgcaaacactcgcgcagacgcggcaaaagccttccccgaacgacttccaatatccgccgcttctcctcctcctttttgtctcttgccatgtcctccgtttccttttgtgcgtccactggtgtttctgacccttctccaaattcgttaccctcgtcttcctctgttttcccttcttttttttcgtcacagtttcccttttcattcgaatgcgttccctttatttttaggtgccgcaaatcgaagtgaaaagcattcaaaacagcgccgatcactcggatggcaccttttgtgctctcttcaccagcggtgtccaataggcgcaagaaatattccaacatttgacaatattttggccaaggggtgcggcggaggattgaggagaaaagatgcagggcctggtcagagagtgccgaccgattggacgccgtgtccatcagatagggctcaacgatcggaacgatgaaacgaacgagcgaagaatggccaattgagagctgaaaatgggagatttatgcaaatttaaatgtggaaagagaacctctttgttgttcaaacgttcagcaagcttatgaaaagctcgttgacgacggtggagttggatatgcgtcgcgcattcgaagaaatcgacgtcaggatcaatttcaaagtcgacggacgccgaagcagttgtcgatgttggtgttgtgtcggttaaatgccgaagagcagcaaattgcggttcattggggaaacagtggacgagaaaggcgaaacattggataaattcgtgtcgagccgactgaaaaaataaagtgaccgtttttacttacttaataaatgaatataataatttcacttcatcatcgacggaagtgcgcaagccgcgcaaaatcaacggaatgaaatgggcacggagcatttggacagcgtccaaattggagtcattggccgtcgttgagacaaagtgaatcagctgccggaaagtgttggcggccgtcccccggagggaaatgtccgacttctgtcgtaatggaatgccattcctttgcaacaaatttattttccgtacctgtaacatcgaatgaacgtgcgaatgtgccaacaacggaagagtgcgagcggcgccgtcatccaacaaaatgtgccggtcccgatgttcgtaccaatcgtgaagacgtaccagggccttaaacaattggtatcaaattcaaaaagcactcgcccacttcgcatcgtctgtccgcgtccggttcttcaattcgacgcgtatcccaactttccaatgcttccaaaagctaaataatggtcaaataatgggactttattgcaagtccacacatcaattaaattcctagcagccaatggaaagtgccggtttttcccgacagaaagtgccatttgagtaagcgcccatcggagctgacgaccctccaaatgagagaagagagaagcaaaacagctgaaagaaaacatggtaaagttcagaaaagcgagg

SEQ ID NO: 5739 - DNA, 2000 bp, Heterodera glycines
  misc_feature (1905)..(1906): n is a, c, g, or t
  misc_feature (1951)..(1951): n is a, c, g, or t
acagaaccaaacgagcgccaaatgatgggggaatgccatcagtctcatcacaatcgggcattgttaaaggagtttgagggagagcatcgaacagattagaagaacaacaaagagaaccgacttcttccatggcattgttctgaaaaaggtgaaagtcgaatattcatgacaaatgaacgaaagtgacaaactgattccgagtcaagcattgaacagaacatacgcaaaatgtccattttgattgtgtttttatttttggacaattgatcacagagaaatgccatcggagaggcgacgaccgaacgacgaacggaaggagcaaattcaatggacaaaggcacatttagcaaagggaaatatctaaaaaaagtttaatgccacaaaacgaggcaaagcataaccttttaatttgtgcaaaagtgcaaaagagtcgcacgacagaaacaggcaaagacaaacattcgccagaagacaaagctaaaggaacattggaataacgataaaaagttgaacaaatcaaaggaatttcaaccttttccactgttgtgatcacggatcaaaggaccgatgaactgttggaacaaagtgagaaaagaaaagacgggcaaattgggacgggactgaaaagcgcggaagaactgaaaagagaaagtgccaaagaaacgcggaaaagaaaaggtacaccttaatgagcgtgagaaagagcaatttacgcaaactcttcagaaagcgttcgtccgacggtgtcacgtcatcgctattcaattgaatcttaaaccaaaaaaaaagtggaaaaagaccaattaagcaattggctaacaataactaagtgtgctaagttttcacctggaaaacttttacttttttaaaattttcgggggggggctaactgcttctggctgaattacctgctccttccgctgaggataaagtgaagaacggagaagcaaaatgcgtgcgatgagcacaatggaagcaaagagaaggtccaattgggcatcggaaaggaaagggccgaggaaacgaaaaacatcggaaagaaagccgagggaactgaacggaaaacaaaacgataatttatacattttttaagggaaaggtcggatgaacagaagaacgaacctcttgagtttgttaagagatatggactgaacgatgtccgttttggagtccaatgaatgcaacgcattcccaagactggaaactgcgtcattctcatcaatttctaaaatgaaattgcgtaattatttgaaggcactttaaaaacaccaaaaaaggtgaaaattgggccgaagagaagacggaggaaaatactgagttcgttcgaattgcaattggccaaaaaacggaaaatggcgattcgttttgccttgccacggctggcgacatgggtgtggagagagccgtaaaggagcctagaaaggacagttcagcaagtggttttagtggtccacacacctcaacaagacggggataagctcagcacggtgctgatccgtcaatgaatgctcgtccaatttgttgttgtgacttcggttgtccacaccaaaaaggaccaaatgatctctgagctgccgggggtccaacaacgcttcgagatgagttctgtccaacgcaacaaatagaaatcccctgtcctaatgtcttttttaaaatttaattaccggtatggacacagccaattgtatttgtatgtaaataaacagccgagcgccgcctgctgaatctccgcctcgttgacaagaagaagctgattgtgagaaagtttatacggttcgaatgccaaccatttctaaaagagcactgacttcgtagtaaatgtcgagcacttccctttctctgaaaacacctttcgggttggaaaagcgtccgtaaacggctaaaaatgctttgattgcttggacnngcgttcgacgcccgattcgaaaaccgcaaggtttcactgcgatgngactgactgggctaaaccaaaataaggaggaaaatgaaataaaaaggaa

SEQ ID NO: 5740 - DNA, 5057 bp, Heterodera glycines
ttcactgatgaatccggggatttctcccttctcaataaattgataaaggccgtagcctcctgatccgctttttctccaagcgaagatcaactgagtatgagttgccatcagcagctctgagtgtgagagagtcgacacattcatccacgactagtcgcgagtccaatgttagcgaaagacaggctgggaattcggcgatgtcctcaagttctctgatatttttgatctcctcctcagaacggcactcatgtgcagcacgtgacagtgcatcagcaaacatgttttgtttcacagcgacgtgcacaattttgatgctgtaattctgaagctcaattagccaccgggcaagattgggatgggcctcagccttctgcaacaaataagccaatggcttatggtcagtgtgcaactctacattccccatgtaaatgaacggtcaaattgtcttagcgcaaaaattattgcgcctaattcgacctggactggtggccacttacgctctgcttcagacaaagtgcgactgcagtaggccacggcgtgaaatgcactgctgtcctgctctttctgcatcagagctccgccttgtccaactgttgaagcatctgtgaagatgtggaatggtttggaatagtccggaaatcggagaatcggatcttcagacaagagcttcttgatttggttgaacgcctcgtgttgttcgacgtcccacgaaaagggcatgtctttcttggtcagctttgtgagtggctcagtaattgttgagaatcccggtatgtgcttcctgaaaaacgacgccattccaacaaatctgcggacttctttcaacgaggtcggcgctggaatatctttgatgatctccacttttcccaagctgggcgtgtatccgtctttattgataataaagcccaaaaattccattttgatgaagccattacacattttttggacttacctttaaattgaattgccgtagccgagtgaaaactttccttagtgccaataaatgcaaatgaaatcaggcgatttggagtaaatcaagaaatcgtcgacataggctataacagagtcttccagtcctgaaaaaacatgatccatgactctggcgaaggcactggtggcgttgcgaagtccgaaaggcatgtgcgtcatttggtagacatcgtcttcagtgatgatgccgcattttctgctggctcgttcggtcagtcttatctgaagatatcctgaggacaagtctaaagaggtgtaccaatggcaattgccaattttctcgagaacgacttctagtctcggcagtggaaagtgatcaggcactgtaatctcattcagttttctgaaatctatgcatggccgcagccctccgtccttcttctgtaccaaaacaatgtttgaaatccacggagtgtcagaattgaccattactccagctttaatccatttctgcatgtgatctctgacctcttctctgaaacgaaatggcgtactgcgcggcttggcagttatcggatcctccgtggttgttatgatgtcatgttctcccacaaggcatgagcctaaatcgtattgggattttgagaagacatcagcaaattcagcgcaaagctttttcaacttgttgaggttttcacccgttgcagaggatttggcgaagttgattttgaatgacgggtcatttgtagtaatttctggattgacattggcttcctttacttgcgattgttcctcaagccatggaccgtccgcgctttgtttcaattcattggcaagtgctacgtgcattccggcacaaatgttgattggtgcatcagttgggttggttaatatcatcttgatgcatccttccacgggctttgcgacagttgagatcatcccgacatgcattttggagagtcgtcctccatccagtgaatgtgttacaacttgatcaagttgaatttgtgaatcaagtttgccggtcagcatgatataggatcctggttgaatgtcaacatgatgacgtgccacaactttgacattggagtacagcaagtcccctctttctcccatggttacagatttacctgaaatactgattagaccttgaacaaaatcaaaagtaatcggtggaagttttgccatcaagtcacatccaagaatgacttgataatcccttctgtcactcataacttcatcctgaatgagttttatttcgccaaaaattttctgacctgcaatttcgatgtgtaccattgctgctgctgttatgttgatccaatgtccggaggctgacctaacggtgtgatttgtcggaaaattttgcatttcaattcattggcaagactcatcggcgcaagagaaacacttgctccggtatcagccagacagtttactggtctgttgttgatcagggaacggactgtcgctgttaagcgaggcgtcactgtatgattcgcaacaatttcttccataatggaatgattagatgaggccgtagcccaaaaactcctgctctttgagagcacactcatatggcatgcatgaatccagccattgcaccaagagagaccacgattccaatcagttcgaacaaatctgaaattgtgagaaagatacctgttccggctttcaagtcagattgggatgctttctctgcgttcagtggtacaacaagcaaagagatcatcagcatcataatcgccattgttgtgctcgttccgacctgcatgaccgaagagggcctaagcctttttcgtggagatttgtttacaacattggttgtcattgatgctgctgtggggtcggaagatgaaaatatggtctgaaaacttgacactgaaggtggccagttcattgggttccctggaatgctttgtaaagggatttcttcaacggttacgctagtatttggaaattcatcagttgtcacatctcccgtgttgcacgagcctcttgacttttttgcgccccaaatcattcggcccagccatccaggaccggtgtaagtttcaagaagtactggaagtcaccttaagagaaaatcaattaagagaactagacttacaaatgataggacgcatagccatgtcagtttgtagtctccgactacttttttctcgagttcgtctgttaattcacgccactggtcagaaactgtgactcttacttttttgtgcagttcattgattcgatacgtgagttcacttaccttgaccataccgcttagaaaggcatgtgtattcaggtcggagacgttaaacaaagccatttggtgaaatgagtgcctttcaatttccaatatccctgggagccgtggctcaatatcaaagtcttttattttgaggattttcgtttctcctgttacctgatctacctccagaggctggccttcaatttgaactacaatttttctgtgctgtgcacatgcgacttttgccgaatcaggaacgatgatcatcgtaaatgggtcaaggaaagctagtctgttctcggattgtgtgacaaattcgattggcaatttgtcaaagcatttgttatccaatcgggttggtttgaaacggaactcacctttcttcaattggacgcaaggccaaattttgagaagagatgatccagctctgactgcatagactttggtgttgttgaacaacgaacgcgcaagagaagttggatcaataagatgagtgttggtcagcattttcgtcatcaccgagaagaaatcgcactgcgttttgaaggaatgtcggagtgcatacatgagcgagtcgacccattcatcatccaaataagttagtttggcattcatttccggtgaagttgccaatccaagatgttcgactgagccgtagctcctttttgtgcgctttcgttttctcacaattatcctcgtggcaaatccttgctctgaaacagtaagtgttttgttacagtcacttacctttggagtttttgtcttgaaatgaagaccatattgcgcgtcgtccgacagccatgtgttgctacgtatctgcctttgaacttcccgattgaagtatatctgcaattcagctgcttttcaggtgtccagactaaaatcgatttatcattaagagtgcaattaccgaacaaatatcggcaatgtgaagttgttccaagtggggttctaatggtttcttcaccaaaatgatggaatacctgagttttaaaagcaaagcaatcctcactttcagtgtccgaccacgaaaatgatccaagaagccaaagccgtggagtcaagtcgagtgtatggtcggtcccccaaagtccatcacgttcggtcaagatgccgaagtcacacgttttgtgttccaccatgcgtttgcattcatcgacggacatttcgagcaattcgggatcgagcggttcaacgacgggcacaccggaaagagttgtgaacttccttgccttcttttttatttttcggcaagcccatgcttgcgtgttgtgttcgaagtcattgatgacgaacagttcccttgtttgaatgagtggcacatgtgtggccacttctgcgggtagtgggcactgaacctgtttaggaaggccccaaattgttggctgaatgtcggtttggcagattaatggaagagaaggaggcgcagctttggcgccattcaaatcaagaattatgacaatcagaaatacaatgaacggaagcagaggtgtaattctgggcatcattcggaccccttcccatggtgagcttcttcctgacgctgggcaatttgcctcatattcaatttcagaattattaggaagggctgtcgcccgagatgagttttcaaccacattcacatcattgagagacttatgctggttcatgtcaagtgacagatttcgcagacccgacgcaatttcgttaagcagttcgattgatctgtcatgttgaattgcgtttgctccggttgcaggagtgcgtctctgtggttgtaagcgagtattgccataggatcctcgttgttcgtcctggtaatcccgaagtcgaatacggcaggcgttggcaacatgtccaacacgtcggcaataattgcaatatgggcgattgttccatctgcgatcattag

SEQ ID NO: 5741 - DNA, 2935 bp, Heterodera glycines
tggatcaataagatgagcgctggtcacattctcgtcatcgcgagaaagaagtcgcattggttttgaaggaatgtcggagtgcatacatgagcgagtcaacccattcatcatccaaataagttagtttggcattcaattccggcgaagttgccaatccaagatgttcgactgagccgtagctccttttggtgcgctttcgcttgttcgcaattattctcgtggcgaatccttgctctgaaatagtaagtgttttgttacagtcacttacttttggagtttttgtcttgaaatgaagaccaaattatgcgtcatctgaaagccatgtgttgctgacatatctgcctttgaatttcccaattgaagtgtatttacaattcaactgcttttcgggtgtccaaaccaaaactgatttgtcatttagtgtgcaattccctgacaaatattggcagtgtgaggttgttccaagcggggttctgatggtttcttcaccaaaatgatggaatacctgaactttaaaggcaaaacaatcctcactctgggtgtcagtccacgagaatgatccaagaagccaaagccgtggagtcaagtcaagtgaatggccggtaccccaaagtccatcacgttcggttaagatgccgaagtcacacgttttgtgttccaccatgcgtttgcattcatcgacggaaatttcaagaagttcggaatcgatcggctcaacgatgggcacgccggagagagttgtgaatttccttgccttcttttttatttttcggcaaacccatgcttgagtgttgtgttcgaagtcattgatgacgaacagctccctcgtttgaatgagtggcacgtgtgatgccacttctgcgggtagtaggcagtgaacttgtttaggaaggccccaaattgtcggctgaatgtcggtttggcagatcagtggaagtgaaggagacgcagctttggcgccattcaaatcaagaattatggcaatcagaaatacaatgaacggaagaagaggtgtaattctgggcatcattcggaccccttcccatggtgagcttcttcctgacgctgggcaatttgcctcatattcaatttcagaattattaggaagggctgtcgcccgagatgaattttcaaccacattcacatcattgagagacttatgctggttcatgtcaagtgacagatttcgcagatccgacgcaatttcgttaagcagttcgattgacctatcatgttgaattgcgtttgctccggttgcaggagtgcgtctctgtggttgtgagcgagtattgccataggatcctcgttgttcgttctggtaatcccgaagtcgagtacggcaggcgttggcaacatgtccaacacgtcggcaataattgcaatatgggcgattgttccatctgcgatcattagtggggccgtggcccatgtcccgatcacggctttgtcgtcctccattccttgattcgtttctgttcgattgccttggttggtttcgccaattattttgtctcggagggtaccgattttgctgtgttggagctaatgttctaaagttacctggcggtgtcatcgaattcgattgcaaattttgattgtccattgcttgaacagacttaaatttttgaacaaatggcaggcctccagcctgcgccgagagcattatttccacttctcttgcttcccagcaaaggtgttcgaatttcttaccccttgacatgtctaacattttcatgaccaatgagatgtttggccgtagcctttcaagaaatagctcacgtaattgtgcttccttttgtgagtcatccttcacatcggacactgaagcttcagccagtggaatgaagcgattgaggaagtccttgaccggctcactgtccatttgtcgacaggcaatcagcgcttgcttcgataatcctttgctttgcggcgaatctaaatcagttcgcaaattagccaaagctaggtcaattgtggcctttcgattcggatccattttctccaaaattctttttggaacaccatccaaataaatgaccaacctgacaagcttgtccttttcatcgagttttcgaccaaatgcatccatgtattctctaaagcgttttgcccacctgtcaaatgtgaccacacagtcatccttgtagccttcaagtgccatgggatacgcattagtgatcatgttgacactttggaaggatagtgcattgcgttgctgatcatcatcctcatcatcgctactagagctttgttggctttgattaggtctctgtcctgtttggtgtcccaattgctgtacaggaggatgagcatgatgagggacaggtggttgagtgacagccgtagcttgttgaatgtttttgtttgctaaattgaggttttcgagggactttaccttaccagcaactttcgaaatctcagcggtgaaggtctgaaagcctacgttgacttcattggcaaggatgccaagatgattttgaacattgtaagacttgcggttaacttgtcggatggtgcagctgactccctcttcgagtcgtatgagttcaccaaaactttctcacgtcctcaaaacggactgtgctattttgctgtttgccttgaaacagtgtcttatttacgactttaagaatcgactcatcatcagaaaagttaggttgggctgtcgcccccgaagacaatacagaccctgaggtcgatgaaggcatttgaaggggttgggatgggtttgaaggagtagtgaattgagtttaaagttatctataaaccaaggtgtgtagtctcaataagtacacactagtgattgatgcaagcgagttagcattaagtgagggacttagtattggttagtaccagttagtgataaattcacttattttttgacagttttttttcaatttttggcacatatgttggccttttttgagctttttag

SEQ ID NO: 5742 - DNA, 1986 bp, Heterodera glycines
  misc_feature (17)..(17): n is a, c, g, or t
  misc_feature (110)..(110): n is a, c, g, or t
  misc_feature (136)..(136): n is a, c, g, or t
  misc_feature (1867)..(1867): n is a, c, g, or t
  misc_feature (1956)..(1956): n is a, c, g, or t
ttttagcacatatttcnggtaggggtcaactccgtctggccaactccgtcctcagcaatgttcaaaaagctataacttttttctttgttggccaaacttcaccaatcatnggtatcattcgaaagccctagatgtntagaagatatttataagctatttctcagtgattaatcagttctcaaaaaagttgtcagtttaaaaccgcaaaaaaggcagaatttcaaagttttttatttctatctttttttatagttcgaaattttctgtaatttttagtaggctaatagagcctatgaagagctttcgaatgatatcaagattgtttgattcggtcaataacttcaagagttatattgactcaaagttggctcagacggagttggccagacagagttgagcccgttccgcgccttttggagcttttttggcacatataaatccgttccctggcaattacaacaaaaaatagaacaaaaaaaaacaaccttcaaacattatgcataatacttttaactcttacataagcaacaaattggaaaatgaatgaaatgccgaataatatataaatttttaagaaatttaaatttatcaaaacctaacaatgaatagccctgaaagcttaaaaatattctcagtcaatccgtgacaccttcactttttctcttgaattcagatttatatctttctaaagatctttttgtaatatttaaaatttccgcaatttggcgatcgttgagctttgggttttggtttttcaattgataatattgttttattttttccgttttttccgcaaatgtataatgcttctgccctgtaatatattaaataataaaaatttttaaatttaattaataaataacaatttgtttaaaaatttcaccctttgaaagaatttgatttaagccaattttcttgtcccatttttcaattgtctgaaaaattacaccaaacttttgtttaatttttgcattaaattctttccattcttttcgtgaatgtttctcattttgcataaattcattttttaatttaaaatatttttcaacaatttctcttttttcatcatcagttttttgctttttcaccatttttccactttttaattgtttcttccaataaaaaattgttctaatatttgtgtccaaatgttttgctattatttttttgcatttttctctttttccctccaatttttcattgaatttcatttttaattttgcatatatttgatcaaattgctttaacattattcttttttcttcaactgaataatttttgttcttcatcattccaaattctcttttccatttgtaaattttcttttgatttatacccaatttttttgcaatttttatttcaatttttgtccattcttttcttgtgaatttctttcccatttgcttaactttctcttttattttatggaatttttcaacaatttctcttttctgtttgtcatttaaaattcgaatttgatcataaatttgtccattatttgttggcattggcaattggtcgcccaattcatcacaatctgtggacatttcttcactctcctcttctttcacttccacattttcatcaaaattctgatcaaattgacgaatattttgtccaaattggttattctgatcagcattttgtccataaattattggcccaattcgataaatattttcttcagttctttcgtcccatctttggccaaatatttcagcaaaacttttttcttgacttattttgccagcctcaatttggttaattgcttttttgaatattaatgcgcataataataaaaatattaataatattttcatttttttgtaaaaatataatgaattatttttataaaaatatttttcgncaatgaattttgtaattattaattttatagcatggcttaatttttcttcaatcaatcaatattaaccactatttaatctattatttcanttaatttgacaacatttttataataattca

SEQ ID NO: 5743 - DNA, 6909 bp, Heterodera glycines
  misc_feature (19)..(20): n is a, c, g, or t
  misc_feature (117)..(117): n is a, c, g, or t
  misc_feature (139)..(139): n is a, c, g, or t
  misc_feature (3418)..(3418): n is a, c, g, or t
gtacattttgaagctttcnnaattcatacaaaaaagaaaattaaaattttcagaaaaatgacattaaaataaaagtgaaatttgtatgataaattaagaaccgaatgaaaaaaaatntaaaaaattttaaatgttaatntaaagccacaacgacgacagaaaaagctttcgcgtgctcaattggacaaattggaatgtgtgtttaaaagcaaaaattacttaacaaaagctgaatgtaaacaatttgccatggaaaatggcattatggagcagcaaattcaagtagagaaacaaaaaatgaaaatttaatttaatacaaagtgtataaaaatctaattaattttaatcttaaaaataaaagaataattaaggaatggttcaaaaaagaacgcttaaaatgcaaaagacaagaaaaagtaaaaacccaacaacagcgaaatgtaagtgattaaatcagggatggtatccgtccttgaatggcaaggacgtccttgaaaatgggccctctttcttgaaaataaaaaatgtccttgtatgcaaggacgtccttgaaaatgagcatttggaaaaatttttaaaaaatcaaagaaatttgagaaatctttgtaattttcaacaatattttgattaaattatggcattatgtcatttaaaaatgtaatttttgagaatttttgaaattttatggcattaagtcactagtcactattttccttaaaaaattagccaaaaatcgcatattttggtcatttttggacaaaaatctgtaaacaactcgcattaaaaattacaaatttttccggacccccctatcctcaaaaaaattttttaaaaagcgcgccgtaaaaaaacccattttataaacaaaaaaagtcgtcgcatggcttaaaatcgcaaaaattaggcagtttttggtgaaaatctgttaacaaattgcattcaaattttcaaaatttttccccggcggcgcctgtcggcaccgccggaccccccccccctgtcccacaaaatttttggaaaaagcgcgccgcaaaaaaagcgtttttaaagcagaaaaaagtcgtcgtaaatgaagaaaatgataagtgaaaacaaaaaaatgttggaaaaaaacaattccggtgaaaaatacaagccatttgaataaatattaaccattttgcattgcatataataaaaattttaaatgtccttgaatttcatgaattttccccactatgtccttgcaaatcggcatacccgtccttggaaaccgagcattgggcgataccaaccctgttttcttttattttttttcatgtaaggttaacaaaagcatgcattttgtggttttcgaggtcgtcgatcagtgatcacgaatgtaatatacctaaccaaagttttggccaatcccggatccgaattcagacaaaaagtctgaatttcaaatttttggttttaaaattatgttcgaatctgttcacaaccattttaggatattacattggtttcttattattactcatttttaatcaattttaaaataaaatgtcaattttgaactttcgactttttgttcgaattcgggtccgggattaaaaatgccctaattttggatttttagattggcttaataaacaattaaatggctgcgaccattaatcatatatctgcaagcaacggaaatgatcaaaaacggcgacatttggcaagtggaaatgagccgttgcaacgcttcggagaggcaaaaaaatggatgactgatatctatgggcaattggatggacatgttggagagttactcgaattctatttgggtaagatagaaacaaattattgtagttgtaactggaaagtccaggtttggttaaaaacggacaaaaatttgttcctcccgctcaaattgatgaaattggacattttcgcgactcagtaagggcaattcgtgaagtaatcgggcgggacaagatgaaggtcgtcttcttcgggaggttgattgcgggatttctctagtgaaaatcagttttatgtggtttcagaacaagcaacggtaagagcagtgtgatcaatgcgatgttgtcatgccgagtgttgccccaggggatggggcacaccacttgctgtttcttacaagtggaaggggggtcggagcaggacaagtacttcatgatggaagacggggcgaagcactttccaattgctgaattggattcggttgggcatgcgttgggctcggaaggcatgggctccctgggacgcgactcgctcattcacattttctatccaaaatcggcgtccaaattgcttcaaaatgatgttttgatcgtggacaggtacaaaattatggctaatttgaccatttcattggtttgcgtctttcaacagccccggcgttgacctcagtcccgagtttgacagttggattgacaagcactgtttggatgcggatgtgttcgtgttggtctccaattccgagtcaacgctcactcaagcagttcgctttaatttaaagctcaacaaataaaacatatatttactgaccaattgtaggagaagaatttcttcattcgcgtcagcaaaaaattatcgcgtccgaatattttcattctttgcaatcgatgggatgccagcgctactgagaccgatgagagccgtgcccaaatccgtgctcaacacgagcaacgatttgaggattttttagccaacgagttgaaagtgtgcagtgtggcggaagcaaaaaatcgctactttttcatttcggctcgggaaatgcaagacgcaaggcttagggagaagggggaactgaccaaaacgagtgggtcagcaaacaaaacgaaagataagccatttttaaggtccctaccagcaggagggtttccaacggcgagccttggagttcaaacaattcgaagagcaatttgaggcagggcatttgaaaattcggtgattctatgcaattgaatttagaaatgcatttcgaagtcagcaattcggacaaaattcgaggcgcataatcgccgtgccaatgacatagttgaggcaattcaacacaaccttagcacagtgctcgatttggccgaccaagaacagttcaaacacctcaaaatttaaagaaaaatccctattccaaggaaacgccttgcgctggaattccaattaaaaaccaaagaattcgcaagttgtcgtgacaatttcaaatttttcgagcggacttatttcaccgaacaacagaaattacgttctgaagtgcatttgaaggtaaaatatcataacagaaggaagggggagaagaaaacagaaaattctttggtcatttctatgggcgccattgataaatttcccctccaaattttattttcaaacagttcgtttaaggtcaaaggagaaaaattcaaactaataaaaaaaaattaattattagagaattttaatgatctanaattcctcagcgtcgtaattattttttgttcttttaacaaaaaaaatttttaggtttcggctgactttttagacgaaattggacgcttagaagcgatcattgaccgtttcaacactcatttgttgatgaccccgaactgatcagcgattacaaacgccaattggccatccatgtgaatggagtgttgtcggaagggctgcaaaatcagtgcacgggcggactaatggcccaaatttggagtttggagcagtctatgcacggtgagtgatgaccaattgaaagaagcattcatcctttcattacttcaaaaaaaattagcctttgtcaaaaaaattcttaacgaacggcacgctgcgcagctggacaaaatttggcagtataaacagcccttcaaattcgcaattgtggtgaactgtcctgaattgatgtccgatttttacgaggacttggaattccgcttttcacttggagttgagaatgtcgcacgttggattttgtccataacacgaggccaaccgatcaccgccattgaccgaaacgttttggtccgatacaattttattaattaaaataatattaatttcagcggatgaacgtattgtcacgacagggacacaatgacggttgatgacggagtactaacaattaaaaagaaaaactgatactgttttaggggcccgaattggccatggacagcaacggcctgacaaacgcgaggtagacgcgttcttgtcgaacatcgttgtgcagtcggccacctatttgatgaatggttccgttggcgtgaccattgcggggctggtcatttacaagaacgttgactggcgatgggtggtcggaggagtgggactcgttgccggactatacgcattcgaacgcctccgatggaacaacggggccaaagaggagcgactgaagacccaattcagacagcacttggaacaacggcactcaattcgtttccatttgtttgaaaataaattgaaatttagcctccatcaaaccgagagtatccacaccagcagctgtgagcagcaagtgacccgggagctggaccaagtgaattgatcgaccgaaattccttttcaaattcccttttcgagttaggtttacgaaggactcaaaactgtggttgggggttttcatcgcgagatgaaagagggaattgaccagtgcaagtgccagaaggattcgctcgagggaatagtcaaaagtatcaacacaataaagtgagtgcgttggatagagagaagggcgggggaaatttatgtatacattcttggtatcagtcgaaatcttgaagtctgcagaagttttttgtgctaaagacaaaaaatattctggaatatacacgaaaaatgatgctttcgagtttccctattgtagtttttttcgtaatgcaaaagtattggttggaaaggaaaaagtttattgtttactgtccaaaaacatctcattccactcaagaaaaatttacaacgaaacactcgaatttttccttcagaaacaagaccaactttgtgggaagcaccttagacgaattttcaaggcgtttcttgaatgcgttcttctgatcgacaatatttgcacatttcgaagtgattaattcagttggtgactttgctttaggtgtgcccgttgattgatcccgaacctctctcatgaataattgtgtatttttgctcaatgcccactttcgtttttgaatgtcatttcatttttatagttatatttgtgtcttagaatacgagttctgttcaaataaacaatggttagccatcccattcattcgcattctcagccatttgtgccattttggaattttccttacttgacactgaatttgctttttccctgatggacttgccaattccctttttccacacagaccatttttccacaaaatgccattttgtaatgcgggatttggggagtccaatcagcaatattttgcgcaggagagaaccgatgtccagactcagcaaatattcctcgcaatttgcaggtgtcgtttaaggggacaacctttggaatttgttgccagttttaacagaaccactaaaaatgaatttttgcaatgtttgggagtgatttttctctaattatgatttttgcgccgttatatgtgttttatgtggcggcccgactcaaacggccgcctcaaatgacccaattcgttgttttgtcaggtcatttgtttcgcccgctgttccgctgaccgttccgctaagcgaagatcgtcaggggaatatttacgtcagttgggatgttttgtccttcgacggcattcgccgctccttcgctggtgctttggcctggcagaaaagccaattcgaggcatttctgaccatcatttgtttgattgcttcttctacgctttctcaggccgtcctccaaacggcgtcggaattacgtcgcaaattgcgcttaattgacgaatttttcgccgatccgttttcctatgcccaagaggtcaattcgctgattgactcccatttcatggtcgcttccgtttgtgacgctttgtcattttttgcagaggcaaaaacgatggcttgcaaaatgttggagacggaaggcaaattttcgggtgaagcgataattctggcaaatttaccgttgtgtatttcaggaattcattgctttggcgaatttttacaaatgttgagaaagcgtttttcagaattcccgcaatatttagagaaatttttaaaatcaaaaaatgacaatttgacgaggacagaaccgccaatttacaccttctgggcagacttcatacagcaccttgacttttggcccatttatgagagtgaaaatttaatggtaataaaaagggaaaggaaaaacaaatcggacaaaatttgagccggcgtggaagacgacactttttggggggaatggtccgtctgctgggcaaatacctcactttgcgtcttaaatcggccagaaatgaaaacgggcaaattggttttaactgaagaaattattcattcccattttctgtttcacagggaaaggcttgcttttttggagtctctttggactaacgatgaatgggtgctcagtcggctgaatttcgtcgccaattgtgggcaaaatattccgctagaaatgttggaagaaaatggccaattatgtcccttttatgagactttcatttcgcatctgcgcaaattcaaagaggacggaaggcaatgaacaatcaattaatttggtgctttctgagtgggttaggctcattcattcatgtcatttccatgccaagctccatgttttggtatagtgtggagagagagagagagaatggtcccctttcgattggcattttgcagttctaggcctcgttttgggcgttgtttcctccttcaactcgtccaccaatcgctcgtccgccactcgccgtccaatatcgacaccactgcgcgttccttatttgtccaacacgacatcttgcttaaaactcagccgaatcttctaattgttatatttcc

SEQ ID NO: 5744 - DNA, 879 bp, Heterodera glycines
  misc_feature (847)..(847): n is a, c, g, or t
atgggaaagagaagcaacacgtggtgtactaatgtgggggggggggggagttcgtcggggcaggggcaataaaagatggaggggcagttggattccgtcagtggttgaggatgggcggggagagaccgaccgacgaatctctctgctttggttgagttagtctcttttctttcgcatccattctttcactcatttcttagaatacggagaataaccaaacaccacaaaattttaaacttcgtgagcctaattttgcgtataatcgacaaagtttaatgggagttttggggtgttaccgctgataaaaacaataacaacaacaacagtctctatatattacacaaaaagttaacgaatttttaccccctcccccacactaagttttgtgcgtatttcacataaattctatcttttatttattatttgttagatacatatttctttaaaaaaatacgacagttggttccatcgtcttacaatttttttagaatggctgaggccagaaatattgctgccttaagcttcaccgtaacacacgatggcatttccgtctcttatgaccaggaagttctgcgggacatttggcacgcgttttcacgcagttataaaaaacgcatcgcaaaattcgaggtttgcttttatttttgatatttacttttgtatttcattaactttcgtgttttccagaatgatttcttcgctgggattttcccagccaatatccgttcgttggccattgtcattttccttgtggccgcattgaatgtttcattcggaaatgacaaaactccgttcaatcttgccgataagctcaattactacgtcttttcctaatatcaccacgtgnagtcatttattttgtcaattttaaaagggttg

SEQ ID NO: 5745 - DNA, 2183 bp, Heterodera glycines
cggaagatttaaatgaaaatgatgatttaaacgaaacctttattaggatgaaaatcggaatgtcattttaaatgatcgccaatcgcgccaagctggaattgagaaaagacaagaattggtggcccgttttacctaattctttgttattttcatatatattttgtctctcaaatactctttttattagattttgactaattttggttaaaagtgattttttaaataatatcacatgtctctattttagggaaattaattacagttcataaaaaaaattttttttttaaattttgagttggccctaaaaaatcaaaattgatcattgagaaaaattattttataactgtttttaattggttttttgttagtttagcctaaattatttatcatacaaaaattttttggttggattttgactacttttgctaaaatggattttttatatacttatcattaggttaaaaattttattttggtatcagatgaaagagcacacttcaatcaataagaaacttatttttgtttatttttatctcacaattttccgtgtcaaaaggctcatggtaaatattgcaaccatgggtatgatggtggtagcttttctaaccaccaactcccgtcaaatgaccacgaactaccttcttattctacgggttaaaaagagggtcatggtcatggttaaatgaccaccaacttcatggtcatttgcccaaagttcgtggtagctcttattctgcgggttttaccaccaacttcgtggtcatttaaccataaccacgttcttattctacgggcccagacggcgaacgaaaaggcagccaaaatgaggttttcggattgctttccttttcctgagtcacacattcatttcggtgtacagacatttcgccaactgacatctcgccaacatttatttcgccaacttaaccaaaatctgacatttcgccaactgacatttcgccaagtagtcaaaaaagtaatgaaaaaaagtaaaaagacgaaagaattgcatcaatcaaagcttaagtattcctttcatttttataagttcttttctaaccaaacaaaaaggtaattcagattttagtaagaaatgccaactgtacgtgaaatacttgagagtctgcaaaatccaattaaaaggccccgaattccaacaaatgaagacagcgtactgaatgctgagaggacagacgcagaacaacaaatggaaggcacgtcaaccaggaatgatttggacgtcgctgaaagcgatgatgaagaaaattgtgcgcctgttcatttccaacgtggcaaaacaatccgaggagcgctttgcatttggcaccaaggtcttaatagttttttggggtttcatttgtttatttttaggcttccgatttctcaaaatacgaagcgatggaagctggttcaggtgcgaacggcgcaattgccctgcgacagcaaaattggaagatgaggaattgacgggcgttttgggtcccaaagaacaccatcatggtcttgccccatcgcgttgatgcaccagtgcgattcggtctgcattcgccgcaaccatcgactccaacaattccatcgacagaagaaagcagtttggagcttattcgacgatggggacacgaaattgtccgtccaccacgcttccccataacgttttggaatgtgcacatcagggctcaaatggcacttgaaaggacgaataacggcatggaagcacggccaattcgcagtataaagcaatacatttcagaaaggcatttatttttttggtcagcgtgaactcaaccatcatccatcatttagtgacttcattgctgcattcactaaggacattgacaaacagttagacatcggacgcgcagaacagctccagaaaagcactaaacgacgacaacggtacatcatcaaagaacaaaatgtggtgcggatccttgacgaggccgactttgaatcggaagaaggattgacaaattctttgcacctgctcgggctcgtgatgcaaggctttgtggaggggcttcacgttcgtggaaatgaagagagtggtgaagaaactgatgatgccgatggaaattaaattcgaacaattttagattttatttccctttctttttgttattttatttattttataaagatttcttcgcattggtgtgcttgggggagaattttttaatcattat

SEQ ID NO: 5746 - DNA, 2250 bp, Heterodera glycines
tggttaatatgatcggaaaattgtaatttattatcaccttttactcctaaatccctaattgtatccacagcatttattctatttccatcaaatttatatgtttcttttgggttttttgaacccaaatataatacaaaagttttttgcattgaaactcttatttgccatttatttgcccattcgaataaattatgcaatgctttatgcataatttctgtgtcggttcttgctttataacaaatatataatttaacatcatcagcatataattttattttcactcctgatggcaaagcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaggagaaagttgtaaatattttggctaagaattctttccataaccctgcaaagtgagcaggttatagaaataggcctataattttcaggattaaatttgtccccttttttgaaaagaggaaaaactattgattccttccagatatctggaagagaaccagagtctaatgaaatcctgaataggtcagtaataacagttgctaatgaagaatggcagtttttcaatattttatagctaatattatccggggaggtcccgtttttattcggaagttttttcaaaagtttttgtgtctcgatgatgttaaagtctatatctgatataaaacattgattaacaaaagtattgcccaagtttaggtagcctgggtcaacatcagaattgttaaacgaatttgcaaataagttggcaaataattcacatttttcatcaccatcatgatagcatttgttttcaaagactaaattcggtatttcaaagggattaacatcgtatttttgtaggtatttaaaaatggaatttcttccctttgaaatagcctttttctcaatttgcgagtgaaatttatttgtttgtatttttatgtgtaaactaatgctatcataaagtgctttttgctcttaacacttttgtaaagaaaaagaattgtttttgtatatgcaaagtcaatggaaatgatcttacacttagttttgatattgtattgaaaaagttttggttcgagaaattgtttgaccttgaaatggagtttttttgtttttgtaattaaagcggatgtcaattatgcctcttttaatggatacggttttaattggatggatttatcgcacttattgtttgttttgacaaaaataagtttcttttaacgatataaggtcagtttatttgttctttttttgtatgtagatgtttatgtaaaagaaattattaaaatgtaagagaacaagtatttattatgaaaaggattttctacgcaaattgtatttcataatagaaatacgtttttaaaattccaaaattatgctgaacaggtctgaattaagtcccgtgattgacatgccgatgaatccgtaaaattgagttcattgtttggaatagtgaaggattgagtcctcggtgattggaatgctggtgggattgagtcccgggaataggaatgatggagaattgagtcccagtgattggaatgctggttagttgagtcccagttattggaatgtcgcagaattgagtcccggtgattggaatatcgcagaattgagtctcgatgattgcgatgccgaaggaccggtgaggttaggtcccagtgattgaaatgctggagggttgagtcccagtgattgaaatgctggagggttgagtcccagtgattgaaatgctggagggttgagtcccagtgattgaaatgcaggagaatgagtcacggtgattggaatgcataaaaactgagtccgggtgattgaaacgcaggagaatagagtcccagtgattgaagtcctggagatttgagtccctgtgattgaaatgcaagagaattgagtcccgagtgattggaatgcaggagaattgagtctcggtggttgcgat

SEQ ID NO: 5747 - DNA, 1892 bp, Heterodera glycines
  misc_feature (64)..(64): n is a, c, g, or t
  misc_feature (77)..(77): n is a, c, g, or t
  misc_feature (83)..(83): n is a, c, g, or t
tttttcaaaagtttttgtgtctcgatgatgttaaagtctatatctgatataaaacatgatttancaaaagtattgcncaagtntaggtagcctgggtcacatcagaatttgttaaacgaatttgcaaataagttggcaaataattcacatttttcatcaccatcatgatagcatttgttttcaaagattaaattcggtatttcaaagggattaacatttttctcaaaaacgggaataaaagtacactggtaataataggggctgatttgtgagtgaaaaattgttcggtccgagggtttttgtttagtccacacaccgtttcagcttttgcctcccagttacaaaaagatttgaatttttgtctcacaaaggaagttccccaggtgtccgtgggatttccgaatgaaatttggtgggtggatacagcacgatctcgatcggtcccgatcaatggcgtccaaaatctgctccgtcaaccgttttcgcgagctgcgttggagttcgtcgatggccttccttggtcttcctctgtttggcgttgctaaaattgacaaaaaatgaatgatcaatttttgagaaaattaattgggaaaagagaaggcatcgaaatttcactcacttttgctggtggttggtgtcgccgttggtggtgccgcacattgctccagctgacgacgcagatcactgatcagcgcttctcggtttcggacctgctcgcgcagaaattgaatggtgtcatcccggtccttgagctgcttctccagctgttcgatgcgctctgatcgctcgtcaatggccagcggtggcgggatcgtctctccggtgtccattggcgcagttggtgttgtcgaaaacggcaccaaatcgccgactggtgtgacagatgtcgacggcagcgaaaagccaaattccaagatttcctcgtccatctcgggcgtcggcactggtcctggagttgatggcgatggttccatcgcttcttctgttgatgcagcagatgttgacggccctgcttcgtcctgctgtggcatttcggcattggggttcgactgtggagtggctgaaactcaaagaaatgattttttgagtttaaattgctgaaaaaactcgcttttcttagtccatcgggtttctctggccctcgcaatattggcctgtcgctgctctcgatttttcacccgtttttgtgccgatttaattgcattaagcttgcacacaatttttctttttgccatttaattaaattttgctttaaaattaaaatttaagttaaataaaagcgattgttttctttaaaaaagcgattgaacaattctatatttttttctctatcggtatacaaaattaaaagaaattctgcctgaggaaaaaaaagttatgctgttcgaagtaaatgttgtttttcctaataataaaaatattagatagtacgccaaaaggagacaaaaaattagagaaaaaagataatgtttttctctggcactctctatttattggtacacatctcgttttatgaaacggtgtgtccaattaaatatttaatttcttggagaaggaaagaaagtcacaaataacttggggaacaaatataaaatgcaaatgaatgaagggaagacataattagggctgtgaattttaggttttaactaaattttttgctcgattgatttgaagaaaggagctcaaaaaacgcatttctgcattaaaaattttcgattctgatgtcattatcggtcactagaaatcactattttggcgacgagtcggcactaaaatagttaaaaatcactattttggcgttttgtcactatttcgacattttttggaaaattctttaacaaaaatgcaataaaaccaaaaaatacacccctaagaatcgacctaaaaatttt

SEQ ID NO: 5748 - DNA, 3214 bp, Heterodera glycines
tataatattttcttatctctttttctttcttttatttctatcacagagaataaaatgatgggaaattctttgtggtaaaataaatttttttagtttaatgcaactgaaaataaaaggtttcaagccacaaaatcatctttatttgatcatttgacaaattacccaataaaatatgtacatagtttgtttgttttctgtccttgttttgtattttatatttttctgcctttttaaggcgaattaacggagaatgattttgccattaattttattcattcaccattttcgtaaaatgaatttcaataaaaataaattttatttaaaaaaaaataattattttattctttttcataaaaatggttttaataaaatttattattttattttcaattaactaattatttttttttatttaggaaattgctttattttaccacagaaaaaaagcaaacaaagaaatggccgggaaaatttttgtggtaaatgaaagaattttttatgtgaaataattttaaatattaaaaattcaggtcactggcgcaaacaagggcattggttacggcattgcgcgtgggttggcccaacaagtgaatggtgccaccatttacatgacgggtcattttttatgggtgcacccccaaaacctcgctgccgaaatttatataaaaaattccataactgaaatttttcaagaataaaaccatataatttttttcaaatttcatacttcgaaattatgaaaattttggtagcttttttttagaaatttaaaaaatatataataataaataataaaactttgaaaatattgctaataaatttaaaattttcttacaaaaaaaattctgatatttttgaaaaattaaagtttgaattggtggcgcgattttgtcccgtgcactatttatttatttatttttgaaaaatttaaatattttgattttcagcacgaacgccttcactaggcgaaaaggcattggatgacttggagaaggaattgggcacaaaacgcatttcaaaattggcatttcatcagttggacatcactgatgagaaaagttgtgccgattttgcggcatttttgaagaaaacccacggcggattggacgtgctcatcaacaatgccggctttgcatacaaagtcggcatttttggatttaagggtggcaaaattttgcctcttaaaactgcagcataatgcgacagagtcggccgcaatccaagccgatgttacgattggtgtcaattattatggtaccaaattgatcagtgatcagctgggcccattgatcagagacgggggaaggtgaggtgaaggggcgcaattgacggcacttttccgttagggaccgcaattctttgccattgccgaaaatttggcatgacgaagaagtgccgttaatggatgacaataatacataattaggcagcctaataaatttgccaatgtatttttttgtgtgtgtgtcagaattgtgaatgtgtgcagtcaaatgggcgtaatgggcagtcagattggtgtgatgggcaacctgtacaaacaggcactgattgatcagttcaaacatgccgatgtcacttcggacgatatcaacacatttgtggaggaatacaaaaagtgggaacattaaatcccaccaattttctttttttttcggaattttcgggggataatttttaaaaaataaaagttacaatggcaggggtataaaatttcaaaaaattttgaaatttccaaaggcttgcccatgcggacaagcgcaaggagggcggctaccccgaatcggcctattgcgtgtctaaagcggccgaaattgcgctgtctgtgctgcaggcacgcgaattggccaagcggaacattgttgtgaatgccgtgagtggaagaaaattggcatttgaaactaaggccaacaccctcccttccccccatgttccttctctgaagttggacatttcgatgggatatgtgatcaagagaattggcatttggcaatgcccctggcaaatgcctaagaatttggcattcccaaaaaaagccggaaatcgagaaattggccaaaacaattgctgtttggattgggaatcgttttttttataatccacccattcacagtgttgtcccggctacgtggacacggacatgacaagtcacaagggccatctgaccattgaccagggcgcggacacgccaattttcttggccattgaccaaagtgtgcagaaaggaggactgttctattatcagaggaagccgatcacatggcttcaagagtgaaaatgggaattgatcagtggctgatcaactgatcagaaaagaattgtgatttgcttgggcttcttgggagtacattttgatgaattttccatcactttattcgtggatattccaaaaaatttttaagttaaatatttaataatgtgaaagctttttcaaataaatgtgtgtttgtttggcttaatgtttttttttacatttaatcattgtaatatctgttcttcattgccctgtatttgcgcagccgataaagcgccttaaaatcacaaaattgagttaaattagtaaaaaaaaaagagaaacaaatcggaagggtggtaattagcttgccttatcccagaataattggcactttttttttgtacattttgtcaatggccaaaaaacacctccaactccttgaccacgtactcgccccgtttgatcagctcgcgcactttggcctcttcctgcacattggcgttgcgtgcgaatgcgttttttagccgttcatggaaccaacgcgagccttgcggatagtccttcaatttgccaaaagctttcatgcttattatttgggtgctaggctaagccttaagctttatttattacattgttttttattgtgcgcgaactgctctattgctccatttttgtatgattcccaggctcggtaatagtgtactttgtaccccccttttttgaaaaagaaaattttcaaaaaaagtttcgaaataaaactgttttatgtgggccgtagaatttgatgctgatatcatttcggcccatttcgaacccctgacccggactcgaacaaaaattcaattttcgaaaaattcaaaatatgcagccaaatgcattaaataaaaaggagtctcgattcagaaggcaaaacatagtaattcctgcatttgaaatggtgttgtggcatattttgaactttttcgaaaattgaatttt

SEQ ID NO: 5749 - DNA, 1772 bp, Heterodera glycines
caggggtccgaaatagatatcagaatcgaattctatgacccagaaaacccattatttcgaaaaaaaattttctttaaaagacaaattctccgagtcttgaccaaggcttcatggtaaaagccttttcgagactcggcctcgagaaattgtcagtgtctgacatcgccaaaaaattattttctctctcaaataatccatgataatttccaaccacgccttcgtgaacccaccttgcccaagtggtacagctaaatgaacaaacatgataatttggcaatagcaaaaacaattttttttttgtaccgtcttgtaaagttgaatcacttcggcacgaagcgagtgccctccaacgatggacattgtcaaaaaaaagtagttatgcaccaaaaatgccaaaaaaaatttgcgcgaaaaatccactcaaaatcaaaaaaggaaaaaaataggcatttgtttaggaaatcattattatgatagataaataaataaatgaatgaaattgtcaaaatttatttctttttacattattattttatatatacagaattgcaaaaggctgtgtaaaaatggtaaaagtgaaatttacattttttataatttttgaaaaagcggcaattggccaagctcgacacagcaaaaaaaaaaaatcgacaaaatgaaatgagcaaaagtgaacaatggaaaatagagaataaaattaaaatgaaaaagttgcaaaatagcaatacaaaaaatggacggaataaacagcaaaataaatatacatattggacaattctcgagcaaaaaaagatcagttataaacggcagaatttaaaaaagagataaatgaatgaaggcaaacgatgaggaggggaggagacgatgggcccaaaaaaaaactgaaaacttcaaacatatgaaaccgaaaattgttgcgaacaattaaaaatgaaatcccaaatttttgggaataatttaggtttccggtaagttgagaaaattcgtaaaaatgctttcgaatcacaccatatttgttaattttagtcaaatatataagaaaaagctacaaaattttacagtttttttttcggggcccaaacttccacaggccatttgggaagtgaaaaaattattgtacaatttagcaaaataatcctcaacatcgatatttattgtatggagttttcaagaggccatcattgtggccaattggtcagcggaacagtgccacaaatcgggcatacgaacacagttgaggaacagctggttgaaggacgggttgagcaggttctcctccgccgagcattcctgaaaaaataatatgggagtagacattaaaattgagaccttgaaaaaaaaattgggcaaaaaatattgttgaaaatttttttaaaatttttacggggggaaacggcgggggggggggggggtaaacgacctgcttccaattttatgacagtttcgggctgccatggaatgcaatgacggattatagatgatttgacccgtagtcagagttagaaaaaaaaatcggggattcaaaacaaaatttacatattaaccaaaaaatccatcacattttggaaatttttgtccacccttcaaaccgatggatagtcagtcaaatttagagcaaaatttgtcaaaaacaatgtttgaaaactgaatgaattgcattgttatgccgtgaacaatggcaatacatcacaatcaatctttggtacgtgcctggacaggcaggttccactgctggcgaagccgttcaacgagacggtccagttcagcaatct

SEQ ID NO: 5750 - DNA, 1003 bp, Heterodera glycines
gggcaacggttgtttgtctgggcaaatggaaaattaaaaaaaatgagaaatttaagaggggagggggggggggtcaataatcccaacaaatttgcgaaaattccaaaaaaagtttccgccggacatcaatcactacgtgaaacttctcatagaatttgctcaaaattgaacaaaaatctatgaaaatgtgggttgtgttttggacaaaatcaaagttgcaaaaaagcataaatatgtatcacgaaaattttcaaattcttcaaaaaaaaaaaaaaatttttcgtcatttattcgctagcaaattttacatcatttcgaattatatatattatataaaattttcaattttattttccaaaactcaatgagagagttattgtgggtcacgcatcaaatatcgtaatggaatgcacaggcacggcactgacaattgtaaaaaaaaaactcaaaaactgaccgattgtgacagtgccaacgacaatgtgccaatccatttttgcattgtcgccacgcttgggcagctgaactgcagtgcgctcagcaacggtccgccgctgtcgtcggttgctgactcgccattcgctccgctgctgggcacccgcgcctcatccgcaaagtccaactggaacacgtactgctccacgtcgttgaccagctcggcctggtacacctgttccacggtgtcgctacaaaaaataaaattattgattgaataattttaaatggcaaaaaaatgccgattttatttttggtggttattaccgtatgctgacacagcgttgggcaaacttgtaggtggagtccgagaacaggtacagctttgaaccgctgaacagttaaaaaagttagaatagtcgttagcgaaaaattaaaaaaaaaaaacactaataaaaagcccatgaaatgtcgaaaggaaaatcaaatagtcaaacatttgaaagagtttgtgtaccaaattgaaggtaggaagggtcaaaaacctccaaaaatttctggaaattga

SEQ ID NO: 5751 - DNA, 1317 bp, Heterodera glycines
aaaaaaaaaaaaaaaaaaattggaactcggcatggaaatggaagccataaaaaacatcgggaaaaaactgggaattttacacccgttgcatgtgcaaattacacaatttgatactactagtggcctcccctcgttcacctgagcaccacgtagctttgcttccactcactgctgcccaccggacgccatgtccaaccgcgctggtacagctcgcgcacggacatgtaacactccatcatcatcaggttgctgccgcttccgcctcccctgtcatgttgttgaccttgttgctggtgttgtacatcgcccgtggttgatggagcagcagcagctgtactgcttggtgttcgttgcttctgttgccgctgctcctccagccgacgacgctgctgctgcagcatttgctgttggttgtgctgcacccgtggcgcgtcactctggtgccaatacaccaatgaatggtgcacaatttcgagctgttgctgcaaaaggcaaacatttttttaggtgaagacaaaaaaatatatgtatttatttaagagattatatacataattggaaaatctgtgtgttcatgggtagtgctccggaatacgtgtggaattgtttttttggacagtattttagacgtgtcatgtaaaaatctccgttcgattttgattggtgtataaaactatagattagagaacaattggtggtctctatttatctgaacgttcttttaggggtttctagaaaaaaaagaagcaaaaaaattccaaaaacttattatctgccttttttcgaaaattgtaaagaaaaatttttttattgaaaaacgacaatgctcaaaacaggaaaaaaaattttgttccccccccttcaaccgctgcttaccatgcccaactcgctgcgcagaaaacgcttcagcaacagtgccaaatgcgacgagtgggacgtgctcacatacaactgctgttgtggggcagtcaatgatgcttgggccagttcgtcagcagctgaatgaatatttaccaagcattttttggtatttcttgttttctaaattgtctccaagagctccctcacgcaaatttcccaaaaatttttaccaacatccttaaaagtgtctccaatttttggtgcaaaacagacttatcaccaccctctctcctcgccctttttgatgaaaattttcaattttccttattggctttctcctccagggactgggtcgttttggcgccgacgttttggcgccagcctcagtttttttattataactttttttcttgttgaccaaatctaacaatcttggtatcattcgaaagcccttca

SEQ ID NO: 5752 - DNA, 734 bp, Heterodera glycines
tcactttttgcctttttgctcctttctttttgagggctttattattttgctgactgaaaagaatcgcctcctctcaaaccaaatccaataaaataattagtgtttattgattaattaatttagcaattaaaaatagtaattaaaatgtgcagcaatccaaacgccaaagttttgtcttcgatttgcggcttcagtcggatggggccgaaccgcgagttgaaaacgcgcgttgaaacgttttggaaagagcaggcgaagctgcgcatggacggtgcaaccgaaggcgaattgaccgtttcaatcgatcaatttgagagggacattgaacagttgcaaatccaacgttggcagcaattgcaggtgaaaaggggaaacacaaaacatgactaattaatggattaattaatttatttgcacaggcaacgggcatcgatctgatcccatccggcgacttctctctctatgaccacgtgttggactgcgcgtgtcttttcaatgccattccgacgaggtgaaaaattctcatgaattaggcaccaaaagcaactaattaattgtaaggccattaccatattattttgggtgtgtttgatcttgacttttagttgaaaagttgcatttattgaattttaactacagtaataattttaggaattactgtaataaaattaaattttatataaatcggatcgatcaacggcggggggggggcagaccgtatttagggggggggg

SEQ ID NO: 5753 - DNA, 3604 bp, Heterodera glycines
gttatagaggtcccacaacagttatatgcaatttctccaattggtactttggcagatacaaatcggctgctcagctcagcggtgttccgtcccatctgcgcctttactttgcgatggcacgcggtcttcaggagaagggggcggatgtgccggcacttccgatgaagaaatggttcgacaccaactgtaagcacacaatttgcttttcttttgcattgggttcatcgttttgctcattttcagatcatttcattgttcccgaactgagcactgatcagtccttttctgttggcctcaacaaaccgttgaatgactttttgttggccaaaaatgcgctgaatttggtgacaaagcccgtcctggtgggcccggtcactttcttacatttgagccgagtcggagaacggaaggaattggcgacggaggagcagcaaaaagtgcacaatttgaagctgctcccgtcgctgttgcctcattatgtgaaggtgtgcgagtttaaattgaggaatttaacaatttcaattcaacggttttcccattaaatgaaaggtcgtccaatcgctggtcgacgccggcgccaaatggattcaaattgacgagccaatctttgcactgacttttgcggagaatgaggcgcccgcgtattacgacgcattccgacagaccgcgcgggcactgcagcaagtgacggcgaagaaggcgcacttgctgttcgccacgtacttcagctccatcgcgaagaatgtgcaaattgtcaaagaccttcccgagggtcggtgcaaattcgtctcctaattaccgctaattgccctctcaggcactggcattcacattgacttagtccgtgcccccgagcagttggacccagtgttgtccgcgttgccagccaattgctttgtctctctgggtcttgtcgatgggcgaaatgtttggctgagtccgctgcgtcagtgtcatgccaatacgttgcgcgttgtgcaaaaattggcaccgggacgcgtgttggtcagcagctcatgcagtctgttgcacgtgccatattcgaccaaaacggaaaagcgcagcgcagaagtgccaaaaacggtggccactggaatggcctcgtcgaagataatccattggctatcatttggtccgaccaattctgcaattgttattcaatgaaagatcgttttggatttgttcaggcattgaaaagtgcgaacaattggtgaccgtcgccaaaatgataaacggcggagactgcgccaaagaattggcagagaacgacgcccttctcaaagaccattccgtatccccgttgatacacaacggaacagtgaaggaaagggtcaccgccattgaggtggggagggcacggcaaatgacggcattttcacctttgccttagccaaatcgtccatttcttttcccattctttttgaaaacccatttgaattgctaaatttcgccattttcccaggcttctggcgttgagtcatacttccgtaagtcgccctatgagcagcgcattgtgcagcagaaggcgtgcctgcagctgccgcccctgcccaccaccaccatcggctcgttcccgcaaagtgcgacggtgcgcgcgatgcgtgccaaattcaaagcgcacaaaatggcggacgcggattattgggcatttatcaacgcggagacggagcggtgcattcggatgcaggaggacattggtggggcggggaggaggaaaatgggcaaagtgttgaaaaacgataattttcaaatgccattttataaattgggccaatccatccaatggccaaccaatcaatcaatctgtcgtcattcgtcgcctttgtttaggtttggatgtgcttgtccacggcgaattcgagcgcaatgacatggtcgaatatttcgctgaacatttgcacggcttttgcgtcacttccaacggatgggttcaggtgatttttcgatttgtttccgacactttctcttccattttcaattccttcgcttttttcagtcctatgggtcgcgctgtgttaagccccccgtcctttacggcgacgtgcaaagggcgggcccaatgaccgtggcaatgaccaaatttgcgcaatcgttgaccaaaaagccggtgaagggaatgctgacggggccaatgaccattttgaagtggagctttgtgcgcaacgaccaaccgcagaaggacacccttttccaggcaatgaaaaatcattgccaattaattgttgggatttctcatttttaggttgcgttggcattgcgcgacgatgtggccgagttggagaaggagggcatcaattgcatccaaatggacgagccggcattccgcgagggattgccgttggacccggcacagcacaacgaataccttaagatcaccgtacaggcattcaaagtgagttagttgctacatagtcgtatcattgatttgaaatttcaatctgttcctccctcacaattccccccattttttagatttccactggttgtgttgcggactccactcagatttattcccacatgtgctactccgactttggcgacattttcacgcacatcgccgagttggacgcggacgtcctttgcattgagtgctctcgctcgggtaaaagcatttcccctttctttgacgctttgttcagatttgagtctgctctcctgctttgaccgctttggctatccgttgatggtcggccccggcatttacgacattcactccccgcgggtgccgtccgtcgacgaactgaaggcgcgccttcgtgcgatgctgaaatacatcccggccgggcggctcttcgccaacccggactgtgggctgaagacgcgcgattggcccgagactgaggcggcactgcgcgcaatggtcggcgcggtacgttccgtccgtgccgaattgaaatgaaaaagaaccaaagaacagcaaagaatgtgccattttcacttatggaatcctaagaaatcttaattccccttttataataagcatggttttattcgtatcacttttgacactttttaattaattattttgtttatttattaaaagtttttctgaaattacatttttattgtagacgacgacagaatatattaataaatatttaatatttttcaaatcattaggattggaaatttaagtcaaatggttttttctggtgactcgaaattgcttcaaaacgtgatgagtcgaagtgtcaaaagtatgggtaaggggtgaccggaagaggcgggtcatttcagtacgggaaaagttatttaaataacttaattgaataacatctaataataacaaatatatttgtcctctatttcagtttagacgaccacaaaaaaagacaagaccatgtaatattttgacaaatttcatgcaccataactttttatagtagcaaccaaatttatacattcttggtatcattagatagcgctaagtgtcctttattttcctgtaaaatttcaaaaaatttcgttcggttttaaaaaagttatggccaaaaatgtttagaaaaacaatttttgaaatttacaagccacaacttttttataacccaacgaaattttttgaaattttacaggcatatatgggacacatagggctagcgaaaga

SEQ ID NO: 5754 - DNA, 2872 bp, Heterodera glycines
  misc_feature (2723)..(2723): n is a, c, g, or t
  misc_feature (2725)..(2725): n is a, c, g, or t
  misc_feature (2800)..(2801): n is a, c, g, or t
  misc_feature (2807)..(2807): n is a, c, g, or t
aaaggtaccgccaaacgaaaaacatttttaatactgaatacctatgcaaaggattccagcgataaacacgaagcaaagcataggaccgaataagcaaattgcgctccatacatataaattttctttcgttaatttttttccaaaaattcacaaaaatggctcaaaatagcaaaaatagatctttttctcgacaaaatcggttaaattaattcgagttgcgtttgttgctaaagttaaatctgtgtttgttgctaagtttgtagttacgtttggacttacgtatgtttgtttgttttttgaacaacttttcaaaaaatggaaaaaaaattgaaaaaccccgaccgaccccaaacgatttggtcagcccgaccccgacggtcggggttgcagccctacagggtcctaccatcggtcaatgccttttcgtaataaaggtttaataaacgttataatcactagagaccggattttgaggcatatgcctttttttgctaacttactacggcctaatacgcacgaaaaacgaatttttaacttttttatcaaaccatgttaagaagccataattttttttgttgatgattaaaccaacaatttggttaattcgagaccaatttttacaaaaacaattaagaaggttacaaaaaggctatcgctattgtggatgaaatgttctcttcggcgggtgatcggtgattagagggaattgattaaatttgtggactgtggtgaattcccccccccctttttgccccacctctctctctctctcttatcttatctcccccccccccccatctcttctgaattccatttgatgaactgtgctttttcgcagcaacgacacaaaatggagggaaagctgatcaaaaacacaaatttctccatccaatttattctcgacaaaattcgccgttcattcgatttggaagaggcgcaaaatgagcaaaaatcaacggaatggccggtggccaatcagctggacggtttcgaagccattgtctgtttaattaatttaacacaaaaaatacaattgaaccgttgaataaaaacttgaggacatcaccggtggtgccgcgtttatgtcgtcgattttaaaagttacgttccattggaaagagcccaaaaaagcacatccctttcccgattctgttgtactaaaggttaaaagggatgatttatatatatatatatatatattgaatttaatttaaattgaaaaatcatttaattaaattaatgatccccttggcacagattcctggcccaaaatacaattctttggtggcacaaaatgggagggaagaacaaacggacaacgcaatggaagaagaaagctccgattatctgatcaaagcgcacaccgtaaagtagcaactattggcaattaaggtgccattttcagaatgagattcttttctacaaaaactttccgcgcttcgacgcgtccctccgtctgcccaaattttacttcggttccgactacagtcccagccacagtaagtcgatctgaccgatcgattggcgcagtttgcccagcaacggaagcgcactgatttctcacacactttttcagccaggaattgtgtccgcttttgtgatcagtgattttcccttcagataatgggttgatcatcatggaggacctgagcagccgcgcttcgtcccttctcactttgccaggcttcgacgatgcccatgtgctggtggtcatcgacgaactctccaaaatccacgcaatttcttggaagcacggcgaactgaagcaacacttcccgatcgaaattcggcccagttttatcgagtcaatgcgatctaacgcgaaacaattggcaaaggcaaaagagcaaagcaaattcaaagtcgaataatttgttcggatttgcagattgagccgaatcaggtcggcccactgatcgaccgtcttttgtcaatgttcaatgtcgattattacgccatggcattgtacaccggagacaaatacggtcagtgaaattggcattggcacaattttaaatgtgcttttcggcttcttaaaggatttcccagttgcattgtgcacagcgacctttggtcaccaaatattttgtgggagaaaaatgccaacggcgaacccagcgaccgtttgtgtgccatcatcgactggcaaacgcttcatgacggcaacccgtgcaacgatctgtcgcgacttttggcactgaacacgtcgggacagtacagacgcgaaaatacggggcgactgttggaatattacgcaaaaaaagtggccgaacaaatgggagggacggcaccattcacaacggaacaggcaaaacgaagctgaaaatgagagcaaaaagaatcgcaaaatgtgaaattcatttcagttgagagttgcatacaaacattcactgcccttctcaatgatgtgagtgagaaacggcacgaaaataaatgtcaaagcaaatcactaattgtttagatgggagagggggcggggaggtgaatgagtggtgaatattaatgaatttggcaatttgagaaaagcttaaattgattgaatgttgaatttatacatttacaagaggaatggtttttacaagtagggatcccagcagatgtgataatgttttatcatttggcagtggcttttttaataaagtttttgaaattttgaagctttttgtaaagcaattgtcattttttgatcaaaagcataaaatttttaatttccttttatttcngnctaaaacatcacattagacattttagacgaatctttaagaagactcataaacacaaatttttgaaaatgaagcannaattgntgaggattgaacagtgtgaaaaaaggatataataattatcgtttttactgtttttgaggcttttt

SEQ ID NO: 5755 - DNA, 5249 bp, Heterodera glycines
aaaaaggaaaaggtttttcctcctattttagacctgggagaagccagggaaaaaattaagccttttgcatgtttttggcatccctgtcttattttgttcaccagcagaaatcaaaatttttcttgtttcatgcatgaaaaattctaatacatgcattattctctctaagaaactttttttccgtttttgaaataaaaaaaaaaaaaaaagccttcaaaaataaatttaaaaattgtattttttaaatttttggacaaaaataaataaaaatattcatgttgcacaacggactcgagcctccgcccattgtccttttactatcttacaaaaacctctgagcctcgcaccccatccgaactccgtcgcggcgcccaattggttgcccatcagcggattaagcatcccaatttgggtggccatctgttgcatgcggcgcatctggcgctccttctccgtgtccgccagcttcaccgtcagcgcgccggaagcgccgcgcattgtttggctgccgtgcagtgtgaggatggcacgctgcgcctcatgcgcctggccgaacttgacgaaggcacagccctggaaaggtgtgggaacttagtgaccaagtttcaagactctcgaccgggatgaggtgacctcgtttcgagagtgcttgatcgggctttaagttttattgagttctttgttcgccgtaccatgaatttgatcaacggaatacggttctgatcaaaaactgagcaaaaaggcacccaagtcctgaacatggaccggaaaagaagcattggcgatctcgatcgagcttttgctaggctttttctgcccaggtgtttttgaatttttcaatggttttctgtctggcgtgctcataatctcgtggcaccgctcatcatatcgtcaaagcgacaccgacctttgatgcaccgtccgcggcgcgcagtacagtgatctcctcaatgtggccaaacggttggaacattgcgcgcacgtcctcctccccgtactgcttggacagcatgccaacctttgaaatgaagcaattaaacaattattgcattgcccaccctttttataggggacattttcagagagctgaggctattgtaagagttttacaaggacgtccttgttaatcataagaattcttgcttgagggaaagtaagttatcaatttgttcgctcatgtggcaacggaaatgtccttcctttcaaggacaaatttaatctaaaccggaggctaacggtttatcaaggacgcctttgtaaatcattaaaatcctttcttttcaataagatcaactttaaatgaagcgctaattaatgggaatgcaaatatcattgatttcaaggacaaatttcaatggtaaagcgaatgctaacaattagcagtcaaggacaaaaaaactcacaaacaatttcctgtcctcatgctttggcgagctgcttctgctgtccgtgtccgccggcttcacctgcatggcccggttcatctgagaagggtggcgggaaaacgcatttaattcggctcaattaacggggagagtggagggtgttcatgacagttctcatactcgtagttttttttaatccgaaattattttttcttataaatgccatgaaaaatttgaaacaagtatttaaatgccaaaaacttgacgataattttattttttcaaaaaacaatttccctcgtttacccccggaagcgttttccgatcgtgtagtgccgcctggcatttcagcgcactttcccgatggcaataggtcagaaaggcacagccctaaacagaaaatgtgatatggctattggcacattaccggctacagtaacacttgttggattttttagttaccgtataccttgttcagtgaaaagaattcttgttggactacaataagaaaaaggcggagtggaaaaaaaaatgtcgaccttgtgcaccccggtggttttgtccttgagtatgctgaactcgtagattttgccgtacgcttcgaacacgtgcctgagatccctttcttccagatttcttgggatctgcaaaagtggctttgttttttttttgatgggtttatcccaattttttggatggaatcactcattttgcaaatgacattcgataatttcaattttgtttttgtgaaaaactaaaattttcaaaatttcccgctaattcttacccttagaatattttaaaaatttttcgctggatactatatattttttgtatgtatttggcttttttccgtaaatttagttaaatttttttaataaaatttaaatttgaaccctgctggagagtctttaaatttacatttttcttttttgaaattttcatataaaaatcgcaagcctttcttctttggtctccttttttaaacttctgccatgctatttttgactttaatatggcccacaattttgccaaatttttgtttcacgtccgtccatcactttttattcattttcataaatcaaaaaattcttccctctgtcatttcatgcgtttttttaaccctcaagaccttagaaaccataatcacccatcatttacccctctaattactgcggcaaagtttcgcgcataaatttacacccaacacaaacaaggatggcaccacaaaaacaaccacctgtccaacaaacagtttgatggcatccgggtctttgaccgggaacccgttgctgtccgtcgatgaacaccgttgttgttgtacttgttgctgttgtgacgttgtggcggcgcgtgccgtgccattctcggccgccccatttctcgtgccattgttgctcataattagtcgtggcccaatttctgtcggcatttgactgctgctacattcgataagaatggcgccgccggcactattattcttgttgtcatgccgttgttgttgtaccatttttctcgttcttcttcattccctcgggggaattgtgtgaaaagtgtgtcttttgtttgacaagtagtcgtcgagactctcgacggacggatgccacaaaaaaatatatcaaaaatattattttgccagccaaacaatgatgaatgtttcgtccctcatgcaaaagttaaaagcatcaaggaaatgtgtccgggagcgggggtatggcgagtgagaaattcttgtgccaatgcttctcggccaatcccgcccacgcggggcactacttgtgccacaaatcgatggcacacactcacacagacagtgccagagtgatggatggcgttgaagcggaatgaatggaaataatgagggtttggccagtgccgcggcgcgggtcggtcgggactgcgagacggtaaccatgtgccgagggacagagggataaagacacacaatgattgagtgacagacagacagacagtcggctggtctggcttcatcattctcgccactctcgacctactctaatcccctcagcagggctcatgcatttgggtagatgaagcctctcccgtgcccttttctctgcccccgttgcgccccagggagagcacagtctatgcttttggcctcatcatcatcatggatggcttcttcttggatggggagagggagcattcgcttttctgcccctcgggggctccgtgcaattgggaggggtagggataaagccttagactttttttttctctcgggtcgatgttggctaaaactccgactcagccgaagttttctttgttggtcaaacctctaacaattttggcaacattcaaaaactcgaaatgtttaaaagaaattttcaaaatgctaatgctaagcaattaaatggctcacagaaaagtcacaatttttggtgtttttttcataatttttgtgaactttttttaatttggcattcttttataattattaattactaagaaaattgcctgtaattagcttttgaatgttcccatgtttgttgggttaagttaacaactttacagttatattgactcaaatggttcatgtcagacgaagttggcccgctccgtctcccccacccccccccccctctcctgtcaaagtgccaaaaattaaattgtgccgaatcagcttcattttgaaaaaggcaaatttgtttgtgccaaaccagtttgggcgatagagataatggaggacgaaaggggtgaaaccggtcggtccattgccgactttcacaagcagtatttttttttgtacatttggtaaataaaatttttgttttttggccattttctccaagtcgccggtctcatttttgaatagcttaaaaaatcctacaacatcaagaactggtgccaccaatgggaaagagtaaaatctggcattctcaagctccctcatcccccgccgtcggctctcctctcggttcatatgccatcgaagaggctctctttaagaagccagcagagcaaatcctcactgccgtcgctatcttcgtacccccaggggttttgtgtgtgcttgatgaaatcgcccctaccccccccccctccctccctcttcagtccgtgcctcgttttgtttttacatgttccaccaccaccaccatggcacccgccccgccgtgcccggctcaagcaagcagaagtggcagctggtggaggtcgcgctaatcgttgtgctccatctcctctcttctcatccgccgaatgtgatgtgtgtgtgtgtgtgtgtgtgtcccatcaatttgcgtgcgccagacgaggcttaaaagctgctactccctgccgtcccccttcccgccccctctcccaattcaaccgtttctccgttttcttcgtcgagtcgtgtgccaattttggcgaggagagaggcgggagacagtggccctaccccgcctggggcgcggacacctaagaaggagagagagagagagagagagagagggagaaaagagaagagaaaaaagaagagaaagagagactgagtgagagagggagaaaagagaagagaaaaaagaagagagagagagagtgtgttgaggaaacgagtgaaaatgctaattgcatggaattgggtggcgaattgtgaaaggattgagaggacaaaatgctgccatcaatggaaatgaacgaatgaatgcttctgccatggatgatggaagagggtgggcagaaacaaggatagaataatggcttaaattggttggtaatttgctgctggtaagggcgattcttggacaatgaagcaaaacaaacaaaaaaacaaaattttgaaattttatacattattttgaattataaaaaaaatccgttctgatttttgtgaggaattcataaatttcggag

SEQ ID NO: 5756 - DNA, 1748 bp, Heterodera glycines
  misc_feature (39)..(39): n is a, c, g, or t
  misc_feature (49)..(49): n is a, c, g, or t
gaaaatgtttgtagaatttttgtgtccatttgatacaantttggattantataaatttgggcataatgttttttatttatttaaaactttttaaaaagctttaccaaagctaaagcttaagcttcattaaaagcaattaactccacattttttccctttaaaagctctgttttaacattcaaaattttttacccattttagcccagtatttcaacaatttattcatttcactttcaatgacaatgaaccgacttttgtccggccgttctctgctccccaaaatcatgcgaaatttttcacacagcaatcgcctcgccgcctccgaggcggacccggaacattacggctatttcccggacccaaccgaacagacgtggggcctggagagggaaatgcttgctgcccgcctgaagggcgaagatgtgggagaaaaatttcgatttttttttgaaagtttttttgaaattttagcgctactcacccaaaatttattaccgcgctgaacattcgaccaaggatgtcccaaatgtggtgcatgtccatttggaggacaaagtcgtcggatgcctttgtgtgtgaaagttacaaatttttgcgctacgttaaaagtgggggattttgaattttattaaaaaacaggggggggggctttttctcggagacttttggggtccctgatcatgaattttacatctattttgatcagtttctaatccctaactcgaaattgaacaaaagttgaaaatccgattcgtgattagtagagctcggcctggacctggatttttcctgggtccaggtccgggtccaggtcatttttcgtcaacctggatttttcctggacctggatttttgtccaggaaatccaggtccaggcttttttcaaaataccgagctctagtgattagggattccaaaaagctccgagaaaaagttttaaattttaggcgaacacgacggagaccatgtgaattattggcacatcagaaaaggcgacacaaagcgatgcgagtgcggacattggtaagcgaagagagtggtgggaaatcaaatgaaattctgaattttggatttgggccctaatttttctcgtaaatttttgcccaaaatttggtccgtcgccaagaaaaattaaaaaattagactgacaaaaaaaatgggctggaagagctaaaaaagctcttaggacaaaatttggggccgctaggcgccgccgtaaaaaatttgttttgaaaattttaggcatttggcaagggttgggcattttgtaatattttctcatattttcatttaaaatgcagcggtttcgctgaacatttaagcatattttaatgaagaaaactattgtttgagtaatttttcgtaaaattttaaaaatttaaactgaaaaaagttttttcggttttatggttctgggttcgtaatttactagaatgaatttcatattcatgataagcgacccctaaaatcctttgaaaattttcatacatttttttttatttccgaaaaatgggtgggggcggtaagggggtgacaaccaaatttccaacttttcacaggttcaaaggcgtgcaagcagacaccgacagtttcgactgaatgcggtggacaccgatttctcgctttgaagaggataggaaattgttttggttgattaaatctttattttttgttttgttttttcgttttcaataaaatgtatattatacaaatgagacattgtctggtcgatagtatgtcaaacggtg

SEQ ID NO: 5757 - DNA, 253 bp, Heterodera glycines
tttttgtttctaaaatcgattaaaacaagcaagaactatctagaaaccatggcaactccagaaaataatcattctacacagattcgaacataaagttcgactttttgttcgaattcgggtacggtgttcaaaataagtcgaaattgatgccggattcatgatcagagaccctggaatggaagcatgttttcatgacttatgaaaacaaaaaaattttcatcaaaaaaggggggcaaccatcggcagtattacc

SEQ ID NO: 5758 - DNA, 808 bp, Heterodera glycines
aaatactttcggcatttgtagaaaattcgagctggtgcgaccaatgcagaaagaagtgttggaattcctgataatttaggggaaaaaacacgctcgctatacgatggcggttcgcgcctccctttccaagtccctttcctccctttccgcgtccggacatttttgcagattggttgtttgactgtagagaattaaatgagcaaaagaagaagagtgaggaatagaatgaatgtgggcgctatttatgctaaaaaaaaatggcggctaaaatgtgcaggcacgcggagactcctttcgtgttgaaaaaaatccatttcaaaaagtgacgccgtcttactttccctctcacacactctctctcgtccatttctctctgctcccacaaggggtttgcattgtctgcctatgggatgggcgttccctccacattgtctacataaaagggctcacagtcgccccattccgcactttcattcgaaagcaagcggatcgattcacccagagcgttctcttcagcaaaaccttcacttttctccatattttgttaacaaaatgccaccaaaaccatccggcaagggagcgaagaaggcagtcaagtcgaccaaggcggtgcgcacgggagacaagaagcggagaaaggcccgcaaggagtcttactcggtaggtttttttctgcattttcagggatttttcaggagggttggaaatttttttcgaaaaaaaaaaccaaaaacggactttggctagcaaatcctctaaaattcaaatgattttaatttgcttattcaaagcaaaatgcaattcttaa

SEQ ID NO: 5759 - DNA, 3868 bp, Heterodera glycines
cgttcgacgtgggacaacaggaagactctccactccgatacattcagggtgacggtttcgaattacgggaatggggaggtcgacccggcgttcttcgtctacaagaacgatttcgggtgagtttttcaaaaaaaaaaatatttgcatcactaataaatcaatatttaggccaacgcgggattcgaaagtggtgacgagggagaagcataaaacgtacaggccggtctcgccagaaggggatcatcgatgaggagcttaacgtgatcgccatttggattttgttaattttgtattttattgttgttttttttttgttaaataaagttgaattaaaattaaagtgatataggactagcgggggtggaacggtctaacgtgaaggcccactccggttagccgtaatattttataaaaaatccagcagttcaaggggaaaatagcatctatgaccgttattctggtacatagttatacatgggagttgagggaattgtagcttgacacggtgtctcgagtagagatgctgttcgacagtaacccctagaaaacctcggtaggcaaaaagcctattagaaccgttaaatgcaatgtcatccggtgagataaactgattgtgcctaaggtgtctcgttataagggcgtgtcttctcaaaaatttcaaattttgtttctttcgctggcgtagaatttcagatagctcgtgaggttcgcattcgttaaaatcgcatagaatttcaatgagagaattcattttgagcaccagtaggcattctcatattcgttgaaaatccttatataccgttacctcaccgccgtatgatgaatttttaccttttctctttatttttaaaattctgagaactgaaatacagatgatgaccactaccaaatcgacaattgacaaaaaatatacccaaatatttgaacttgaaactttaattttctcaaattctttgaacacgacaaaattaaaaaattcactatctgtgtctgacacatatttgggaagtatctcgtttgaggcaaatcgatctttgtatattttcttctctttaattagataaatttgtccctcaattattagtaagtcggtaaatgatgatggcatagacccgatcggtttagtaataatttcggtttcattattgtgggtccataaattctcgattgatctaatgtcaatttcatctattcgatcgtcactgattacaaaaagtcgaccatcaatgtgatcaaatctaaggtccccaccgggaaaattcctaacaaccttttcttgactccctcttgttatcgaagtttcatttgtattttcgttttggaaaattaaataactatgatcgttgtaataaaaacacgctcggggctttaattgtcgaaaatcctggtaaagcttaacattagttggtccgctcttttctattgaattaatttcttggattgatacactccatcctgaaattgggttcctatttatagtacatagtctcgagcgatcgaatccgaactgtctttcattgaccgaaactctttgtcatagtgagatacttgtcgtcaaaaagttgtgcatcagaaagaatagtaaccctttctccactgagttgaccgactatcgttaggagaacaattaaattaaacattactgacaaattgcttaactaataaatcggccctcgggcgaaccttatatagaccgtcaatgacctcacaataagtgattccatagcatcgttgtgtcaagaaataaatgcaaaattgcccacatgcatctgagaattgatgttggacgatgcggtcgttaatgagaattcgtttgaataggttaagatatgaacttaaatcttcgttgggataatcgcccaatgaatcaaaatattctatttctgtcggcgaatttacaaaacaggcgacccagtgttcacctatcgtgcccacccggtcggtattcgccacaaaacagtacggaaaatgcctgtccttcaattttggcatcttgtcggaagcaaaaaccccgataaaatattttcgggttgtcggatgtttggatagaaatatttcaatctcatgagaattcatcatatgcttccgtcgctactgagcacacgattagcattaatagatagaatcgaatcaaattcccccagaactatcatctcatacccgccgtcctttataggctcattaaactgcaccttgatgctggtcgttccgtttcgaattaattcaaaaccgggggtgtcctctagagtagaggtcatcgggatgacgaagaaacaccacccgtttacaaatttttgtatattgatcgacattgttctttcaccgtcgtccatcccgagtcctgtatacatgtcaacaaatgctcgaatgtatttgtttctatcaaaattaagagaatagggtgacccggggaatatgtttccattcgcttcgacaccgatagagcgtatttttgcatgttcaaagacgaagggtgactctttaggatttccggtatacgcaccggttgaaacaaacccgacgattaaacgtctcggaacaatgctggtaaaaacattgtgtgagagatcagaagtgcctcgtgggatgaaaagactcctgatctcaatttttctcataggatatttggccgaggtggtttgtagctgattgcttattacgttatttaatgactgggtaatgtcgactgtttttacataaattctaatatcatgtatgttaatacgatatgtgtgcgggttcgctatgactgcatttcctgaaacatatggcggtgccataattagaaaatcatcggtgttacggtgtatgctaaaaatgacatccgagttattaagcaatagattgggctgacggccgagatcaaaattaagtttcaccattgtttcacattttgcaccatcagcaaaacgtgacgctctgtttttaaagccactgtttgtataatcatcctggtcgacatcgtcgacataatagcaggacgcttcacagagaccctttttgacatcttctgaaaatcccaattcattcatcatatatgccctaaacgcatagtaaatgccggaatcataagattcgacacctgaaattgacacctttaaggttttgacaaagctgtgcccaaaattttgaatgacaccgacgtgttggtcagcttcactgtccttggtaatcggaatccaattgcttttgtcttttctctcaattgaagttgacaaataaagaaaagttttattgagatcacaaaactgattatctgaaaaaagtctaaagatatacggtccagattgatttattgctgaaagagggagtaattcccgaatactggatttattaattgcaacgttcgtcggagggatgtcgaaaagtgaaaggcccccctcgagaccgtcctcactcgccgtgtcgattttcttgagagttgtcatttttaactttttgtattatttgttctatttatacctttagatgaaacttaactgatcaaatacccgttttcggttcttattagtgatcagggccttttttcctttaccacattgttgtaacttgtcggtaaggttagtcagcccctgtcttgaatgttccctgacggcatcccttaaatcacggccctgagcgatgtcactcagaactctctgccccgcggcgagcccctcatgtcctgcactcgaggcaatattcctcgcaataggggtcaagaaacgtgccacattaccgaggaaaccgaatccccgctggtacttgctcccgacaaaatattgtttctgtcctcttccatgttggggagtaaaaaaagatgaccaatcgaccgactcgggatcgaaaatacgtgtgtcatttttaaatatacttttcttaaatgtaa

SEQ ID NO: 5760 - DNA, 3618 bp, Heterodera glycines
attctttcgccgttcagcttagggggtggtggaatgaattgcccgtaaaatttgaagtcaatcggactagtggtgcgcgtgttttggtgcgcaagtctcgggggtgcgcgagggggcggggcgtcgggaaaacttcgctcaaaatggtgcctgaggcgaaattctttcgccgttcagcttaggggtgttggattgacgacctaatgtgccgtctgaacttctccaacgattcaaacgcccccccctgttctcacttcactgtgcacagcgacgcggtcccctcccatccgttagattcttatcttttgttcatctgcaactgtccgttctccaccaacccatcattttcatttccatttctccattttgtattgatttgttgtccgtttaatttatttgtcctgtccaatatttttatatttgttcattatttttgcttattataactcgctaacaaattaattaattaacaaagaaaagcaaacaaaaataaagaaaagaaaatcaatgaaagaaaagccatgaaaaataaaaagaaatttaaacgctaggaaaagataagcaggtgaaaaaagataggcaacgaaaagaaatgaaaaagatattttaagctaattaaagaaaagcagcgaaaaaagataagcaacgaaaagccaagcaaggaacgaaaagccatgaaaaaaacttttaagccaagaaaagaaaaaccaacgagagtattaaaaaaaagaaacgaaaagccaagcaatgaaaacgaaaagccatgaataataaaaaaaatttataagttaagaaaagaaaggccatgaaaaataaaaataattttaaaatcatgaaatgaaatgtcggcgaagattaaaaagaataggaaacgaaaagccatgaaaaagaaatttaaaagttaagaaaagaaaaactagcgagagtattaaaaaaataaacgaaaagccaagcaatgaaaaaagatttaaaagttaataaatgaaaagcatcgaactattaaaaagaaaataaaacgaaaagccaagcaatgaaaacgaaaagccatgaacaataaaaaaaaatttaaaagttaagaaaagaaaagtcatgaaaaataaaaataattttaaagtcaagaaatgaaatgtaggcgaatattaaaaagaataggaaacgaaaagccatgaaaaagaaatttaaaagttaagaaaagaaaaacagcacagttttaaaaagaaaacaaattaaacgaaaagccataaaaaagtaaaaataattttaaagctaacaaaagaaaaaaactgcagtattaaaaagaaaataaatgaaaagccttacaaaagaaaaagaaatttaaaagttaagaaatgaaacggaaaagccaagcaaagaaacgaaaagcaaacttttattccatacataattattaatatattgctttttttttacagcgaaaaaatttaaattgtactctattgttatggctgaacaacaacaacaaaatcttttggggtcaatgccaccttttggccaagtaataattaaataaaaataaataaatataataaataacttaaattgtttaaaggttgctcaattggtggaaccaatgctcgtaaacgcggcccaacagtattttgcggtgctttcttcttatttaacattattaaaatttaaaaattgccatttcagcagcctttctgtacggatggcacgcacaacattcaatttttgaatggatgtgtttcccagttgggtcagccattgccgtatgtttaatattaccaatcaatcgatattaaattgtgttgagttttttagcccgctgtgcctgatcgtcgtttcgattgagcaccgcgcttcacagcagacgccagctgggcctcttcccatgacgaactgtgtgctgcgcacgggtgacggccaccgcgttgaggccgcgggatggcaggcgcacgcgggtgccctggcggacttgtgtgttggcagcgcctactggttcaccaactgtgtggcccgtgccaggtaccagcgactcgactgctggtaccgcgttagcgtaggcggccccaacgcactggtgatgccgcacgtgtccacagcggtaagttttttttattatttttttattattataataataaaatcttttagccaatgttgagtgcgcatccgatgccgcctgttcagacgggggcgggggtattggaggtaatgggcgaataaaatattgataataaataaataaaaatgcatttcaggtcactgttcctgtgcagcttggaccaccaaggtcacgcgacaccgatgctggcgacatcgacatcaatgtaagaaaaaactttattaaactaaataattctttatttaaatataattcatgattttaggccaatgaagtcgttgagcggggccagacctcacgtgagcgactgcctcagcgacgtgccgcgcaacgggttggtttgcgggtccgattcaatttgtccccagaagtagaagagatcccgagaggggaaagacaaaaaccctatcccgcccgtaaaattaggttgcttcccaattttgacatttcacccattcacattgaaaaatcccttgactgcccaatttgcatgtgcccttttgtgattggggatggggccacttctcttcattgctttcatatttttcacacgggttgtattgttccttggcttaggatccaccgaatttgtccaacttgtaaatatttattgccatgaataaatttttgacttaattaaaggcagggagaccgattgaagaatgctttgtgattgagcggacaacggcaatgcgcaacgcgccacgtaacacccgaggcgaaatttgtgagctgcgctttctgccgctggaggatgctgagcggcctgaccttttgatggaggcgctaatccaacatctgctggatcgagtgctagagggtcagccgcgcccgtccctgattggcctgcaagtccacccgccgggctttgatcgcccttatgtcatccgtcttcgaccacctgagcagaacaacgctgcgacactggcggcagcgattgagcgactaaacgaacagtcggcagcgggcattgatttgttggcgggaaggacgatcaccaaagtgctggctgtgtggccccttgaagcaattcgcgcggacccacagagcggaggtgagctgtccgtttattaaatgatgaattgttatgacgaaaacgcaggcgcatgcgaccatgccgcggaacaccacgtctcgcataaagtgcagtcgctgatccgcgtcatcaaccctgacgacaggctttgcctggcgcgtgccgtgcttctgggtctgagagaccgagagacgagaatggccggtggcggtggccgtgcagcactttctgcgtacgcgattcgtcaagaccaacacggcgcggatgctgctgatctactgaccaatgccggcgtcgccctcaacaaacacacgtacacgcttgatgacgtacgacaacttcaacaatggctaaacaatcagcatggagtggggcaaattcggctcgtggtgttcgagaaagagcaggagtaccggatagtgttcaaaggcgatgggtatgttaattatttttagtggattagtcaatgatatat

SEQ ID NO: 5761 - DNA, 980 bp, Heterodera glycines
  misc_feature (947)..(947): n is a, c, g, or t
aatagtaaaaaccggtaattgccattaaggatggtttaatatattttcccgagactcttgagcattttttttaaaacacaaacacctccttccattagagcaaatctcgaagcttttgtgactgattttccaataccggcaaccattaaaaatagcggtttcaatttctggaccaaaatccaggaaaatccagatccaggaaaaatccagggtgccgaaaaatagcctggatcttgacctagatcaaggaaaaattcaggcctggatccaggtcgaggccgacctctaattaccaaggcattttgtaattaattaattttcccattttcagagtcaaattatggtcgttttccgcgaggacaaaacgtttgaggacgagctgaggacgtggatgttgtggcacaaacggcaacattcgcacaagcagcgaatcatcgaagtgagaacatttgggggaatttggaggggaaagtcagaaattacgaattaaaattgaagaaaaaaaaacaaaataaaatttaatttaataaaaaaacataaataaatcgagacaattaaactaatattaaaaatatttaaaatttattttcaattttttatggcaaaaatgctttttaaatgtaaaataaataaggaaaaattaaaaaaataataatgaaaaatcgaaattgataattaaaatattgtggattatggactcgaatatttaaatgtaaatctctaataatacaagataaaataaatgctttgtgaaattaaaattattaaactcaatattaaaatattttaaatttattttctattttttatgtcatattttttctttaaagattcgatttaaatgtaaaataaaataaagattcataaatttaaaagatcaaattttagaaacaaatgtttaaatttaaattccctaatattcgagtggttaaattaattatttttanaattaaatttaataattaaataattaatttggc

SEQ ID NO: 5762 - DNA, 1522 bp, Heterodera glycines
  misc_feature (90)..(91): n is a, c, g, or t
  misc_feature (102)..(102): n is a, c, g, or t
cagttttctgttccatttttaaaacatttccaaaaaatgtttctccataaatggtaaaaaaaaaatctatgttattttattcatgtatcnncattggattcnaatgaaaatttgttggaattttttgaaaaattttccctaaaatttggtccttcaaaatcaagcaaaaaatgcttaacatttgatcgatcacagggcgcggaacggaaattgcgcgacgaagacaaacgggcggataagcgacgcaaaagcaacaacagcagttcagcagcaggtcaaaaaaaagagaaaaaagaatatttgagggcattttgccaaaaaaaaatgccaaaataattttgggtgccgaaaaattggttaaaaaaatgaaaattgttgttgtttgaaaaatgagtttggcataactttttgaaatgtttgagatgatgggaagaaacaaatttaatgagaaattattttaaatatattttaaatttagaaaaattaaaaatattttttctaatgaacattaaaatgagatattattaattatctgcgaaaggttatgcaaaactcaattaacaactaattaataagccaaattaaaaaggagtgaaaggggcctaatcaaatttaataaattaatttttgtaattttcgaaaaaataatttaaattttacgtaaaatccctaaaaattcgttttcaaaaatctgctgcttgcttttgctttttgcttcgctttttgtgccttccatcgcttgtcattttgtccatataatttgtccatttgtccatttctgcactttcttttttcatcgcttttttcgtttcattttgttttttttcatttttttatttataataatttaatttaattttaaaaatttaataaaattgctgtggccatttaaaaaacaaaattactgtagtcaaattggccaaaaacaaaggcatccttcccgtcccttttgttctcgacgccatttcccattgaatcgcgcgagagtctggcaaattcaaagtgtcccattttacgctacagtaatcattgatgcgattacagtaattttattatttattattttttcattattctttatcaaaaagtgttcgtatttgcgttttttatgtgccttgccttatttgcagcttttttcgccttttatagggtgccaatcgaaaaatgttgcacgaaaatcggcgggacgaacggcgccgtggcggcggcggtgagcaaccaatgaatttgattgatcatagtgatgttcgggatattttcatctcgaattgagatcggacaactggtacggatggatcctgatgaaatcccgatgaatttaaaaaattctcgggacggatcccgtatcagtcccgatgaatattaaaaaactcgagacggatttcgagttcgagatcccgaatctaatcccgcgtgatccaataaaattcaacggagtccaaatcccttcctatccctagtcttgaacatcactaattaattcatgcttatatgctttaaagcggcgctttatgtgtgctaa

SEQ ID NO: 5763 - DNA, 1750 bp, Heterodera glycines
tagacaaaatccttttctaactctacataattattcaaattctatattttttgattgatcagatcaaatctcaaatctataaccataaactgatcgtgatcaggccaccataaaaggacattttgatcattctctaaatattttgctgatcgatcagcgagagggtaggtggcccatgctctgatcacccaacttaactgaatcggagtgatccatacactgatcaccaactgatcagtggagcttccataagaggggagggaattccgatcaccccgactgactgactgtgatccgagcgatcactgtgccgaatgcattatccactttactctcctctgtacagcttgccctgatcaacagcactcatcaaccgacaattcagggggctccggcgccgggggcgcgaacggtggcgccggaggcggcggcggccgtaaaaagatggacggcgacttccacgagccggccgatcgctcccacttttaccacagtgcggacatggaacggccggcaccgctgttcgtgccgggcgacgatttcttcgacaccgcctccatcggctcgtacgatgcgctgtccgagctggagccgcagccgaagcggccaaggccatcggagcggagtcagttcatttaattgggggggggggggggctaattaggggagaaagagcagcaactcgcccccggggtcaatggcaacacatacaaatggcaacttgtattttacaaaacaaagcttaagcctaggcataacctaagcaattgtacgagttgccttttgtacaagttatcatgacacctctcgccccccccgtgccgtccctcccccgtcgcgaatttttttaaattgatttttgtctaaatttcttagagatgtttttctaatcgtatcgtatttttttaaaacaggtttctttcaatttaaataaaactaaaaaaatagcttttcaaaaaaaaatcatgcttttttgaaatttttactaaaaacctttttgaaattataaaattcaagaatttcaatttttatctttcgattcgagcgggtacagaccgggaatttcttctcaaaatagtaattttaaaattgggtctgctgatcacatcattcattgatcatccacatttcatcaattgatcaatgccttctcttccgtttagtaatgatttacgtccgaaagcagggcgaagagattttcacgccgcttcatttggtgccgccatcgcttgggtaaaatatttaaaaattaaaaaaaattgtttaaatttcaatgacattttttagagggttggcacgcgcagtcagcgaaaaatacaatttggacgagtcaaaaattgaggccttctacaaacagtgccaaaaaggattgaccgtcaaaattgatggtgggaaaatgactcattaaagcaattaattattaaattatattttgcaaatttaaatttttatcagaaaatttaaattattttttaatttaaattgattaattttaatcaaaaataaaaaacaaacttatgtattattttcagatgatatgctgcgccactacaccaaccaggacacttttcaaatcgagctgaagcagtccgagttggacaggtccgttgacaatgagactgggcctcgataactcaaatgatcacagtctgatcagtcagagccctcttttttctaaacctattgctttgatcagttaatttattccggagattaaagcatttaaaacaagcatatttacgccaactga

SEQ ID NO: 5764 - DNA, 3059 bp, Heterodera glycines
gcctcctcgtcctgctcgaactcgtcagtggcctcagctgctgaacatcagcaacagcagcaacttttgttgaacatcagcactaacagcaccagcggcggaggcgcggcgacgccgacaaataccgccgccaccgccggcagcggtggtcgctgcggcggcggcggtggcacaacagaacggcacaacgacacaacagcagcaacaacaacaactgcagaatcagaggacaccggtctggtgatggtgaacagcaacacagaggaggaggggacagtggaacagcagaggtgggaaaaatgccagtttgactgaaaaattggcatttgccgtttattttcggggccagtgccagatttagagacattaatttcggattttttattctaaagacagggaggatgccatatttttcttgcaaaagtggacattcgcgggatagtccatgccggatttctgggaacaagttgccgagtttttttttttgtttttggtttttggtttttgttttctcgacacgagactgattctttcggcattgagtccctccctcccatccatcgctgataaatggccctaacttttgattgtgccatttcggctatctttctgtctcctacttcaattggccccggtttatcccgccgggtcaatgccaaaacgtttaaaatttattttatttttttaatttggaaaactggcctagtctgacctaagtcttcaaaacccaatcttttttttttgttgtattgccatggcacagccccgccccgggctaataaatgccaccgaattggactgaatcattatttagcactaatttgtcaacgtgtcgcgggtttcgttctcattttcatcaaattccctggtgccctttcccaaccatttctttctttttttgtttgctcaccttcccctaattatttatttaatcgacattcgaatattccattacatcccattaataatttcagcagtcaaattgcattgggcgtcaaatgatcaaacgcacacaccgccgcccgccgccgcttttgccccgcgggggcggacgatgacgcaaagcgagcggcgagataaaaggggcaaacgcggcagagaaagaaagaacggaggaattaatcgcgataataagccccccccccgcccgttaaatcgttccggaatttaattattgtttataataggacgacccttcctccgcacctctctttctcccggtgttcgacattctcgacagcatttcagcgtcgagagttgatggaaatcccatcaagactcgcgagagaaattgagtccaattaaggggagatgtcaaaaatggggccgcaaatattggccaataaatcgaatcgagacctactggaatggttagcgaaaaagatgatgatccacatgtgatcgtcgagactctcgaacagaattaaattctaattaactccccaccttgcgaattcgtttttttttgtgtgtcggcgttgtgcaccctccgattaaaaaatgcgagaaatttctcgagtcaagtctcgagaccgggactggaaactcgagaattccaataaacaaagtcgagactgactctcgcccgctctctctgtccccctttgtccgtgccgtcgtttttatttgttgtttctgccttcctccactcatcagtcattcaaattccgtcccatttcattctttcaaatgcttctcctccctgtctttgaataatgaattaattaatttgcctaatgattcatccctaatttggctagttttccttgctattttattatatgacagtgtttctgctgttcagtttagtcattccccctttttctttctctcatttttcgttgtattattttgtcccctcaaaaaaaaattgtgcaacaaaaaattcattgaaaaaatttatttggaagtaaaaaataggaaaaatttccgatttttacaccccaaaaaaatttcacgcaaattctatttgatttgatatgttcagacagaattttgcccaatcaatttttggttgaattttcaattttaattttaacaaatacaaattaatttcaaaattttctccccaaatttttggttgggcaaaaaaataaaaaattgaaataaaaattaaacaaattattacaatttaaaaaattcccaataacatttcttctgtgataagtcggcaatcattatcattcattcgtttcatttgtcatttttttattctctcaaaaatatattttatattttattattcttttttttgcatttaacctccgaaatttctgtcattttcatgtaaataaaataaaataaaatttattttttcaatttttatttaaatgtgagaacggattaaacaaaatcactttgcatttgttggatttgccacttaataattattcaaatttaatatcgtaataattttcgtgaaaaattttgctttttcttttaaatttttctgcttttctaagtcttcaatgtctttcccatctttgaaatttaattgaaatttcggcacttttttactcttagatcccacgaagtttatatgagctttagggatcactgaccatgaatccggcactaattttgaccaatccctaatccaaactagaaaaaagtcaaaaaattaaattttatgaatttggttcgagggcacacaaaaatatttttcgttggggcctaaagtaaaaagtgccaaattttctctattttttttaagttccgataattttttaaagccatggaaaatgaaaggaatggaaatggcggtgccgttttggtcaccggcgcggccggcttcatcggctcccacaccattttggagctgttggatgccggatttgacgtggtggcggtggacaatttttccaactcaattcccggtgatttaaatataaaaattaattaaaataattgaagttaaaattaatttttaattattttcagatgccaaaaacaatgcgctaagtttgcaaagggtcagtgagctgagcggtggcaaaagcataaggcaagtgaatggcaatttgcttatttaatttcaatttctgctaatttatttacca

SEQ ID NO: 5765 - DNA, 2236 bp, Heterodera glycines
atccattttcagaggaatccgtggccaaaccaattgattactacacaaataacattgttggctcgctgaacctgatcaaggtacagtactaccatatattaactgtcattattttgttggttactgtattcttttacgccgtttcgttttttgtcccatttcttttttagaacagaaaacggtgagaaaatttcaaattttgcatttaaaattatttttaatcttttgatttatatttgttttttctcgatttcccaattctacttgtaggtttcggaaataaaatttaaaatttttaaatttgtttaaattaatttattaatatatttatttaattaataattatatttaaaaataaaattttaacaatttttggtagaaattcagaaataattttaaatatttattaaaattaaaataaaagtcactttaaggatgtctagattttattagtaaaaatttagttttttttataattattctttttttgttttaatcgccaaaaacactgtctaaaattctcttttcccccccccctattttcagtgctgcaaaaagttcggcgtcaagcagttcatcttctccagcagtgccaccgtttacggccaacccgagcatttgccgttgacggagacgggccgagtgggcgtcggcatcaccaacccatacggacagtccaagcacatggtggagcaaattctgatggacttgaagcgggcggaacaggtcaatttttggggaatgatcagagagttcatttgtgcgactgaccaatcattttgtttgactcgttcattatggtgaaacgtgggactgatcaatgcttcttatggacctaatagacgcatttgttgttgatcaatttgtggtttgatcagtgcttttttgtgtcttatcggttcatcatttgtgcgttgatcagtgcattttactgaatctgatcaaactgtggttctaatcaatgcatttattggcctgatctctgatcagtgaattttatctctgaccaatggaattgtggcctaatctgtgtatttcttctgtctgatcagcactttttgatggtctaatctaagtgtctaatcaatgcatttgttgatcggatcaaaggatttgtggattgatcaattctttttgtgtcataataattcatttgtttgtggatttgatcattttgatcacttcattgactttcaacaggactggcaaatctccattctgcgctatttcaaccccgtgggcgcccatccgagcggacgcattggcgaagacccgcagggcatcccgaataatttggtgggggcgggacaaaaaataattgcggataaaaattggaaaaccattttgtcacagatgccatacattgccaatgtggccatcggcaaactgccccacctgaacatttatggcaccaaatacgacacgccggacggcaccggagtgcgggactacattcacattgtggacctggccaaagtgccgtggggggtgttggaaattggcacgatttgttggcacactttttgggggaaataatgcatggataaagggtggggggagcggagcaggtccttcccctgaaaaattaaaaaacctaactgaaatttttcaaaaaagcatagaaattttaaagaaaatttcaagcaaaaaaatcagcgtttttaaagtttcatgatgaatttatttataaatttttttaaaaaatcgttgaaaaatttttaaaaacactttctccaaattttctcgtaaaaatttttcatgatttttttgaaaattttcaagcaaaattgcgttttttttgggggggggggaaatttggacagcagatcagatctctgggcggattttcccgatcagaaatccgctggatttaattgggtaaataagtttttcaggcccacgtggcggcgcttgtccaccttggcaagcacacaccctcagcagcggatggcaaggagttgtgcgaggtgtacaacttgggcaccggcaaaggccattccgtgcgcgaaatggtcgccggctttgagagggcggccggcaaaacggtgggagagaaaactcgtggaaatttatttcaacggaacaatataataaatgaacgtcgtaattaagacaatccttaattgaccccagcccttagggggaatacggtatgtttgaaggagtttcggtaatacgaccgatggtaccacaccttttttgaatttttttttacaaaatttatgaagtcgtaaca

SEQ ID NO: 5766 - DNA, 6471 bp, Heterodera glycines
  misc_feature (19)..(19): n is a, c, g, or t
  misc_feature (46)..(46): n is a, c, g, or t
cccaatgaaacttttctcncaaaacaaagacgcggaaaaaatttcnaaaaatatgccaccttctgaaaatgaaaaagaaaccagccaaaagaaaattaattctgttttgacaaaatgcatcttttcagaaaatgtcgccccggcgaaattggcactcagcgcacactgctcaggcattgagcaacattcaaattgttcttgcattttgctggaagaagtgtttccgaacttgccggccatggaccctcttcgacgcgtccaattgtcatcacttggagaattaatcccaatttcaatcgccaaacagaaagggattttgctgggccatattcgcagttgggccaatttggatgaagaatcagcttcactcctttgccacattccaaatttcagtcccgacattcaaaatttcattcctccaattttaatgtgggtggaccgttgtgccgtcgcatttcaaaccctcaaaaatacgggaatgaaagttgtacagcaagagatttgctcaaaaaatccgctccaccggttcggggagttgatcagcgaagcattcgaagaagtgaaggcaaaaaatataatcggcttttcatcaatggaatccgaaaaattccttttttacggcgactcatcggttcgagagtttgctagtaaaatggaaacaaaaaccatcatttttaaaaacacactggaaatggccgaagcattcaaaaatacttattttacgactaaagtccaagaaattctgatcctgatcggaaatgacgatttggaccaaggccttgtgttaaatgatgtcgaagaggccattcgcaaaataattgttcatgcaaataaattctcaatcaaaactattttcattccacctccttttcactattcaaaaagaattttgcatggaaaattgataaatttgttggccaaaatgttgccaaacgatggaaaaattgtgttggcaatgaaaagaggcaaacggagtttggcagaggtaacccggttcgggaacctcgaaaatcgccgaacagtgaatgaaaatggcaagttgaaaccgcctggcattcattttacaatcagttttttaactgatgtgttttggatgaccacgccggtgaaaatgtcgtcagaatcagggagttcaggaattcgaaccccagccacttccaattcgcgtgctccgagtttgctcaatgtgcaaattccaccgccaatcattcctcatccccgtcaagagcaaaatgcttacaggcgtttcaatcgtggtcgaggaagcggccaaaatttccaaaatcggggggcttaccgcaattaccattggcaaaatcatggggattatccccctccccctaaacgtggaaggttctgaacggatcgtcattaccttaattgtgccggataaattttatttttgattgtatttccctgcctcagacctacttataaatgacctcattattgtttcattttgttgtttatttatttgttttttttctcatttaataaattttcatcgcttaaaacattcgtccaaaaagagtagtccctcctatccaccccttcccctttatttcatttcagctctcgcctcttcgcttcatcaaatccgctgtttgagcgccgacgtcaaaactcgcaggcgctcgtctttcgctgatccgggggaggtgcgcggcgatcagaccgtgaggacactggtcttcatacggcgggggacgtaggataaataatgatttatccttattttattgttttttgcaacgattgtttttcgcgttaatttaaaatattttgatccttcatttaattttcctttttatttttgtcttcgtgttctctcaagtttatatatattttgtgcttttgaattatttaataaaactacaaaaatttggtgcttttccccgtggactttcattcagcaacaacaaacgcccaaaggcttaattggtactgttgtctgagttcctaattgcaatttcccttattctctaattccttgtcagtaaagtggtgttgaaaattaagtaaatctttccttgaccccagaatctcaacccaaaccccagcaaatcccaaagtccctccccgaaaatacgccgtctttctccaacggagagagaacattggcaacggacgccgtcccctccccccccccccccccccgcgcttcgctaatccccctcccccagcaacaaaaatgcaaaagaaaaagttttgtaaaaaatacaaaaataaaaatagccctaaacccttgggtttaatttttagcgttcaaataaaagcggggaaaaatttccccgcttttaaaagaaaattttcgaaaaatacagtaacccaaaaaaaatgcgggaaaatttcgcgcactgtccccaggcctcggacagcccccggttcactgctaaaacacgtgttttcacacccccctaaaggtgtgaaaacatgtgttttcacaccggtcagtggatgggtaccgtgtgataactactcataagagaagaactcgaactttttgtttcatatatggaaaaacaatggctaactaaaaacgaacccgcgaatatctggaattttaatagactttcacggaccaggtcaacaaaccctgccgaggcatggcattctttgatcaaaaagttagtattatttcatatttgtataaaaataccctttagggaaccaacgagtatgcgacatgcatcagttacaaattttttgtatttttttcaaagtattatgtcagaaactgatgacagaattaataaaatcaatatgggaaaaatacgagcgcgggggagagatcaattttacgctaaattagatgaccaaattacagaaaccatagatgaatacgaagtaaaattattttataaattgaataatattttcctgattaagggaattctcgaaacaaaatttcatacggacgaggattttaaacaagtttcaaatcattatttaagtaaaatttcatatttgctccttgaaatgaattcaaaaggaacagcaacaaaaaaggaggaaaaaataagggaggtagagcaaaagtactgttatgaatatttttttaaattaagagaaaacgtaaatttgcgagttctgcgtgtagttctaatgaagaagcttcggactagcttgtagtaattgaaagttggataaccaaaatacctaacaaatctgaatcactggaaataatatcgaatttgcctgaacaagtgccagagtcaaaacttttattttttaacccaattgcagtggaagaccaacaagaaatttgcagacaatgggagcttcgttttggtataatttaacttattatttatttaattcctaatgttatagtccgtccttcttattcctttggaattcaaagggaattttttgatttggagactggtccaggtgtttttaaggttatttcttaaacaaattaattttaaggacgtatgataaatgttgaagctgatggaaattgtttttataattcattatcagttttacttaccgggactgagttaaaagaaaatgctaggatcatacgacgaattattacacagttcattgactctgaggttgagcttcatgaccttggaattccttggcatggatggtgggaaatgttacatcccggtcaaactatttgattcaaatgggaatgaggtagtctattttttaaaccgatacattattcattttatagataattagtatacgtacctatgcacaaaatcatatggaaccggcgaattctgcggcggaaatacataaatgggggagtaatgttgattttctcgcagcagccaaactgttcaatataaatgtaattgtctgtagcccaaaccctcagagaaaaaaagactctgggattcaatatgtttggtctgtgtacacacccgatatgctagatacggtattatccattaaattaagttcataacttttgagccaatttagatgctaactgaccaagcaagagaatataaatcaatctttatttacttcgaagggggacattttcaagcgatcatagacccaaatagattgaattaagtgctttattatatttattagtgatttactttaattaaattaattataaatagttttatttatttaatttgctgaataatatttttaaaaaaattaattataaatagttttattaatttaatttgctgaataatatttttaaataaattaattatcagatttttatttatttagtttagttgataatatttttaaattaattaattaattaaaataagcctttttacttttaattatgcgttaaattcttcatttgctttgcttgtttgcagtggcttgtgtgtatacggttaagggtcgaaacacatattaattttttaaatttaacaaacagagacaccgtactgatgaggcccggtctcttttgttagatatttgcggttttcgcgaaatagccatttttgcgggtttcgcgcaacgccctttttgtgacgtaatcatttttgcgggtttcgcgcaacgacgcggcaccataacaattacaactccatttttgcaacaatcagtgaatagtcaattatcggggaaagaaatcaatataacattaaatggaaaaatatttttttttgctactcaccaatctttttttaatgaaattcatattgtacaaaacaattaataattaataaataaatgaaaaagatttcttcagattatttgatataaaataattaataatgataaactacctaatttaattttttaactttttatgatttatttcattttactattttaggtgaaaaaatctccgattagctcaccttaaatgcttgcttatatatttttagccattttttgtgcgaattttatacaaatttttggggtggaagaaaacgacggagatttatttgatgaattatggcaattagcaaaattggaaaaattaaattcagaaaaaaatcatcgccaaaaattgggggaaaacaaaataaaaattgaacaaaatgatgatgacaaaaatgtggcggaatgttcacagaaatgttttaaagaggaaataaaaaagaaaaaaatatttgacagtgaaaaagagaagaaaaaatttatggatggaattccaaaaaattggcaaaaaacgacgattaaaaaagaagaaccaattaaaatggagaagaaggaagaggaattcgatgaaagcgaaaacagacgcaaaatgatgatgataattagtgaatttgataacagaagaaaagagcaaagattgaaaaagggatataaacgtgaaaatcggcaccaaattgagcacaaaattgccaaggaattgggcacatatcgcaacaaaatttacaaatggaaaaaggaaattggaggcaacaaacaggaaagaaaagtggaaaaggaagaagagaaaattgggataattgaacaatttgaaagaatgagaaaagaatgtaaagaaagaaaagaatataaaatggaagagcgtacaaaaattgaggtaaaaattgccaacgaattgggcacaaatcggcacaaaatttttgcgtggaaaaaacaaataaatgccaacaaaaagaaacgaattgaggaaacggaggaagagaaaataagcaaaattagccaatttgatcaaatgaaaaaggaaaaacacagaaaaacaagtgattataaagagagaaacaaaattgaagatgaaattgccacggcattggacacaaatcggagcagaatttacaagtggaagaagcaaattggtggcaacaaaaagaaacgaattgaggaggaaaaggaagaagagaaaatgggaatttgcaagtggaagaaggaattgtgtaagtttgaaaatgaataaaacctatacatatttggaaattttggcttaatttattagtagggctgggaatttaagtcattaaaaatagccaaaaagtcacaaaaaagtcataaaaaaggcagcaaaaaaaatcatgaaaaaatgaaaaaagtcatgaaaaaatagccaaaaagtcacaaaaaagcacgtaaaaaatgcaaaaagtcctgaataattaggcgaaagttaaaaaaatcccattttgaatagtttatagaataatattttgatcgtatttttaggcacttaattttataaataggtacccaaaataggcataaaaaagagattcttccatcaattaagaaaaaattcatcctggtttaattgcctttttatcgatcgaaattttatttttcggaattttctttttatttttcggcattttcttcgctaaaattcaaatttttgcctcaaaaagtcaaaaaaatcacgaaaaaaatcaaaaaagtcataaaaatcccaaaaagtgtaaaaaagttttaaaaaagtcacaaaaaatggatgttagaggcttcagacaaagtttagaaccctttttaagtcattttaaggccatttagagtcagcaaaaaaaaaagtcatttgacttaaattcccagccctatttatta

SEQ ID NO: 5767 - DNA, 1350 bp, Heterodera glycines
tttatcatttcagaattttacgctgggcaatttgaaaaactgtaacatcacagaacagttggacaagtcaaagataaaggaattcaacattggcattcacgtcatggacaatgccggcaaatacaatgtgacatttgacacgggtggcaaagtgacagagtgccattacgaaaatccggaaatgccaccatggacagtgcaatacatcgcggtaggaaattctgaatcaattatgcccctaattaatggccaataggcatgactcttctgcgctaattagcgtcacaaattaattaattatgaagccctaaaattataagcattaccatattaattaaaccaacattaatgttatgaaaatgaaatttgtcgttaattaacgagaattagtaagatttcctttttttaattgtatttagttatatgctttttaataatgattaatgcatgttaatcaaaatttttcacagtaaaattgtttttttcaatatctcaatataaattacataattttttttatgtcttttaatgttcaatcgcatttttttataattttcttaaattttaggttatacttaaaaatgaccctcagcagttaattaagccggaaatcagttgtattccgcaaaatcgttgcatgaaaatgaaagaagttgatgacctattagagaaacaaacaaatgggatgaaaaagaagctttagccattggcataatgccaagaatttttattcaaattgaattttcattaattcactaattaattcataaaattttttaatgaaaatgtgtaatataaagtacaaagcctattgtaatacagtatgaaattcctatgaataaggctaacctaaaaaacattaaagaatgtttagcttaataaaaatattattttaattttttattaaaatttggcacagtgtcaaaagccaactttggcctagcctatgcctaaagaataggacacaaaaaaaattagttttccttagctgacttttaataaaaaaagtacaatttcaattcgataaaaacttttgaaaacgcgtaaaaaatgaatgcattttaagcaattttaaaacaaaaggagtaaaaactgctgagtttgttctcacccaatgcaattaattgccgacaatttatttagtatgaaataacaacatcgtttagcaaaaaaaaaagataaaattaaaggttttaacaaaaaatgactatgcgaatgagaatactaaaatatataccagaaaatgtttattaactacataatgaatatttgttttgtaatcaaaaatcagtataaaatataatgaaaagataaatatttaaattgtcgttaaatcttataaatttaaaa

SEQ ID NO: 5768 - DNA, 1911 bp, Heterodera glycines
ttcggcgcggccagttcgacgcggccacttcgggcgcccctatataaaatgactttttcggcgccgaaaaaattttcaaaatctggagcaaaccatatcaaaagcaaaaaatttcctgctgaaaactacctacacactaattttgagaaaaagtaaaaaaaaaaatgttgcattgttgtttacaatcgaatacctggtcagtttggaacttttaagtccaatccaatataaatattcgaaatttgaatccggggttctgagttaggcaaacctatggtcagattgtaatcagcaccctcgaaacccccgattggtgattttgaaccaaaatataaaagttaattagggaccacaattatgcaccattgctcagagtacaaccgctatgccgaaagtgtgcttccaagcaagcccactgacttcacgctggcgcagacgatcgacaagctcaaggccatgttttgtgcaacaaaatccattttcacccgtcgattagaatgttttcagctcacaaaatcaatttcacaatccccattagatttcgccagccaggtcaacgcaatgtgcgagcgatcacaaatggatctgaccaaggacgaaatcaaagcaatgatcttccttacaggactttcggacactgatcaagagctccgagagcgttgtttgcgacttttggaggaagcgaagaagaagacaccgccggaagcaatctcatacgagaagctcacagaagagtaccgcccgtttctctctcttcgcaacacttccaacgcattggcacattcaactcatgtggccaattcggtcactataaaaccccaaaaattaagggatcataaacagcgaaagcgggatgggtcgcgaagctcgtcaaagacgacgtccaccaccagcaacaatcaacgatcatcccaatttcagcgcaaaccgcaacaaccaccgtcgccatgccgtttctgcaatcaaatgcactgggtcagcgactgtccaaaggcaccgatctgctcaaactgcaatcgtcgtggccaccatcattcaaaatgccgtctgccatcgccatcatccaaatccaattcacagcgcaaccatgcaacaaaagtgacgcatttgattggtatgtctacgcacaacggcgtttaagattggaacgtgcaccttccaaaccacacctgcgccttcaacaactttaccctgcaaccacatgcttttgttgtaccgatagttgagtatcagcacgttgtctccaatcgcgaaagtcgacggtgaacttctttttgtcaattgaactgttttggcatgttgtcgttgctgtgtttggtgttgtttgctgggtgtgaaaagttgttgagagtggtggcaatgggatgttgaagtgccgcttcgaacgccctgatccatggaagaccaaacaaattcattgccccttttggtgcgacatgacactctaattgaagtgtgactccttggaatgtgattgagcaaatgaaatacccggagatttcgaaaaagtgccccgaatatgatttggtctttgaaatgccctttttgagtttggggctgcctaactgttcccataatgcttgctgaatgacggccaaacgtgatccagagtcggccatcagtgatgccttggtgccattgagttgacagtcgaccatgatccaatccgaatttcgccacgatttcccaaattttatttgaagggtagggttagcaaccggaaaatttttggaatttttgatcgattttttttaatttgcatctttggcagactccgatggtcactttggaatcgcatcgcgagcccgtgatcggctgcgcgtggcatccgtccaactcgggccaggcgatcactgcttcatgggaccatcagttgatgctttgggacctccaattggcaggtgatttttg

SEQ ID NO: 5769 - DNA, 4148 bp, Heterodera glycines
tttgatcttggcagtgttatttgtcgccatgattgagctagcagcaccaaaatcacgaaaaaatagagctttttgatgctgatagaattgttcggttgacgagtaattgacaccatccatttcaaaagaagcttggtaaaagtttgagaaagcataattttccattaaagttacacttatagttttttactcctaatcaacctctatataaaggcttaaaatatcgcagaatcttcactttcagaatccaaatttttttgtaatggcagcacaacggtcccaattacgccgtattatttccaataaaggaaaacagcaaatttacgaaaattgctttctttatctgtttgaggccaaaagcaaatccgatcacaatctctctttttgggcatgtactaaacgctatgatacttgtccagcacaaattcacatacggggagaacaaatcgttaaaagatatcacgaacacagccacgaacctgatccagcatcagcagaagtcaaagatttaaataattccatcaaaaagcgggctagggatacagttgaacttcctggtcaaattcgtgaccgtgttttacagggggctagccaagcgatcttaggtcaaatgcccacaaaaaattcaacacgaaaaatggttgaacgagcacggaacttagaaaaacgggtaccaccagatcccgaaaccattcaggcgttggaatttcgggaggaagaacaaacatacgagggagaaaactttcttttaattgatacagggcatgaagatccatctagagtggttgtgttcgggaaagaatctgtcttagaatgggcccaccttgtgaaaagcctttacgttgatgggactttcaaaatttgtcctcgtccttttcacaatggtcaagtttttatgattttaggcaaaagaaataggcatgtttttccaatgttttactgtcttcttcctagcaaacaaagggctacctatgacaaactttttactgaaataaaaaatttctgtccaaatttaaatccggattcagttgcccatgatttcgaaatcggtcttttccattccatccaagaaaattggccaaattctcagttgcatgggtgtttttttcatctcaatcattccatgaaaaaaaaaagtagcggaacacaatcttttgccacgttataaaaacgaccctcaaatcaaattaagttgcaaaatgatcgttgctttggcttttgtgcagttagaaaatcttgaaaatgcttttggggatttaagggacttttttgacaatgaatttcctggtctgaaccctctcttggattggtttgaaataaattatatgggacctttaaaccgcaatgggactcgacgtaggccgctttttccacgcgaaatgtggaatttatttgagagggttatgaataatgaggaccggacaaataattttagtgaggcggggcacaaacggattcacaaacaattgtctatggaccatccttcaatctggaaatttgttgacgggattaagaccatccaaaagggaaaagacgctgattacgaagcaatgattaggggggataatgcaccgaccaaacgtaaaaagtaccgacaaatagatgagcgaattttggagattgttcaaggggggaatgagcattggcacacaattttaatatggatcaataattgctgttttgcttttaagccactgggagcacctctttggaggtttattgtgccctttgggttggttctttttatttaaattttctttgctgcagtgctgcgattacacccttcgttttttttctttcggatcaagaattatttttatttcggtaatttcgctttttatttttcaaaaaaaaaaaggcgcactaaggtaccattaccaatcgcaggcctcctcgtggccgtgtgccggaaactcattaaccgttttatgttggttaaagaggccaatcctacccttaaaaaggataggaagcgaaaaatggtttttttttaaagtttaaggaattttttttcgaaatttttcgacgctttttgtcccgacgacgttttgtctcgacgacgttttgtcgggaactgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgacccgtttgtcccgacgacgtttcggctgacgacgttcaggctgacgacgtttcggcgacgacgtttcggcgacgacgttttggggtgcaccggttggcgttgtgtccgatgtctgttggcactcaaccgaccagcatttgtttgtttcggccagctttgacaacacagttaaaatgtgggacgtccggtgagtttctggcacaagcgtcgagtaggtatttagcgaatgattaaaacaaatttatattcagaatgtcattattagtactaaatattgtcttcataaatttttgactgtggaggggggggggtgtatttcgaggatttgaattttaagaaattctttttttctgttactctaatgttttttgtgtccaatttcagcagccccagggcggcctatatgatttgatgggccattcggaccgcgtgctgtgcgttgattggacagtgccgagccgtatttgcagcggttcggtggactcgacggtgaaagtgttctcacatgggaccgaagaaaatatctaattgtttatcgtgatatcatttgttgttttattatagttaaaatttctgtacaaactgagaacaaacaaattatacatggcccaaaaacacttctgattgtaagcctattttaatggaagtttaatgaaattgaaaacttttggtagaaagcttttgtttccctttgccagaagggatataaaagcaactttttaaatggtgaagtcattaagcatttatagccattaaatttaattcaatgtgaattaaataaaaagtgaaacttattgttagtagaaatgacaaaggcaaatgttaagtgacaaaaaggggggatgattgatcatcgatcatattccgccatattctgtggctcctccacaatatttgccgtttccgcctgctgttgctgcgagtcggaagattccatgtcgacgaaagtgctgaggagcaaaccgccgaagagcaaatcgggccaatgggcgaccaacagatcgcgcagagaactgatcagagtccaaacggtgcgcacaacgccaaccgccagagaagagaacaactgagccgaaaaagaagcgtagaaattggccaatttgaggggggggggggggggggataaagcggccttctttacacgtcaggttttggaggttttaagggccgctgacccttcattttttgttgattccggcccggatttgaacaaaaagtaaaaaattcaaatttttagagcggtttcaacccaaattaagttcgaaaagtttcaaattcattataccgtagaaaaaatttctaacggtttgtagaataatttcatccaacgtgaatggcactttttgcttaaattagcaccgttaatcccttcgctcactcaccggccaatacaaagtgaacagaaatgccaaaacggcaaaaattgcggccgttccgcacaccctcaaaaattgcttcagccgttcccatttcgcctctctctccgcgtcagcgctctccaaagtgctgaccaatgactgaaaactgtcgtaaaattaaaatttgatgaacagagacgataaaaatgctgcaaaataaaatactatataaaaaacaatggaattttaaatgaacacgcaagtaaaacaattttaggaaaaaccagcacattgagacaaagatgcaattcctcgcgctgtgcttcgcctcccgacgaac

SEQ ID NO: 5770 - DNA, 5449 bp, Heterodera glycines
acagcaaaaacgaaaacattttagcgaaataatttagaattttaatttaaatttaaatattttcaaagaataaaataaaataagtaaaattatttctgtcatattttgcattttttaagtcagtttgaatggggtcgttttaatgcgtttttaatttttgagtgggagtcgttttagtctgtgagtgcccatttaagcatggtaaagctaaaataactgcaactgctccttctacatgcttacaatgctctcaacgataattccgcgttaaccttgtaaatattacccaattgcttaatgatacctctcgaaactgcgaaattattcttaatttttttttttttttgtaattgtgatataattttcaatcattttttattttaaggtgtataaggtttattatacatagggtttaaacaatttatttatttttgttttttccgttttttgttttgtctttaaaattcatcgcaaataaagaaaaaattaaataaatttatactgtgaatgtttgacttttgtagttgatttttaccaatttatccaaattacaataattgggccaataatttgcaaaatcatagtaagaatacatgaattggattacgaaaatccgcaactaatgacttcgcaccgtttttccccttttgatgataattggctgccgacgatctttggccactgataatggtgcatttgctactgtttttggacgaggaatactgtatacagctggtactgttctggcattttgccgaggctgactgccactgccactgctggtggccgttgattttttgtgaaacaggaagaaaatgatcagctcaaaaacggtcaaaagtgtcagaccaaagtaaaggcccattgtagagccaaggtcaacttaaaaaaagaccattaaaataatgcattaccaatgccattgctaatgttattgaacgaaaagacatcaactaagcaaataagcatggccatggacgcccaaaatcagaaaaagcccaatttttggtttataaaatacgtaaaataatttataaagatttccaattttgtgagcttaaaaaataaaacaatttttccatttgctcgattgttcattggaatggtcaaactcaagaaaattgtgatgcctttatttaactttgacacaataattatgagataacccaagagagtttttcatttatcaaataaaatgtttttaatttaaaaattatcaatgccaaaacgaccagaaaaacttttaatttgccaaaataaaacagtcaattagaccattatcagagttcatgcaaaatattaccaagcaaattgaagttgttatattcgcgcgattcctccattcgaattacagtcattgaaaggaagcgaaagcgcaaagtggccatattatttcttaaaaatggatttgcattttcgagaagcgaattccgattattgaaaatttgtcatcggaaaccaaattaaaacaggcacttactcaaaatatttgccgccttggcctcgtgccgcttataaatcagaagagattgaataataatattatctaagagtaccacattttttttcgttttattattatttttggataattttttaaattctcagttctttttttgccaaatttacgccgattaaatcatctttcagatttcccaattgaaaagtcaccatcaatttttgaaacagaaaacctaacaatttgaatcaatctacagataaaatgagatggacattggtaaaaagggcaaaactgatctttgattgaagaatgacttctaagttgcgcacaagcgtgctccgtaccgggttgtaagccacccgggccaccaacggttcattctatgcatttatgataaatatttaaatgaaacaaaattagaaaaataaaaaattaaggaacaaacaccttgatgatctgctcaatttcagcaatcactttttggcatttcgcattttcacgggctgcaacatttttggacaaatcgcgccaaagttcgagcaacaagcggaacagttgattggtgtgctgtttgttataattaaactgacggttagcttcagataatttctcacttcaacaagttttcgtttgcttcgcgtctccttctgataagcttcgatcatcttattaaaagcaatggatcattttaaacaaatgccaaaaacaccggtattggcgagggagggatacggtatttgaccgcctcaaaaaaggtgatgtcagtcacatcttcattgtgctgaacacaaaatgattagaaagggtttcaaattgagttgataatcacaataatcacttactcttccccaatcaaattgccaattccgattgaccaattcgattagatcatttttaaattttaaaatgcttgagaccttgaaactaaatattaaatttatattaatataatcaaaaccgtttttgagcattccaattcttctgatgtttggtttttgtgcaaataattgctcattgacaattgctcttctatgagagcccccctaatttggaaaatgagttacaaccaaataaaaattttagcaatttgaaaataatacattggcaaattgaacaatgccaaaatacggctgtgcccatcataaaagtgccgaatcaatttctcgaactcataataccttaattggttttttcattttaaacacttccgcccacaaatatggttgaaatgcgtcattgttgagacggcggacgcgttccgccagcatcctggactggcggttcttctcccgaacaaacatttctctgttgagcccgcgtgggtattggaatggcatccgatcattcattctgacctttcattttatacttttgaaaaataaaatattaaatttcaatcaatttctacagttacaaaaagtataatattctgatatacagcatgcacagactaaccttactgtagcccaaatcgactttgtactgcacctgctgtgtacactttcgccacagacattctgcacaatttatgtacacaataggaaaaaataaatattttaatttaattcctttttatggggtcaaaatttaaaaaaattatgaaatttgataaatttcaattaaacaattttgttttaaatttttcaaataatcttctttagcagaaaaacatttgaaaaaattgtatttttggacaaagcctattaacaataaaactgaaaccaaccgtgccaattggggcgtttaatgtaaattacgaaatgccataaattgaattttgtttttgatttttagtgcctttttcggcgtctttcccttcgcctgcgtcccattgtgccatcgctgcttgacaattgtcccccgtatagtttttctgcactgtgacaattacactcatgtccaagtgggagccggcggacaaagtgaccccggagatgccattaagccgtaagagaaggaacaaagcaataaatgttgaaaaaatgtgtggcattactttaactgttcactttcgatgcgtgggttactgtaatttttttatttatgaatatttttacaatttcaaattgaaaaagggagaaaaaacagtgaaaagatttagtaacaaaagcataaaaaggctaatgcttgttgtaaattgtaaatttgtgcatattatgcaccgattcattcatcattccacgagaatggcgttttgccaagaatttctggaatatttttgcctttgccataaatcttttcctttgacgtttattttgtgttttctacattatgagttccaataattttttaaaataacctgtaatattatccaattaaatagaaaaataatggttaaaaattgctttttaaacaaaacaagttcatatttaattctttactttcataatttaattcagactcaatttattggttaaatattttttctatgcgattttgccgaccgaaaaaaagctcttctagattttaataaacattctttattaaaatcgtcctttggatttatacattttgtccgcttttcattcgctttgtcacttttcactccgtcagtgatcgatcaaattctccaggttcaattcgattgttcccattgctgtccatgtgggcaaaccaggacatgtttttggccaaatcgtcagctgaagtgccattctttgtcttaaccaaatgcgcaatggcctcttttgacgaaattccgccgcttttgtccacgtcaatctgcacattagtttaattacaaaaatgattaatttatgccattcaaaaattaaaagttaaaataccttcccgaattctcctcgcttttttgcagccgattccaagtgtgaaagcgaagaattgtcactacaaatatgagtgctttattaattcttaataaaggcatttaagacagagagcattttcataataattattattaatattgcccagtggcattttcccaaaaatgcacaaatactaccgtactcatcacactttgtatcatacatttatgttttttttactatccgactgtcattgtaaattttgtacttgatctgcttgaaatgggctgctgaattctgcgggcatccgccctccccgtccttaacgcaatttttgcacccatccggacaagtagaggcgtactgtggatcgcaacagtagtagcagctgcaggcgacgctaacattgcacgagggcggcgagtaatcgtaacggcacgccacgcaattgtggccgaaaatgttgcactttgggacgagatggccggggcacctgtgaaaaagagaaacgtgttcaaaatttaattttaattcattaaatatcattgaagtgcgcacacagtgatgttccattcgtgcattggcattgattccgagtcgcagcagccattgccaattgtcactgcggcacaggcgaaagcctaccaaggcatgttcaaagtttacatttttatgggttacaaatttttacttcgtcaacgaaactcgcaccaaaaaaggcactaagaaaaaacagagacaagcaaaaagtcatttttaaaggcgaaaagactaacgaaagcgaagcgaaaaaatgaaataaatacgaaaaaaataaatggggaaatggaaatcaaataaaaagaggaaaagaaataaaatgaaaaattaatgcacaaattgtctaaaatttataatgtaaaaattatgcagagtttggttttcattttgaaataaaaagtcgtttcataataattttgaatattaatgtgataaatgagcaaataaaaattaattaaatcaatcaaaatgatttttaataaatttaaaaaacctaaatttatttgggtttttttggggttatttcaaagaccttcgagcaaaatttaaaaaaggtaaaattttaaaaatgttccaggcttaaattaattcatgtatatttaaaaaatatatatcttaaaaaagtgaattaatagattccgtttttttctgatgaagaaaatatttcctcctccgattt

SEQ ID NO: 5771 - DNA, 1598 bp, Heterodera glycines
  misc_feature (68)..(68): n is a, c, g, or t
tttatttcattttttttttttgattggcatttctaacccccccccgggccattttttgtgaaaattantttgtccattagtaccatattgagcccacaaccgacggtatcaccagtcgtgaaaattggttttcctggcagccattcattcccaaaccaaaaatagccatcactttgataaacgatggtccctgccgaagtgccgatactttggtcactttgcttgagggcgagtccaatgtaaacgcaactgaatgaaatgtgccaaattaacatttattaattaagtaataggagtcaagataaaattaaacaaatttgctacaatgccttttggcaaactttaacattaattaactcgactccccccccccccccccaataaggagaaagggacaggatgaaaatttgagttttgtttgacaatttcgttggttaaaattgccaaaattttattcggaatcctaaaaaattgcaacatttacgaaaacaaacaaacatgaaaaaattcattttttggtgttataaaagtatttcttgaaagaaacttttaattgaattacatattttaggcataatttgtgcagagtaggacaaaacgtcgtcagccgaaacgtcgtcgaacgaatttttcgaccataacttttttctttctcaaccaaattaaacattcttggtattattcgaaagcattcgaaaaatgctattagcctgtaaattttcaaaaaattttatttatgcacaaaaaaatcagagcaaaaaaagttcgaaatactgggtttttgagttccttctggccataacttttttgaaacttaaccaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcaccgtaatttgtgccatttgacttttttttaaatttttaaacaaacattcaccaaatattccttaccatttttgtttcatttgtaagatgctcaattcatagtaaaaaaaggtggcagaagaatgaatcccattttgcactggatatttcgcgaaaactgcactcctattgcctgaagttgagttaattagaaaaaaatttaaatgaaaatttctaaatgcattaattaattcaccgttttctttacaacggacagttaaaaatccggtgtcaatcaactcaagtccaatttggcaagtggtgacatcccaacaattttgaggacgattaaaagcattctaaaaagacagtaaaagggagagaagaagaaaagaaaaattcttttaaaatcaatcaattaaaattatcaaaaattttaatgcaggcggggaactgatatggggagaaaaggaaactgtggggaggggggaagagctgctccctgtcaacgggaaagggtcggttcggcgcaaacgtttcggcatcagcccaagttttttgactataagttttttcactgtcaatcaaacccaacaatattggtatcattcgaaggcccttcacatgctctattggccttacaaaagcaaaaaga

SEQ ID NO: 5772 - DNA, 944 bp, Heterodera glycines
ttcaatgcaatttgctccgtaatttacatctcaatgcaatttgtcaaaatttctaaaatttacatcatcattggcacttacacatggatctttgcgcatggtatgaaatttataccacttgaatttaaatacatatcatttcgaagccattagaaattgtacagtatccccaattagcgataaatttatcctttattctttgaccgacaatttaaaaattaattatatatattttcttttcactaggttgtcctcccctggtgtatttgctgctcaatcaacgaattcgaaatgattgtgccaactatggccgtgccattttccgttttttgcgcaatcgcaacaataattcggtgtcaaacgggctagttgccgtggcatggtccacacaaaatgatgccggaaacaatgccaacaacagaatgagagacgataacaatgtgcaacagcagtgaagcctagcgggagaaaagatgaggcgaatatttactaaaactcaatattaaatcatttcggttatcaatatattgcttttttttaattgtattcctcaaaatgcctgttggacaaaattcatttgttgcaacaaaataatcccaatttaatggcctaacaaaatggaaaaatggctcttggttaacttataaaaaattttttaaatgagatagaattagggtaggtcgggaccgggaattttgggcacaaccgggaccgcgactttttgggttgaaaaaccgggaatttttggctgggaaaaccgggaaaaaagcagggaatttcccggtcccggtcaaaactggtcaaaaccgggaccttggtactcagttgtactcagttgtccgtgtccaggtcccggtcccgacctaccccagatagaatcaatcaggcaaattgaggttggttcaaaagtatttcctcaaaaaatactttatcaatgaaaatca

SEQ ID NO: 5773 - DNA, 6493 bp, Heterodera glycines
  misc_feature (31)..(31): n is a, c, g, or t
gtccatattatataattaaatagccttaatntagtttataaactcattaaattataaaataaaaattcgttagaaaaaagagtgaaacaaattttggtaaaatataatgtgagttatgaattctcttttatatgcaaccatgcgaaaacggccacgcggaaaacgtcctggcccggccgacgaggcatgccaactcggattcttaccgaaaatggaacccaattcgtcttggcatccaaagtttccgcggccctcgaagccggtagagtgccgacttcagcactggatcgattcatggcacgagaggcaatccattggcgttttatccctcaattgtcaccttggcaagggggagtctacgaaagactcgttgccttggtcaagagctgcttcaaacgagagctcggccgcgcaatgctctcatgggaagagctagtcacatacacagccgaagtcgaagcagtactcaaccaaaggccgctctgccatgtctctgaagagcctgatggaatcctgccactccggccaatcaacttcctccttccgagagcaaaacttggcattgtgtttactgccgagaccgaccacgatgagttccgaatttcttccaccaatcaaagagatgcgctcatccaacgttggcattccgtgtcatcatcaatcgaccatttctggaatcgctggcagaaacaatacctgctgatgcttcgccagagacttcagtggaagtttaagaaacaacggaaccaaattgcgcgagagcccacggaaggagaagttgtgctcatctccgaagaaaaacttccgcgcaactgttggccaatgggacggatcgtcgagttacaacgctcacacggggaaatccgaaatgccaaacttcgattagccacaggaaaggtgctaagccggcccctgaatcgtctttatccattggaagtggcttcctctgccgaacaaaatgagagccaccagcagctgacagacccgccgcttgagtaacatcacaacagaacccaaacagcggaccccactccaattagccaaactcgtgctcggcacaatttatctggcccgactcatcctatggtcactcgctcaaaaatcaaagcactggcctccgttttatccattctgatgtgcctatttctgattggcgcttcccaaaccaacgccagtagcacgaccaagccaaagcgtgggaaaggacttcaaattcgttgccgtggatgcgaactggcctgtacaaaaaccggcgttgacatttcaataccgaatgggattgtcaaattcttgctatgttgtgccggtggaactcagtgcctcactcaatccggcattaggaaatccttccatcgcttgcccaaggaacatcttctattcgactacgcttattggacgaaaaagaacaacaaaagaatcgggagcatccaatgtccagaccagagatgcgtgcgagctgatcgattgttgggtatgcctcgaacgcctggcaaatcctgattgtcgtccagatgttcagactcattggtggagcgagccaacacaaattcacgaaagagccgtccgtgtcactcacacccggcattacgttccgttggaaagatttgagcatcacacctattgcctcgtctgttcctccggccccaatcatggcaaacaagtttctctcggatggcaataacatggccaaaaatcaactgccaatgccgagatgtcaaactcgaaccagcactcgccgatcctgagaagcgcctaccaattcagctcaaaaacttgcttatccgaaatgaaaagcgagacattttcgccgaaatcacctacgcaccgattcagctgtccattcaatttgaggggcttcgaatcgccacggaagaagacctcacaaaatgccatgccatgtccaagggtcttttcgggtgctattcatgccacactggatctcatctccatttgcaatgccacaccgactttggttcagcacttatgctacgttcgttgttcggatggcaccgagttcacagctctctgccacaaaacgccagaagttttgaatgtcagcctatcatttaaccgtgccgaagtcgacatcaactgtaccattgaatgcagtggaggacggaacccatttgtgatcggtggtcatcttcgctacgtgccaaaacattttcaagcacctaatgaggggagctcattcatctcgaaggccaaacccagcaactcatgcctaatttggtgcccagattggaacttcgatttttctgatgtcttctggtacttctttggtctacaaaatgctctacgaaccattcgcatcatcactctggcactttttatcgtctatatcctattgcgctgcaaccctgcccttcgatcttggagagccataaaccgaattgttcttctgttccttgctctttggccagtgacatgtcattctgcagcgggagggctgagtcgcccactcagcattcaaaacgcaccaaaacggcagttcgaagaccattgtgcaatgtcagaacggatgactacgcctcatggcatttttgaggtccaattgtggaacattcatcccttcaacgaccaaaaattgctcataactaccctataaaagcggttcccaagtcactcaatccaccattcgttcaaatccttgaatttgccttccacttccgaaatcaatcccaattctcttcctttccaatggccaccctgctctctttcctcgccaattcgatgaacatcgatgtcgaacgctttggacttgccgtcactacatccttgagccgttggaacgaagcccaggcgatcgttcaaggactgcacgatcgaggctacgaattgaagacacggcacttgcacccatttgagcgcaatgtcagactccacgggactgaactgagccgaatcgctgctaatcgtcttggcgcttacaacggacaggcccgagggcccactgtttctgaattctaccgctctcgccatggaatcgtccttcgatgcccctcagctccttgtcttatggaacctggcggaaatgggcaccgagattttttccctattgaactcatccgagtggtgtctcctgatcggatctcggcgccgcggcgactcgcgactcatccactccctggccctcgcccctcacactccgattgttcgaccgatttccccattccgccatgcccggtcatcttttcgttaacatcagcaccgacgacgtgccaattggagagccgggaatggagcgccgactttcacgtggacaaacagtaactattcatggcccgatcaccttgcgtatctaccctgcccttctcctcgtttgtcttttgctgtttttggcaacatttgtcacatctaccaatcaactgccacacgacatttgtaaacaacaattcggttcccccctggcaattcacatcgactcaattttttcttattcacccgccgcccttctacacaatccaatgtccccccaaattggtgtgatccatttgccgctgtctctctatctactacttaaacaccgccagccagcattcatcaccaccatttgctcaaacccctttgcccccaattctgccatcgctcaaacgccttgccttgcctatgacatgtccaacctgctctctgaaaaacgtgccgccctaaaaagggcccaagaagagttagccgaggcagaacgaaccaaccgccgcccgactccggcccctgctggacgaccccttcctttggctgctatttgcccttccccacccaaaaaaccagccctcgccaatcgcaatgccacggaagccgcaccggacgatttgcgcgccatactccatcgacaatttgctcgcctcgccactgatcaagaggctgccgcccaatggacagagcgccgaaaacgcgaaattgctgaggaagcggaaaaggtgcttaaagggctgaaggaagtgatcgtcgactccatcgacattcaacgacaactcctaaatgagcaggcggtcgctggtccacctggtctttgtgctgggagtgttgccaaatgcaacgaaagaaagaccaaaaagacaaaatgaaaaaggacaaacaatgtgattggattggcttttggccggtgattaattccttctgttgaaaattatatgttaaatgtttcctaaaaattctgtccatatttctgtattaatcatcatttcggtctttgttcccccatttttcgatcctatttaaatgcttctcactcctcctgttcttctcttcaccattttcctttgactgttctgcattggaataaagcgcacttttctaaccgtctactcgctcgttttcccccaatcgtttggccagtctctcgcccacacgtctctccgttcgccgccctttcttggctctttcgctgccccctcgtggtcacccccccctcccggtcgttgtccatcccctttgtgcgacaacccggacccgtagccctaatttaatatacgattttgtagttttttgaagtaaaaaaaggtacagaaaaattgaaaaactctcgctctcgtctttttggggactctcacctctcgtcaaactttcgctctcgtcttttctgagacaagtcacacccctggtatgtaatatgaaagaatattatcatttttacaattattttccgattcgtatgccgattagtttatcataaaaatttgttagatatgggaaaaacttggctctattctagtttacgcgtccgatcagtgtgattcatcctcactttttttggtcataactttttaatgatgaatttcgggttttctcgttccaatctttttccaagattgtttggattgaccaaataagaaaaaaatatgatttaaaaatgaggatgaacactgattggacgcgtaaactgtaatagagccataaattttaagcctcctcccgggtttttgtgcttaattgtgggtcatttttgatatttgattaatttaaaatgaatttttgattttgaattttcaactttttttttcgagtccaggtacgacaggtcgaaatgcatgttgtatttgtgatcagcaacccagaaaaccccataagacatgtttttacaaatttttaaaatttttgtcaaaaaagggatgctaccacctaaactgttatcgaaatttcaaatcatagggcacaaatttaatgctttttggctgaaaaatatagaaaatatttgattgtttaattttttaaattttattaaaatgacgaaaggtttagtgacgaaacttcagggagccgagttccgattttctcgaagtgccgttccctttccgacttttattaaatgagattttggacagattcgattgccttcttcattcaacaattcattactacaatagataatacataataaatatttgtagtatttttgtaatttcgcataaaattaaatttatttcaaaaataatttaattataattaaagggcaggggcaaatattaagaaaaattccgaaatatgtacaaaaaaccccaaatatataccaaatatgtaaataaaatttttaaatggttttgttaatttgggtacattttataaattattttttcaccataaattttcaaaaaaattctcaaaatatgttacaaaaaatgaaaatatgtacaaaaaatttgccgaaattttaggtttttttgaggatttccaaaaatttccgtaaaaaatcttcaaaatatgtaaaaaaaaaatgaaaataaaaaaaaagtcaaaatatgtaccaaatatgtaagaaaattcacgaaatatataaaaaatatgtatttatataaaattggcagcccctagtgatcacactttggcgatttccggaaaaaatttttcccaaaactttttacattttttgtgatttgtttttttcttgaccaaaatttctgtttttttttggtaatttcatggaaaatgtattcaaaaatttcgaaaaatataattattcgcaactgtaactaaaaagagatgatatttatagttgctaaaaactttcaaatttaggggtgtaaaatcgtaaaattttatccaaaaagtaacaaaaattaagccaaatcagtattgagattcacgttacaaacaataacatttcgagttgttcaggagaatgacggaagcgattgtcagtcaaatggatttttaattagaaaacgatcgtttaacatcacatcaagtcaaaggagcgatttgtaaagagaaatcagcttgggatgcatacggaaattgattttatggccagaaagcatttttccaacgtgctgagtcgatcctaaaaaagtatcaatgataatgaataattttggatttatctaaagaatatgaaacttaagggatgttctttaataataaatatgaagtcatgcaacatattgcaatgaaaaaattactgtaaaatgaattaaaaaataaaatatttatataaattttaaaatatttttattaacaattattaaatttaattattcattatcattgatactttttt

SEQ ID NO: 5774 - DNA, 1579 bp, Heterodera glycines
aaagagagcaatggcaacggaacggattaatcaccaattcacacaaacccaattaatcgtaaattaatattaatcaattaattcggttatacttaattaataaaaatgccaatgcttttgcatcagagagagaaagagagagagagagagatagagattagggaacgaataaaaaaggaggaggaaaagaaaaagggaggttgggagaggaaaggaatgcgaaggcttggcaaatttagtgaattcatttaaatctgaaaaagtggcggagcattggaaaatgataaaacagaaattaggacgaaggaaaaaagggtaaaagcgaaaaatgaacgaatgaacggcactttttgaatgcattcttttgccattttttttattattatgagagagaattacggtagacttttttcagattattatactcgaaatggggatagatattagacaaatgaggtaaaaaagttttgggctgatagcccttcgctttttggggaatgggatgcgttttagccgtgcgttgggcgcgggtgcgtgcggttttttgggagacggcccccgttaatgcaaatattcccttccccttgccccccccccccagcaactcctccaacgacttcatcccctcccgttttcccacaagagagacaataacttcgacgacgaacgttttgatgatgggacggggggaggagagatatttgctaaccgtctgagagcactcttcacaacaaaatttcacattttctgttaattcccacgcgcaccaaacaaaacccattcttcgccttctttttgcgctaatccatggacttttaaaaatatttttttctgttttgtcagtgcattttggaagaaaagcaccgacaaaaggacgacggaaggagagaaatatttacatcaatttccggaggcttttccccaacaaaaagggcggaaaaggtcacacacccatgaaaattgtcggtcttcgcctactcaccgccattttgaggcagcacaaattccacgccatcgatgccgttgttgctgatgttgtactgctgttgctgctgctgatggaatgtttcgtcctgtggcctatatagaaaattggcatttccgccgtttccatttgcgttgtcttcgttcagcagagaagcgatgaattcgttgtccatttgcatccgctgctggtaataattgtagtaatcattcccattctctccccccttttccaattcgttttccccgtcgtattccgttggaagttcgaattgatctcttcgacggaaatggcgaatgattctcgtcatcttctaatgatgatgcatttgcacttttcaatctgttcgggtcaattgagtaaacaaatgcaaataattggccataaaatgccatttcaggcggtgggcggtgaaactgttcatttctttatcatcggagcatttatccactttgtcctcccccccccccccctttctcacttccctcccttttccgtttacgaaattgaaatgagaggcttttgttgagaggagaatggcgggcttagatgggaaagagcgggtggactgaacattctaagctatccgagaag

SEQ ID NO: 5775 - DNA, 577 bp, Heterodera glycines
cccccccccccccccgcggcggttgtctccccatttcccatccatccgacttcttcaaaagacactcttcgtcggcttaacgggtgtatgtgtatatttttgttgctgtgtccatattggcttcttcttctcatcatcgtcaccccccccccccccccatttcggcgatttgtttggttatgcgaaaatggcattaggcattcttgggcgaaaattaggcctttgagaaagaatattttcagtgaagattatggaagtgtgaagtgtaaacaggaagaatgctttattatgattatttagggatttgggtcgggggactttttctgattgtgagagggcggggggcgaggcggggggggggggggggactgaactggacaaggttggtactgaaaagttctagaagcacccagcccagggggttagagatagcggcctggaattttttttaacttttagccaacacttcatcttaaaatcctaccagcggaaactttttggtcagggtttggagtgatttttttgaatttttaaaaaattattaggggtctttagtccacatcgaggctcaagacgg

SEQ ID NO: 5776 - DNA, 2332 bp, Heterodera glycines
cccccccccctccttttgttttcggcattttttgcttggtgtgtgacccccccccccctctaatttattatttatacattctgcttttctttcctctctccactgacctaagttttgttgttaaaactcctttcctccatttgaacaaaacacccaccgcttcaccccccccccccttaacatctgatagtgagaaaggctaatgagtgcttttctttcccaacagcactttgtagaaaggcgtcaactaaggtcagaaaacaacgataatggcatgtccaattttgatagatgaaccagaaggattattatgtgttttaggaccgcaagtcaagtggaactaatttaacaaatagcacaaaggaattggtgaattttcggtgatatataatattaataaatcatccatcctaattatttgttttatttttaattttacaaaatacaattttttaatatctccgcttatttgaggaatgaatgtgttgtttgtttatgtttagcgttgattgggaattaaaggaaaagtcagcgcggcgtcgaaaattgaagcaaaaaattattaaattgtgccaatttgatgatcgcacataaattatgccattcgctcagtcattaatttcacttgggaaagtccgaggggctgcccatttggcagcataattgtgctttcccttaaaaagtttgtttgtcccaatgcaggccagacgagaagaagcggagaagcaagcggctaatatgggcatggagggcggtcaaatgcccccggcgatgatgatgatgatgatgtcagcagccaccgccgctggaggcgaaggcgcagccgcaaattcgttcacttttgcggcgcctccgtcgccggccgttccgcttgacccgcacttggaacggatgttcatccaacaaccgaaacacgtcgccggagaagaacagcgaccacagcacgaggacgaggaaaattatgacatttgacggtaccgagaagcacgggagaaggagaccaaaagcgattttggagagggagtccaaaagcggggacagagaatcacctcataaagcaacgcaacagcatacagtacccatatgcataaagatcggatccgcggatcgtacgtaacgctctatttctcatcattacctatgcaatttccctttcttttacctgattcggtccgcggatccgatctttatgcattgggtacagagccctttcttttccctatcattccatcgtttgatgagctttttcccattttgttcatttttatcagaaacttctgctgtttctttctctactgacccttctcctcttttcttatccgatttgtttaagcttccgttgcattttctcattcatatgtttatgtttatttggtattattttagttgtttttcttagatttgtcctcgtgtggttggctttgttcgttctcattttcatacatcaattatgtaatgtttgtttgagcaaaagtaaatttgatttgcttatcctcctattaaattatttgcttgttttgtaatggacggaaagccgtggagggaaaaaagaaagatcaaaagaaaagataattggcgtgtgtaaagtacgaatataaattaagtggtaagtaaattaatggtttttcaaaaaatcaaaacaaaaaaaggagtgtttcccctcagtaaagcgcaatttatgaatttgtggggggggggggggaatcacggtaggggacggttcggtgcccgccgtttcggtgacagcccaagttttggaccacaacttttttcattgttgaccaaatctaataatcttggtatcattcgaaagctttataggtttagaagcttttctaacctattgcttagcgattaaacaattaccaaaaaagttataacatgaaataacaaaaaaaaaccaaaattttggaagttttttcttaataacttttttacaagctaaaattttttttttgttttttgtaaggctaatagagcttgtgaagggctttcgaatgataccaagattgttagatttggtcaacaaagaaaaaagttgtagtccaaaacttgggctggcaccgaaccgtcctgttccgtttaaatttatagaaaatttataccaatttttagtgaatacgaaaattttttgaaaaaaagtctcggaattttcgatctaagtcgtagtccaaaacttgggctggcaccgaaccgtcctgttccgtttaaatttatagaaaatttataccaatttttagtgaatacgaaaattttttgaaaaaaagtctcggaattttcgatctcgagtctagaaaaattttatagttatggccaataatttttgttacaa

SEQ ID NO: 5777 - DNA, 1804 bp, Heterodera glycines
agtgatatgtactaattgctttttattcctcaccttcataatcacttctttgcacaagctgaaaccatggctttttctcataattatgaggtcccgccacccgcccacctgttaattcgggcaaatgagcatcggtctctgtgccggtgccaatcactgagtcgacattgccgagagcaatagtaagtgtagcagtggcggcaccaacggaaatgcgaacgcgcgtcacgcaacggacggacgcaggcgcagaaagcgcaacggacaaggagaggctcattctgttaatgggaaaggcaataaaggaaaatggatcgtattcctaatgagcctattagtgtcattctcattattaaacgttccagtgttttgtcaaatgccttttactctctctatcacacttttttgttttctgtctctgaccttcaacagattctcggccaagtgcggctgttccgccagcctttccatcaatgccaaatcgggcgagaaaatgccggggccgtccatgttgcggagctggttttgctgttcggacaatctgcttgtgcgagaatagcttttcttccttagccccgttgctttcgctcccttaattaccccgggtcggccgggggcggttcctccaacggtttggtggattggaaaatggcgtccaacgcctcctccagcgttattcggcccccgtagcgatgtgccaatggggcggcttcggccaattggcgatccacgaaagtgtccgccacttcgaccactcgcgagtgttttctgtgtgttggcatgcccggtaggattggcatttcctccctttccttaatggccgcttctttcctaccggtctcgtcctgtgccccattcgcttggcactgtcgataccgtataccctgactgatgtcggccatcgctgtacggtactgtgctgacttcggtttttgaatacgcctaagacaattttaaggacaattcactgggcaaaaggctatttttttgcggacctcccgagaatattctctggtcacagtgcgagtttcggtgagcaaagaaggctcagaaggagtcttaacaagaaaagtaaaaacttgagaccgattggcataacatgccattattcactcaactgaacatcggaatggtttaagccaaagtttgggtgaaaaatgtgcattgaaaggtgagggaaaagaaagtgccaaagccaatggaaaaaagagaaaaggacagcacaaagggaaaatcactttttatttctttggaataaaataataattgaagataatgataataataataataataataaaataataataatcataaaaaaagtttggaaagtgtccaattttgaggaacaaaaggggcgaaagcgcgagttgcagaaaaagagggcaaaagtaagaaaagcacaaagggaaaaggaaaacaaaaagtgaggaagggatggcatggcaattaacgagacaatgggcaaatgcactgaaagggaaactgaggaggggcggtgagggggcaaagggaaaagggggaaagggtgcgtcactcgaacagaaaagtgccaaactcagacaaatgggcaaacagctgcggaagacggcacgacgaccttttggttgacatttgaaagaatttacgagcattcattgcgaccagaaaacattttctattgttattaatctgctttgctgatcaatcagcagcaattcccttgctgatcggcaagagactgatcagagccgaccaataagcaattcccttcacttgctgctgatcaccggcacttccccttgccattgttcgttcgcaccct

SEQ ID NO: 5778 - DNA, 1052 bp, Heterodera glycines
cgacggcatcgtcggcgcgtgttggtagtgcgacggcggtgcctgctgctgatgatagtcgcggtaccaatccggcgcatggatgcgctccgtcgatttgcgaaagcgcagttcgtgttcccccgcaggggcgcccattggcgcgacggacggaggggacaaagcggagccgatgacactcttttgcaggtcattctcaggaatgtgatgctcatcacgcggcctaaacagcacagcaaatgtcagcggaggacaagcaaacacaacgccaatttaacaattaaagcaaaaatcatttaatttgtttaattaccccccccccccccctccgcccgttttccttccgccgaccttcgcgggtccgtcagataatccgcactttttgagcgcgagtgctgtgcctcggcctcctgttcccccatgtcccttcggctttggcgtgggctgtagtccaacactgagcgtgaccctcgccggtgttcgtcctgcggacggaaatgaaattttgcggggattttggcaaattgaaaagaaagaaagaaaagacacttagagaaacaaaaaccgaagaaactcaaagccgaagcaaagaaagtgaacaatggcactgattaagaatgccaaggcaaaaaaaaagagagggaaaagaaagaaagccaatccattggaaagttggccaaatccacggaaagcaccgctgggctttttttaggcccgtaccctgtaggccatttgctcctccggtgccgttgtcgcccatctcgtggcgtgtaaatgtgccaaaggcgacgcgtggaaggaattgccggaggcatccgaatggaaattgcgctgctggcgatgggcgcgacgaaagtaatgggcgagttgacgacgcgccttggccaacagacgctggaactcctggaagaacgcaacgcatcggtggacggaacgaacggagcggcgaacggacggacgaattggggacaattggagagggaaagagaaaaaaagaagaatgaggcaacagagggaaaagaaaaagagatggatgagagaaagggaggaag

SEQ ID NO: 5779 - DNA, 1477 bp, Heterodera glycines
tttttgttcgaattcgggtccggggttcttaattggccaaaatggataccggattcgtggtcaatgccccccaaaagccaaggaacttgtttttatgacaatagaattttactgacgcattttccactgacgcattttccgggcgccgggcaagctgctcttccattaaatcattcagttcaaatgcgataactacgtaagcaaatatgaatactgaaatatatttggtgaggaatttatatttgatattttaagtaagttggggagaaatgggacagtgagtttgtaaaccgaactgactttcatctccacattttcgctaagtgccttcagcttccagatgaagtccgaccgtgccacctgctccgagcggcgactttgcatgccaatcagaaggacagcgaagaagatgaccagcgtgttcagcagttgcaacttcagcgaatcgttgctttaaaataaaaacaatattttttaattttgctattgccgattgaaaatcctattattttaaatttaattatatttttttgaaaattcactcgcaaatttcttcagcttttacggatggagacattgtggccaatgttgttaatttaatcgaattttggccatttgcttcggcgttcgtagaaggaaaatcgagcatccaacatctgttgtttgttaattgaattatttttataaaaataattgaattaattttgttaaaaattagcaaacaataaaaaaaagggggtacaaattcattaaatttaaatgaatacaattttatttaaaaagaaattgttaatccaagttaatatttcagttatcaaatttatgccaattcccaattaaaccaattaattggccacctgctccaaattgtgaccaaaatgggcaaacacagacaaatggcgatgaacaccttctcaagtgcgagcagagaatggaaagcgcaaacgcacaacaaaaggggcagcgcacattcaaagattagctaaaagttaattagccaaataaatgaaaaataattattcgaaaaatgggctcccgccggaaaatacgtcagtggaaaatgccggtgagaaagtaaattttcaaaaaaaaaaaattaattaaacaaatatttaaatttttcaatttaattattggagccgccgctggaccttttctttacaagtttgagaagtatcatctttgtagaagaataatgggaaaacatgaaaaaaaaccctaaatgtcatttatagtttttccatcaaaaaagtttttgtttctgacccgacataaaaactgaatccaggggcgtagctagaaaaatttttcggggggggggggggggggaaccagggacgtatccaggatttggctgggggggggggggggggtaccgatcccgaaaagtcattcttaggggtgtattttttaaaattcttccccgattcttaggggggtatttttgaaaattcttccccccaaccacctttttttt

SEQ ID NO: 5780 - DNA, 2666 bp, Heterodera glycines
  misc_feature (815)..(815): n is a, c, g, or t
  misc_feature (2640)..(2640): n is a, c, g, or t
tcggtggttccatttgtggtgggaagggacgtccacttgaagcgtagcggagaccaaaacgcgttggtgccaatcgtcgtaggaattatccgtaagcgaagatacattcaaagtgcacacagaagggaccgatcgagagagattaatttaatcgtaggaaaatcagaaaaaataaacttaccattcgcatatttttcgacaaagccaagccattccatccgggcggtgtcctcgcattcggtccgcttcgtccacaacggacggcaccactgcgcgacaacacccacatggtctcgttgctaggccgctgctcatcgttgagttggagcagctgtttcggcataaaaaagtgtgagaatacgcggtgggattatggcaattacaatttctactaattatgacaaattaccgacggattaaaaaataataatgggaccctaaatcaattagtccaaaaaacccaatttgatgtcaatccgacttacttcgacagtgtttttgggttggagctcttcgccatccgtttctgctgccgctgctgatgccaaattcacctcgcggcacgctttgatgtcgtgcgcgctgtaaatggccgcctccaacgttggcacgttgaacgccgaatgggcgccacgctcgcgagacaatccgtccaattcgctatgaaacgatttttttaaacaattttcactttttaagaatgatccacactgaccagcagcagcatcgatttgttgtgtggttctaccaggccggcatattgaaatgtgcccacgacaggggcgtatctagaaaaaattttcgggggggggggngggggatccgacctgaactttttttttatgctatttacccaataaaaaaaatattttttccccgctgctgggtaaaaactgcactttttcactaaaaatgacccaattttggcggttttaaggcaaaaaacatgtaaaaatagtgcaaaatggaggtccggcggtcgccgccgggaaaaattttgaaattgagtgctatatgttacgaaagtagcctataaaatttttaaattttcgttttggggggattcgaaaaaattttccattatttgctggaaaattttttaaaattttcatttcgggaggggtgcaattccccccccccccccccttagatagcccttgactgaatccgaaacccggcattttctcgacccgtggcaacccagaagtatatactccagtatattcacattttacgacttttgctaaattttactaaattttatttaattttttaaacttttcaaatgaattgacgaacgagattcttatttaattttgagtttttctactgaaatacttaatgctgcagattttattttaaattgtattcatcactgaagcactctccactgatttataatgccaaaatgagactaaaaacatactgtaataaaataggaccaatcacctcagcatgaggaagagcactcatttgttgttcttgttgttgttgatcagcatcagcagcaatgatcggcaatgaactgagggcgaatcgcagagagaggaaaaatgcgcaagcggagaacagacaaagcaccaacagacacttgtgaagacgcctaattggttaattaatcaattatataaaagaagaatcaatcaataacaagaaatagtcatttaacttacttcatgacattgtgccgcttccggtgatcagctgctttctgctgaatgcaaagttgattttaatttttttttcaaaattcagctgcttcaagccaaacaagagaaaattttatcaaaaaaaaccaaaagttcattaaaaacaattattgtaaatgaaaatgtttaataattaataatttgttttaatttcctattaaatttaggacttaataatcatttatagagaaaataaaataaaattattattttaaaattaaatatggttaaaagtaaaaatattttaaattaagtagcaaattaaagcaccatgaaaaaacgacgaaaaacgatgaggaaaattaggagaggaattgccacgagacaaatgatggaggcgatgaggtgatcagaataactgtaaagaataagactaaattacagtaaatgaacaccatcaaataaattgcattggcatttgctttacgtgagatttgccaagaaaagcgcggccatacaaagcaaaaaaatggtcaaaaggcaagtggactcgaccagcacagcgttggctttgtattgcaaaaactgaaaaaaataataaataatattttataaataatagttctattataccttttgttccacccgtgtgtgcttgaaccgcagtgaatgcctttctggaaagatgaaaaatataatactaaaaatataaggcccacccaccccaccccttaaatagtgccctcaagtttgaggagggtaaaaaatagagcctaccccctaaattaccaaattagtgcaccgccctcctaaaataagtcccactccttgtgaagggtgttgaaaaatagagcatccccctaaattacctaaattggtgcaccgcccctctaattaaagccttggagctctattttatgaaatacagtagaattaaagtaaatctaaatttttcgatcaatgcctgcccaaataaaattagagaaatttntggatgaatttatcaaacagaatttg

SEQ ID NO: 5781 - DNA, 3947 bp, Heterodera glycines
ctgaaaaggttgaaatgagaggagagaacaaagttcaaagatatcaaaataatgtgcgcatttcccttcccactttttcaagctgtactttcagtgcatccagctccactgatgcgattgttggtgacggattcagcagagaacatgacgaaggctttggttcggcgtgtttgtcctcgttttgctgtgtctgttcgtccttcggttcctccgtcgtctgtggtgccgtcgatgtgccaccgtcgccaccatcagaatgatgacgtatcgtttctggtggcatcattagagtgcagtggttggcttcgcggattgcaaagcctccgacggcggttttgcgaagttggaactccagaaaatctgaaagattggcacaagttttcaatcagtgccaaatttttttcaaaaattgccattgctttatcgattataatgtcaaactttgactgactatctttgtcatggtcggcgccggcgccgatcattgcgtcgacgccgttggtactctgtcgtccgttagtcgttgtcagcgacgatgtcccgtcaccaccggcacaaatcggctccacgggcacttccaacgcacttggttcgtccccgtcctcgacaaagtcctgctcaagcgccttcacctcccaacctgaaacgcaagatttctttattaaattaaattttctgtcaaaaaattacgcggaattttggtggctcggtcccgccggaattcgtactcgtccgctgacgaacttccggctcaatttccgtgtcggtggccaacgatttgatgaagattggatagatcgaattgtgaaatttctttttttagtccagatgagaaattgaaatgaatggaggatcagcaaaaacgaaatgacaataaagtgaatcaaattatctgtcatggaactttttttttgaatgtctctctccgtctcagatttgcttgtcatttagtattcatttttaaaaggtaaataaattcacagcttctattattctttttccggtaaaaacccaactcatactgccccaactcgatcgaatattacaaaagaaaattaagggctattaacttttatgcgtgcccattcagaagtttacgaaaacatttaattgcatagagccctgggttggtatcataccaaaagggatggaccaaaatttacaaaacaacatgattatagtacacattcgttgacagcgactccaaacagaaaacgccaattgtgtgcattataaatgatgctttcaactgatgaactcagatgcacacaattggcatcttctgaaggcagaatttcaattaatgattgataaatgggaatgggttgattgtatgcagaagctcatttctttctgagccaattcttattcatactgttttggcaaaaaactttttcgaattgaccgagtagaaccatcctttgtccggatttgtctgggtttattagggttaaatcatgtttaatgtgatacataatttgatgttttcattgttttggtttaagaaaagttcattattataattttatgtttattaagtctgaaaatggagcaaaatgaaccccaacaacaacaaggacaggaacaacaacaacaaggacagcaacagggacaggaaccgcagggacagggacaaggacaggaaccgcagggacagcaacagggacagcggcccgagatgggcaaaaccccatcggtttgctttataaaattgaataaggcttccaaacttacctatttaaaaattttggtaatactggagaattggtgtccctgcttaaattaaaaatttttcttttctaaaaattaaagcatttatgggagttttctgggtcgatgatcacgaatctgacattaattttgatcaaaattcgaatccctgacccggactcgaacaaaagtcgaaattcaaaattctcacacacaaaaacaagttttttcggaattggccaaaactaaggtcatattcgtgattaacgactccaaaaacaccagaatacatgtttcttacataaaaatttattaaaaaatcaagtatttggtgaaaaatcatgacaaaatcaatgatttttcgaattctgagctcagatccgtaatcagcgtattttttacactagaaaactcgaacagaacgattttaaatttattttccgtcgggactacaattctgccctttgccacaatttgcatgtttcattaagtttgccattaaaaaactattaagcgaaaaagctccgcaatgcgcaatcgaatttggaaattcataaaaatatattcagtttttttttaccggcggtaccggtactagacaaaccagtaacggtaatttcatttttgaaaaaaccggtaccggtaccggtaccaaaaaaaccggtaattaccggccagtaccggtaccggtaccgctcaaccctactattaagcgaaaaagctccgcaatgcgcaatcgaatttggaaattcataaaaatatgtttagttttgaaacgattgtctttgtaccataacaaaaatatactgaatttttaaattttatttgtttcaatattttaaattcatggataattcgcataaaataaaacttccacccgaactcctttcggaaattgtccgaacccttcctttcaacatccgttggtccattgtccggatttccttcactttcgattatttggttgtaaaatggcagctaaattgggttagaatggaaaagcttcgtcgtcttaaaaagagagaggaaaaattgcgacgacaaaaagaaaaaattgtaaggagtgatgatgcgaaagcacaaaacattttcttacctgaaatattaattgaaagaaataatttaactgttttccgttgggacaacaattctccactgttaccaaggtgtgggttcgattcctacccgaggcttaaaattttagctttttattactaagtccagtaacgattttatacaatttcatttttttacattacagcgggtcaggacttatattgaccatttggagcgccagttggagacggtgcgcgcggcgcatgctcaagaaatggcgacggtgcgcgcggcgcatgctcaagtcgttgatgagcgggattttttgagacgcataatagaaaatttctcaaatcatgccgtggcaccaacaggtcagtgatttttgcttaaaattcaattttactgtttaatattaataacctgaccacaacaataaggcattttatgagtccaatcaactattgatttctgagtaatttttaattatctatttgtaggttatttgaattttcaacttttttaatataaacttttttcttactattacattataaaaaaagctgtgggactgaaccgccaaagccttaaaacgcaaatgcaacaaaatagatatctatcgcttcctctcggcatgtaaaaaggatgaatccgaaagaatttttgatcaaaaacgatactgctgaatgttatggctcctcactacctccaccaatgacacataaaacgctctgcatactgcctcgtccaccctccgtattgccccattactcgctcttactaatgatgtgctgcccatcatttgtcacgtctctccatgacactgtccaatgttctgctcgcacttttgctccttttttgaactgctccaccagcatggccatttgctgttcctttacgtggcactttctggccacaatttcattcccctttcattggccatcaaaatttgctcgatttcactgtttgctgtcagcggaatttcgctaatcatggcatttactggggtggaccgactgttgtgcgtcctcatcctggcattgtaatttttcaaaattttgctgaaaccggcaacaccctttttggcgtttataaaaattccactaaatgggcctaatttaccatatttcgtcaaacgattttaaaaatggaaaacaaaaaaaaatgaaaagtttctttgg

SEQ ID NO: 5782 - DNA, 1636 bp, Heterodera glycines
taaaacgctcgtcagactgcttcctccgccctccgtcttgccccactacttgctccgccttcgcatgctcgccaaggcgggcgccgcgcgcactcaaaaagggatttttatgcgttttaaggctttgggcggttcagtcccacagccccattttgcacttcagccccgggtcggtaactctgttcagaattgtgaccgcgccttaaaaatggtaccattcgacttctctcgcagagaggaatcgattgatatatacataattcgtatgcaaaatcaaagttggcagtattctgaacttttaccagtttttttcttactattatattataaaaaaaactattgggttggttatggctttggaccgataaagtgcattcgaatcttttatgtttctttgtgtttatcaccatttcttcgttgcctttaggtttcaattgggttcgaccacagacgccgcttctccgaccgttcgtcaaccaccccaacttctttcaaggttctaatatcgcattatcatttaaatgaaattttaccaaatccgaaattattcagtcaaataacagagaattaagttatcagaagctaaatatgagaaaaaccctgagaatacgacgtttaaatgaaaaatttaaaaaaaacaaatgtcgcttaattgacagtggcttttttaacagttttaatcattgaaaatttttaattttaaactaaaacttggttataagcattaggaatctgtgaattcttgataatttataattgtttgcttttatagggattggagcgcaagcccaacaattcatggggggacacaatggaggtcagggttttccggataagctcattttgtttacttaacatgcataatgatattcatttaggcaacggaggaggaaatcactggtggcaaaatgcgcccggacatggaggtcattttcattggcgttttatttttcgtttttaaaatttttctatttcgttcagtgcccttcggtggagcagtggcaaacaacggtggacaaggaggctatgggcaaaacatcgtacctggtctaaacggtggtcagggcggctatgggcaaaacatcgtacccgctcagggtgatttactcaagactattcagtttattatttttatttaagtgtaaatttatagaataggtaaaaaaaacattttttgaatccaaattttacttttttgcattttagctggcgctggcggcgttggatactttccggcggcctaccagcagcacggagggcaaaatgtgccgggtggaggtcctttaaaatcaattaaatccttcacctgaaaaactgattctcattgtgttttaaattaacaggccagtagtgttgttcttcggatgagactgattgtatgatgaaagactccgtcgatcgcttttattctcattctgtcgtcgtttttcccgctttattttggatgataataaatgctttacaaattgcagtattaattttttatagttgttttgtggatgtgtatacctacattaatttcacctttatatttatgttcagttttcataataactttgcttatggatgcgtacaaacctgaaatccgttccaatactttgaccgtttgaaaaaaggccgctgcgtcaccctatca

SEQ ID NO: 5783 - DNA, 3457 bp, Heterodera glycines
  misc_feature (49)..(49): n is a, c, g, or t
  misc_feature (57)..(57): n is a, c, g, or t
ttcgacttttgtccagtttgggtttgggattaaatctttaaggtagatngagattgngatcgaaatcccaacttatccgagaacaagttttcacaagttattatcacaaaaattttcgcaaaccaaaaggaccccaaccccttggtttttaataatattcaaaagccgaaaattattaagtcccatcatgcattcttttatagtttttttcagacagggcttgataatatacttaactgcaagaaatatattaaaaattaccaaaatgttttcttcgtcttcattagtcgaaatggaaatgataacatttggatgttcggacaaaaggctaaacaatccatccaccgtttcgacagtccttaaaaaagcaaatgaaacgaagtgacaattgaaaaccgacttcatccacgaattgaattccattgcatcggaaatgcgtgtgttgagctcaaaaagtgcagcgataatggcggtgagcacctttgcgagcagtccaacgcccaaattgtgttcatctgcagctttgtacaactcctgcaagtagcgcacgtacacctttcggttggtcgcccgtcggcctcggttggctcccaattcgagaagtttcttcaccaccaaatcgccagtcacttcggcctggccgtcgaagaggggcttggccacgtcatgtttgtaggtgatcttctgccaagactcctcgttctgcccgtctgcctcctccaacttcttcttctccagcgctattttctcgcgttgtgccgccttttccttcttttcctttgttttgcctctgtccgttttatccttcctaaaaaacaatttaaaattaaagggaatatgtggcaatgctcactttaagaaatagcgtcgaagctcctccatttccttgccctccaatggttccaaatcggaagcggatgacgattcgtccgactcagtaccccactcggactcttcgccttccgactcggactccgcgcccataaatctcttcttcagatttacgtcatttgttgcaatggccggcgctgtagggatctgaacattccttcgttggtatggttaaagttcaatgctcaaaaatgacgaactccattctctcttcccataacctcctcgtcctcgtcgtcttcagcagcgccgctggaataacccattgggtcgggctccgttcggtaagtgcccaaatcctcctcaaagtccttgttgtacttcttcaacttctgtcttagtgaggccaatgccttcgaattcgcttttgacattatctgttcaatttctctattaaattggttgaaaattgtccaaacttttcttccttctttgtcctcccattgttcgttgatgaagtcctcaagttcggccaaatagcgaatgtaaaagcgaggaatgctcagattttcgcgtacaataaacgtttttgccttttcccataatttcagttgagcctcaaacacttaaaaagtaaaaaacaaaattaaaatgttttttatgacatacactcgacgatatccaaatgctttagttatctaaaatgtaaaataaaaacctgtttgaagtttagcaatatccttgatatttcgagcatttcgtgaagaacggatctgttctttgagttcggcataagttttgtccttttgggtgcgcacaattcgttttgggccttcgtcctcagaatcactcggatatgcgaaatcgcgagctcttaaatatgttaaaaatttaattataaaagcgaaagtgcacattccttcttttcaatcactcacatcgtacgggtttgaacgatttgctcatcggcagactcctcgctttctgatgactcggagcttgaaatagcacctcgaaagaacttcgacataattctcgatgatagattatttgtctattcttatgttttacgatcaatttgctaaaaagatttgtcattaaacaaagaacgaacagtaataactacgatgttacgtggtatgctctaaaaaattccaatgcccccaactacattaaatatcaatagctcatccgaaagctcttgttctctataacatatatgcagatataggtaggaggtatgtgtgctttttaagcatgatgaatttttcgtataattcacatattttttacaccagaaaaaaacaaaaataaattttaaacttattttcatcgtgacaacaattctgcagcaaatttctgaatttaaaataaataaattaatatttaaattttgttctttgaaaatttttccgctttgcggaaatacgagactttgcgggaacgcgaagaaaaatttcccgtttggcggggacgaaaaaagcattttttaatcggaaactctgttggtgaatgaggaagtccaaagataagccataaaatatttaattaacaaatactatttaaataaattaacacgtatttataaaaaattttttatcatacgaggaatatttatttgaaataaaatataaaaatgaattatttgattttcttaaaaaatatcaatcagtctcagtttctccttcttcaatgccattggaaaattgcgggacacctttaaaaacatttcataaatttgaatataaaaataatggctgaatgatagtgaagacagacccgaagaagtggacgaagaagcggcagaacaaacggacgtggacttgggcagagcaatgggcggactcggcacggcacgctccaccgcgaccaaagtggcatttctacgcgacttctcacctcaaaagagccatctcacgtgaaaattgtcggcattctttccccacctcttttggccacgcgcagtcgcctcttttcgctgccactgtcgctgttcagtcccgccaaatcgggcgactgttccctttcctgttgctgctggccgagttggacactttcagtcgacatttttgcctaaaacaaatattgggggttgacgatttattttctccttttaagcgtatttcctactcaaaatgaatgatttgcctttttagacaattcggggctggcactccctccgcccccgccactaagaatcatccgatgcgaacggttgtgctccgccagagtctttcggcagggaaagcatttgccgcaatctttgcagtcgtaggtgaaccccgtgtgggtgcccatgtgcaagttcaaatcaaacgcggtcatgaaagtctgaaagcatttgaaatgggattgggaacaaaacccttctgaagtccgctcattcagttctcggataaagcgtcattgacagtatttttaatggaatacagtaatacgttgcaacgtgattacagtaattaacgcttcatatgagaccggtttttaaaagtatttttggattaaaaaattgcttctgagggtgtatttcgtgtttgccataaatcctaactctgtcccctccctttttctttcgattggcacttacaccgccaccttttggcattggttgcacgtgtgcgcactg

SEQ ID NO: 5784 - DNA, 2053 bp, Heterodera glycines
tatccatcttttgagttggatctgcaaaacttgcgtccgcttgttgaaaatttgtgctaccatttgaaatcaaattttgagtgccatttttggggatttgtagtggatacgatccattgttatatgttgatcgctcttcgaaggagtaaaaaacgttagggaaatggtcgatgcaatggtggattagttcgagacgagaagcgaaagttttgtgacactaaaaattgaaatttaatcatcgaaaatgctttttccattaataattttaaaaaaggttcacaagtgtgaggaggcttttttcagtctcattttgtggtttggaactttttattgtttttggatttcttcgaagatttgtccaatttttagaaatttgaaagtgcatattaaaaaaagaggtttttggtagcagaggattttgaaaatgtaatgtgatcaatgagaacccaaaaaaaagaggattttttgtttcctggtaaattaagggatcactgaccggacgacagccaccgacggccaaaaggccctgcgaggcgatttccttgctcaacggaacgatttgttgaggaataggcgagggaaggatcggcggaaggaccgaattctgttgaggcgggagcaaaggaggcgaaaaggcggacaaaagcgacaaattcgctgaaatttattacaattaattagagagaaaaggaaaagggagcttttaaatgctatagaaaaggataattaacaaaaagcaaattaatccatccgttaaatttgatcaataagaaataattaaataataattattgacaattaattgctcaccccttaaaaaggcggagaacgattccaaatgctgagggagggactctctgccattgttttcaccgaatccaccgaccgtcaacatttgctggtgattttgggattggaaagggtctttgcattgtgccgcatttctggtcccattagaaatggccaaaaatgcatttgtcttttgtcgttttgcgttgtctgtggacgccgaaagttcagcaaaactttgatgatcgccgtttggtgattggacatcgttctgaaaagactgtaatattccaagtaattgctgtgcactttcaagtagatagaataggaaggagggcggtgacggggggggggcgaagaggacgcattttgcaccctttccccctccccgggggagatgacccttcctcccaaaagacgcctccccccccctcaacaagcaaatcaaaattgtttattttcactctaaaactaatttgatcctagtgacctttggcacccctcattcatttgtccaattgtttccccttgtccctcaccccattcgttgctgttccgacattattttgtggcatttcctcccactgctgttgctgctgttgttgtcgatgcttttgctgttgtttctgttgcgtttggctctgttccttttgctgctgcacattgccttctccgtgttcgttttctccctgctgattttgttgttggtggtgttgctgctgttgttgcatcatcatcatttgctccaacaaattatccaatttcatcggcggcaatttttgttttttttaaatgaaatgaatcaaatctattcaaagaaatggctttgattcttttcaaaacctaaaagtacgaagcaattcattttggacataatactcaaaataaatacaaagcgaagaaaatgaaggcggaaaggggcaattccccccacaaccccacacattcccatcaccagcttcccaagcagtaaatgaaaagagaataaagtaattggcgggagacggtgtggagagaggaaagcgcctcaggggcttttgcttcgggcgatgatgggaagggagaggagaagcagccgctggagaagagcgaccgcgtaagggacaaaccgcctggggcaatgctggtcgggggcgtcgaattgtgtgggttggggaggaaggggatattgtatttatggtctattaatcgaaatacattataaacaagcatataaaaaattttttttctgattaaaaaactctataaatcattattctactta

SEQ ID NO: 5785 - DNA, 1150 bp, Heterodera glycines
atgaatggtgcacgacgcatcacaacggacgggcggcgattgtcccacaaaacgcaccacagcaaagaataaacgcatgggctgctgctgtatacaatgtgctgttgaaggcagaaacggttgtgaaaggttaaaaaattccttctcgaaggaaggaattttttgtgcccctgggctatggcaatcggcgggagtttttttgagtcagcactaaaaacggtaacaaactcaaaatttaattgccacaaacaaatgagtgagtattttttaatttgtatagataagacttgagagaagattttatgacagggtaattttggtaacagatcatttaaaggcataagaaacctaaatacgccgaaggcggattatgtgcgtgagcatggctaaagcatgaatttttggaggagggggggggggggtgtttctgatactgcttaaaaatgctcaattctgctcaaattgtatttcgcctcgagcgtcattccccgcgaatctccgctacgggaatttgtgaaggcggaaggagagaaataacgggagaactttcttatcgcccgcagcaaaatacgtagagggaataaaagcttgaaaatggtaggagaataagtgaaggaagaaccgatggaaaagccaagcgcaaaaaacaaatcaaaaattaattatttaacaaaaacttttaacataaatgtatgaatatgatgaaatatccaatctccttctccggcggggactgtgccaacgacggctcaacacaaatgccgacgatgccttcctaattttgttatcattttttcgccttttcctccgccccttaatgcatcccaggcaaaaggagcagcagcaatctcagcacaaaattcaagcgacgcattaaataatcccaatctgtgccttctgatgggccgggggcgtacacagacagagaaagaaaaccttttgtgttgttaccgaagacgaagattatatacagggacatagggcagtaagtgattgaaatttgtcaaaatcagaacaccgggctcaaaaaatcggattttgggttcgaaaatcagaatgagctgacaccaaggcattgtcacagaaaacattcgctaattccttacaacaaggatcaaaaagagggtagccagatgaaaatttcaaaaga

SEQ ID NO: 5786 - DNA, 8222 bp, Heterodera glycines
ggtttttttgtgttgtcaaagaaattgaagaaagggtgagagaaatattgttaaaaaaatgagtgacagataggagagtttagggagaacgcaaacaaggtggtagagagagaaagggaaagagagagagagagagaaattcgaaagtgatagagaaattgaagaaaacgagaataagaaaggagatggaaaaggagaggagtgaaagactaattaatgagagtgagagagattaatgactaatcagagagtgagtgtattagaaagtgagagaaggagacagaggaagagagagagagcgaacgaaataaggaatattaatagtgaggaaagagagagagagagagagataaagggagagagagagagagagaaagggacaaagagagagagaaataaagggggagagagagagtaaaagcacaggatgaaaaatgcccaaacttggctaaaaaaatttgaatatgaaacaaaaaattttatttaatttcaaaccgaaacccaactcataccgtaaacgaatgaaatcattcagttatcgtaagaacagcaaaatttcattatttaccttttttcgttttcttctatttttggctttgggttcatttattttatcttccatttttcgtttggaccgtaccaccgcctccccccccccccttcttactaattaactaattaatacgaattatgaacaagaattataaattgcatttttcagtgtgtgtaaaaatgggtggggaattcactgataatcaaaacgaaaatgatttggtgacaaaaaaggcaaaggaacgaatggaaaaaggaggggaatttaacaaattagaaaagcaatttaaattaaaagagcattttaaaatttgattgaccaatccttggaaatgttttctgttagtgcttttagcttttttaggctaattaactgatttaaacaaattatagagtctttaatcaaactctttaacaatctcatttatccccccccccccccctcctcaaattggtcaatcttccgatcgtttttcctccactgaaaaagcaccatattattttctctccctcccccccccccgggggattcgtttttgtccatcgattgattggtccgttggtcgggcgaaactctctaaatttccccgtactatctcttcattctctgctatacagcctctctcatcttacgtttactctctctctcctctttttttattatgttaataattctgtagataattatcaaatcagtgcctaattagttgaaagaaatgtttaaaaaagtgacgaaaaaagataataaaaaatattgttctttttctattttggataataattcatttaattttatttttattcattttcccctaattactttttgatcaataaattaaaaaacatttatatagattatttgcctctgttttttttgttttgtttattccttttttaatcttttcccttttttctccccccccccccccctttttttgcactttttgcccattggaagtgtctgctgctgctgttttcctttttcctgtgaaggacgtctcgaaaatcgcttcgtccgccggtggctggctccgccggtcaccccgcggggaatgcaatgggcggggaggggcgggggacagagttttttgggctacggtcatagggcagcggcggaggaggcacaaaaacatttctttgagttgggctgtgctgtggtgttttgttgtgggttttgttggctgattgctgattcaattttttatcataaatattttacatttttttcattttatttaattaacttttcaattttttcaatttatttttaaacttttttcgactgttaaattattaccaatttatttttggtgttttttattccaattttattttttaattatcgcttcttttttggtttctaattttgagcttttcgtcatgtctgggtaatgctgttgatctttgggtttggcatttattatctccgtttctttttttgcttccaaaattaattttggcgcttttggtcattttctcacattttttttgttttttctaaaaataagcgcaaaaactcgtctggctcctctgttgttttgtctcctaatgactttttgtgtccattttattattatgcctgtttggccgttttggccaaaaaacaatcgctccttggcaacgctttgcaacatttgaaaccaaaggccattcttggccaattaatggcgtgtgatttgcgcgcattccacgtttggcatgtctgagacgaaaataaaaatgttggcacaattcggcgcctcttaaatatgcgggaaataacggcgaacagaccaaacaatatgaaaatggcacaccaattaattcatttgtggcggaggcgcattggcacaacgacactttgcaaaatgtttcttaccgtacattatggcattttcccttgtatcatcctcctcccattttgtgccaataattaattacctttgtaattatgccgcgggccaaatgcaacaaacgcgacaaccgttcccttcatcattttgtcccatcaaaaagccattttgggacgaattttgagggggaaaaatgcctccggggtcggcggtccgccgtttggccaacccattcattccttcattcattcactttactccccgtctaattcatgattaaaacgcaacaccaccgccaccggcaccactcccttcggcttctgctgtggccgaaaatagctgacacccacagattagccgccaccgccgctctgccgagggcaaaaaccactcattccttggccccgtcccttcgggggttattttcttccatctgccgccgggataaaactcaaaaaaataacaccgggagcggattaagaagatccaaaaccaaaccatcttcttcttcttcagcgttcattcgttctttttgctttctttccctcggccaaatattttttggcattttttgcaattatttgcagaagcttagcagagtaatcatgccaaaagtttggttgactgtattgcgctttcattttggagggattctatttaaattttagggttttttaatttgaaattttaatttttggctatcaaataaagagccaacttgagggtccaacgacagcagctgaagaatgactttccgctgtttttggaggagttttttgcagaaaatttcttctccctttgcctaagcaatttttcttctaaaaccagtccccccctccctctctctctcccctattttcctcccctcgccaatgtccgtccgtccctctccttctccgaccatggcttgtgatctgctcctcctcctcctcttgctgctgctgttcggtgcttcgttcttcaccagcgacttttgttctctcgcttttcctctccgtgtctgcctttctttttaccatactatttttttcctttaactttctttcacttccgaaatgcacttttctctccctgtctttcttactttgtctccttctttcttgatcaaatgctttttttcttttgtctcgtgtccatttttctataacctatcatttacctctctccttctctctctctctctctctttcctcttcgctatttctttctttcttctctcgattgggtttccttctctaccgccatttatcaatcaaattaacgaattttttcaccgtagcccttcggcggggtaattaggtgtttccccgcccgccggcgacgaatgaatgaacgtcttcgcctctgctgaacttcagcagcaacagcaacaaattggggataatgggggaaaaacgatgccgtttttgactgactttttcggcatttgatttggtgtctttttaaactttgtccgtttatctgtgaatttctttttggcatttcaactctttttttggcatctcttaaaaagtgcgttcatcggtcaccgatcaatcgatcgatcgttcgcttcgctttttccatgtaaaagtgtccaatttttctctttttctgctgctgctgttcacaatgaatgaaaatgagagcaaaagtcgcacaatttgcacaaatagggggagggggtgaagcttataattcgtttcgtttttggaagaaaatccatcgacagaaaataaataaataatccatgcaaaaaacaaattggaaaatgatttgaaatcgaaattgttaagccttcgttgtaaacacaaagcatttaaacgttatgttctgtgctgatcagtgtccgctgatcacacacaaattttcattttggattttggtctttcctgaaattaactgatttaattgcaactttttccttttgatttctttatttgaatctgatcaaatcagtcagtccaccaaatcaatggtccgatcagcggagagtcaatgggcggggggcaattggcacacaatttaaaatattccgaatttccacttgtttttttgcccataatttttgcgcgtttttctgcgtctctgccttcctgtttcgcctcaggcgctgcctttttctttcgccgctttctctgtctgtctgtattccgtttttctgccttcatctcgttgtccagtcaatcttttcttctctgtcgctctctcctgttgcctctctctctctgctctccgttggctccgcccctttggctccgcccccggggcaacaaaaaacagcgaacaaaatgtgttcttcgccctcgtccattttcacaaattgcgccttaagaaaaacacttcgccccgtcggggaaattaagtggctctttccgaagaaagaatgggcgacgggggaaagggctgatgaccttgcgaaaaacgcacccttttcaatgccaaaaaagtgccaaaaaaagtccctaagggcaaaaaaatcaaaaaaaattctatattaaaacgtacgccataaaacttttttggacaaaaaacctaattaaataaccgtttgtatgggggcaaaagcgtttttatgaacgtgtggcgatgctccgccgctccgccaacacttcgcttgaccttgcggcgttaagcgatcgcgtcgcctcccctgggggaaacggagaatctccccccgggttgggtggcatcaccttgagaggaaaaacaagtggacagatcagatcaaagcaaacagatcaaacggcattttttgtcttttttaaaccgaaaatatttttatatgccaaatttaattcaaaagttacgataaataagctacgctcttaggcaaaagcttatcagcgcgttgcttggatacttttcaaatataccaaaatttattagagataaaagagagcacaaacaaatcgcctaccatattcattcatttcgtttttaacggtatttctcaaacaaaaataatttttgcagaaaaaattgtttttaaaatttttaataaaaacatttttattttttaaaattccaaatcaaaaaagctgatttaattattttgttgcagaatattttcctcaaaaaattgatgggacgaaaagagggaatttagtctgttttaattccaaaatatttttgatcggagattttcatcagtttgatcagtcaatttgtcagacaaacatcgtacaaatcccccaaaattgtatgttcgttcagaattcggtgtccaactcatccgaatccgccagcagtgatcagcaccagcaaaagccgtccctcgtgctgcactcgtcgacagcagccaatcgcccgccgatgttcccccattcgctgctccagggcttcactgcttccgcctcctcctcgtcgtcgtccgccgcctcgggcggcggtgccgtgccgaacggcgctgggggcggtgccgtctccggcgcttcgcccgccacgccgtcgtcgctgctgcagacggacagcaaaccgtcgcccaccgaaatgctgctgtccacgtccgcaacggtgccgcgcacattaatgattgttaaattaatgatcaaaaaggcttccttccattcattaattgcttttaggcttccgcgaccgccgctcaattggccgttgccgcacaaatgtcggcgatgaccccaaatcagcagcagggtgtgttcagttggaagaaggaatagtagggtccaaacagaatgatttgatgctggaatctgaagcagttcattcgcaaaaaacaacgaaattcccggctaaaaaaatgctaaaaaccccaaatctttggaattatccatgtaaaaattgttttgtcattttgttggtcgaggcggactttttgtggcactttttttttaaatcgtctcttcggccaaatcactccatatttgatcctttcccccttttaggctccaatcgcgagccaaagccgttcaaatgcgggcactgtccgaaggcattcgccaacaattcctacctctcgcaacacatgcgcattcatttgggcattcgcgcgttcggaccgtgccaattctgtggcaaaaaggtggcacaaacaaatttcgaggaagacaaatgaacaattgtccaatttaaattttaaaaaatgcataatgccatgtcttcttctttccccgatcagttcacccaattgtcccacctgcagcagcacattcggacacacaccggcgagaagccgtacaagtgcaaatacgcaaactgcgacaaggcattctcccaggtatcttctgccgatgactgacgtactgaacggcacaaaaccattaaaaaaagggggggggaggtaaacggagaaagcatcccccccaaattttgaaaaagcatttgccggatcaaaagatttttccgccccattgggtacccccaaacgagccacaaaaaaacaaaaaaattttgtgtacaaattgccgtgcaaaacatcatcattttccctctgttcagttgtccaatttgcaatcgcactcccgatgccaccaatctgatcggccatttaaatgcaacaggtctgaccagcatgggcttttgctgatctcttctctctgcctttatgtgcttactttatatgtttgcttatgatcatcccttgtttttcctgaatgttttctcctgatcattttcatttgatcagaaattttttctgttcattttttaatttcctttttccctgatcatttcttttcccattcttttccccttcttctgatgatcactttccctcttccaattgatctcccacttctttctcacttttaagctgttacaaatgcttcgctgatgaagccactctgttggagcacatcccaaagcacaaggagagcaaacacctcaaggcaagtgcaaaggcaagtgtgttgtcattgttgtcctcgttggagttgatgttgttcatcgccttcgtcttactgacccgacttgaaaagcttgtttttggatgcccccatgcctaattcgattatctgctgtttatcactttgagaatccccaccaaaaatcattgattacgccctaatttgtccatttaagagggtattattaattttaaattgtttattttccatttaattttccatttttcgttccctcatttgtcaggtgcacatttgtcccttttgtggcaagtcctattcgcaagccctttatttggacaagcacatgaccaaacacacggatcggcgcaacgaaataaggtaagccgaaaaatttgccgaaaatccatatcaatttttcaaaaaaaaaattcagcaaaaattactacgccaatgggctgaacggcgtggaggtgggcaatgcctttggcattttggacagcagcaacagtccgtccaccgttctgttcgacggcctcggcggtcatcttgggcaacttggacagcaacaacaacagcaacagggatcagcagcagctgcagcggcggcggaggaattcagtttaagtaagtgccatttgtggggagggggcaagtgccggacttaagcgaatgccaaaaagttgaatttcactttttcggtgtcatgacaactcgtacaatggcttaggctagcctaagatttaggcttaggcttaggcctaagctttaggcttaagctttatttttgtaaaatttttagtacgaattgcctttgtacgagttaccattggcccaatttttcaatctcactcatataccataagattgaaaagtataaaaccaattttgaggataggcgcaaatgccacaatcgatgcgcacattttaaaacaaaataaattgcaaattgttttattaatttaaattttactcgggaaataccgtaatgcttctttgtttcttttttattcatttgtgttaaccttgtccc

SEQ ID NO: 5787 - DNA, 1357 bp, Heterodera glycines
gaatatgccttgtatcttttgcagtccgttgtgccttctaagccggggcgggatttgctggtcccatgcctaactcctgtatttatttgaaactgcggagaaaatcccatttttaaaactatgcaattcagcaacactttgaatttgcgtgtcccctaatgcagcataatttaaaagaaacggttccgccgcgattaaaattcgtccgttccgttcctttctacgcttttccttcatattcacctgtttctgcgctccttcgccgcttcttctctttccaatttctctaaatatttttctgcttgattccgatttttctcagtttcttgattattttttttcactttttcataattttcttcgctcattagcattccgtctatgctaacaaattggcttgtttcgccaaacatcaattttattgggccgtcaatttgtggtggattgccgaacaaatcgcgcacatattttgatcctacatacaaaaacatttattacaatagaaaccgtactatcggtcttttaatcgatattttttgaattttttcggtcccatttttcgcttttgtattgaaataatattcatttttttaggtctcgataaatcactagtaaatttcgaaaattttcactacattttatttggaaaaaatatatattttatttattttggacttttatggagaaattgccggcttaatgccggacccggtagaaaaaaatcgctgataaattatcgatctttttggatttttcgatattgtataggaaaagccgatcgagctattttaaaaagcgcataatcataacattccaactccgataatgtttcggtcacgggttttgctattctcggccaataatattatgcttaccggacttcccttgcttcacttcgattttgacccattcgcccgtgtcatccatgaactcggcaattttgtcaagtccattagtctctgttgggtatttctcttttacatcaaattgtcctcctaccgccacgaggtgttcggcgtggacaggcaattggtattttgtccaactgtaaattatctctgccggatacagaatttccgtgccatttgttcttaaaaatcgtttcttcccgccaaatgtcaaatcctttggttcttcaatttgcggcagattaccaaacaaatcgcgcaaatatataaccactgaaatcaaaaacaaaaaaaaaagtcaatttgtataaaatttggtgtcttgaaaaatgagaaaattattttgtttaaaaaataaatatattagagcccggaattttgaaagtaccgggcccgggaccgggcttcgacaattgaccgggaccgggccgcccgttaaaaaaaagccc

SEQ ID NO: 5788 - DNA, 3815 bp, Heterodera glycines
ccttgctttacttcgattttgactcattcgcccgtgtcatccatgaactcggcaattttgtcaagtccattagtctctgctgggaatttctttttaacatcaaattgtcctttcgctataagctctttgggatgaacaggcaatcggtgatttgtccatttgctaattggcacttttgggtactgagtcggcatttgattgcccgcattgtccgcaaatggatcatgggaattcttttttttacgtggtttagaagtagtcgttttatcatttggtcgtacggtttctgtgctatttgccaaatttgcgggagcaatggccatttgttgagcctgattttgtgaggtatcccccaaacttaacatatcgagactaagtacttctgttggcaagttatgtgttagtttggtttggccaattggttgtggattaattggtatttggtaattggtttgggcaattagttgcggatttggattttgataattggtttggccaattagttgtggatttggattttgataattggtttggccaattagttgtggatttggattttgataattggtttggccaattagttgtggatttggattttgataattgggttggccaattagttgtagatttggattttggtaaattgtttggccacttgcttgtggcttaatgtgcaacgattcgctggacatatcagcagcagcagcatttaatgattctattaaacaatactaatacacgttaattaataaaaatgaattacttacttccgtaatattgaatcacatatattattttattaggaattattctttttatttaagaaacccaatgaatacgttcttggatggccaaatcgtttagctgcttggtaattggttcattttctgcaatgctaggccttcgggttcttcgacttttcgtaatatctactgtttgcctcctgctggaatggctgctatccgcttgggtactgcttgagcttgtgacatttgccgcttcggctgacgccgtttcagccgctctttccggcaaatgccatgcatttgccgctccttttttgttctgtccaattgatgatagatcggtcagcgacggcttttgatttgggcgatcgcgcgggggcgaagcgtcgaaaatgggcccattttttgaagcggcttttacttgactcaatggcacgcagaaaaaggaggcacaaaaaaggaaaaaaggaagcaattccatgggagaacaattcctgaaaaaatatgaatatagtaaatgatatgcataaaaagaaatataataaagccaaaagaatttttgctttgaaaaatggcaaaaaatgccaaatcgattgccaacgcacttaaattcattttcttatatgctctctggctgaatctctgcttataatatagacgtggctttacgccgctgaaccatttccttgaaaaactaatactgacaggcaattattattaatattaatatgtagagctcgacattttgaaaaaagcctggacctggattccatgttggacctggattccaggtccaggaaaaatccaggctcatcgagacctggatccaggatttatttgatctttttttgaaaacttgaaaaaacatcggtcacttgaaataataaattctaaaaatttgtccaggaaaatccagattttttcgggttttgcctggacctggatttttttttcacattagacctggacctggatttcctggacaaaaatccaggaaaatccaggtccaggaaaaatccaggctcctcgagacctggatccaggcctggactggattttttgaaatttgttttaaaaagcaaataaatttttgaaaaaatcaattaattgcttgggaacatctaaaaatatctaatttataatagacctggacctggatttcctggacaaaaaatccaggaaaatccaggttgccgaaaaatgacctggacctggatccaggaaaaatccaggcctggatccaggtccaggtcgagctctattaatatgtattataatgtgtttattttcactcgtttttcattttatgaggtaataagaaaaaatataacaaaaatttttaaattttaagccaaatttatttgaacaatatttgacttttgtaatatctttttttaaaaataaaatttttttaataaaaaatatatttgaaccattttttaaaaacaaaatagaaataaagaagaaaaatggaatttaaaaatctgagagcataggcatacgaaacgagagcaaatcactgaatcaaaagaaaatttatgtgtaaaattcaaaaaaaaatatattaaattttacacaaaaaaataactttttaattccgtggaatgctcggagagacacttccagtatgaggagggagttaagccgaacgcatcacatcgttttgaaaatgtcgtttcatccaaaaagcatatcacaaaaccctcaaaaaaaatggaaaaaacactgaaaagttcccaaaagcgctgaattgtcacacgctttcatgccaagtgtccatggagtttcggaactaaattttacatgtattggggccaatttgtcggacaaaagtgcaattccttggtggtaaagcaagaagttttggcgcgacattttggttattctgttgattggcattccttttgcggtaaatttttggattttgatttttttaatgtcaaatttgcagtttttgtctgagaaaataaacaaaattaacaacaaaatagacgaacagcaaaaggtaaattcattggcaataaattaaaatattttatttgaaggttttccttttttcaggcgatcgacaaaatttgggatcccaaagaaattcagcaggtgtaccgatttttacaaaactgaatcatttcttttgatattttcttcaaagttcattattagggtggaaaaaaggacctttgggaaaatttttagaaaaagtttataaatggaaaaaattttcaaaaattaaaatgggatggatataaattgtctaattcggataagtaattttgcatattttcagtcatttgtcagcgcatcgacctatgagaaaatggcattttttgtgtgcggaatcgtcgttggcttcacactttctgatcaaaggaaatgccaacaaaatttgggcggaaaaacaacataaatgcaaaggatgatgaggaagaggccaattgaaaagaaaattggggaggaggaggagagaatgggagacgagtggaggcaattttagaagcgaatgatgagcaagaaaaggaggaggaggataatgatgaacaggaaaaggaagatggaagtaagtgaaccatttttgagcaattggaagggatgacgaacgatgaggaggacaaggaagaattcgacaatgaggaagaggaggaattggaagaaaatgaaggaaggcaattctggtggccaatgatgagagagaaaagggggaggagaaggaggaggaggaagaattttacaatgaggaggaggaggaattggtagaatgaaaaggaagaatttgacaatgaggaggagttgacggagcagaaggccatttagtgagtagcattctcaccgagaaaaaatttttacaaaacaaaattttttttttgaaggaaatgggggaattcagcgaaatttgcgcatttttaagatttcttttagcttttcggctccattccccttggctttacactaaatttcattcatcaatgaaaaaaaataaaaattaatttgtctacatttttcagcaaccgatggcacaattgaagaagggaaaagagaaacgacgaaatttttgcgggcaagttcaaaaga

SEQ ID NO: 5789 - DNA, 2062 bp, Heterodera glycines
aatttcgatgaatttaaaacgaataaactgggatgtaaacggcaaaacatgaacagatttttctgtcaacgcacgggcatccatggcacaaaagcatcgcctttcgtcgcctataaaaaaaattaaaaattagcaaaaaaaatccaggaatttgtgtaaacatttgactcaactataaaaatttccaattttgagcatttataaaattttacgagcatatgaatattttaaggccgggtaaatttttaattttagataataaaatttgcgttcaattcatttttgttcagtgcaaatggaaactccaccttgaaaatttcgttattcagcaaacccatcacaaagtacagtttttgtttcacttcttgatcagacaaagtcgacgcgaaattcagacggaccctttccgccagctaattataagaattaagttaaattcagaattaaatgtaataagtttggtgcattagcagaaaccatacacaaaggggaggggcaggggtccgacagagtttgcgagggaatgggctgggggggggcaaaaattcgaaagaaggtcaagccatgtaatggattttttaattgtcagccaccctgttcgcgggtcttctcgaaaaattggatagtaaaggcgacccggtggcgccgcaacacatcgtcggaaaaattaaggtgaatttgttaagaatatttgtataaattttcaaaaagtttacttctctctttctcagacgacctaaccctcttcacggcactcctcgtcccgaaccccccccccctcactgggtccacaattttaaacttagattttttattttcaggttaagagtgcataaaactcacaacattgtccgtaaaattgtagtagtgaatgaagcacagagacgacaaagtctgattagcttccaaagcaattttaagatcgtccttcttaaccaaaagctttgttagaggtgaatttgagaaaatacgctcggtactagtttagatggtaccccccccttttttagggaaaatgtttttttgttttaaatccatggaaagatatttcaaagggtttttggggtcgctaataatgaatgttgcattcgtttttgcctatttagaactcggagcccaagttcgaacaaaaagtcgaaaattggaattttacaaagtttacttttatgtccgaatgactattttttggtgtaataatggtttgtgattgtttttgctagtcttaatctattttagaacaagagatttcgaaaaactcgaattttccgttttttgttcgaactcgggcccggagttctaaataatcgaaaaagaataaaaatttttcaattaaaaaaaaaggggggggggggtgccttcgaaactaataccttacgctgctcttttaagcattacatttgtaaatgaataagaaaattcgtacggccatgcgtgcggtgcgaccaggcggcagttgttcagcatcgatggtgatcaatagtagaaacaaaatggggtcgggggtctacgggaatacgaaatatatggatattgtgggggattgatgttgagccaagtatggtgtgttgtccaaatgttgtcaaatgttgggacaaatatttattaagaagtaaattgggaaatcggcggaagaaaatggagaaacgatataaaattagaagagaactgcagcaggagattaaaatataaaaacgactgaactgactgaacaacatgaatgagaaagaataatgaaaagagggatcaattttgggactgaattgggaaattgtcaaaataaatgatcgcggtaatacaaaaatattttaaaatgggatcttttgtccgtttggtatgacatctttaaaacattttttgggaatttttcccgcgattaaattccgttttttaaataaatttaaataaaaaatcattagaaattttttttttataatcacggatcaccacggctcacggatcacggaaatcacggggattttggggtgctgtgatcacggttcacgggtcacggattttttttaaagccccgtgatcacggctcacggatttccgtgattggaaa

SEQ ID NO: 5790 - DNA, 5493 bp, Heterodera glycines
cttcagttgccattttttacaggccaggggtttgctctttaaaatttttaaaaaataccaccttgtagaggacccttaggcggagtgccctttcagcgggcactttttgattcgagttttacaaaaaaagttaggggccttcaaatgcaaacaaaagtgagaattcagtccctggtactcagttggccctcggatcaaaaaacctatagttttcccagatgcgcctcaaaaagttgtaagacccttccaccactttcagggcgctcccggccttcggccgggagattttgttttttgaaacgaaactccttgtcaatataacgtatatagtaactagcgtgtgggaattgacgggggtccggtgcagcagttgaattgcacgcgcagtgattgcacggcgtataaagtgcatttgaaaatgcattggattgtgtgtgttgaaattagcgcttcgcgcaaaaagacttcgttgctagtgcttgcgcggctactttaagcagtttaataatggattctgccccacctaaagtgttcattcggccgcttcgcggcctcattttttattattcttaattaattaattttaactaatatttattctaattaaaacattaaaatattatgctgttttaaaattcatttaattaaatataaataaataataacaacatatgcaaaaataatctaaatagataaaagttacttaaaaatgcatgcacttttaaatttttctttatttattttatagaaaaattattttcattttttaaaaattgaattataaaaaataacaaaaataattttgacttaataattagcattaaaatatagcaaaaaataaatcaaaaaatgatttacaccgtccgggttcgaacctgaccaacgcaaaatgatgcctcagaatccccaatcacgcagggattctgaagtcttaacgatctctaaagtgaaatctgattacatattcgtgatcagcggcccaaataacccctaaaatcattttttggaagatttttggtgaaaaaaattttccacacaaaaatcatggtcacacccctttgatcccgaatccaaaaatcacttttatttctataacttttttcaaaaaagtgataaaaagctaaaataaaatttataaaatagagcaaaaaattgtggattttttgagtttattatttttataaaatactttttcagaaccgagttctgaattttattatgaaaaatcgaaaatttccagaatttctggaataacttttattgtttgcaagatcgaaatcccaaataaatctcaaaaaattctccctatttttctctattttttaaactttaaatggactgaattggacctttttgatgggagttatgaattttcaaaatgtagcttaaattttcaagggccaaaaaattttaaaatttcaaaaatttttaaaaaattccaaaatgtctataactcaaaataaagtccatattcatgatcagcgacccaaattacgtaagaaaatatgtttttttaaattttagagcaaaaaaatgtgtccatgaaatttccaaaggggtatccctttggattttggctccaaaatcagttttatttttataacttttttcaaaaaagtgataaaaatgctaaataaaatttatataaaagagaaaaaaattgcggattttatcaatatttttgtataccttagcacattgtttggaatgagttatgaatttttatgtgaaaaatcgaatttttcaactttttcaggaataacatttttcatattaattgtagaaaaatgcaaaaataatgataaaattctcccaatttttctgcattttttgatcatttaatcttcacatttgacccatttcaaagggagttattaatttttgaaaattcccccaaatttcccctgggcgaaaaatgaaaaattcaaacacacccaaatttggtcaaataaaaaatttaaaaaattgaaaaaaatatagaaaaattttagaaaatatttccagccccttagaacatcgttacacgtcataaaaaatcatccacacgccgcgggattcgaacccgggcccccctcccggggggcccccagcacacaccactggaccaaccggttctgcagggaaaaactttttttgagttttcaaaattttttttatatcattcgaaagctcttgaaaagttgcaacccaaaagtgccgtgcgtttttcgatggcgcaaatgtaaaaaaaattattggcaaaaaaccgaaaaaccgtcgagggggcctggattttttttggtcgaaaatttcaaaaatccaaaaacacggttggatgcagctcaaaaagatgcactgctacttgtcagggaaaccggctccgagcacttgcggccgagttattcacgaaaaacagaaatccggttttttgggtaccaatttttggccacctgtcccggtcacggatttgctcggatcgaaaaatgtttgctggcaatgttatccggcatagtccaactggatttcctcccagcaagcgtttttcgatctgagcaaaagcaaaaaatttcgtaacactgagactgcaaacaggggccatttcagcgccgctggcgctcacctggccaccggaccggaaagcccgtatttttcctgaatccgcctcaaaaagttggtcgggacatcgaatttgcaaagccctcccggcgctcgttaggctcaaaatagcaaaaaagtgcgaatccccacttctttctataatatataaactagcgggtgcgtgaaccgtcggatctgggcttgggataaagcgcttcgcgcttcttgagcttcgctacctagactgtgaagcgattcaaattgatcgaattggttggagattttttttttgaatttttaaaaaattattagaggcttttagtccacatcgaggctcaagacgggcgcttcgcgcccgttttttaaatctgttgaacttacacgggtgcttatcgcccgatgcgcaattttcgcttcccttttcttccaagtaagagtttttgagttaaaggctcgtgaaagtacgtcagcaacgtgattctctttaatggagcacctaattccatgatccatctgtctacttttgaatttccgaccgaatttttgcttttgaacatttggggaagggccttatggtcggtatatacgattgttggaagccatgcgataaaatgcttaaatttttgtacggcaaattttatgcctaaacattctaaaactgttggcccataatttgactcggtttgtttacagcgtcttgatgcgtaacaaattggtctcattttcccagattgatcccgttgacaaagcactgcacctaacccatctttcgacgcatccgaaaaaatatgaaatttaaattttggataattttgtgccaaattaaaatccgggtatttaagtacaacttcctgaacaattagcgattttaatgattcaaaactcttttttgcttcgtccgaccaaattaacaccttagcatcctgttttttcaacatttttgttaaaggtgccgcaatttttgcaaaattcataataaattttcggtgccaattgaccattcccaaaaatctttgtaattctttgattgtttttggcatcggaaattctttgatgggtttgtatttttccggatcttttgcgagtccttctcgtgtaagaatatgtcctaaatatggggtttggtctaaagcaaaaccacatttttctgccttgactttcattccgttttcattcagtttttcgaaaacctttctgagatggaccatatgatcttcaaaagtttttgaggctattaaaatatcatccaaatagacaaaaacaaaatcattcacaaattcgcccaaaattttattcataaaacgatggaaggtggcaggagcattacaaaggccgaatgggaggaccaaaaattcataaagaccaccaggtactgtaaacgccgttttttcaatatcttcttctttaactcgtacttgccaataccccgacattagatccaaaacagtaaaatagtgcttgtttcccaaatacatcaaaatttggtcaatgttcggtattgggtatgaatctttgattgtcacactgttaggttttcggtagtctacgcaaaatcggattgagccatcttttttggctactaaaacaattggagatgcccagggagagtttgatggtcgaattatttcccgtttcaaataatcatttatcatttctgtgacttttgttcggacaccgaatggaattggactaggagcagttttaattggggttgcgttttcagtttttatttcatggggaaataaatcggtttgagtgagttcaaattcatttaatgcaaaaacatcagaaaatcccagccaaaattgttgcattttatccttttcactgtctgagagagcaccaattttgttgttcagaattgaaataagttctttatttctcaaattccgttcgaattttgcatttcttagggttgattttggtcaattgttttaaaaatcgaaaacaggctttaatggaatcaataaagcaattagcgtaaaaccggaaataaaaatatactcacagcaaacaaattaaaaaattcagcacgtttcaaaacccaactattctgattttaattttttcgtgtaacttacaaatttcagatgacaaatcactgcgtcttctatttcttttgctttattgcattccataactagcgcttccatttctggtaatatttgtgaaacggctgctccccaacaaacgcccacgctcgcttcggtttttctgaattgtccagcaccgtgtttgtgtgatgccgcgattttgtgcaattcatggaaggtctcaaaagtggataaattaaataacgaaaccaaataaaattatatacattgcacatgtgtattgaattaagcgaagaaaccattttttcattgtcaatgacctcaactcattaaatatttgttttagaacaaaattttgtgaatatcgagaatatggccaaaattaacggcaattaactcctcccagtctgtctttaaccacccaaaatttaatctttttaaatttgccattttttccttttctgattgaacaggataaaacaattttaatgggttttgtctcataatataaaatttgctaaacattcatgcgtttttttaccgttggacggttcaatcccaaagtcatttggttatatcagttccgggtttgtaactattcagcgattagttgccgcaaaaaaattctttcgtgtttgctcattagaccgagaggagtaggattcaagcccaaatagaataaataaggcaaacttacccttaaagaaaacgggttgttgagcaaatcttcgcgttttttcagctcatcgttaaagaatttgtcgttgataaacggcgaagcgtcccgggcgtttcgagacatttcctcgagcctttcgccaaaatcgcccacgcggcctgggtaacggctttgatgacttcc

SEQ ID NO: 5791 - DNA, 1680 bp, Heterodera glycines
  misc_feature (573)..(573): n is a, c, g, or t
  misc_feature (675)..(675): n is a, c, g, or t
tttcacaaataaaatctaccaacaaattcccattttcctgtttgccagtcgcataaattaaacaatttcttctctgattctttttataactcggaggaacagcgcaatttttgcggaagcattagcgatgaaactttgtttgattttgaaatggacaaagatgaatcccaagtgacaacaattgcgcatttcggtggagaaaacggtttagtttcataacttaatttaatcgattttttttcgtgctttagcgccgacaaatggcggtgccaacaaaaatcattttggccttggattcggaatattcgacacgatggacaaaaaaggcgacgatgatcacaatttcctaactgttcccacacagcaaaatgagacggactttggcatggaatttgacgaaataaataatcgaccaaacctttttgggagagaaaatgcattcgatccacgctttattaatgcaacgtccgatcagattggtgcgcacatggaataccaccaaatttgaggaaaagagtggacaaagaaaggaaaaggggggagacggatgaattcgaaattggcattttctgngggacggaccttaaaatggcaattgttaccctgcaatttgatggtctccccccatagtttcctttacacgattcaattttcattttcacaatatggtcccanattttcccaatttctcttccatttcctatttattccgattaatttgtgatatttattggcattttttatttaagtgtttatggcgattacattgtaaattgactcattcatttactaattaattaacacagttaattgcttccttttttaatattttgcataattccttctcttttgtgtgttgatttaacatatacctaaatcatcctccgtctgttgttttattatttatttgtacttttctcgtttgttttctccgttttctttgctttcgctaaacgtttcttttctcttctgtcaattccaaattcaaaaacatttcctttcctttgcacatatgtattctctctctctctctccattttcttttgtgaattggagtttatttatgagaataaagtcgtgttgttaacaaaaaaagtcaggaggccattgctctttttaccgattaattttgacaaaaattggttctactaatttctggatcccttatttgcaagagttagtttagcttttgttttttatccctctttaattggaaaatcaacccactttgggtgtgccatgattttccggcaccgtttaacgccctttggttaattgttttctattggtctgttttttgaatagtctccgttcgaccttcgtccattcccttttatttcctacgaaatcgcataatcattttcttgccgttttcctttcgccggccttttccctttctctttgccctctttctctttctcttgcatttgcccttctctcctcactctgtctgtctttctcgctctcctctctccgcattgtctctctcattctcgtgtctgttttggctctaccccccgggggattctattgacagcattcgccgcttctctgcgctttctctcattcgctcactttttgcgggaaatttctttttctgagttggacgaggacagaaaaagaaattgggacgggaaaaggcggcggcggtggaaaaagagcaacagcagagagggagag

SEQ ID NO: 5792 - DNA, 5058 bp, Heterodera glycines
  misc_feature (5050)..(5050): n is a, c, g, or t
agtaaaactaattattaattagaataaaaatatctattctgtacaaaataattacccaaattattttttaattattactatttatacaaattcggcaatctctgaacgaaacataaaatggcacaacgatatgaaatgaggtgcaaattcgattccgttttttcttttttttgtgagtgttattaagcaaatttagtggaatcatcgaattggcgtcgtcttcctcctcaaattccattcagcagaacaacgacttgcgcattttgcgaaattcgcttaaatcccttaacattatgccgaccgaagaggacatccgcgcgaatgtcacggttaaaccgccatattccggtcaatcgggcgaattttattttattttttcataattaaacggtctccaattagtttcagtctcaacaaatttttggtgcttcgtttattactacgaactcaacgaaagggtaatagtaaaaaattgcaaatgttttgtcttgccccatttggtgccgaccattcattttcttgcattttttcaccacttgaaggtcggcgaagtgttcaaggccgaatggcgacaacacgcgcaattcgaacaaccccagtgagggaggggggaaagggcagagaaagggatggaataatgggggaggaggagggaaaaatgatgggaggggaagcggggatgaaggagggagagagactcaatggtggcaagggtaggggacacaattagggagagaagtaacgggatacaaaaattggagggggggggggtgatggtgagcaggggctaatggagtgccaagtagcaacgagtgggttgaaggactgcaagcggcaactctgatcaaaattggcaggttgttcatcgacggcggcgttagcggatcgtacgaaaacacgcgctactgtttgggtaaccgggggaaggaattaaaattaattggtgactaattgtgttttgaagggatcatcggcaacatcaatcggaatccggtagtgagtaagtgccaacgaacgaacctcaaaattccctttctctttcgttccttaagctgatgtccgccagtccattggtcagagaaagtccctttgccactaattgcttttcccttttcattgcctcaggcaaaggccttcgattgtttcagcgcaacgaaaacatttacttggaatgtctaagcgattctgccctttttgtccgtaaggcattgaccaattaagcgaattgccaatgtttctcacagaatgccctttctttgccaagagaaacggagatcatctcgcgaccgtttacaaattaatgaaaggccgccaaacggcgcattcggccgaatcgtcgggtgaacaaaacaatttaaatgtgaacgaatgtccaaattatgagaagagagactgaaatgatccgatggcttcctttttccgtcttttagagtccatttgcctttttgacaagaatatgttcgacgatttgctcaacgacgcctccctccggggatataattccctttacgccctcaacgttcgtccgtccgtcccttctctcaatttgaatttgcttaatgtttccatttgccttcagattttttgtcagtgtcgtatcagtttcgtgaaaggtcattagtaatttttgctaatttttgcttttaattggctgactttaaatgtttaggctggggtcagcagtaccgacggcaaaccataagtaagttatgggtgctattcgctgccaaacacttccatttcaatggtcaattgcttgctaatcagcttcctgtccgatgtggatcgaattgcaattcccacggccattacaaatattggacagggcactgatggaaagtgccagcgaaatcggcatggaagaagtgcacagcttttcctgaccaaatcaattcgtgatcagtggtgccttcggcataccgaattataaaaacaaagacattacccgtgttacaatccaaccgatcatttttcatttttattgaacaaaattcacttttgactttcgacccaacaaagtttaagtttggtaacacgggttgactaacacaagctttgattaatttatttgattcatataatcagctaaataaacttgaatttattgcaaattttacattttttttcaatttaacaaattaatatttttgaaatatcgaaatataaaaacgaaagcaaaatatcattgtttatattcaaaaatgagttcattcttggtgcagtgaagaatcaatcattcgttcttttggctttattttccccgcacttttcccaatttcgctaatatcccacggggcacgaatggaccctttttctgaagtcgttgttggccaccaaattaccctcgtcgtccgttagcaccgcctgcaccgaggcactaaaatcgcgcgagttcgttgtcatattatgcccccgggcacgcaatgattggagaatggactgaatattgaattataaattaaaatgatcaaatgttacttggggaaattcttcctcaaaatcagtgacaaaaggtgtgaattggttgtgcacgcgtggcgtgtcgatggcctccttcacggagtgattgaaggccaacagttggaccaacacttgggacagtgccgtggggatcattgtccctccgctggcaccgatcgcgagtttaacctgtggggcgaatgtgatcatttgtcggacggacttattgacatttcatttcatttgttgtttgccttgagtaagaagcctgttaaaggcgttcttagtctatcagctgaactacggcactcccttctctcgcccactaatgctcgataatattggattaattgtcgcctctattggtccattttcttcctctcggggaagcttctcctattttggcccctttgttttatttattacgtttagtgatacagtacggagtatatatattcaaatttgaattgaatctataccgttttcttttccagaagatacagtatccctttccgatagtatcccctccctctctccctccttccccctggtgcccacctttttgttctctttgtgataaacgatcagcggactcatcgacgacattggccttttcccgggttcaataaaatttgtctttgaaggtgccagtccgtaataatttgttctgttgggttggctgaagtcgtccatgtgatcgttccaaatgatgcccaattggggagatcggatcagagagccgaaactgaaaataatgcacaaattctgacggattgccaaacgattggccaattatttggccatcggttggcaattggtgccaccacttacgctttgttaattgagctggttattgacacggcgtttccatccgcgtccaccacaatcacttgcgttgtgcccccgctattttcagggaaaaacttaaaaattattcttttataattatttaaaatatgcaaaattgtgcctctttcgtcgattcggcaaaatccgcccatttggtcgcgcccattctttgaatttcactggcaatttcgtcaaccatttcacttttgctcatattcagcgcaatttcttccgaaattttgtcgaatttgacgtcgcctttaatttacagaatgtcttattgaatttttattttaaacttttcaaatctttttgcctaatttgtgtcgaattgcaaatgcgcgcttttgcgattcgatcaaacggtggtaataatcggcagaatgccaagggatcgatgcattgcttccggggggataaaattctaaaaaaaaattaaaattttaaataattaataaattcggcaccactcactaagcattacggccaaaatcagctgagtgatggcaaaactcgaggaaggcttcgcgccacagaagaccaatttgggctcggccgcgctcgtgaccagcaaaggctgttcgtccacaacagttcggtacgtgtgaaggtcttttcgcgtaataaaaccccctcaaaaaaattgaaaataaaaaatcaaaatccaaacctaaaaaattgctttgctttatccatttaatttttacgttttgttcccaatttttaccattatttgcaaattcttcggcaataattctggcaatttcgccgtttgcactgtaaaacagctgaagcggctcgtgactgagtgccaatcgtttgagtgtctcggccaaaatgccgtccctcatctgttcgccctccttgtaaaggtcgctggttgccggattaatgaagtggttccttaggaaaagtttgctttctaagtgcttttaatccctccgcccaaaattccttctctccccaaaatgccctcctcttcctttttttgcccacctcatccccaaatgggagctgttaatgattttctcgctgtacgtttccaaagtcttttccataagtttggagacgggaaatccttaattggtttttttttgttttttcaaatagatgagcatgagaccatcggtcagcaaatgaacagttggcattagcaaatccatccaagcgatttttccactgccaaagcgtttgaaagacgtccaaaagccgtgtaataagccgggagttgcgaccgatttgtagcccgaataaaaaatatttaacatttgtcaagcgctaattgttagtggtgttttgtttaccaaattgactgtcctccttcggcccattgccaaaagtgtctttggcggtacgcgcgggggccgtctcgcgggcgtcgattgttgtgcatttgccataaaagcttagtcaaataaaatgcatttaaatataattattattatatccttaccgctgataataggtcatcaaaaagccaccgccgagcccagccgagtgggggttaagcgcaccgacgcaaaaaccgaccgaaagtgccgcgtccacggcattgccgccttggaggagaacttttctaagaaataaatgaaacgaaaattaaaaataaatgaaaataattaattaattaaatcgatttaataaacaaaattaattaatttaaagttaaaaagtcttaaacaaaagccaatgaaaatgttttgccgagacaatttccgagccactattcctattttcgctngagcacca

SEQ ID NO: 5793 - DNA, 1772 bp, Heterodera glycines
aattatgaatttttctgggattggttgcggtttcaaattggcaaaagtcccggaaaatttctttaaataaaaaaatatgatattcttttgatttaattcttttgatttaattcttttgatttaataattcttttgatttaattcttttgatttaattcttttgatttaataattcttttgatttaattcttttttttaattctttccttacgctgtgaattccgtggtgttcgtaaagaatgtaaaggagaaaggcgcacagaataagcagcacaaaaatgaccacaacggcggatgccaaaagccaagggagtcccctgaaaggggaaaggaaaagcgaatgaatggcaaaaagaaaaggcaaaaaacggaattaataggggaaatgagtgattattgaaattaaaagcataaaataaatttattttttctataaaaatttaatttaactcaaatatttatatacctattataggtatattctttttaacaagaaaaaacttagattaaaaaaaaatcaatttttaaaatatttgtagagatgtcggtattccatttttattttctaaatatttggtcgaaaatttaaaaaaatacacattaaaatgagaatatttttcaaaatcaaaattatgatttttggaaggtcatttattttggtcgtgtgtaaaaaaagttccttggagtcttaacgaaaagaaattcttttttttagaaaaaaagtttttcccacccaatccgcgtatcactcctaatccattggaggtagatagggattctgatacgcgaatcgccaaaatgatccatggatcgcaaatggtaatatttatgcatacggatcgtatgcgagtctacgacccgaccttcgggtccatgtttcccttctaatttgggccatggatccggtctttatgcacacagacagctgactggtcctgacacgataaaagtttataataattatttaccctaattaaaattgcattaaaaatgaaagctgaataattaataaaaattatattcaattacattgtcttataaaataagtttaataagatttacgcactttttcctcatcaaaatattcgcagtccgttggttattattgttatgatgactattattgttgttattgttcgtattggtgccgtttcttgccatttttggcagatgaaaattcgacccattggtccgtccgctgctcggcattttgcagggcgacgaattcactgtcgatgtccctacaaatgaagtgaggaatttgtctaaaaagttcgaatcaattttgaactattcagtaggataggccacggtagtttaaccgataccgaatttctttttttctctttttcttttcctttcttctccttttccccattttccttcttcctttttgcttgcccgtttgttcctctgtggccattggtgcttcttccaaagtgtacatttgggggcggtgtttcactttttatgccgttattttgccgcgaaatgccacaaacggaagggggacgaatgtcggagaaagtgaccaatgaattggactgttggccaaaagtgtcgaccattcaaatgacgaataaaggagcagcagaataaaaattacaatttactcaatttatcaaattttttcgcggattttgcagaaaaatttttgtggtgagtaaaaaatatttaagtggcccaaattgttattttttgaggggataaaataatggtaaaaaaagggctaatgtttgggctgggatgaaacaaagggcccctggcgacgg

SEQ ID NO: 5794 - DNA, 6746 bp, Heterodera glycines
  misc_feature (107)..(108): n is a, c, g, or t
  misc_feature (6693)..(6693): n is a, c, g, or t
  misc_feature (6723)..(6723): n is a, c, g, or t
aaaaaattttaaaattattttttttatggtaaaattgacgttgctcacggatctggcaaaaagattgtttcttttaatctctgactaacatctgcaatgacttctanncatttatacaatagactaatctttgaacagcagcgtcgctgattttatgcctttttcaatgggacttaattttgtatgtcatcgaaatggatccgatttaatctaattaatgcgctttttaaagttttgttttttggatttgtcttgttattttcttttttccatcattagacgattgtcgcaagattgagcatgcgacagcggaggatcgcatgcgaatgcataaccccgaaccggcacgagcagcacaggcaattagcaattacatggacgagccggaaagtgttctgttcgttgcaatgtcagacaaaatgaatttataaatggcaataaatattatgcaaaaatgaagttaaattttaattgattattttggcagtcatttaaaatttaatttaaaaatttagtttttttatcttaacagaacagcatatgatggcagtgccaatgtgattgcgtgttgtcggttgaaattgtgccaaaatggcaacacaataaacggaggaccatttgcgcagattggcccttttgcaacattaataggctaggctggtttcgttgatttgattgtttcaattgaagataattatttaattacactaactaatataaattataaaaatttgtgaagggattttaggtgctaaaaagtaaaaaggtacctaaaaagagctaagaaaacgccaaacagatgctaagaaagtattcacatttttttaattaaatgaattcctgctttactatttctgtaaattaaatttttatttcttttgaaaaaatgaaaaatttccttaaatacaaaatttaaaaaataattattttttctttaaaaaatttctattaaaagccgaatagccaatttagctggtagttaatgaccccttctgccgttttaggctttcaagggtttggcattggcacggctcttttaaatgaagcgcaaaaatacgcgcaaaggcaatggcacgtcgctgagatgcaattggaagtgcacggcgtcagacgaccgattggccaaggcgaaattgggccaatgacagcgcaaatgaatttctatgcaaagcgcagctatcgaaggacgggaaaggtgcgaaatgagaagcaaaacgaggagctaaatttttaggaaaaaaataaaaaattaaatatataaaataaaatgtaaataaaaaataagtataccgtaaaaattcattttaaagatttaaattatgtgatccaaaaatgttagaaaatacgttttttttctctaaaagatgttaaaataagttcaaatgattttccatataaaaatttagcaaatctatttataatgagaataattttgaagcatattttagtacttttttagagaaaaatgtttagtttgaactttttgcattttctattctatttttcgcaattattttagttattttggggtttagcaactgaaaatccgttcccaactaaataaaatagacgtagtacatttgttttggttattagcttattcagcccccttgttagctcaaattaatatttaatctaaaaatattttgcttttttggttgatttaaaaaataaaattgaaaatatattattggtacatccattactgggacgcaataactgtgaagatttttgtcaaattctacaaaactaaaaaagccaaaaagcttttttttattttaaaaagtaattttttttttatttaaaacgtatattatcaaaaaaaacaattttaagcggattttattctttccttttatcaaattcgaacgcttcttaaattgaatgaatgaattcaggtgcgatggttcaataagccatccgatgccaatttcgtggttgtgccaagtcatcttgcatatctggaattgatggtcaaacatttgagtgaatttggtgattattaatagaataattccaatcgtataatgaaattcgatccgtaaatgaataaatatttttgaaacaaaacatagagatattaacaaaaacaatggattaaactcaaaattttattaagaaattcaatgtggagataaaagattttatacatatttttataaaaaataaaagttttatatgtctattttgagggtaacatttttacttatacggtatgaacactttttgatacattttgtcggaataggacaaaacgtcgccggaaagttttttggtcaataactcattttttctttctcaattaaattcaatgttttggtatttatccaaagtctgaaccttttatcgccattttggcaatttttaatatttttagctactaagtattatcgaacaataccaagatgcttaattggtttacaatgaaaaaagttatgatttaaaaaaatcgtccggcaatgtttcggatgttttgaggtgcacagaaatgttattattattaaaaaaacgtggctttacgtcgctgcttatttctttaaatgtcatttgtcttctgtttgtgtcccctccccggcggaaagcggggagggggtgaaaatattttttgttttattcaaaatggcattaaataaatgccaaacattcactcagacacattgaaactccaaagtactcagaatttgccacattggttctgtttgtgttagctcaacattgccatttaaaattcatttctttaatttaatgtcgacaatttttcttcccttttctcagcccccgaggggacgatgaataataataattagtgacaaattaattggggcagcacaatttgttggcaaaatcaccggccaaatgtgcgtataaaagtggtgatcaaatggctgtcaaatcaccaaaacattcattcattttattattttattggcccttttcctaaaattcaatttacaaaaatggtttccaagcttcttccggtcattctctgctgcttgtttttggtatgtttaagcattcggtataaaatactgtaattcgagtagaaaatcagggagtacggtatctatgatattattaatttctaaaacagggcttaaaaaatccgtgaactattttaaataaagattaagcttaaactttactttttaggcttctttcgccctctgctcgcccaaggctgctgatgtgctggtaaatggctcatttttggcattatggaaaatcaaaataatattaatatcttgagacctaaaaactcaatttcacggacatatttgcaggattaggattcaaaatccgttaccggatgaatccgctttattaatccagcaaaatgccaaacaaatgcacacgattgtgggcccaataagccctacaaattcttccgtctccactattatccatattaaaattgattttttcagaaatttaaacgagaagcggcgatcagcagttgtggagctgtaagacatatttaaaacaatagaaatattcgacaaaatattcatggaggtcgcttaatccctaaatttgttaatgaaatttaaatttatttgtaccactaaaagcgttagatgttttttaattagccatttttgtcctgttttctattttcggcacttttagggacagtttgaatacgggggcggctgttgtacgacatgcacaagcgatgctgattgtacgggcgggaaggtgagttagccaaattttgagaagcatttgccactgttagaatgggattaatcacagatttaagtgaacgattattaattaaatcattaattatgtccaatcggagtaaagtttgacaaattttccaactattttttgtcttaactttttcaattattttccactcttttaatgtaaacttttaatttgtttttatctaatttagctttgtgtgcccatcctcaacttgctcagcgtcagtctgtgctttgccccatgcggaaattaagacagaaaagaaagcagcaaatgagggtgttgatagtgtgataaattgataggattaaatggaaaatggggagttaataattacttaaatgcatttaaatagtgattgatcaataaatatttttcggagttaatttgccttaattacctgaaaatttgactccttcgcttttgtctgcgatagagttgttttataatttgtttagtttggtgaaaggattaattaatccgagtgccgcggcacggaggcccaattttcttgcgtttcggtgacagattagagcatgatgtatgttacgaagctctttttgaaggaaaaatagagtgaattcatttaagcaaaatacatttctgcttttataaataatttatttttaatattaattgtaataaaattgaatgccttaccaaaacatgtacacccaacaatgggtgctttctcttattttaaatttttgtacagattttttatttcttttttcgtttccattttgcaaaaattttcgaaatgcaaaaagaaaaaggaaaagatagtaataccatgttatccgatcagcaaattgtcaaaatttttcaattatttttcattcttttaatgtaaattttcaaatttaagaaagcaataaaaaaggactctgatagtgtgataaagtgataggattaagtgaaagatgtgagtttaattacttcaattcatttaagcctattaaaagagctagaaaatttcttttatatttttacaaaatttccaactttcgatttcagaaaaattttgggcatcgaatgccatccctgccaaaaccaattcatttattcatttgcttcttaattaagctacaataaatgtattaaaataataaagaaaagtggggttttttttggggttttgaactctctctgaaaaaattctaaaataattttttctatggtaaaattgacgctgctcacgaatctggcaaaaagattgtctcttttaatctctgactaacatctgcaatgacttctaaccacttatacaatagactaatctttgaacagcagcgtcgctgattttatgcctttttcaatgggacttaattttgtattgtcatcgaaatggatccgatttaatctaattaatgcgctttttaaagttttgttttttggatttgtcttgttattttcttttttccatcattagacgattgtcgcaagattgagcatgcgacagcggaggatcgcatgcgaatgcataaccccgaaccggcacgagcagcacaggcaattagcaattacatggacgagccggaaagtgttctgttcgttgcaatgtcagacaaaatgaatttataaatggcaataaatattatgcaaaaatgaagttaaattttaattgattattttggcagtcatttaaaatttaatttaaaaatttagtttttttatcttaacagaacagcatatgatggcagtgccaatgtgattgcgtgttgtcggttgaaattgtgccaaaatggcaacacaataaacggaggaccatttgcgcagattggcccttttgcaacattaataggctggtttcgttgatttgattgtttcaattgaagataattatttaattacactaactaatataaattataaaaatttgtgaagggattttaggtgctaaaaagtaaaaaggtacctaaaaagagctaagaaaacgccaaacagatgctaagaaagtattcacatttttttaattaaatgaattcctgctttactatttctgtaaattaaatttttatttcttttgaaaaaatgaaaaatttccttaaatacaaaatttaaaaaataattattttttctttaaaaaatttctattaaaagccgaatagccaatttagctggtagttaatgaccccttctgccgttttaggctttcaagggtttggcattggcacggctcttttaaatgaagcgcaaaaatatgcgcaaaggcaatggcacgtcgctgagatgcaattggaagtgcacggcgtcagacgaccgattggccaaggcgaaattgggccgatgacagcgcaaatgaatttctatgcaaagcgcagctatcgaaggacgggaaaggtgcgaaatgagaagcaaaacgaggagctaaatttttaggaaaaaaataaaaaattaaatatataaaataaaatgtaaataaaaaataagtataccgtaaaaattcattttaaagatttaaattatgtgatccaaaaatgttagaaaatacgttttttttttctctaaaagatgttaaaataagttcaaatgattttccatataaaaatttagcaaatctatttataatgagaataattttgaagcatattttagtacttttttagagaaaaatgtttagtttgaactttttgcattttctattctatttttcgcaattattttagttattttggggtttagcaactgaaaatccgttcccaactaaataaaatagacgtagtacatttgttttggttattagcttattcagcccccttgttagctcaaattaatatataattttaaaatattttgcttttttggttgatttaaaaaataaaattgaaatatattattggaacatccattactgggacgcaataactgctgaagatttttgtcaaattctacaaaactaaaaaagccaaaaagctttttttattttaaaaagtaattttttttttatttaaaacgtatattatcaaaaaaaaacaattnttaagcggattttattctttccttttatcncatttgaacgcttcttaatttga

SEQ ID NO: 5795 - DNA, 1369 bp, Heterodera glycines
  misc_feature (1077)..(1077): n is a, c, g, or t
tgattaatgaattttttaattttattttctatttaaataaatttataaattgatttatgcggggggtggaagggatcaaacccaaacaaaaaattttttgcgaattgtccgctattttgttccttttataagcaaaggaaggggggcgggggcggtagaccttcgcccgtttttcatgtatgttttccttgatttttcctggacttggattttcctggattttaccaattttccagttaaatgtgaaaaaaaatcgaggtccccagcttttctggaagatattttaaaattttttgttaaagagaccaacgttttataaataaattaaattgtcaattgaattttatagatgtgttcctaaaaatcaatcgattttttcaaaaaattgttcaaaaaaatccgagtccaggtccaacatggaactcaggtccagaattttccaaaatgcccatttctactttataccataaatatttaactataaaattatcgattacaaataaaattgagccatttaaaaattctcatttttgcgaatgggtccgcgccactttgggctccatttgtggcgcacatttgttttaaacaaatttcaaaaaaatccaaatccatggtctaaatccaggcctcgaagcctggaaattaaaataatctattgccaaataaaattgggccttctaaaaatgacacaattttcatcccttctccaccaacagtacgtcgagtcgtttgttgatgcgtcggaccgtgagcgcctgttgctgcccgctgagcagttgctgaagccgttggtgcttgtcgcgttggacatttgcaagttggagcagttcaccggacgtacggcaccatcagtgatcacttgaagatgttgagtgacaaagataatccaaggccacaacacacattgaggatgacgacgataattatgataaataataataataatttaaattcatttaggcgattgatttgattggttttttaaggtttatagttttatttgcccaaatcggtgtaggaatttcttgccgctttttaagccctcttttcattgccattgatcgatatcgtgggcgnaaacttttggggatttgcaacttggggacccgacatttggggacccgacttttggggatcccgacatttggggacccgacttttaggggtccgacatttggggatcgaacgtcatggggatccgacacttagggaacccgaaatttggggatccgacatttggggattttaataaaacaaaaaaatattaaaaaatttaattttatgtctaaaattagacaaatttagtctgctttagccagagttaattccattgcagtgcagcaaagaatcaaaataatattttttcaaa

SEQ ID NO: 5796 - DNA, 1959 bp, Heterodera glycines
acaaaacaattaattgttgttttttcactcaagaaccaattccaaagtttatggccaaattgatacaattaaagctttcggatatgaaatttcgagtctacaaatgcttggacaaaatctcttcttttaaaagttcattaaagtttaattcagacccttttcggctcatcacatgtccgggttacccgaggtccgaaactcgaccccaacttttcggtcgacccgaaaaccaatccgatttttccttgatcagaataactgattcatatgaccatttctggccaatcaatgatcattttctttgcatatcgatcagtagcgctactaaaccgccgatggtttgttaagtgcccggctcgtttaagcaatttgtttactcttaaaggtaccacctaattgattttctttcaaaaaaaaaattgtgatttgccccaccattatataatttgtattgttgtttggatgatcgatcccttctgacatatagtgtctcacttgttattatgcttattattctatgccaaaaatattttaagcaatttaattagcgttcaacattctctattctattctttttgttattccactgtgaaattgaatttgccttccccaaagtgtgctcatcaaatattgaaaaagtgatggcttaattgaatttgcaacaattattaattttctcaattacatattcatttagtatttgataaaaatgttactctcattttaatacctaaaatgcgtcgaatttctttttttttgcttatgtttatccatccaattttatttattaaaatttgaatttttactattttacataaattagcgcattttcatttcaattttttttgttgttgatttgatttgccatattcaaaatgtttcgttcgccatcggagccgagcccgttctcgtcaactcggtgcccctacgatactcaggcgcgctgtggacgtccgtactgtccatttgcacaccgagccgacgacgctgtcgacgtcgttgaaggtgaagaaatgacaaagtttgggagcgttcggcggtaaaattgaggcttatggtgcacctttttcgacagaatcgtttgtttttgtcattttttttgttaatttcggtttctgtcactttttgtggccttccgctccttgaaattttttttagataatttggtaatactggacaaactgggctccacaaaaaaatcatatttctgtcggagattctgatcactatcagatttgcaaaaatcattgcttttgaaatttgatcactgtaatcaaatgatcctaaattaattatttgtttcgcgtaagatttttaaaatcgctgataaattttgcaaatctcatatcaaattcgggatctgaaatccaaagggatgagaactccaaaataaattgtggaacttttcattaatttgttagggggtgggttgtttcgagacaccccacggcgatgccgacagggcgccgccaagaaaaatttaaaaattttattaaaaaaattgttgcaaaagtaaaaatcggtaccgatttttaaatgccttccatttcatcagacacagcaaatgatatgcttgtgttggacagtgaccatttgtccgacggtggccggtcatcagtggggacagaaattcgacaggaaaacccgacaggtgctgtttgtgatattgggtagatgcaattgtatgcacaacacccccctcccgaagaagtttttaaaaaaaaccctacggagaatggaccctttggatttttaaattttttcttgggtacctactatggttttttcattgggtttgttaaggtacaaaagtgccgaatttttcttaaattatcaaaaaattattttcactaatccaagttttcaaaaaaaaaggatcaaaatttttttagctttttttcataaaaaaatttcttcgaattttggaaatttttttttttgataaatcttaagtactat

SEQ ID NO: 5797 - DNA, 3455 bp, Heterodera glycines
caaagacgtagttgcgttcccgcaatttccacacacttcaaatggcaacttttaatgcgccgtgccgtccattacggctgagggtcgtaaagtggtggcatttaaaatgtaattaaaaaatgcccttttaaaacgggggtccaagaaaatgggttttaacctccagacactcttgttttgttttttatgctgcttttgcataaacaattcgagccatgttcctattaagtgaaaattatgccgcccaaacccccaaacgtttggcccttctccgtgtttttctccctcgaaaacttccactgttttcctgctatggcgtaattaatttgtgccaacgacgacggcacgggcattaaactttgctcattcgattattggttttttttttctgggtgggtactcttaaacatttcataaagagtgaagaaatgcttttatggcattatggaatattaaattaagggcaaaaatatttgggaaaaaaattttaaaagttgattttatgtactgtatttgatgaaacaattttgaatgatacacaatttgtaaatttataaaaaaatattaatctctctaattaaactgttttttaaaattaattagggcttttttttacaaaaaaatttatgcacccataacacttcagaatcgaatttttttatgtacagagatgataaaaaggcaaggaaaagttttatcctaaaatttctcgaaagtttcccgcgctgttttcgtgctatgcataattaatttgtgccaacgacgacggcacaggcatattagactttttgtcttattacccctcattttgtcttggtttttttgtgaagggggattttcgttttttttttgttgttgttggatcatcttaaacattcataaagagtgtgcaatatttaagattaattcttttatgggtttatggcatattaaaattaaagggccaaaaatatttgtgccagattttgaaagttgattttatgaattgtatttggtgaaatatttttgaatgatacacaatttgtaaaatttatcataacaagaacaaaaattattaatctcaaaatttatcaaaaaaagaaaaaatattaatttcgctaattaaaccgatttaaaaaaaattaattagtgaaattttttacaaaaatttatgcacccataacacttcagaaccgaattttacagggatattaaaaagacaaggaaaagtgttttatcctaagatttggctcatatttttcgggtttttcttttttgagaattatggggaattgaaatttcaatggcctaaaaatatgtaaagaaatgtggggggggggggagtgtgtgccgggcccgagaaatgatgcaaattgtccgaattttggaaccgtctggaatttccgaaatttgttcctaatttgcccagcccacttaattattccaaaattcactttaagtgccctcctcccctctcgattgcttccgtgcagtgcccttccccattttattctcatttcattttctctttttcctttaaataaatttattgttgggctgtatggcagggcttccatcgaaaatttttcaaactcagaacatcgggccctaaaaaatcagattttggggtcgaaacccagaacaattcgcgaaattgcttcaaaacaattattttttatcctatcaaaaatgtattaattattatatttttcgcttccaattatcgattttaacaattttaggggaggaaataagtaaatcgtatatttaagtgctatcaggctcaaaacatcagattgatttttaagaattttttgcggcgtttatttccaaaaaaaaaaattttgggggaatgggcggcgggggtgtgggtccggcgcggtgcagataggcgccgccgggcaaattttggaaaatttgagtgcaatttgttaacagattttgaccaaaaaactgcctaaatttttgcaattttaagccatgtgacgactttttttgtttctaaaaaacggtttttttacggcgcggggttttttttgtgatttttctaattgtttttccccacagctttgccccaatttggaccgtccaccgccgtgccggcgcattatgtccaatcgtgcccatttgttccgacatacccctcctacccaccgcagcatcaatattccgaaccgattatggtcataaaaaagcattattgtattactgtatgagtgccttcgttacccctccccatgcatcagaaaaatggaaatttcgtgttttttcctaaattttttaaagatttttctagtgaaaaaatgaacaataaatattttttttatttgttacatgggacgggggaaccaagctgctcccatgcagagtattttattcactcttttattcgagaaaagaacgcatttacagtactcgcatccggtaccattggctaccgtatcaacaacgatgacaccaccgtttccgtcagcagctgcggcagcagttcaaccgcagacggtagcaccgagcgccgttaaacaacaccgcggcagccataaaagggtgggcgctaattatagtaacaaacacagcaattaatttttagtcataatatttcatgaaaattttgacaccaagagttttctgagtttagtgatcatgaaaccaaacatgaacttgaacaaaatgagtcaaaaacatggattttccgacttttgggttcaagattcggaattagccaatattggttttatatttatggttagcaatcccgaaaatccacggtacaaattttcacgtatacaatccttatgtgggaaccaaggagtttttcttttggttataataaaaatttcaaaaaataataaatattatttatttttatgttaccaatgcttcttttaaaaactgatatttcgtttcttttaattaaaaaatgtttaaaattaataaatttaaacaaaaattttttattttttaagcccaaaacagcggcaggccccggcggtttgcccgcgtacattccgacaccaatcgctcaattggaaaaggagcagaaagagcgtgagcggagaagagaagaaaggcgggcgagaaaggaggacggacagccaaagaaagaaaaagagcatggggcagagaagcagagcgacgatgcgaaggcggcgagacagcgggagcaaatggagcagcagaacgacagaggaaggagagagagtgttggcgagggagagagcgtgctcggcggcggcgcaggcagcagcagagagacagtgaaagagagagagggtgggcagagaaatgaaattaaaaaaaataaattaattattttttactaataaaataaagaatttcgagttaaaaatttctgcagaaatttataggatttttgtttcaataataaaactaatttttcatttatttaaaatctataccttaaattttaaaaaattttttaaaaaccaaaaagggggggaggggacaattttttt

SEQ ID NO: 5798 - DNA, 1436 bp, Heterodera glycines
cagggatgggacaaattgaaaaataaaaagcgaaatgcgaaaagcgaaactgaaaaattaaggacacaaacaagcactagaatgaaatattcaacacatcgaaaagaaattgggaaattttctttttttacagaaaaacataaaaacatctcaatttgagaggaacgaatgtgtcgtttcctgttgccttcacgatctaaaaacattataaatgaattagcattatttttattgaccaataaagcagatctcctctaaattcggatatacgtagcagggattgcacggaattccgatttccggtttccgacatttttggggtcggaattccgaaatttttggggcctcggaatcagggctggacgtaactgattttcagttacggaaatccgtaatccgtaattacggcaattttttcagttacggccatccgtaatccgtcattacggaggtccaaaaaggccgtaatttggcgtaatccgtaatacgtaattttcaaaattttttttttaaatttaaaaaatccaatctaaaaattgttaagattaatttatgatcagaatatctgcttgtttttttgaggtgaaaatcccaaaatagttttttttgcggtgtgctttttccaaaaaactggggaatgtgggggggggggggtcaggcggcgccgaaaggcgccgccggaaaaatttttgaaaaattttatgcaatttgctataagattttgtctaaaaatgactaagattttggagctaatatttaaaaataattaggaatttttggggcgggcggtgccgataagcgccgccgaggaaaattttttttcagaattttaacgaattttgttaaaaaatagccaaatttttagcatttcctcttttcccctttgctagcatcccccctcccctttatgtatgttaataatactacaaattaccaagtataagtcagattaaatcgaaatatgggtagccttttaataaaaatagaaaaaaaactcattttataaaaaataatcttgcaagaaatcgtctcgaaaaataatctaaaaagccagttacggatcaaaattacggaaaaatcccaaaaaccacgaagaatggatgaaggatgattaattttcgttgttttcatccgcttctttttcttcttcctctggtggcgacaatgggctaaaattaaattttaattctttatatgtaaaacttagagaccggacaattggggtcggagggcggtgcaccccaaaacgtcgtcggccgaaacgtcgtcggaagactttttgaaccataactttgttcactgtcaatcaaattaagaattgttggtgttgttcgataggtctatgtgtttattattaatttgcaaaatctcaaaaattttggttaagtttcaaaaaagttatggccagaaggaactcaaaaacccagtaattcgaa

SEQ ID NO: 5799 - DNA, 1786 bp, Heterodera glycines
acattcattcgcaccattggtgaatgggttgccttctttattgattacaaaaatactatctgagaaatgaattaacttgacaaaaaggaataatagttaagtaacatattggaaaagcctttgagagcaaattgatggttcttcaattccaacaacaacaaatattgtaaatcagaacaaataaatgatagcatcgccttccgttataattgtctcattgtcttagtgtcctttctttcggaacgaacacccttcgacaagtcgcgccttcccgccggtcggctgacacaaaactgtactgcaaccaacacagacctaaattagaaatgtatgcaaatttctacaaaacacagctcatttatgaccggtctaagtgtgtactattcatttgcttagctcattaaatcactaaattatttggcaagaataaatcgataccacaacagtttgagcatggctgaacactgtagtaatcttatagcagccagggcatttgacgtccataaacttaaaaaagggatgacagtatttaatttatttataataatgcatacgaaagaatttggatgttgcacgagtcttttgagcttgtgcttttgacgttccttttgcggatcaggatacaacaaatcttcagccaaaggcatttcgtttgtatgagaaaaatttaactaaaattgaaagattaactaaaattatatggaaaaaaatataaattaacaaagttcaatagattcgaatgttttttagaaaagcattatagggaatttactctaaaattgaccgagaaaataaaactactaaaatgatagagttagaatttgcggttgaaaaaacattattttaggggaaaaaatcataatctcaaaaaattgacactcaaactcaaaacagagatttttaagaaatctaattctttctctgctttttctttttttcataataatttcttttagtttggcgtattatctcttcatttttaatagaaaaacagaatttactctatgcatgaatacctcaattagttacctaaaattactagataaataggtattcaaattatttaactaattttcagcacatttttcagataaatttattaagaacaatgcgttcagtaaaacatggaggaaaaaaaggaatgcgattcagatacaaattgtcagcagttaagaggcaaaacaaaaagcagaagaaaaagcaaaggaacatagctggatggtaaaaaatattgaagttttaaattgctaatttcctgttgttgtattcaatttgctgatggtctcacattattttaatttttttttgaaattcctctttcagaaatttggaattcgattttgaattttattttcatttcaaatacatagatcaacaagctcagcaaatagatacaattaattcatggcattttttttaatacttttagctctttgatcaaaaaagcatggcaaacccaactatcatcgcggcaaaatttaagtgcaatgggactggtctatgatccaaatgaggcattgaaaaaggtatgtttttgatttaaccatggccatttaaatcgaatcctcgacaatactcatttagaatcctgaattcgccatggaaatggaccaaagcgaaattgaagtaattggattgccagaagccaaagctttgggaagcgtgaaggaacaaaaaaaggcgaccaaatcaaagaaagcattcccaagtaaaagtaaaatgcaaatttttcactatatcaaattaaggcaattcaatttagagttgaacaaatctgaggccgagt

SEQ ID NO: 5800 - DNA, 1487 bp, Heterodera glycines
tgccttagtttgtttccaatcctatttcggattcccggccataattcgatcattcgaaaaaatgaattccccatttttgttcgaaaatttgactaaaacatttcaaaaattagtcacaatattacattattataaatggtcaggttattaacttttgtttgaatacatccgcgcgggattcgtaataggccaaaatcagttgtaaaactcaattcatagaatggtcatattcgcgatcagaaccccaaagattttttcgcggctttttaaaccgaaaattttaccaaaaatttgccaattgtataaatgataattttctatttgtcagggcatgtctcgtgatcctttgaatatttggcaaaacactccaagacaaattgagcgaaagattggcgtatacaaacgaagcatcgcctgtgactgaatgtgaaaagcgaaaattgtttttctttgttgttgggcttttggttgtttaaataaataaaaaacaattctgaacacattacaccattatattgcccttatgccgttttttattcgtatttttgacttcggagatttgtcggactatttcaatttgactatgaaaagctgtttgctttagtaaggaacataaacaaatgggacaaaaatatcctggtaatggcaaaaagtgaaggacaactgccgtcttgtccctcccccccccctttccctctctcttctctctctctcctacatactctctccccctctcaatcacttgagcagttttcctgtgcattcgctttctcttttgttttatttgtgctttttccacgctcaaagtcccattcattcctttgcttttgccgatcgattgatccgaacaaaacaaaatataatcgaagtccaagagaagacgacgtaaaggaatgccttcgggaggcgacgatgaacaacagtttgaggaggcggtcaaaccggcattgggtgggcaatcgaagtgccattgggacaatggcattcattcaatgagtgaataaatgaaacggtgcctttcgcagagtcccttttggcggatttgcaaaagaccaccgaagttcttcggcaaggcaaacatggcaaaggccgacggcaacagaaggaggacgaatccgccgctttgttggacttgaagaagcttcggaagtgaggggggggggacaaaaagagtgatcagagtttggttgggttggctgatcgggttgggttgggtggtcgtcggtgtttgcgcagggcgtgcgctgaaaatatcgaatttccgcctttccccccaaagctctccccgccagcgaaaccaatcgccggcagcggtcgccaatttgcgaaacggaagaagcgaagaggtgaaatccgttcagttatttgctgttatccttatccccaaaagaaaatattacgaatttcgttaattgaacgaattcggaatggtgggcattagtcgccaaatgacccccaatggtgccattgtccgtttttgttaataa

SEQ ID NO: 5801 - DNA, 4464 bp, Heterodera glycines
ggggactgtgcttcgtgcaaccaagcagtgattgggcccgtggtaagtctttggctgtataaaaatgagcagtcggaagcgaagggtggcagaaatgggatgttttacgggatacgaagcaaaatgaaaggattttgaatgacaaagaacaaagaaatggaccattttatcaaggtgatagcccttgggaagatgtggcatcctgaacatttttgctgcgctcattgcggagattccattgaaaatcggaattttttcgagcggcaaggaaaggcgtactgtgaaagcgattaccacggtgattgggtcattagcttatttgctagtcaatgttgttgtttttccaagttacactttctcttttctctaagatttgttttcacctcgttgttcctactgtaacgggcccatcaaagaagtacggtggaagaattacaaattagaaaaaaaatacttgaagcaaagcaaaagcattcattttaattactcttacatagcctttttgtttagcgttgtgtaacagcacttggcggaaagaattttcacgtggaggttaaaaaaattaaccttttgaaacttaaaactttctcagcattttgtttgcgccgaatgcggcaaaagcttcggagacggcagattccatgagaaagtcggaaattttattggataaattaatgttatcaaattttaagtccaattccgcgtactgtcgcgattgtttctaccgtacttacgcgcccaagtgtcagtcctgcaaacagccgatcactcacaaattcatcacggcactcaacacacattggcaccccgaatgcttttgctgtcaggtaaatcggacggacattcgctgccttttcgcttctcgcaaaaagctttcaaagtttctgttggctgctgagtagtatatggcgtcaaaacctcgcgggtatctcgcgggtgtttcgcgcacaaacccttgcctatgggaggggtgcaaccctttgaaggtgccgcccggacattttcccgcacaatcccaaacctatgggaggggtgcatccccttgaagttgcccgctcacatcctgagcctatgagattttctttgaactctgccgccttggggatttccccaaattgttgcgggtgttttttttcacccgcgccgcgcagcgccgcgggaaggtcatcaatcatccacctgtcaccaaaagtgacaggtgaaggaaattcaatttttcttttgcaaatttaaatctttttgatcccaaaccttttgggccggttttattttctcaaatcctgagattttttttttatgatgatttttctgaattttgaaaatttgccaaaaccgtgcggtttttatcacctctcccctccctccccgcccgtccggcgacgcgatgccgccgccgcgaaaaaaaaatcgataacggaatttggaagaagtgtgaattaattgatattagcagcaaataattttgattatgaattgcacaataaaattgattatttaaaaataaaaatcgaaaattgaataaataaattaaaaaactttttcaaaagtaggtcacctgtcaaccaaaattgattaatggatttttatttctcttccattatttcgcaatctgcagtgactttttgttcaaattatttcgcaatatctcccctaaattaggtcaactgtcaataaaatgtgattgattggtttcttatttaatgtctccattatttttgggtccaactatttcgcaatatggcccgtaattttgcaaacctgtcaagaaaaatgattgatgacattcgaaataaagaatatccagacgatttttttttgcagttttgaataaaatgtgacagttgtctacggaaatgattgattaccctcaaaattaaggcaaacccagacagtcacgtgactagacccctccccctttttgcctatttcgcacacccggcccaaatcgcaaatcattcaactaaatagttggatttcattaaactctcttcacgctctaattttatttctctccgctctatttttatttgcattaattaaatctattactatttacctacgtctttttcttttcaaatctctgctctctttaattcttctgtttcaatttttctttttaaaatgtcttttaaacgcgtgaactcctgccaacccgccgtgccaatggccaaaaaatgggatttccgatcaatcgggcaagtgatttttaataaattaaataaaaaaataatttcttaaacaattataaatacaattataagataataccctttaagaattatttcaaaaaaaattttttgttcagaaataattttgctgaagaaatggaaaattataaattgatggattatcaaacgactacttgccaaaaatttggatttacgaaaaatattacggaatttcgtgtcaacccggacgtggaacgccccgatgaagcgatgaaggatgcgatcgacaacatgataaaggtggctttaaaaactacggaagaaaggatgaagcggaaagtgcggatgtttggagtggcaattacgggtgctgggcttgctttcccggtatgggtaccgtacagggcgtacccgcagaacaatgcggatgttatcatgcaggagattaataagttggggcagagcggggacggagatgaaaataagaaaatgcttttattatctgagccagttacgatgaaaattacttgcgtgaccatgcccagtggagaggggccgaggaatgtccataaatttgactttggattcaaggaacaccagcggatagggtaagtgtttttaataaaataaaattaaaatagaaaaaaactaaaataaaaaaaaatcaataaataaatttaaaataaatacattaaatttatttaatgaagcaaaaaaattttttaaagaaaaaaattgaaaaaataataatttaatgaaacaaaaaaaaacagaataaaattaaaaataaagaaagtaaaaaataaatttaaaataattattttaaaaaattaaatgatacaaaaaaaaacagaaaaaactaaaaaaaaaaattaattaaataataattaaagtaaagaaaaaaagaaataattatttttaattaagcaaagcagcaaaaaaaaaaacagaaaaaaaaattttaaaaataaattaaataataaagaaaaaataaatggaaataataataattttattaaggattacaaatgtggataaattatgtctgttttacgcgctcgtagcctcgaaattttatctggaattgcatgtggacagcttcaggagatttatgaaaaatattgtgagacagagggatgcagctattgaacttttacgtaattgtggaattgatggaaacgaaattagttatggtgtggagcaattgccgacggttcagaattattgggtgggtttaaaaacggtgaaaaacatagaaatgaccaatttttcaggatgagatttaccccggaaaataccggattgtggcgtttgaaaaatctgcggatccgagaaaatcgatacgtgttttgtggaagggcccaatggggcgagaaagtgtagtgccgatatttttggagaacggacattgggatggtctgaagaattatgtctgctttttcaatcgagggaaaaaattttgtgttgattgtgagtgcttttactatcaggatgttaaacatacgatggagtgcagggccaggtgttattactgcaacaaagtgggtggagtgccatgtcaaaaggagagtggagtgaagattgaatgcccgaagtgtcatcgttatttttacaattgggagtgttataattatcatcagggacatcagacttgcaaattatggaggcgttgcgtgatctgtgacaagacatatttatttaacacgaagaagggacatgaatgcggagagacttattgccagctttgtagtgtgagccacgaccccaagcggggttgctatattataccgatcgaggagaaggaggaaaaagatgtctacagaattgtagtttgggtaagttctacaaataaaatcaacaaaaataagtctttaactccaggattcggagacttcgcaggattctatttacaagggggaccagaaggagcatataattaattatatttcggcgagagtgacgtgtacagaatgctgtgatgataaaaataggacaaattgcaacatttgcagggaggtgaggaccaaggattggagtgaggctgagggacatgagccgaccaaggattttgtggagtggattttaactgcttttaccaattacgatacgtacatattcgcgcataacgccgggcgttttgacggtaatgaaaaaattaatctaaatttttaaatcctaaaatttttaggtcattttgtttttaattacctctgccgtaccgggaagaacccgctaccgctcatcaatggattgaaaagttatgaatttaaagtgcaaaactcgaagaaacattcaa

SEQ ID NO: 5802 - DNA, 5577 bp, Heterodera glycines
ccttaagccttctccgttgtccatgattcctttaagctggccagaatcggataggatatatctcaatgcttcttcttccaattggcgtcatcgaattccagtccaatcatcacacaaataccccccgccgtccctctgccgaagcattcaatccatcccattccattacatatctgtccccccccccctccctcaccagcgagtccaattgatgacattttgctggaggcattgagttataacataacgcctgaggcgaaaaaaatgaaaacacttatttttattttcataaattaaaccaaataaatccttttaatgaattttttccaacattttctatcagcaaattgttaaatttcacatattaatgacgaataacagttttttttaactatacgtcttttctatattaattttttttgtcaatttttatatagatttttttcaatttttcttgcaattttcatattaagcatttatttattttacataaaaaaatttttcaatgattaaatttaatatgttcaaattgaattgcgttttaatgaaaaaaacgattgatttaatatttttcaattaattacaaaaatttatcatttcttggagaattaaattaataatagaataatttgcttttctctattgaaggtgaaacgaaaagaaatattcaataattaattgtcatgtctgacccataaaattgcataattattaattaaattatttttcatttttgtcgctattcgcccactctttggccctttgtccgccattcccaatggtccaaaaccaacaacagcagaaagcgcacgaagttggcgaagtgaacgcggaaagccaaaagagacaaacgacgacgagagaggacgaaacagcggaaggacagaagcaaataacggagcagcaacagattaacagcaacaacagcagcaacacaacgccaacaacaacgacagtgaaagtgggaaagaagcaatttgaaaattgaaattaaatataataatagaaatcataaagttttgtaaataattaatatttattcaggttggcttctacgaggtggaccggaccattggcaagggaaattacgcggttgtaaagttggccaggcaccgaatcaccaaaacagaggtgagaaaaaacacatttacgaattatctattttaaatattattttaacatttgaaatcatttattttggtgaattttctgatactctcagcaaaaaacccattgaaattttattgtactctcgccaaatgcctaaaattggatttttagctgcgaaaaaaattcctgtgttgtaagaggaaaaacggacacaaagggttgatttaacggaattttattttaaaattttctatttaaacaataaaatattaattgatggggcgcacaaaatgcttacgggacgcataatataatattctgtgaatttggcgaacttgtactattctctataatcttacaaaaatatatatgaatataattcaaaaatgcttttatatcgttaattacctaattaatttaaataggtcgccatcaaaattgtggacaaacgtcgtttggactcggttaatttggcaaaaatttatcgcgaaattgatgtgctgaagaaactcagacatccgaacattgttcgactttatcaggtgacaaattgaggacatttattactaattgattgataattaattaattgcttaattttgtaattcaattgaaggtgatggagacgaacaacatgctttatttggtcactgaatacgcaccaaacggcgaaatttatggtcagagatttaaatttaaaaaagcatttgcattttcttttcagatttaatttcaaaacaaaaaaaactcagcgaggaaatggcaaagcaaaagttttggcaaattatttcggcggtggattatctgcacaatttgaacattgtgcacagggatttgaaggtgttttttaatttaatttaaatttggaattcatttttatttttgtatgattttactaaaatttctttcctttttgttatatttcgcatcgatttgccctcttttttacgtcattagcagtttaatttgttttatcattaggcgaaagaaggcgaaattatcaaaatttggcgaaatcaaaaaatgattaaataaagttcagtgacgtaaaatgagacctctaaaaaagcaaataaaatccctttttttctaaaagtattttaataattaataaataataaaacaaattaaggccgaaaatcttttgttggacgcaaatttgcaaataaaattggccgactttggcttctccaatttcttttcttatgatggcactttggacactttttgcggaagtccgccgtacgcggcgccggaagtgtttgagggcaaacgatacgccgggccagaaattgatgtttgggtgggcatttggccaatcattattttattttaaactaattatttaatgggttgatttaattgaagagtctcggagtgattctctatgtgatggtctgcggcgttttgccatttgagggcctcaatttgcagctgcttcgtgaccgtgtgctaagcggacgcatccgaattccctactttatgagttcgggtaataaatgttgtctgaaaggcattggtttcattttccaatattggcgttgtgttcagactgcgaaaatttggtgcgtcgtatgctaacggtggattcgcgccgccgtccgaccattgaacagatcaaacaccaccggtggatgcgctacgaagagttcgccccgaagtacgaactcaacgagcaggaacggcacgcggcgacggagcaacacgtggcggaaccgcacccgcaaatactgagactgatgaacaacattggcattgagtcggagaaaatcaaaaatgtaacacagaggaatattcttttcataaaacaatgaaagcggatattgtgcttttcgcttttttcaggccattcaagcggacgcctatgacaatttccacgcgatttatttgcttttgttggaacgccttcggggccatccgctgtcgcgcagccattccgcctccagtcatgccaaccatcctctggtcaactctccctccgcaacttctttgccctcgccgaccgcgccacacgcacaagcagtactcgcgagtccgaccacaaaggcggcaccggcagttgttctgacggagtcggcaggaggaggagacagcggagaacaaagaccaccgatcattcggggggttacggtccgtaatttaaatgatttgaactatccacattgatcgatacgatttgcagattcgtcgccaatccgatggcattgccattgtgggcggtgccgtgccgtgccattgctattgttgcagtgctgcccgagcacatccgatgctacagtcaatacagccgcaatacgcgcccttgggcatcatgacgcgatttgcgcaacatcagcagacgcgacgggacagtgatggaatcgcaatgcaatttgcatatcaaatgcagcaacagaaacaacagcagcaggaggaactcgcgcgtggcgtacaaaacacacagcaaaagcagcagcagcagaataacgtcgttgttggacacgtcgcggcacaaccacagcaaaagacaggacggcaacagaacggcacgcaactcggcaccatggtaaagggagggggagaagcaaataaattaggaaacgattaaattccgatattgccagcaccatcattccaccacttcggactacgagtcggagaattgtttttcgggttcatccgctggaggctcaacactttccagacaatcgacaatcggaacaatcagctcattcgatgatgtgattttatttaattaaatatttttattcttttaaatccttttaattgttggaaattattttcgaaatttatttttcttttggtgagacatttttggagttataataaaaaaatgtaaaatcacgcaaaggtaagtcagtgccgacgatataaacattaaataatttgtttccaaatttccccaattttagtgttgtcctgacgattctgcggccactccgtcctgttcgcatgctgcgggcggtggccccggcggtctgtcgctgttcggcggtgtcgcactgcccccgcttcaccaccaaccgccgattggtgccaccgctttttgtggtgccgaccaattgccgccctttgacagccaactgagtcaggacccgctgttctcctcacagtcgtccaacaaaagtgccacggcatttcgtcctatcagcggcagtcggtcgaccaataacagcgaaaatggtaaatttggccaaattaattactgtcataatttaagtctttttttgagtttaccataatagttttaacagtgctcatttagcttataaatgactttatcatttagcaataatttttatatttttctttaatttaatgctattattgacgtctttatgtgcggtgtgctcagtttccttttttcgtcttaactttttctaaaaattgcgatgggcgcactttcgtcgatgacgcaaattggggaaagagaagaaaggggacaaaagtgaactttttaaaatgacaaagaccagcagtttattaagtcgaaaacaaaatttattatttttgataccttaacataaaatggcgattaattaacaaaaagaaaaaatatatattattaagctttgacataaataattaggcttttgtattgcgtcattcgcttcttttcgtgctgcttgcctacttcatttttatttttctgttccaatgcttcttggctcatcatttgcgtcatccgttgttcgcccttttgttgttttttgcttgtgcaaatattttacgatggtcgagagtctcgaaaagcggcgatgcgagatgctttacgtggagggggggggggggggggggaggaatgatgatgacattttgggatgaaggatgactgacccattcacccatacattcgcagttgcgtaattgcatttttcacacgttatggaaatttgtgttgacatggccaaaacaaagtccaaatgcgtcatcaaataattgcaaatgggagggatgtttaatcaaataataataataaattggtaatcgcaggttgttgctacggtgttgcaccggcgggcattgtcgtcggcccatcaggcggaagcagcaacctgctgatcaaaaatgcacaggcacagcccccgccgatgtttccgaataatcatgcgaacactcaccttcaccatcgtctccatccccacctattgcaaccgtatcaacagcagcaattgcctccattcctccagcagcattactgccaacaacaacaacaacagttgacgacattgtcggcacgagcgcatgggacgacgacgaatgaaacgacgaacgaagacggcgccggaggggacgcagcaatgcaacgacaacaccagcaacaacaacagcagcagcagaacagcctttgtccgcaacaacacatggggatgatgtgcgagaacggatggagggcgaggtgagggatttggcaaggagtgggatcagaatccataaatgaaaagatttgtttccaatggttttaat

SEQ ID NO: 5803 - DNA, 3821 bp, Heterodera glycines
agtatcatgacaactcatacacaggcaactcgaacaatggcttagactaggcttaggctttttttgcaaattttttaaatgttagtttactgtctgtggtacgcgtaaagtgtcatgagacgcgtaaaaccgactagaaccaaatttttatccagaaaaaatattttttttaggcaatcaatttttggtaaatgtttcaattcttaggtgtatattttctgaaaaatttttgggtaatttcttaggtatgtattttcgtttttattgcatttttgttgaggacttttccgaaaatcctaaaaataggggccaaaaatttgcctaaaaaatgatgccctactaataataactaaaatcccaaaatgttaattttttttatatttatgtatttgtatggacgttaaaccgatgaactttcgcgctaacatttgtttattatataaaatttaatcaattaaaaaatgcttttaattatcattctttgatgtgatattagttgaaaactcgatctttcagtggcgtgacaacaaagatgaaacacacagcgaaaaaaggagaaccaatgatggcaccactcgttttagtgccccattaacgcggtagaagaaaggcaaagtgtcgagaggggccttaattaataatcaaataaatgtctttgaaatgtgagagaattgtacaataaagcataatttgtaatatagtataaatataattcttttaattttaaatcataaacattacttcgtaatccttcaacagtgtctctcccacaataatcgctgcttcgccccctctgttgccgtctttccattcgcctcttggcaaaaaaatgtcccgtttcgttttgcctttttgcagcactggcgcaacaacctgtgcagtgacaataacaattgaattaaatgaataaatgagttatccgccgatgtttaattaccaatttccagccgaccatgtattggtctttgcagccgtaagcaaaagtggcattgtcactggaccaccacattggactgtgcaaaaaatgtactgtttaaaaaattattacacgataaattaaatttcaatactcgttttgaaacgaacggaagggatgggggaattaagtgccccgaaacattctcgtttaaaattcagatgcaataatttaggttattttttgttgaattccctgttggtgtccatttcacagtgattactgtacttatgataccgtatcactggctctccattttttacagcatcctccacactttccagaatgtacggcatccatttggctcgcaattcgagcacatttttcacctgctccaccactttgaatttggactgattgaagctcggatgccacggaggatatgaaaattgcatggccagcagaaaggcattagcctaatggaaagaagtattaattgaattatattaaacaatttgcttgtttaattattgcaattgatgtcctcacctgagtccatctgatgtacagctcctcctcaggcggattgcctttgatgttggtggggctgtggtcaatcccattcccgccgaccatgtccggcaaattccaataatagccgtgcagtgatgcttgcaatgccctgcggggcaaaaacaaaacatttacttttttttctttttggtaaatgcgtgtatctttcaattctcaattcttaattaatttgaccatgggatcaaagtgctgagtccgccttcaccttcggatttgtccctaaacaaatccgaatgaaaaatatgtttttttaattattcagtgttcaaccaatatgaacttctgtccattgttctcataaagatattcgcgtcctgtgagttactgccgtaacggttttcaacggctggcccaaattcggccgcaaaatgggcataatcacggccgaagccttgaatgaaaatacgatcaaacaattgtttacttttgaaagaatttactgtttggattttgtccgtaattaagtgcaaaatttttcggaaaccaattagtctcgccggcatcgaatttgaatgtgtaaatgccctcctgaaaataaatttgaaataaaagcgtacgttctatccccattagccgggccggatggaatcaatagctgggtggaagagagaatgcggacagacagttaaagaccgaagaaacaatgaataatgaagagattggttgccccactccctcgtcacaaaaatcgattgaatcagtgccttttgcatgtttttgagctgtgttctccaccaatctcgggtatcagaattggtaagatccaaaatctgtaaattggacagactaaacattagcagtgagttggtctttacataatacatgcataaggggcttctcaagccaacgacggacgattaagttttagttggcaacgaagaaagggtccggcggtgccaaaaggctccgccggttctgatttgttaatcacaaccaaagggggcaagagtcttgagacaacccttgtgcatgttttggttccacaatcaaatttggttttaatcgcttctcctttacatatgcgcatggctttttctcttcattgcctgcgctgtccttggtcaccggacagtcccaccaccaggtcagcggaacgtcgccttgcgatgatttcatgaaaattgtatttcgcaacgacaaatcctggccattcttcgagtcgtcgttgacgaatgggtgaacccaggcttcaacaaacaatatgaatttaatggaataaaaatcaatttaatgcaaaactgtaccagtcagtctggcacccgttttgtttctgatgtaattaaccattccggcaaagttagggaattttgcgctgtcaatttgatagtctccgtaagcggtggtccacatgtcgtccaattccaattgcgaaattggcattccataactgttaatttcgtccacataactttcgacctgcaacaattcaaatttataattaattaaataataaaaaaatattccgaataaaaaaaatagtcctagtgcaaatatgcggccaaaggatttttacgcgtcttataattttttcaggtccgccagtatcaatccgctcatgacgaaccgcttatatgtatatcgtaaaataaaaaataaaaatgacagaaatttattttaattttttttaaaattggttaattttttgcattcaaaatttaaattcgtaatttttttagttattccgttacttttggctgtttcacttctagttaataattatcttttttaaataaaattcatccctattagatacaaataaaattttaacaaaaattgcaatttaattgtgtttgaatttgatgcgacctgtgtttggttcacagcgacccaaaaggtggcccaggttgaccaaattggcttttccataattaaactgtccggtgcagctaaagcacagaattgtctcccatatgtccttcccagtttgaaatttcttgcccgttggcgctttcaaaaatttggcaaagcattgctggtggaattccttcagagtcaaattgccgtgtttgtctaccgccagcgtgtactccaaatgattattacgcagcaaaaattgggagcccttcagctgcgccctaatgttcagttcgctcttctccaccgatgtccacaacggcactgtccacggcacactcagcgcaacttttttagaggacagccaataacgctcttgtccgctcactttggtctaaaataattatttatataattataaaatagtttaatctataggatttattttaaatatttaatctttttgagattcgtttaaagtaaaagcccacaaattggtaaatatcgtgagaacaaa

SEQ ID NO: 5804 - DNA, 4255 bp, Heterodera glycines
cacaaaatttcctgaaattttgttcaagagatactctacatctcctgcaaccgcagagatgttcaccgcgtaggagtaaaggaagggtgtaattcgtaacagtacgtcgctgggtatcagattgtacgacgacggaggagtacaaagggaggagaagctacagaagaagtgggaggataagcattggttgaaaaagacgtaagcagcggaacatttgcaaggcaaaaagggaggaaaagcctataatagtaacgtctgtgtttgtcggtggtcaatatctctaattaggcacataaataggtgccaaaaatcaaatactaagtgaatgagaaagtctgaacagggggagcggcggtatgtgttcccgaaaagggcacacatcggcatggaagacagtttgacgagtggggggagggggactcacgctgcgcggaggagaaaccaatttgagcgggggcaaaaaaaaacgccggaggggacgaatttgggggcgaaatttaattaatcatccgccgctgcgccgcgccgacgaaccgacaagcattttttagaagaattacggttgctgctgtgcctgctagaggaggtggtggtggtggtagtggtggtggcaaagagtggaagtaaaaaatgccaaaaaattgcaagtgccaggaacacttttagcaaaaatgccaaaaactgaaaatgctaggagcaatttttggcaaaaatgccaagaattgtaagtgccatttttgtgattatatggtcaagcaaaagcgagtgatcatgaggggcatttgtgattgatgaaggatggcagtgattgttcactaattgatcaaaaatgtgggaattattgattgatgattcgctaaatgatcaggatgagatgagaaaaagaatgatcaacgaactgttaaagaaggaagtaggtaattaacggtttgctatattatcaattacttatcaagatgggtaataaactttagtgatgccaattaatttgcgtaaatttctttgtaattaattaattcatcgttaattgaagcatgaacaaatttgaacaggagtagtgatttgtgaagcattgctagtaaatgtactggtttttgagaaattgagggtgagaaaatttggaaaaacacgaaaaattccatcaaatttgtaaaaaaaatttttgccgtttttgtaagaattaattttcattttaaatttgtgagcccacatcagacggagcagcaggcattttttgaggggcttctttattcatccttgaaaaatttttatggtaaatttcgtggaaaatgccaaagtgattaattggttggctcgtccgccgccgcgttttttttcctcctctacaaaaattggcattctccagacaccaaccaatttttcaccaattcttttttgaagctgttttttggcacacattatgccaatttccatggcatagaatggaattgagtgccaaaaatttagaaaaaaaaaatgaaaaatttataaaacgcgcatttaaagaaataatggaaatttgtaagtataaaaaatagatgtatggtagcaaattaatttaaaattttgaaaaaaagctaaaataaaatgccaaattgaaaaataaaaatgccaaattaaaaagccacattttaattaaaaagaattaaataaatatcacaaagtaaaagagcactttaatatacctatatgaataaaagcagcattttggcactaccatttttcaactatttgcgcagcagcagcacattatatgtccacggtaaagcaaaaaaaaaaaaaaagattttctcagacgcaatgccacgccaaatttcaaacaaaaaacgaaatgcgctttttcgcgcatacgccagtgcccgccgccaatggcactaacggcggcggtgatggtggcggcatattttgtaccctttgcgtggagaaagtttcccgcccccacctcgcgtggagggcacagcactaacaaattttataccctcggggcacggcaacggcacgcaccccatccacaaattttgtacaatgagtgaatggcatgggaaaacaacacaacaaattcttttatcggcaccgcacgctttcacatgctttgtgccagtgccaccaccgccggccgcatttgccccgcggggctcggcacttggcggcaaaggcacaaaacgccaaaacaaatcgaaattttttttcaatgattttttgtaccggcgccggcacactatgtacaaaatgtgctgttgtatggtgccacacaaaaggggaaaatttgtggccgccgctggcgagaaaatttttaaagtgacaattttcaaaaaaaaaattggcatagcaaaatttttgttttttaccgtagcctactatcgtaccgccaaagtgccatccatttttgtttattgaaagatttcggcattttacgagaaattttcggcattttacgatgggtgtttcaataaaatttaaaatgcctttttgaaatttgcattttcgctaaattaattttgaattttttcccatattcccaatttttcttgacctaacgcataactctttttttttttgaaaattcaattataaatacatatttgttgttgtttgttccgttttgtggaacggaaattcaatttttgtgccgaagggctcgcgcattttgccaaaatcggcggcacatggattgtgccgaatacaaaaagtgtgccgaagatgaatgaatgggagtttgtggcacaaccattgtggcacacaaaaggggggggggggcggaaagggaagagattatgcaaatccaatggctcacaattgcgggaggacggatgaaggatgaatgaatggaggagaaacggaaaagccggcggggcatttccatttttaaatatatctattttcatggacaaaaagcgccgaggaatcgatgggcggttaaaatggtgccaaatttgggaaatttccaggaaaaacaaaaaattctggaggggattagggggtaaattgttgttgatttttttggagaaaaaatgctgggagaggcaaaaattggaaaaattcatataaaaaaaaacggttgagagaggtgacagtaaactatgtgaaatttttataattggctgcaaaaaaaaattctgaatatcctttgatagggtaacacatttggggcaaaatgaatgaaataaatttgggaaaacaaaaatcctgcaggggttaaggggtaaattgttaaattttttgaaaattagaaaaattcatggggaaaaatgtgctgtaagagaaggtagtaaataggtatggtgtgaaacttttttttaaaaaatcctttgataggtgtcgtcgcacttgggagaaaaataaataatttgggtatttcaaaaaaatatatatcaaaaatttagaaaaaaattttcttcccctgcgttcaaaatgtggaaattggtttaaaaatgatagttattagagagagagagagagagaagagaataggataaatggcgccaaaaaaattttaaaaaatttttgaattttttttccacaaaaaaattaactgaatggaaactgtaccgaccgatttggcccaacatttggcagcttccatccaaatttgttgccccagcatttgttgtgccaatgttgtccaatgatgccaatgccgagatgccgcccattgttgttgtgctgctgctggtggtggttgtgccgccgctgccattcaacaacagcgagttggacgtgcacggctcgttgttgttgatgatgttgttgagcagtgttgtggagatggagcggtcaagggacctaaagcaaaaaattttggaatttttggggaattttttggcaaaattaagaagaaaaaatggcatattttattgaaaataagtgcgaggatcataatcatagccgaattttctttgataattttaaagacttcagcctcattagtttaatgaggcgaaaaaagtttgtgccatggtcgagattctcgatcccattttagcagagattaaaaatttttccaatttgaagagcagtgcctttgctgcgcaaagccatcaaccactgttgttgtagagggggaagatgaagcggaggatgaagccgctgccggtgccgtcgttgtcgtcgccgacgattgaatgccgacggaggaagaggcggaatgcggtggtggcaccagcaattcggcctcggcaccactagtgaccaccattttgggtgttggtgaaatcaatttcggcaccaccactgtgccctgcggggatttggggcg

SEQ ID NO: 5805 - DNA, 1339 bp, Heterodera glycines
  misc_feature (1179)..(1179): n is a, c, g, or t
gcgctgagttatgcgcaaatgtgccacgtggtgcgctctcccagtgaccgacagacagaagaaattggagatgccccactataaggaaagccatttttggcaaattggaaagttttttaaatttttttatccttgggcggctaacaaattacctgtaatttaaatggtgttttttgaaaattttcaaaaattcattttgcttggaaatttgcggaccaagcgaagttgtttagaaagtaaaaagtttaaaaaaaaaatttcggctttataatttaaattttcaaaaataaacctcccaatttttcataaaaatccggactttttttagcaaattgaaggatttttttgatttttattagccttgtttttggcttcataatttaaattttgaaaaagaacccaaatttttcccataaaatttcaaaattttttttattctttcgtaccccggggctgttggttaattaattattcttcaaatgcctatgctctgcatcgaaatgatcatccgaagaacaaaaattaatcctacagagaatgtgtttggtgtgaattctgcgcgtcgtgtcctcaggggggcttccccgccgccgttggcatttaaatgaaaatcccaccgtgtttttttatttaaatttcagacatcccccgccggcggaagacaaaaatgggtacaagcgtcggcacggcacatttgaggaaggaaaaatggggggatttaggaaagcgcagtgtcacccgcaccgaccccgacgggcggggaatttcggcacaaaactcgaaaacagcagacagactggcatctctgccttccatcccctgaggagctagacttagagcaggccagtcgggcggggtatgatggcatggcacacgaattttgtgccgtaaaacgtaagggcagcgagaggacaggcggccgttcctgccagccggaccggcttgcagcaacagcagcggaacgccgattaaactatattatgtatgcactgttctggctggttggctggctggtggcgtggcgctaaaaggacgggacggcgtgccctgccctccgtcccctccggggaaatgggttgttggattgggtttgggcggtcttttttggatgctcttctgttgctgctgaggacgtccctcccccctccggcgtcggcgccgcctcaggggttgggttgngtttagagaagcggcaacgaatccctgcggacttgtagtgggggcagggggagggggaaatgggcgtttttggggggttggatacccctccgtccccgggggtgggaaggaagttccgccccctcccctccccccccccccccctcgggggggggggggg

SEQ ID NO: 5806 - DNA, 3132 bp, Heterodera glycines
gaaaaagggcatattggatctgcggaagggtcgctcctcttagtgtatggcctatttcttacttgggcgctgttggttcgagaatattcctctatgctttattaggatgaaacttagggtatctcgcaagtcataaaaggtttctccatgcaggcaatctactgtaccatgagtcataaccgcggggtgggctcaagaaaggactacagagatggggtgttcattgggggttcagcgagttactcatatagtcacatcagtacaactaatggtagcaaatgcctgcaattgggaagatgcataagaataggagcagtgtccatacgtgtgccacctgtaaccctccattaaactccttggggaaatattactatcgtgcctggcgtatgttggtcggctacgtgggtgccaaccatcccagaaattactttaatcggagagttcgcgaaccaccccccgactccggacattgccgtagccactccgcccccgcccccatgaatttgcgaccccacatagtgcgccaccccccccccccccccccccccccccctcggggggggggggggggcttgaagtgggcgaggcaaatgggcggtgacgactctccgccggcggcgcagcgcagttaccgtaattatttgggcgccgagcggggcgttaagtgttagtggtccgtcgtccccccgggggtgggcagatgagcggccggtcgtccccccgggggaagaattctctcctcttctcacaaccttttctgctgctatatgtgtgtgtctgtgtgcatttccggaccgcgctttttcccaatttcaaaaaaggcggaagaaaaaaaaaatttttattttttgaaaaataattttttagcggagaaaaattttgggttttgaatatttgtgaaaaattttctgctctcttctgtcaaacggaaaatttaattaaaaatattgttgcgcaaatttaatggacaatttttaagttaaaaaattcttttgggtttttcaatcaaaaagtttttaagagcgaagaaaatttaatttatttttagaaattaaaaaaatagacattttacaagcatgaaaatttcccatttaaaatacaaataattaaaatatatatatatatatatatatatctttacaaaggtttagtgtcaagaaaattttaaactcaaaaaaatgaaaaaacatataaaaagtttttaaattaaacagaaaatttaaatcgaacatttaaaaaatgaaaatatgtttcattcaccaccatttcaaactttttaaaattaaccacatttcgatttattcttccaaattttgcgctgtaaaaataattaatttcggcaattttttggcaaaaaaaaattaaaattaatttttgtcgcaataaatttaaaaaaaaaagaaagcgaagaaataatagcattttattcaacaataaaaaaagcgtttcacctttcctcacagcggacgagaagaaaagaataaaagtaaaaagaaaaaaaataaaataacaaaaattatctttatttatttataaaaatgtcaaaaaaataaaaaataaaataaataataaaataataaaaggcgaaaaaagcagcggaggacggggaacaaaaacagcttcagtcagaacaattggaacaaaaagtgtgaaaagttttgtctgttttttaaagggtaaaattggtgggggggggaggaaaagcacagcgaatgaaagggaaaagcaaagcaaaaatgagtcagaaaatggggaaaaaagcgaaaaaaatccgggacgaacttttccaaaaagttaccaaatttggaaagaggtgtttttttaaatttattttttgacgcacgtactcaattttcaaattcctattaatttgaatgaatttttatttaaattttatttaaaaaatagctagtttcgatttcgaaaagattttaattcaaattttatttaataaaaaatataaaaacgatgaactttcaatgaatttgagaaagaatttgaatttaaattttatttaaaatagctagcttcaattttaaaaagaattttaatttaaatttaaaaaaaaatagagaaaacaatgttgtttttctaacaaaataaatcgtctccagatcttcttaactctaaaaaaataaaattcgcgcaataaaaataaaaaaaatttcctggcaatcttttagctcaattaaagaattttttggaagaggagggcgaaagctcggaatttagaaaaaaaattagatttggtgaaatggcaattttcggaatttgaattgctaaactggcacaagtaagtattagcgagctctttgaagttgccgcctttgattggcaaattagccgtgaaaattaaaaaaaaaaagagaaagtggttgaacttataaattttggggcctgtaaaaactgaatgaaatagtgaatggcacataattggccgaaaagaaaatcctctcccattcccccccccccttgggccttgtttgggttttgcagtggtaaggaatgtgtggggcccctgaggcaccatggcttgcgcttacacattcatttccaatcagactaatggatttgccgggccggggagaggggtggcaaaattcgacaaaacccatggcaccgccggcggcaagggccaagccgagtcaaaagtgccatgggctggccgcacacgtataaatagcggaaaaggatgagccgagccaaccaacgctcgtccccccgggggaagagtgccaaaatggtggtggttgtggtggtggtgccaagccaagccgagcaaagagttaagttggtagtggcatggccataacccaaggcagctcatctccatccggcaccgccgttaacggcatacgcccccaggcgccattcgttggttagttggctcaatggcaccgccacggcatacttaaagctttaaggaggggggggggggggtaagtggcgtgagagagagagggaggtgtgcgtgctagtgccgaaatgccaacccgatttcttctacggtaatcgggcgcgccattttacttatccctcaggggcggctttttacattcgcttaccctccgctggcgccctaagcaaaatctgggattatgttggaaaggcaaagatgatttgcgattagat

SEQ ID NO: 5807 - DNA, 8573 bp, Heterodera glycines
  misc_feature (691)..(691): n is a, c, g, or t
  misc_feature (699)..(699): n is a, c, g, or t
  misc_feature (832)..(832): n is a, c, g, or t
  misc_feature (880)..(880): n is a, c, g, or t
  misc_feature (1543)..(1543): n is a, c, g, or t
  misc_feature (8556)..(8556): n is a, c, g, or t
tgtgtcgagtgacaattgtgatggatttttaaatttgtaaacaaagaaaatttacaaatttttatgaaaaattttgcagattttttttttggaaactttttttaaatcagtaattcttcatgaaattttgaaaagtttagaataatttcaaacaaattttcttgaaacactctgttgttgtgcaatgccaacgccaactctccccacagattgacgcgtggccaaattccgatcatcggctgcggcgggatttccagcggcgcggatgcgtacgagaaaatcaaggcgggcgcctccgctgttcaggtgatgggatgggtgtttacgggaggttaacacgagcccacccagaaatttgttggtgactattttggctctctcaaatacggaagtgtcccactctgtactttttaattgaaattttcaaaaaaaaaaaattattttcagaaaatcaacctaaaagcgttgttttttagtagtgtttcactaaacaaaacctcataaaaattttgccgcttttgcagctgtacaccgccattgtgttccaaggctttccggtggtcggacgggtgaagcgcgagttggccgaactgctccaaaaggatggctatgcgcatgttgcggaggcggtgggcgcacagcataggaaaaaatgatcagttttactttgtttatgttcgttgtattggtnttgttgtntgtttttttttggcttacaaattttgtgagcaaatgacagtaaaacaattattcattttttaagaggaaaaattctacaaaaaaaatattttggcccaagaccatttatttgaaacaaatttgggcgacgccngaatgggcgccaatcaaataggcgccagccccccttttctttccctancaattttttattttttgtatcaaattttttcattactacgtatctctgcaaaatttggtgcgcccctgatcaattacaaattatttatggacgatcaaatttttagacattttttaagtgcaaaggtggtgtctgcaaaaaattttcacccgggtttaaaaaacctaggaaaatttgtaagcatttgtagtgctctgatacgtatctttgaaaaatttggtgagcccctgatcaattacaaattatttatggacgatcaaatttttagaaatcaaaaataatgcataaatattttttcagaaactgctctgaaacgcaccaaattttatttacaagttaaataaggcactctgatgcttttactatcaaaaagggagatgaataaaaactttaaaaatttgtaattgctttttaaaaagtcaatattatgctttttgctttccattatcgggtttatcaattttgggagaagtataaagtacttagtattttgacagatttgggacctcccaatcagaaaaataacacagattgaaagccctgctatcttaaaacgtcgaattcagcagaaattatgatggaacgtggcattgaaaaattattgctctgcggagtttttagtggtctttattcgaaaatttcgattcaagaatcattcaacgnagaattatgcacaaaaatgggccaaccaaccattcatggactcccatatttcttggaataaaattggttttgaattccccaaattgacgcttctttttgctcaccatcaacgctcatttcagcgaagcaaaattttttgatgtccgtctcatgccattccgtctgtttgactttggccatttcaatgattgtgctgccaagtgtttgcaacatttttgtgtcctaatacaaacaaaatacacacacacagtgttccgcatcattagctaatgaagggctgaagaatgaagaaaattgatcttccccccccccccctccgagtatcactattttggagttttcactattttggcgttttgtcactattttttcactatgtcaaaaatgcaaatacacccctaagaatcgagctaaaatttttcaaaatatactcctatgaaatgaaaaaattttctaaaaaatttactttcttggcaaaaatttttaattttaaaaatttttttaggtaactattttgggttttttggtcttaaaaatccctgtcctactcatttgcaactgcaatcagtgaataaaattatttttgctcaatttttggctgaaaattatgtcactatttcagactttttgtcactattttggcatttttactcactatttatgttaactattttttgaaaaaacgaattttgcctatattttttgttttgcttacaatgtttattcacacacacatagcatatacatacatacattcacacacgcaaatattgaaatgacaacagtttttgggggagttcatgtgaaatgggggtttacaatacaatacaacaatggggggtcagatgatccgatttctccacacgcatcgctctccgggcagttccaccatccttctgtgtgcagttagtgtgtgtgcgcgttctgtccgtccgtgttgtgttcgttaattatttgaattaacgccaaaagatgctcgtttatcgatcatccttttgacccttcgtgttgtccatttaaaccccccttttcccccattccgtgcatttctccctcattcatttgttgtttccatttaattgtgacccgctccctcccttcgctatttattatatttatttgtgtggaataaatcaatattattccattgactgttgaacggacacaacagttattggcgcagtcagcgaaagcaaagacgagcgaaacaaaagcggagaggaacgacgcaacaaatcgtcaattggaattgctaattccgagttggaatagcaattgccaaatcgtctgagaataaagctaattcccagtggaatagctgcacacccaggaggtggcattctcaattactggtgttaatccgagttggataacagccagacgtcaatcgccgaatttggagaatttctacattcaattgttaatccgagacggataacaattgcgaatcactgttaattcgagttgaataacagtgaccgtccatcatcaatttcattgttaatccggttcggataacaattgacaatcactgttaatcccagttggataacagttgaccatccatcatctttaatttgatcctagtttggacaaattataaaacgcaacaatggcagcggttgtaaaggctggcaaaggaccaggcccttatacatcggaaacgtcgtggaccatttgggaagaacgatttgagtttttcatcaaactccgaggcatcactgatgcggagacgaaaaaattgctcttcttctcggagattgggccaatatacgaagagcttcgccaaatggcgttgccagacgacgtccgcgacatgtcaattgatgagatcaaagcgctgatggaggaacgatttggcgagacgaagacgattgcggcaaaaaggtttgagctgttttcagccaaacaatcatcaggactgtccattcgtgattactcaatccaacttcggaccttaatttccaaagccgaatggcataaggattcggtcgacatgtgcctgagcgctcttttcatcaacggccttaaaaaggattcaattcgggccgagttgataaagaagggagtgaacgaaatgaagttcaaagatgccgttgaaacggcagtgcttctcgagcagtccgacttggacgcagagcaaatcggtgggcataagaaagcggaagtggcgaaagtctttgctccaaagggaggaagaaagattagcgcaccaacgcagcaaatgcaatgccatcgatgcgggaggaatggccaccgcaacaacgagtgcccgaacaaggactcaaaatgccgaaagtgcggcaatgttggacactgggctgtgatgtgcaagacaaagcagggctccaattggccaaggaggcaagggaagccggttcaccaggtcaacactgaaagccaaaaagcacacgatattggaacactggccaagtctgaagaagtcaaatcgatttcagtgccaccagcgatgataaaacttcagctgagtaaaaaggcgacagatttcgaattggactgtggcgcagatgtcacactcatcaccaagaatgattggatgtccatcggaaggccgaaacttggacaaacttcaggattgatggcatatggaaaaaagccgatcaaagtccttggatcgttcaaaacggatgtggtgtacaacggcaaagaagtgaataccgaaatttatgtcgtggacggcgaaggcaaaaatttgtgtgggagagatttgattggtgaattgcaaatcgatctcaacaaagcgttcggaatgcgatcgatcaatgaagtcaagtgcaaggcagtggatcgagagctgggagcggtgcttctaaagtacgatgaggtcttcaatgacggactcggccgatgcacaaggcaaatttcgttgaaatttaagccggaggtgcaatcgaagaagtgcaagccacgccccgtgccttttgcattgagacccgaagtggagaaggtcatcgacaactgggtcaaagatggagtgttagagcaggtgacaacgtctgagtgggcaacaccgttggtgattgtacccaaagccggaaacaaaattcgcttatgttgcgactacaaagtcacggttaatcaatggctcgacattcatcaatacccgttgccgcgcccagaagaattgttcagcgtgttgaacggaggcgaaaagttttcaaagttggatttgaaggaggcttatcttcaactaatgttggatgataaagccaaggaatgcttgaccatttgcacgcataaaggcttataccaatttacgcgtatgccttatggtgttgcgtcagcgccagcaattttccaacaagtgatggaagacgtccctcgtggaatcgacggagtcgccgtctacttggatgatattgtggtgacagcccccaacgacgcggaacatttgaaacggctggaaatgactctccaacgcatccaaaaatttgggttgcgtgtcaaaaaggaaaaatgttcctttatgcaaaagcaaattgcttatttggggcacatcatcgacaaagaagggattcgaatgtcgccggacaaagttgaggccatacagaaaatgccagcccccaaaaacttaaaggaattgcaatccttcttgggcatggttgggtattatggcaagttcattccgtcaatggcaacaatttcggagccgttgaacgagctacgccgatcagagaccaaatggcattggggacaacaacagcaaaaatcattcgaacagatcaaaattatgctgtcgtcgaacgagctgttggcccattttgatcccaaaaagccactttatttggcaacagacgcatctgactatggagttggagcgatccttttccacaaagatggaaacacaggagagtttggcgtgatcgcatacgcctcaagaacattgagcccagccgaaagaaattatgcgcagatcgaaaaagaaggacgcgcagtaatcttcggcgtgaagaaattcaaccagtacttgtacggtagaaaattcattctacagacggatcacgagcctttaaaaaggatttttggaccaaaaggtgaattgcccgtggttgcggcacgacgacttcatcgttggagtttgaagctcatgaattatgacttcgaaatcgaatattgttcgacaaaaaatttcggttacgccgatggattgtcgcggttgcctagtccagaaattgatcaggtctgtaaggaaagtctcgagctgaacaaaatccagcaggagagccaaaacgctttgccgatcactgcgaaggacattgcgaaagaaattggcaatgatccggtcttcgcaaaagtaaaaggttttgtgctcaatggatggccaacaaggatagaagacgagaaaattcgcccattttttctggtaaaagacgaattggagctgaataacgaatgcctaatgttgggatgtcggacagtgattccgagcaaattccgtgagaatcttttgaaattgatccacgagacgcatccaggaatcgtccgaatgaaggcattggccaggcaaaaagtttggtggccgggcatcgacaaagacattgaaagcatgaaaaagaagtgcaaaatttgtcaaacgaatgcgccggaaatgaggaaagtccctctccatccatgggaagtgccagaaaagccatggcagcgacttcacattgacttctgtggcccatttttcggaaaaatgtggctgatcacggttgatgccaagacaaaatggccagaagttgcaatcatgaaaagtactacgaccgaggcaacgattgaggcacttcgaaaattgatttggacccacggattgccagaacaaattgtgtctgacaacgggccgcaattcgcgtcaaaggagtttgaagaattctgctccaaacgcggaattgaacgaacgctgacggcaccataccacccgcagagcaatggggaagccgagcgttttgtccaaacattcaagaaaggaatgttgttggttaaaaaagaaaccaactgggacaatgaattggccatgaaccaattcttactcaaataccgagtaactcctcattctgcaacaggacggtctcctgcagaaatgatgttcggcagaaagctgcgaacactgctcgacctcgtgcgcccgtccgaatcgaccgaaattgaaggaggagaagagaaggcgaaagaaaatgctgaaaagcatggccaaaaatatttggctcgcgccaaaaagaactttgatcgacggacgtggaaacgatcgtttaaaactggacaaagagtctttgccaggaattacagagacggttcgaagtggatggcaggccaaatcatgagccaaataagcccatcactgtttcttgtccgaacagcccgcggggtctggaagcggcacttagatcagctgaaatcggacgagacgaagcctgatctggagagcaacaccgacgtggactcaacatcgtccataggtgatcagacggaggatgaaaaggacggaggacagcagacggacgtggaagaagagccgaacgatccgccaaatttgcacgatccgccattgagaagatcggtgcgcgaacgaactccacgacagatcttcgaccccagcgcgtgatcgctgacttcagctggtggggaggagatgttgtgttcgttaattatttgaattaacgccaaaagatgctcgtttatcgatcatccttttgacccttcgtgttgtccatttaaaccccccttttcccccattccgtgcattctccctcattcattaattgtttccatttaattgtgacccgctccctcccttcgctatttattatatttatttgtgtggaataaatcaatattattccattgactgttgaacggacacaacagttattggcgcagtcagcgaaaaaaaagacgagcgaaacaaaagtggagaggaacgacgcaacaaatcgtcaattggaattgctaattccgagttggaatagcaattgccaaatcgtctgagaataaagctaattcccagtggaatagctgcacacccaggaggttgcattctcaattactggtgttaatccgagttggataacagccagacgtcaatcgccgaatttggagaatttctacattcaattgttaatccgagacggataacaattgcgaatcactgttaattcgagttgaataacagtgaccgtccatcatcaatttcattgttaatccggttcggataacaattgacaatcactgttaatcccagttggataacagttgaccatccatcatctttaatttgatcctagtttggacaaattataaaacgcaacaatggcagcggttgtaaaggctggcaaaggaccaggccattatacatcggaaacgtcgtggaccatttgggaagaacgatttgagtttttcatcaaactccgaggcatcactgatgcggagacgaaaaaattgctcttcttctcggagattgggccaatatacgaagagcttcgccaaatggcgttgccagacgatgtccgcgacagtttgctagtattgaaaacagtggaatataaaaaaattatcgtaattttaagcaaaaaattaaagatgagcccaggggcataattgagaaaaattgaaatgttgagggggtttaagcaacaacgtgttaatgttatgaatgataattaaccacattgcatgcgattaaacactgtggagtaattagagttattttttttaatgtctttctaaattttgactatttaatataccgacaaaaggaataacaaatttgaagatatcaaatttgtttgaggatgctggctataacatagacttaatgtaactgctccaaaacaaggtgcagaaaaaagtaaaatatttgattaaaacattttcatcctatttattcaacgctctagatataaaaaagattatttttaacaaaaactaggaatatcagccttttaagtgatatggaaaagtttgctagtagtgaaaacagtggaatataaaaaaattatcgtaattttaagcanaaaaattaaagatgagc

SEQ ID NO: 5808 - DNA, 4883 bp, Heterodera glycines
ttcgtctccgactggacgcttagaagcagcagaaaattttgagcaacagctccagaacaatgggaacggcgatgaacagcagggcagcgaatgttccatttgcatgaacaacagagtgaacgcggtcatctaccggtgtggacatatgtgcatgtgggttcagcagttgtgtgaaacgattagcacaataaattattggctttattgttttctactagtgcactcaccttttacgcgtttaatattaattttatgatatgaatacacaataagcgcttcttaaattgattcaacacatgaaaaaacgtcttaccctatcttttgtttctgtgactattcactaacgcccctatctcttacaggcataatgacagcattatatcctattctaatttatctgttcaattccttctgaccttttctgaaagaataattatatacctgaatctcctattattttagttatttttcttatccttaaaaaattaaaattcagtagcaatgttattataaaatggatgattaaagttgtaataattagcaaaaaaaaatgttttctattgtaattaaccaattttgctttttatgagttgggaattgactcaaaataaacatttttcttaaatttttattaaattaacaaattttaatcagtaatattaatagaaaatttaattccgctaaattcgcttcccaaaaaattcaatgccgatttggcgctttctattttccgttaatgtcgcattaataattttggactctctttgatgaattgggcggggggggggaggggcaaaatgaacagcagcagcagtaatagtgctaataacataagcattttggaaattttactactaaaagcaccaaaatgcggaccaaaaaatgtaaaaattcaattacaaaatttttttaaaataaatttaaaagcaaagattggtaaatagaaataaatatcaattaaaataaaaaaaaataaattaaaattgacaaaacaacataatttattatttagaatttatataagtatggccatgagggattttaaatggtcaaattataacatttctttcaaaagtgccaaaagccatttttgtgccttatttgcgcgtgtaaattggcagattttacaccagaaaatgctgcatttgacagaagttttccaatgaaaatagaaaagcgcagaaattagtctttttgttaggaaagctaaaataagaaataaatgtttaaaaaaaaatagtagccaacatttttagtaaattgattaataaagtcagcgaccacaaatttggcgcttagtttttgtgtccccatacataaagcatggaatcggcagcagctttggcttaatttgagtcaaatttcaaggaattactggataaaaataggacgagaaaaacgcttggggtagttgagcacattaaaacaatttaaagagtaaaaaaatatgaataaatttttacgggaaaatttaaaataaatctaaaaaaagttttacttttccctgttggggcctatttcaattcggatcctatctcagatacgacatgtcttatatgtagatttataagtcagaggccttacactagacatacataaaacccgaaagtaaaaaattagataatttgaagaataatttttaatttacgttaatttaataataataataaaaaaaattatttaatcgaacagaaaaattatgaaaaggaaaatttaaataaaaataataatttgatcaatctacagtgtgaaacatacatatatggtcaactggttaaagcatcaatctttcttcattttctgcccggattcgatcgccacacacttaacaaaatttcattattattaattttgtaaattttcctaaagcaaaacattattttttcaaaatttaattaattgaaattttattaccaccaaaaataaataaacaattagaatatttctttacattttaaaacctagcctgaaaatcctcattgatctttttttggtgcaaaaattttttaatgcggaccaaaaatcccttttctgtcccaaaatacagagaaatggccatttttggacaaattctgttaacaatcataacaaattttatcttcgcggcgcctcccgacgccaccggccctatattttcaaaaaaaaaaattttaaaaagcccgaataaaatttttttaatttatttttttcatttataataaaattttaaaatgctgatttttgtcggccaaatgctgatttggaaattttcagttgggagccccataataagctcagtctgttcaagacttaagatttataagtttaaatagaattagacgggtctcttgatattttcgggcccaaataagccgggtattcaggtctaagtccaaacagaaaactagtacacgtctaaccttacgtttaaacagctgtaagaattgactaaatagactaaataataagatcatcaggtttcaattcttctatttttttaattttcaagaaaatataaatttttaagcacaaatttgttaaaagttattaaatttaattagttttataacttttaatgtcaagctcgccataattgtattttctcattttttgggtcattttaaatcgtatccaccatttttgagaagttttaagtttgagagctatgactaatcctcaatctttactgcctttttttaatttttgtgagtgaatgattggcaattttaattgtgaaagtccaaagcctcttatgcaaaggccatttcttttgtcacgcataagactcgaaaatgtttcattggtttgactgaacaaaatcttattttatcaaatacttttattattaccatagtcatgaattgtaagggtcaaaattgtcggtaaattttttaaaaatattgtggatcaattattaataatttcacttgtcttattttagtaatcatagtatatttaaccgaaaccgaccgaccgaagtttcggggatcctggtttggtcatctccgttctcaccattccccggtttgacgggatgtcccgctggctacgagccagcacttaagaagtggcaaaatgagagaaatatgcaatactttctcggatggcttttgaactcatggcctaccttttattcaaatagtaaataaaattataatatttggtttggtgccaaatttcttcgtccattgttgtaagttggtatatgggatgccaatttttttatcaattttatttttactaatcattttgtttctttttttcatctccttacgagtgattaaaccgaattttctcttccaacgataaattgaatcccacgaaacaccaatttttccgctatttttactttaattttccaattgggtttaaaattaaatttttttttcaaattcttcattgattttttcgaattgctcaatttttttcagcttttatttatttggtaggctctttaataaatcttaaaatgagtcaatttgtaagatttaaatattttcatttcttcttaccaaattgcttcttccattcgtaaattttatgacgacaaattcccaaattttctgtaattatattcaatatctttcttttcttatcgtcatatttaaaaccatgaattttttcttttcttaattgatcaaactttctaatcagttcaatcattgtgtccttatttatgtccttaagtacagtgcacttctgttttgtcctaattttttcttcaatttacaaattgtatttcgatcagcgcccattttttcctttccttttcttttttctacctcaaatattataaggacccattaaattaaaaaataataattatttattcgagcttgtggaagtcctatcgtatattaccgtatcattgtaatcctcatcaatttcaaaaatactctgatcagaatacggagcattttgatcaaactgctcatcaatatcattaatctcattttcaaatgatctttcgctcaattggtcgaattcaatttttggcactttgagtgttgtttttaaataattcttttgttcctccaatggttctgttttaatttcttgcttaattattggctttaggtcttcattttctttttctatgtaattttcagactttataattatttccttagcattttgttgtttataattttcattgttaccaataattgtttcctttatcgattgattttctgtgtatttttgatttttaaaacttttcgggatcgaatcgatagctgtgtatttttccataaatcatcaaataaatcttcatcaattccaccaattagtacgattaaaaataaaaagaaaataatcataagattaattttcggcattttttgcgtcaaaaaattaaatgttgttaacttaattaaaaactaaatatttttcattatataagcaaatataatgtatgatatatgtgattaataaaattaaacaacaattatcaaaatattaatcagtgctttcaaccaaatatcactgtaagaaattctgcttgtcttacattactatcagggttgccgcgggtcgaaaaaaatatcgggtcgggtttcgggtcgggtcggcagaaaattatcgggtcgggtttcgggtcgagaaaaatgtcgggtttcaggtatcgggtttcgggtcaattgacaaatttttataatatgttcaaaatcgataagaattttttttatcgaatgaaaaatcaataaaaattttcggctctagtgcactttatgagtccaatcgacttttatgagtccaattgagttttatgagtccaatcaattgacaatcccgtgtttttatacaataactttgttcatgttcgaacaaatcctatctttttggtatcattcgaaagcacaaagtctaacgaagctaaaatatataaaatcgcagcgttcagg

SEQ ID NO: 5809 - DNA, 1058 bp, Heterodera glycines
cgccaaatttcaaatgctctctcaatgagtatttggccgctgttgtggcttataacggtttttatttcaatgttccagtgaaaacaatcgcaaaaattgtattgagtttgatttttgctgttctgtcctcccaaaatttgtccacaaaacagcagcagaattctaatgagacaatttttgatggcattttgacatttgaccatttttcggtgatccgtccaaatgaatttgaatttggcgccgaagaattggcgggaaatttgaaaattgaatttaacgaaacgatggaaaatgtcaaagacccacgggaaagaacactttcgccagaacaaagagcgaaaaagcagatgatttggctgaaaaatgtgctgtttatgagccctgatcaaatcaaagtttgtcattaaccaattaattacccaattaaataaatatttttaaattaaattcaggataacagaagcacaactttggtgaaagacttggtgtggttcgtcggtttgctgctctacagaatgttgttcaacaacaaacaccccatggacaattgggagccaaagcgccgtttggacatggaatttatggcaaagatgggcttctcagggtcagattatttctacatgtacaaaagagatgattttgtgccgggagactttcgcatctttccgttgaagccaaaaagtcggtggatttggatgccggagaatgggcgagacgaaactggggaaatggcactggtggaggaacgaattggcatggaacaggtggccaattaaaatgtcaaaacggtgttattaattaatttttctttttacctaggattatatcgtcaaattgagtggcattgtctctgaaactatgcagaataatcaaattatgagctattcttattctccaagatttagttttaatcaagagaatgaagggcaggaaaagctgattgagcttaacaaagtgagcatttgtcataattataccaattaattttattgctaattattcctaatttagatgtgccatcgaacctttgctgactatagaatttcattcagtttcat

SEQ ID NO: 5810 - DNA, 988 bp, Heterodera glycines
ggaaccattacaggtccaggtccaacaaggaatccaagccagttcaagcattttcaagatagcaaactctctaatcatcaaaatattatttattaccaacgctttttgtaaaatcctcttttggtatgagtggaaaacgaatgttggacaatattgggtcaagaattttgcctcgattttcagccgaacattcgatgcctttttgacggcactgttcgtcggaccaacggagtgccttaattttagaaaataaataattgtaatttataatatttaatttaccgcattccaaatttcgatttcactgcttctcagctcatctcttttgagaatttcacacaacaaattttgatcaatttgcaaaaaggattctgatttgatcaaagcattgatatttcgatcaatgtagtgcaaacaacggagagaaaaatcccaaaaataaaaatattataaaaaattatataattattactagggattgttttttatgtaaatacatatttttttctggtttctacatgctttgaatagtaggaaaatcactttattttttgtttttgcgaacaaaagttgggacctttatttacatatttggtatatattttgggtttttctacatattacatatgtacatatttttatacatattttggacttttttcgtatatatttcgcaatctttcgtaccggactgggacagtttagtctggccggtttattctgaaccaagtttagagcatcataactcttttctttgttgaccaaatccaacaataattgtatcattcgaaagctcttaataagctctatcggcttcccaaaaaccacaaggatataccgacatataaaaaagttataagtaaaaatatgcaaaaattctgactttttggtagtattcatcttgcaacttttttataacttgttaaatcgcttaagaatagcttatcacaagcttctaaacatgtggaactttcaaatgatgctaaat

SEQ ID NO: 5811 - DNA, 1142 bp, Heterodera glycines
ccgtggatttggaaatttcattacttttgcggtgagtaattttttaacatatttacttaattggcatatctaattatggttaatcaaggaattgatggactcgaacaagagcttttacaacaaagcagaggacaaattggcattggccattgatgtcataactgttgatgagccaaaaatggagaaattcatttccgatcccaacaaatccaacggcacactttcaatggaaattgaaaaagtgtcggaatttgcgcgagaaatcttttggagtgaacgtaaaagcgaaactgtgcacatcaaaggatttccatggaaagtatgggcacgaaaaagaggggaaattggaagcactgacactgcgaaatggttgagcatttatctattgtgtgatgctactgaaaaaggtgcaaaattactaataattaatatatatattaaaaacaattaattaattgatattgagcagaaaattggagttgcaaatgctcgggaaatgttcgaattgtctcacaaaagaacggagtgttggacgaattcgttgaccttatttttgacaataagaccatgttgcaatgtgtcgctatcatttcttttgctgtgagtgacaattaaactttcccttaattgacccaattatggaaaattaaggaattgttggactcgagcaaaggattgtatgacaaaaaagaggacaaagtgacattggccattgatgtcacagtgaaagaagcaaaaacggaggacgaaacataaatgcccaatatgatctggcaaaaatctcatcattgaattatcatcctatggacctgctgtgtttagcttctttcttattgtttatcttttgggttttacaatattgatttatggattattaaagcggctttttttaagcattgaaatgaaattggcatatcccctgctgtgccttctattgcttaacaattaattggtcattaaattctgttcggtaatccgccacgccgctcttttttgaaacaacaattccttcagtttaatcttttaatttttttgggtcaccattttacttcgataaaaattatatgggaaaatggaggtgggggagggggaagataagcaaatccaattcaaatgccaatgggtaattgagttcatttttc

SEQ ID NO: 5812 - DNA, 3519 bp, Heterodera glycines
  misc_feature (32)..(32): n is a, c, g, or t
taaaacaaaaatgtaataaaaaaataataatnttataaataaatcaaagaaaagtaataaaaaaataataattaaaataataatttgatagaaaattattaaatgtaaaaaaattaatttaaaaaaaaaaaaaaaaatttaattttcaactaatatttgaattattgttgagatgaatcgaaatcgtacgaaggagaagtaagctcatcagcagagtcatttgagaccaaattaagcaattaagcaacaaagtcagcaacaaattccgatcattgtttatcggctagaacaaagacaagcagaaaaagccgccgcacgtttttgattttatataaaaaggacaggaagggataaaatggataaaatacagtaggaagtaccgtaagaactgagaccactataatttttttattttcaaatttttgctatataatttttaggctaatctttgtcataaaattctttttttttgttgagtgtttgtcgtacattatagtaataaatttatactgtgggtgtattatactgtagggcgtttgcaattataattgtttagtgtaatctagggttaagccccgaccccgagccccccgaccccgacccccgacatttttgggacctattccccgacccgacccccgacatgtcgccccccgaggttcccggcccccgactttttgccccccgaccccccgacactaattcgggggattggggactccgagcgttttaaaaatttaaaagttatgcaaccaaaacatttaaattttacctatcactaagccaaaataaaagtttttttctcactcttttagaaaaattaataatatataatttgccaaattaaactttgcacagatttacaattttccaggaaatttaatagattttcacccaattgattacttttaatggcttcaaaagcatctgatatttggaattttttcacgaaaatttcttcagaggttgctaagtgccggctttgtgaaaaccaattagcgtgtaagaaatcgtgcacaaaaggattgtgggggcattttaaagcgaaacacgctaaagaatttgaaaactatttgcaaaaatccgacccgtcaacggtaatacaagcttccttttttattgaatataaaaaaattcagaaaaaccaaggcattacaaaattttttggcaatgaagacccacaaaaaaaggcggatgaacaaattgcaaggctgatgataagaacgaattgctcttttttatttgttgaggcaccggaattacagaatttgttctctttggcctacccgaaactccaagtaatatttttcacccatttttactattgtcatattttttaagcttcgccgaaaagattattttcggaggaatgtaattcccaaaatggccgatgaaattcaacaaaaaattgttcagggaattggtccggattttttttctgtgacctctgatggatggtcgcaaattacaaaatcacccgcactcttaaggttctctattccttttcatagtttataaaaacagactttagtgttactgtacaccatataaatcaacaatttgtacacgccgattttgtacttgatgtgattccaatgacaaatcacacaggagttgacatagcggaagaaattggaaacgctcttcggacaaatggattaaacccagaaaaaattatttgtttggttcgtgacaacgcaaaaaacatgataagggccacaaatattttgaacttgaataggttttacctaatttttgttttttataattatttttttaagctttcaatgtgtgtgccattttcttcatcttgttatgggagacgtattgggactgtctgagttggcaggactcatttccaaaattcggtcttgggttactttttttcgtacaagtaaaggcctgtccttgctccgcgactatcaagaaaagacaaattctaagccaaaaaaactcacaatggtttcataaattattgttttcacaattattcttttaaattaaggcctgcccgacccggtggaactcgacctttgaaatgatgatggcatttcgtgaacaaaaaaacgttcttttaactattgaaggagaaagacgaggatttggtgttggctcatcaaaaaagtcgcgcctagatattgtccctgaaaatttaccaaatttggaaattaacgactttgattttttgcgcgaactgtgccctttattggaaattaatcatcgagagactttaaaagcaagtgaaatatgttaaaactaaaacaattgtaaacaatttcagttttctaatgaaaaatcgtcagcatcaaccgttatttcgactataaaaagattgcgtgattttttgcaagaaaaaactttctcaaatcgcattttgggcgtttctagggtcatagtggagtctttaaatgaacgagttcgtgaactttgcagcaacccactgttgcgagtcgcaatgctacttgatcctcgatttgcttacacagaactgttttctcagcaaaattggagggttgtcgaacagcaattaatcgaatttgcaaaagagagttggttgaattattagaatatttggtaattaaaatatgaatccctttagaattggtctgcccaacaatagaaatggacgataattttgatgtgaacaactttggtcaggttgaatcaggaattgaccgttgctgatcaagaattgagtccaagcagcaacgagagcatagagaaatgtattgacgattgcatcacataaatcggagtaggacaaaacgtcgtcagccgaaacgtcgtcgaacgaatttttcgaccataacttttttctttctcaaccaaattaaacatataaatactttattttctttttagatgatatctgggcccaaccaaaatcaccatgtggtatttctattccctcaacaatttccggagatcatgactctgattttttatcaaaaattgaggctgaacttgcttgttataaggcaggccaaaggatggagtgaacggagacttattttcctggtggaatgaaaacactggccgtcttcccgaattgtcaaaacttgcaagaatggtccacagcattcctgctacatcagtcagttctgaaagactgttctcaaaagctggacttatttttgccaattcacttcgaaataggtcagaaatcaataatgtattaatttattttataatttaaggctttccggcaatactgtgcgccaaaattttgattgtgaaggccaatttggacgcacttttactggcaccaacaaatgaatatgaatcagatgagggaagtaaagaaaaagacgatttttgagttttgaagactttatttactagcattgaaaaagaaaaattattattttttggttaaaatataaatttggtcatcccccgaccggggtccccgacccccgacaattgagctccccccccgacccgacccccgacatgtcgccccccgaggtccccgacccccgactttttgccccccgagggctcggggcttaaccctaa

SEQ ID NO: 5813 - DNA, 1750 bp, Heterodera glycines
aattgtcattcctttaaaattgtcatttcctttcccaatggatggcaaagcgaatgcaaaatttttttcctccttctgacaacactgcccccaaaaaatttctgtctgaccttgaccaactacaaatccccaaagaaattgacactgacaactccattcccgattacgccaagttgcttattcacttggagcccgtcatgggtcgggcacatctgctggaggaccctcagccgcgcccccgaccctgtcgatgggcaacccaagctaagcttaccggtaccagcagcttttttgtacagctcgatgagctctacaaatggtatcaatggcgtccggctatgtctactacaaatggagaaaattggcgagaagtgatgtcaaaaattgaaaaattagaaattttgaaaatgacttgcgtcccgccgtacattagtattaaccggacggcgccgtgttttgtgaattgaataattaaatttatttatttaattttatcgatcactgagcttttttgtggaacgacctagcaccgttttgaagaaaggagctcaaaaaccgcatttctacgtttaaatttttcgattatgttgtcactatcggtcactagaaatcattatttttgagcttcgtcactaaaaatagcgaaaaaacactattttgacattttttggaaaattccttaacaaaaatgaatataaccgaaaaatacacccctaaaaatcgacccaacaattttcaaaaatacattcctaagggcgctatgtaatttcgacactgggtaaattcgacactgagtatttccgacactaagtaatttcgatactacgttttcgaaatagagaaatttcgatttggacaagacactaaaaacagcaaattttatgaatgtgtgggcattttagtggcaaaaaaattggaaaaaaaattcttgaaaattgcctttgttcatttatttatgccgtcgcaatctcgccttaaagcaatgtgaaatttgatggaccatttatggaaaaaaatgagagaaagttgtaaaatcccacattctgtccttttccgaggacatgcccaagccgttctctttgattttgggttgaatctggtattaaaaatgcacttaaagtatttgcatttaatttaaaaagaaaaaatcagaacaaaaaaaactcaacttgcggagtgacaaggacaataattaattatttgatcaggaaatgggataaacaattcatcattggcataattggcgttgcaaccaaaaaagtgccaataaaaaacatggcaagaaaaagggggacataattttgaatttgatataaatttcatttatttttgaaataatgttttaaaagttaattttttttatattttttaatttcttttttttaattttaaaagaaaaaattttatttttttaagcagcacttttttggtgttaagttcgggcacttcttattgaaaaaaaaattgtagaggcaattaataaagataaagagaagaagtgccttctgttactgatgagatggttcacttttatttattataaggtggggaggataaataattcacggcaaaatgctgacccaaaaataaaaaataagaatttgaattgggttttgcttatcttcttcttctttttttaataatttttaatttttagcaacttaaatagctaaaatggctgagaaaactgcgcaagagacagactttttttaaacgacgcatgtgttcatcttgccaagttaataagcat

SEQ ID NO: 5814 - DNA, 3148 bp, Heterodera glycines
caactcaaagtaaaaataacaaatgttttggccaaaatacgagctgttgaaatgaccatgaaattcaaattcaattttgccatttccctcacaatgccggcacttggccaattgtgccgttctgtgccacggccgtccattcgtcgctttgtccgtcgtcgttgcccacaaattgcgcaaccaaaatgaccaaagggtccgccaattggggcggatggtcgttgacgtccaaaatgtgcacgtgaattggcaccgtcgtactcagttgaccactgaaaatggccaatgccaaagtgagcgccgacattctgaaattcgaattctcagtttttgcctgatcgcttggagttcaatcgtaaatttgttttggggcgcctcaaaatcgaactgttgacgggtccggattcgaacagtgtcctgacaaatgagggataaaagggattaaaatcacaaaaaaagtgaaaacggcaagaaaatgccaaaattgtctcaaattttactccaaaatttattttcctccccatttttacttttttcttcttttccatttgttccgtttgctctctgtccaattcgaagaattttgcgtccgttccgccgaaaattcggaattcaatgcgcgcattttctgccgagtcggcatcgtccgcgctcagttcgcccaccaaagtgccaacgggcgaattttcgggcacgtaaaaatcgtaggaagaaaactgagggattatgggtgaatttaaaatttgaatttgcgcgctcattcacttcaaagtttggcgcgttgtcattcacatcctcgacgatcacttcgatcagcgtccgggcggagagagggcgagggatgccgcgatcacgggcgatcagtggcagcacaaatctaatgaatgccaatcaaatgccgtaataagcgcactcaatttttttaaatgggctactttgacacgttttccctgtccaacggttggttgacgcggagagtgccggaagttcggtccaatcggaaaaggcccaagcgaacggaagggtcgtcggagtccaacaaatggtcaatttggccattagcaccttaaatgaggaaaaattggaatggaataattccaaaatatttgtagctttaaaaacaaataaaaatgccttcgtccgggtcttccgcgttcacttgcaaaaatgaagtgccgacctaaaccaaaatggctaagaaatggcaaaaaggtaaaaaaatgggcaccgaaatgtcctcagggattgtcgcgcgatattccgaggacaaaaagcgggggacattgtcattcactgaaattggaacatattattttattattatccatttaaattcggaaatattattttcatttttcttcttttctcctcctaattcacagctcatttattccgtattgcctcccttttccacaatttttttcatttttagttgcttcttattttcccactaaaatttgttggcattggcacttaatttctctttttaatttaccccaaatatgcaaaaaaaaagagaaaaattaatgggagacaataaaatgaaatgaaaataaataaattaaaaaatttagtgaattttcatatttaattggaatttgaaccaaaaaatatttttcatggagtaattaccgattcatgaccaatttgtcaatgcttcgctgctcccattcaaaagtaaccgatgaatgaataaaatggcacagagagagagacaaaaggcaaagcgaaagacggggggggggggcagtaaaggggagatgccctccaaatttgcccatccgactgtgaatttggggaggaggaggggacatatgtcattttgacaaacggaaaagcatttaaaatttaaaatgcatcaataaacggggtccaagccgggactgagtgttcgtctcgatttgctcgtcgtttctcccccccccccccaattcgcccaccgtcgtccagctcaatttccagcgtcgtccccacactcagcggcggattgcccgcgtcctccgcccgcacttccaccgcgtacaccgccttccgctcgcggtccaactgcgcgcggacggtgaccattccgttcagagggtcaattctgaaattggaaatcttgggatttattttgagtttggctttcaactttcacacccaaattccgtcgaattcattgtgtatttgagctgtgcgttctcccctctgtcttcgtccgtcgcttccattttggtcaccggcgctccgatgggcgcattttcggcgattcgcagcaaaaattggtgggggacaaattgagggggtcggttgacatcctgcggatttacaataaataaatccctcttggatttgtatgtttaaaagtgcccaccttcacttttatggacacattgcattgtccgctcagtccgtcttcgtcggtggccaaaatttccaacaaaaattcctcgtcttttggcgaaaattcgcgcgccagggaaaggacggcgcccttaaaaatgaaaacaattaaaaaacaaaactaatttaaaatatgtcaattcgctgcctgttctgcccccattttggtcaatgcgaacaaatcgctcgccgccggcgtttgtcgcccgattcgataggaaagcttctgcgagtcgttttcgtccgcgtcatttgcccgcagggaaagcagcgaatggccgcggggcttaattaggactaattagcaaaaagagaagcagcggaagcggaccgtgtcctcctcaagttcaattcgataaagcatttgtgggaaaaaaggcgaattgtcgttgatgtctttgacgtgaatttttatctgaaatttttaaatttaaaacatttcgtttttaaatttttaccctaagggacgcattttttggcggttctccgccgtcttcggccaaaacggtcaaaatgaactccgaccgagactctcggtccaacttaaaaagtgtccaattatatttttgcgcaatgatttgcctgccttttccgtcgttcgcaatgccccgctaatttcgtccaattgaaacggcggcggtggtgatgccattttcgtttcattctcttccgtcgcggcggcaattcggtaacgaatttcgccattttcgccgctgtcttcgtccaccaccaacaaacggcccttaaaattcatttaaaatattat

SEQ ID NO: 5815 - DNA, 2514 bp, Heterodera glycines
ttctcttccgattggcgcattttcgtccacaaataattccaattggtcgtcgcctgtcttttcaatgccaataaatgctaaaaatctgttaaattatgacacattttgtgccatttgtaaccgggtgaatggtcgttgacgtcgattattgtgacggagcattgcaaagtcgaaaaaagagatggttggccgccgtcctttgctctgatcagctaaataagcaaatcaatttgaatttaatctgcttgctgaccaatgtcaggggcgactgttttgggctcgcgcgacttcgcagtgtcacttcgccactttcgtagtcaatggaaaacagcggcactgacatggagacgatgctgaagtggaccttccctaaacaaatcccaaattgcctctaattatccctaattgcctggtcaattaccatttgctcccgcgtccgcgtcgcgtgcccgagggcgaagaatcaccgatggcacgggcgcatcttccgtaacattcacagcacacgcggtcccatttgactgctcaaattgcggcgcattgtcattgacgtccaacacggcgatttccaaattggcactgatgccaaatgaataattagtttaattatctcttttcatctgcccgacttcgaccgcatcggcggttggcctccgtccgtggcgattgcctgcagcaacagaagttggggcaacgcctcgtggtcaagttgggcagcagtctgaacaactcccgacttgggattgatgcttaaaacattattaaacaaatgattttaattatttttaatttgcctaaataaatgggcaacttccgccgcttccttcacattgtccagcgaatatttcacttcgccattggcaccgtcgtcaaaatcacgtgcaaaaacactcaaaacagtcgtgccgatctgaaaaaaggaaaatcagcgaaattaaattgtttaataaatatttaagccgatgaattaataattatccttcatttcaattaccggggcgtcctcccgaatttcggcaatataagtggacttctcgaaagaaggcgcattgtcctgaatgtcgatcacttcgacgatcaccgaaacggtggccaattgggaagggtccaatcgctcgaaagcggtgaccttttggggaatagagtcgtcataattacataattaattattaattaattaatggtgtggccacccaccttcaacacgtgttttggctgcgtttctctgtccaatgctttcgcaagtcgaatttcgccactgactgtgtcaagtgaaaataaatttgtagaactgcaaaaacaataaaacaaaattaatttaatttttggcctaatcagaaaattcaaaccgcgaatcttcggagactccgaaagcgtagaaaagggactgatcagcctcattgtgggcttggacctgaacaaccaccgatcggacgggcgcattttcgggcattctttgagaaaagggaacgaattgaccaaaatcgggcataaaataatggattttgccaaattgataagctaaattacgaactcgacaacgtatttgtcctctttgaagcgaattcgcgagtttcgcgggtttctgcgatgaatccatcgcttggccaacggacgcggcctctgttttagctgtgatagcttaaaataaatgccaaaaatggcaaaaaaaatgccaaataaattgtaaaactttttacattaatttccatttttgcatttgtccaattttcgccctctgaacaacgaatttgcacttcaatggtccaatttcgacttcgccgggggcaatgcctttgttcagcgaaaacaattcccgagaaagggtccagcgaaacaaatcgagaacgaagttggggaagaggacattcttaaaaaaggacaactgatcacggacaaaacagcgacaaaagcaattgtaagaccatttggccatcggaacaacggagtgccgggacgaacgcaacggccaatggtcagaaaagaaggaaaaggataaggatgaggaataattggtgaagaggaggaggaagaggaagaaaaagtggaggaattggagcaaaatgggcaattttcaacggggaaaatttttgtgagggaaaggggaaaaaaggagagaaggaaaacggacaaaaatggcaacaacatctgtgggaggagaaagaaagtgaaacaattggccacaaaatgtaaatatttcatacaaattatcttaaaaattaaattttaaatgaatttcacctaaacaatctttgaccatttatttgtattccttttaattaagagttcctgctgctgagcttttcctttcgatttgtctcgacatttttttcctatgtacaaaaaaaacatatgtcacaaatataacaaggacccaaataattgggacggcatacaatgggaggatttattggggattaatttaggactgagaaggatggttgaagcattgggaattgtggtgggtgacatggacggggcaaagcagggcgtgggagggaaaggggggggggg

SEQ ID NO: 5816 - DNA, 1684 bp, Heterodera glycines
  misc_feature (16)..(16): n is a, c, g, or t
ccaaaaaaaaaaaatntctgcgattaaaaaaatgctacccgtcgctaaagctcctacttaaatttttaatacaaaaaatgaaattttatttttaaatttgcaataatttactaaattttatttattttttattttacacatttttttttgtccgttcactttccaaggaaaacaattagtcaccttcaatagcagttagcagaagttgggtgccttctgctgcctgatcacaataggacacaacaattttgcagcacatccagctgcggtcggacggacggcggtccgtccgcggacagtcgtcggcggcggcgcagttgaagaaaacaatttttgccgccgtcgccgccacggccacttttttccgccccctattcattaggtgggggattggggcggggggacggacgttcatccgtcattcaaatccaatcccacaaccattttttctttattctttattgaaagcaacgaattccttttcctaagatttctaagaagtttttttaaatttttattttttgcatttttcatggccataggaattttttcatataattttttttagtaaatttcttgcgtaaatttctcatattttcggggactgttctttttcccttttatatctctgtaaataaatttttaatcttggcactaaaaaatttctaatgttaatttatagaaattagggcactgtcgggaaaaatcgcagagaatttttaggtcaaattagcaaattaattactcaaaaattttcaaaaaaaaaatactaatttttcttagaaattttaattttgaaaaattctttgtcctctttctcatcatatttatgtccaatgactaaatgttattttccatcaacttctccaaggagggtttcaaggatttttctgctttaatttttcaaaaaatccatttccttcttccagcccaaatttttgtccaaatcagacgaaaaatccaaaaatccctccccgaaaaattcaatttcattcgagaggggccaattttcccgccgccatcgtcgatcatcatcatcatcatcatcatcatcagcatccatcccatcaccgctacgaggggagggggacaggtgttgtgccgtgtgcgctgccggtggtgggttcggatttgtttggctgccgatgggacgatgatggattcgcagttgcaactctattttctcccaccctttcgctcgtttcatgcaaaaccccccgggggcggggcgggggcgacctttctcattcatttgaatggacgcggaaacccgcgggcgatgctgtggactgacggacggacaaggcaaaatggacaagggcagggctaatgagagacggaaggggcggagaaatgggcggacggacgacggcgaaagccggggggggggggagaagcgggagaaggagagggaaaaggggtgaatggccaagggggggggggcaattggccaagggaatggacggagaaaatgacagatgaaaagggaaaagcaaattcggataaaagaaattggggaatattgtcgacttttacccaaaagccgaaattctaaatctttttgttaactttaaaaaacgttatggtcataaaattcaaatttcgatcctttgttttttttgaatctaacatttttaataattggccaatttttatgattttaatgggtttatttacgtattat

SEQ ID NO: 5817 - DNA, 1299 bp, Heterodera glycines
gaaatagggagaaatggaaaaaatgaaatggatttacatatgtaatgtaataatttggtcatgattcgctacatatttttggtggcatttatttgctttagaatggcattataaaaatattttattcactgcaataaatacaataaggaagtatttagtatttattatcgatattaaccaaatgcaattcaatttattcaaattaattgaaaaatatttaattttcattttatgaaataaatattttttaaaaaatttttaataaaaaatctgaatttcttttttttatagcaaaatcaaagatttattgttaaaatgagacaatcgaaaaagaagaactttaaatttgcaattgttttttgggccattttattttttttggcactaatcgaaaaatcaaacggaggaaaagccaaaaaagtggcgaagcaaaagcaacaaaatgtgaaaaaaagcgaacgatcggcggagggaaaagcggcggcggacagtgaaacagtcgcggagaacagaaaatgtccggaaaaaggcgaaatggcagaaaattttatgggtgagcaaaaaaaaaaaagaaaaataatttcaaaataattttaaaaaataataaaaataatttaaaatgaaataattgtaagtcacgtcagcagcagatgaagacagcatcgaattgattggacaattcaaaaaatttattatcggcgaataccgcggaacactttcggcacaatttgagctaaaattccaagaaaattcgctgatttggcatttcacgcaaaaaatttccgagctcctaagcgccgacaccagtcaatttagtggaaattcggtggacgaattggaggcaaaaattgaacactttcgaaataaatgggcacaattaaaaaagtatcaaaagaatgccgacagaatgtttgtcttttgcatactgtacaaatacagtacggaaatgatcagagaaacggccgatttgaaaatcaacgattgggaccaatttctaaaggggaacagactgagagaacagattttggtcagtgatttgagaagggtgtgaaatcgagggacggtccggggctgggcccaaattagctaatgcttaatgattggtaaagtgctaattcgttatttaaaaaccatcatgatggcgttatttacaatccaaaaaaattgtttataacttttctcgaaatcaacctaattttaaatccttgatatccttcgatagccctaagtgttctctattcgattgcaaattttcaaaaaatgttaactttcaaaaaaatatggccaaaaagttgaaaa

SEQ ID NO: 5818 - DNA, 1203 bp, Heterodera glycines
taaaattttcaaattttttgctacatattaagttttatggcatttttggccataaaactttgtgtgtccgcgcagtcatcaaatggcatggcacggcactgtctcggttttccattccaattttttcgcatatttacttaaatatttaaattttatttttccaacaaaaaaacaatcggcaaaagccaaaaggcaaatccaagcgatatcgaattacccccgggcccattcagttgactgacatttggccaaagtcatttataaacaaaaacattctcatcgatttgtccccacatttgcactccgcccaaagtttgccggccttttaacggcactcactcaagaaattactttccattaaaattaaatttaaatatttttgaattttaaaggcctagaaattctttcagaatcccggcctctaaacattttcggaatcgaatcccgaccaccaaaaggctcgagaattctgtaatccggacacttggaccctggcataccccacacactcattattaaaaaaccgaaaatttaaatgtgaaattcgacactagttcgaaacattattaaatttgtcgataatttggtgattttttaatttaaattaattatttttctgtttttgatgagcccaaaaaatttttcccaaagtcaatccagatttagaactctgactgactccttcctacgcaggcactttgggttgagagagtttttagaaaaccgctaacctcgcaaatacaccggcccccatggtcaattaaaagcaattagatgagaggtggtcctatttccgtttttccgtcttcaattaacaaaccgaactccctcgaaaattggaatttaaaccgggaaatcgctaaataattctgaattattattaacgtgtgcataattttatatttttttgattctatgaattatttatctaattatcgaaaatgcattttcccaaggatttccgttttatgaatacatattctctttcaaaataaattaatctaacccattaaaacaattgatataaattttctgtcccaacaaaaaccattgtttcttctgctgcccccaggcgcgttctttttccgaattgtttttgcctgaggcgactccgttcgtctggccaaaattgcctccggcaacaacacgtcatccttttgccctccggcaagtgccaccaacactaccacaaccactgatcag

SEQ ID NO: 5819 - DNA, 6304 bp, Heterodera glycines
  misc_feature (6258)..(6258): n is a, c, g, or t
  misc_feature (6269)..(6270): n is a, c, g, or t
  misc_feature (6279)..(6279): n is a, c, g, or t
  misc_feature (6284)..(6284): n is a, c, g, or t
tttggtggcttaattcctttgcttccctttgtcgttccttcttggattattacccccgcaggacactaattaaaatttacatgaacacaaaaatacgagaaaaagggaaataaatataatcggtccgttttatattcacagaaatgaaccccttcttaaggggccgagagggaggggaataaaagaaaaggggaggagagagaaaagagagaggaatatgaagagagaggggagagagagagagggagaggggggagagagatagagagacaggttacgggcgctttggcacttgtcattgaaggccaaggacattcccctaaaaaattttgggccaaatttaagcttaagccgtgccgaggacgggtcagagtcgtcgtcaacaaaaagtggtggtgactcatccttgccgtccccgccggcgcttgaccacgagaccaccattggttgcacattgtgccaacataaacagcaacaacatcaatccgtcgccggacaaggccgtgccagcagtgaagaaacactgaagcgcggggacagccgactgaccgtgccgagagtgagtaataatgccgtgggaagagggaggacccctcaggggatggatgacacgatttggggattttccaatggcatcgttttgctcaataagtgccaataaatacgttgactaatcttttgttatgctaagacaggggtagagccgtgcgtgcacctgagcaagatttctggtaattagtgacacaattaatggaaatatggcaaatttttgaaatttttggaatttcatttgaaaattgcgcaaatttttaattcttcaaaaaagggatgctgtttaaggattagatattggggtcttttttaaaagcttcttaaaatttggtgagcttctgatcgtttctagaataactgtgggtaattagtcaaattataaaaaataattattaaattcctgttaaattttgctaaaatttctgaattttgctccacggcgggaatcgcgtcgactctctctcggacgccaatttggaaatttttttttctcatccctatcaacagcgtattgagaaaaccgcaacccgagatactaatgtattaaaactctaaaaaaaaatacgcaaaacccagaagttaaggggtatcgaaaaatttctattaaaatttgacgtctcattgttagccccttctcttcaaattttcaaaaaattttcaaaaattttacagggctcagcgtcctcttctcagccttccccatccccaacaacagcacgttacacggaaacaattattcacagacaaactgcgacagcagctgtacagcaacagtttgtcgaggtgaacaggcagctgaacaccgttgtggcgacgacaaaaggcggcggcacgtgttgccaatgcgaggtgaattgtgtgataagtgtcggataattatcatggcacaatattggaccaaaagttttggcattttaatcaatgttacagcattgatcagagatgttaatgctttttccaattctactaatgaatatagcaaaaaaaaaaaatatcttttgggtcaatttagagatgaatcattatggctttggcatttcaatgcttttcctttttcattatggacttaggcatttataactctttttcgaattttctcggcacaaaaaaatcccacttttaattgccgttttaattgctttctaaaatttgccaaggaatgtgtgctggcgtgccgtcgtgagcagcaacaactgcagcacgagcaacagcaacaacttgccggcccgtccggaagcggcgccgggcgatcgtccggcaccggcgttgccagcggtgcgctgagcattgcactggcaaacgcgcaacttggcaccgccagcagcggtccgaccacgtcgagcagtgcgggcagcggtggcacaacgcagcagcaacaccaccatcatcagcagcaacaagcgcaacacatgatgatgtactgcaacagcactggtgccggaccatcgccgctgatcagcaccaatgcgcagaccattgaggaacagatcaagcagattgaccgcatttccaaggtgggctgggctgcttgctgctgatcgaagtgatcacacatatctttaatgctctgctggaatcttactggatttctgtaatccagtttcttggatatataaaattggacagccattaaagtgatcaattattgtaagaattaaatgaaaggggacatttgtccaaacaaaaatcaacggtcattttgctgttttttgatcagaattggctcaataagtcctgttttttttctcaatactgatgtgatcagtcttgaaaatttcggtaaagtacgatccagaaaaccattccatttaaagttcaagattaaaaaacaattttattatcaaattccattaaaatttccaaaaaatttcctcggcggcgcctattagcattgtcagacccgcattttatcatagtttattggtaattcaactcgaaaatggcaaaaatttagccattttttttttggcggaaaacggctaaaaatcccaaatttttcttcactactttttataaaaatttattgacagagttagcttttttttcttttaaaataaaagaggaaaaaattaagcagtcatttcgtgccaaatttgttaaattgcatcttcgcgtgaaacgagaaaattaaatttgtcaaaatgcaatttttcccccttttatttattgcacaaaaacaaattaagtcaattggcggtggcacccattgaaaaaaacaaaacaggaaaaatgcaatttgccctgagggcaaacgctaaatgccactaaaatgaaaaacatttatgaatgaaatttattgcctatttgagtgtattaaagaactaaaatagaaaatagaacaatattaaaaatccaaaatgaaataaaatttgttaatgaaatttcccaaaatatttgattaatttttaattaatggaaaaaccccaatttcttttgacaaaatgctaattttaaagtccactaattgcatttcaataaaaaaatatacattttttaaaactctaacgatttttattaattattaaaaaaataaatttattttggttttaatccatttaaggaatgtgataattcgcgcaaaactttggagcacatcaaccgtcggcttgacgatctgaacgacgaagtgcgacggtaccgcgaatttcttggccacgaaaaagtgaggccaaaaaatatattgacagaattgcagacactttgaaaacaaatggggagagagcctaattaactgattttgactaattaattagctattaattgagatttgtgaattaactaaaataattataattattaaaattattaattttaattaattaactaaaatattataatgatttaaatccgagttaattaatattcactttaattaattatttattaaataagttttattaattaactaaaataattgtaattatttaaatcctattcaattaattatttattttaattaatgatttgttaattaagatttattaataaccaaataatcatttaattattgatttgaaattattttaatgaatttttagtcataaaaactaaaattaattagccctaattaaaattggcttttaattttttgaaggcacgtcgtgatccgacactgtacaaaacaagcaccgcagaaccattaagctcgtacaatgacggcatttgtcggctaatcgactcattgacaacacaactcacaatggtgaggaaaaatgcggaggtccggctcgatttagttgaaattaaaaattctcgaactttccaaccgaataattcccgaaatttggtggcctgtgggcatttgattgaaatttcattttccaattatatttaaagcatgtgcacttagcattattttacatgaatcacaaatgtccctattttttcagattttacgctaaaaaatttcataaaataccaattttaccgcgacgatgcctaaataatagcatggaaattcatacaattgacatcttgtactacttttttaaattttcaatagaaaaattagcaaaattattttttagctttttctagaaaaaaaaaatcattctaattttgtggaaaaaaaattctgatttattaaaaaaaaattttacgaactgccattgattaatacgttaatttcccataaaaatttttaataattcgttttcaggaatggactgaaaaattgcgttccatacagaaccagacgattgccaaatcagtagctgaaaagggctgatcagagatgtaaaaacaaaaaaaattgacgaaaagaacaatcaactaattaattaattaattaagtaataattatgtgtattttatgggttgggaggccgcctcacaaataaaattaattggtcattcattcgctaaatggaatttattcttagatttaatattaattatgtagtaaacaatgcaaaataaaaatatttttagatggaatttatttttacattttaatataaaatacaaataaattttaatttcaaatggaaagaatacaaataattaatccatccctaattattttatgggccaaaagtataattttcaaagaattttggtcatttttcctgctgctgctcctccgcccttcttcagtgcccgcatttttgccatttcctcgtcctgctcgtcgtcgtcgttggcacttctgctgctgcttctttggcttatgtcgttgaaatactgtgctgggccctttaggcaatcctccaatgccttaaaaattaagaaaattttaaattttaataaaaaaataattaaattagattaaatttaattaaaaagaactaagaaacctacggcaaattgtgtttttgccgcggcacagcccatcctccgcaagtccctcagctgttttttgatggatgtgccaatggcaaacgatgctttggcacattttcgggaacactctgtgtctttggttgggccttccacgttcatcagaaaatcgcaacaaaaattgcctggaaaaatgaaaaaataaatttatttgaaaattcaaaaaaaacatttaattcaaattttgtggacacatttttttgttgaccttttatttgccaatcacagaaatttgtatgatttttgagaaatttattaaacacttggctgaacttgctaaaagatttgaatagtgaaatgaaaaaaagaaatatttacaaaaaacagcaaaatttggttcgtttttttaattgaagttcattaatttaaaaaagttctattttttattttaaattaaattttaattacggcaaatgtccgtcggcgagtgcactccgccgatttgacgatggaattcagtttgtgcacagctgatcgttttgaaaatgctttttagaaaattaattattgtaaataaatttaaaaaatatttttagaaattaaaaatatgaatttttgattttgttttatttcaaattcaaattttcattataacaaaaacttaatttcaaaaggaaattttaaattgcgcacaatttattgttttttctttatttggtaaacagcgttttttgatgaaatttaaatgagaaatattctcaagaattgtttttccaccactaattgtttgaacagaaaacagaggcataaaaaggagagaaaaatttaaattaaattttcgaaattttctattttttaatattatcattccatttatacttctgttatcacttaggtatatgatatatgataagaaaacgctatgctcttttggtttatgaaaatttttaagccattaaaatttttttgctaggtgtcaaaccattggcggaaagaaaatgtgaaaatacgaaaatttgggatttttaataattttatagaataagccaaaagagaacacatacataataaatatgaaaataaatataaatatatagaatttgcataggagggaggggctaaaacgaaaaaaaaaactgaaaaaccggaaaaatgctgaaaaccaggcctataataaaaacaacgtggaggagaaaaatgacaacaacctcagccagggataattactataaccatttgatcatcgacgaaagaatatttcgaataatttggtcaacgaataattaattaattaatgggggaaaagaaaaacaatcatcggcggaaataaagcagcgagatcagctgaaattgtatttccatttttgattgaattatttgaaatacgcttttatatgtatgtgtgaaaacctattattattcagccanaatatgagtannaaaacatanatatngaaaattatatatataaacg

SEQ ID NO: 5820 - DNA, 1236 bp, Heterodera glycines
tgaatatcactgcagattgcttcagcagcagtctctttttgcgttaagcttagcttcgtatgcaaaattgtatccctccctttccccccccccttttttttccttttcctccctcctccctcccctccccaccacctatctccctcgccccctatctcctcccttttcccctgctttattcgttcgtccaattcgtttccaaattccaattcattaactagtaaatatgttatatatttccgtatcaaatgcctcctaattcatacattttgcaattaatttgcttttcatcgcttctcttcctttccttcatttgcttcactttgctctttttacaactttccccccaacggattttcctttgtctctctcctgcggctcttttctttgtattctttcctttttctttggcttcattcagtctttctttccctcccaatgcttttctgactcatccgatcaatcccttccttttctgctaagtttaggcgcttcatggtggtggcttactgctgttgcttaagtcagcagatccttccccccccccctttaccccttttccctccgtccctttttaaatctttcgccttttgctcttttaccttctgccattacccccgccaattcagactcatcaaattctttttcaaatcaaaactgtccattttttctctcctttagacagcaaattctccccatttgatctgtccaaaccgagcagcatcagcaaaacgaccgatcattttgagactggggaaattacgatgacagacgaagcggtggcggaggaagaggaggacgaacggaggaacatcgcgcggaaagaaaacggcggcaagcttccgctccctgtcgtcacatttattgaacaacagaatggcatggaggcggaggaagagtcgggcgccgaaaggaggacgcctctggcggacggcgccacgtccgccgggagcggcagaccccaaaggaagaacggcttcctcttttccgccggggatgggccatgcataatcgcatgtacatgggaaaattatttttgaatttggtgatgaatcattgaattacattaagcaaatcactgtgaatcgctttcagttttatccaccattcgctttaaccattcattttggtcattcattcattcgtaactttatatatttttattttttcattttgtgtagccaaataaaataaaaatatttgtttttttaataaaaaaaaaacaattaacaatta

SEQ ID NO: 5821 - DNA, 3572 bp, Heterodera glycines
aacgatgatttcatccgcaaaatgtccacggtgtccatggaggaggccaagggggaagaagccgtcggcagcgaagaagtggcactcgaaagcgcggccattccgtaatttgcattcaattgaagaaaatgcaaagaaaaagcacaggcacatcaaccttggcaagggctaccaggcgaaggtgaagaagtggtccgagagagcgatctccgcgcaggagagagaagcgatcgcagacagagaccagccgttgttcgagagtcgggcagtcgaacacattcccgaaacggcgcgtaagtggcggaggatgcccgattactcacccatcattccgcgtttcgtttcacagttgccgcctacgaaacattggcatgttcagtggcagtgccgaaaccgggcagaaacaaagaattggcactgaacgttctggcggagaaccaagggaaccttcaggcggcggtgatggatttgctgcgctgtgacacactcgactgggagcagtacccgaacatcttcaagaactcgtacgtggacgtggacgactggagccccgaggaaatcaacacgttccaagtgggaaaaagaggggagggagcaaaagacgaactgaggaagaaactgccattcaggatgccatctacaaaagtgagaaggacttccagcaagtggcgactgaggtgtggtgggaggcgaagtgaagtgaatgttctaagaattgtgactaaaagacgggggcaatcgtaaaatgaaaggcattgccaaagagtgggctttttatagcaccaaaagaggaggggggggattcgctgagtgaatccggcgacgtttcccttctcccctccacagcttggcaatcgcagtgtgcgcgaatgcgtttctttttactacacgtggaaaaaggcatgccccgacgactaccgaaagctgagaaatttgcgcaagaagcggcaactgctggaacaacaggtgaaagggggaggggcaagccaaatgagtgacttcctacgttttcagctcgattacgcctcaatcgcatgccgacagctttcccattcggaaagccaacagaatggaggcacttcggaggaggaggagggcgaggaattctccgagacggagtccgacatcaccaacccgtccctgctgggcctgtccatggaatgttctcccgccggcctgggtcgtaagcactcgttgcctcggggcgctcttcccccgggtgacttcgccgcccatccgtcgtccgcttcttccctcctgcccaacacttcctcggcacttttcaattccgcttatccttggctgcatggggaaatctttccttcgccgtcctcctcgtcaacttcgacgacaaacaacgaccatttgcagggggcacagaacggaacaacaaacgccggaggagaaatggggacgacggacagaacagaagggacgcagcagcaccacaacgaatacggagggggacaccaccacaaccaccatcacaaagtcattagcgattattagcaacaaatggtgggccatttcagattcgaagcgtagcgaacgcaaaaaaaggtgcacagccttcggccgatggtttcttccattgtcgcctttgtgagaagaggtcgcttttcttcgtccgttttcccccacaattccccccccaaagttcagatttgaaaaggtcaaatctctgaacgcgcatatgaaatcgcacgcgatgaaagcgcgggcggaggccgaagtgcaaatgcagcacaagcagcagcagcagtcgacgtcactgccctttccggtgcctaccaaaaaggaagcggcggacagcgcttgttggggtcgttgggccgcccccctcggccccgtcgcttcgctcaatctgacaagctcacaagcagctgttgcggctgctctgaacaacctcaacaggcagttccagcacagcagggccaagcggtgcaagaagcaatgggtggcataatggggagcaatttgctgctgaggaacatgctgcagtacggaccggcagccgcagcggccgctgcccaaggcgggggcgccgcaacgcctgggggcacggcatcgcagtggaccaccacgcagcacttcaacgcgtagcgaagcggctccgctgcacatgctggaacgggatgacccaccgactgacaaaacgcacttataatttaccacccttagggggattcccccctttggttttttactttccttttcccttctttttgctccaccggtgatttgccctccctttttagcacaatgttcgctattcacctctctcccccattttcctctctttcttgccctttcattcttttgttttctatttcttcctttttcccatttactgcttctgtccaacttcctctccctttcttttgtttctcatttatccatttacaatcactcagcagagccactcactatgtcaattaccatcccggttaattaatatacaaaataacgctaataatcaaagttcgttgaataaattgtatttatacgtgtccaatcagtgggttaaaattaaatttaaaatgcctttccgtgtgcactccataaataatacagtaaactcacgaataatcagtggaaagggcgtgtccttttgtttatgggctgaaggtgaccaatttcaattctatcggagtccagaagttatttaaaaaaattggatttttctcgacggcgtctattggcgccgccggcaacctcttttctctccgggaaagtattaatgtattttagttgagaatgaattcaaaactcttgaatttaaaacaaaagctattttttaaaattggagtgactttgtgcttattgttagccataatcattaaacttttacttataaaccaatacaaaaagcatgtgtcaaaagttcccactgattatcatccattgataattgatgcataggcatacaaatggacgaaagaaaagagacgaaatgggggggggggggggggaacgaacgccgcacaaacattcgtccgccggaaattaaatcactttcacgcacattctcacaactttgttttgtccaccctgcgctgtcctccgttggctaactcagcaacatccgcccgtttttttgtcccgcaccggctgagacggaccaatgcgcacggcggacgcattgccaccggcctgttgaagagggcccatgcgatttttgatttcagtggccattgtgatgaacgcctaaattggctttttttaaagaaccaacgattttttaatgatagtgctccaatacaaagctgaaaaccccgggatttgctccatttttcccccggcgacgctatcggcactgccgacccataatgatctccttaaacagcgaaatttggcccaaattttaaatagatttgaaaacagaaacaattactaataataaataagtaatttcccaaaaagaaagagaattggcacaaatacaatttattttttcatagacaaattctcacaatcattgttttcattgcaatttgtttacagctgtgcaactctttgaaaaggctttttaaccttaaaaacgggctgatttttgttggggggggggttta

SEQ ID NO: 5822 - DNA, 2670 bp, Heterodera glycines
  misc_feature (10)..(10): n is a, c, g, or t
aaaggttttncgagtatccaagaggaccattaattctaaatatttcaaaagccgaataagagagaaagtaagttcaattcaaaagattaaaacaaaaccctccgaaattttaaaccttggcaacattcgtctctatcgcacgtttggtggtcaaatcgcatttattcccgacaagaagtttattcacactctccgatgcgtatcggtcgatttcctggagccattgcttgacgttgttgaaggagtcctgagaatgaagaacaactaaaacaagtataaacactgtggacctggtctgtaatgtcgtaaacaacaatgattccgtgtgctccgcgataataactggacgtaatcgtgcggaagcgttcctattttgtaaaaacaaatggtcgtaaatataacggattggacaatagaaagttttttttctttttttttgctacgcgctatatggaaccaaaggcccacctgtccggcggtgtcccactaaaataaataatgaatggttaatgtatatgggtcactcacaatctgaagtttaatcgtcttcccctcaagctcaatggtgcgaattttctaaatgaatttattagcacgatttaattattatttcggatacgaaatcaacgccgatggtcgaaatgtacgactctgtgtaggtgtcatccgcaaacctaagcaacagacacgacttgccaacaccagaatcgccgatcaacagcaatttgaagagatagtcactggagaaagtgacaaataaagcaaaatgtatgatttctgagttactcactattcaggattcatggcagccattcttcaaatcaatctttaacggcaattaataagagttttgccaagttttataaaatctgaaatgtctgtattgcgcattaataaaaaaaatattaagaaaatgcaaataaaaaagctttttgcttcgtgtcttctttcacaactcatcaattcttttgcttctctttcgtcgcattcgcattatgctgcacatcacacacagcacaatgttctgttcacatttgttcatttgtccgtgtctctgtctctctgtcattgcctttctttcccttcctttgcttatgtctttgtctctatccccttttaactttctctaactttctcatcgaacagtaattttcgctttaataactaaattttattttacctaattgaaaattttgctacccctatttgtctttctgaccgcctaaaaattgggaaacaattttttagtccagttattttctttaatgttattcatagattcagtttctttttattacaaataaatgggacgtcgtatccgagctcaacgcaaaggacggggtgggattttcaaatcgcacagcaaacatcgcaagggcccggctaaattgcgcccagtggattactccgagcgtcatggcttcatccgaggcattgtaaaagacataatccacgatcctggccgaggggcgccattggccattgtacaattccgcgatccatacaaatatcgggtgaagaaagagacgatgattgcggcggagggattgcacactggacagtttatttactgcggcaagaaaggttcgtttccacttttcgattgataattatttccaatactttggtttggctatattcaagtttacgcgtccaatcagttaccatccttagtttcttaggtgataacgttttcttactcatatattcttggtatcaatcgaagcttaaagtctacagaagtttttatatagtaaaaatctgagaaaatacaacagacaaatagttattgaatatacgcaaaaaatgatgaatttcgggtttctcattacatttttcttaatgcaagtattgcgcttatcatacatagcctaagaaactgaggatagtcactgattagacgcgtaagctggaattgagactttgttttatactagggtctgtccagttttaaatgtccatagtattttatgcgtccagccatgcttttgatattaactcaacaatttatatttttagcacaagtccaaattggaaatgttatgcctattggagaacttccggaaggtacgaccgtctgcaatttggaggagaaggccggtgaccgtggacgtttggcaaggacttcaggttgttattgtgcaccttcccttttgtcccttatgtacatccgaatgttaatttattcattatctttatcataaaggtaattatgccattatcgtcgcacataaccccgacacgaagcgcacgcgaattcgtcttccatctggtgccaagaaggtcgttccatccgccaaccgtgcaatgattggtagttttactacagaatattatgtacctgagcttgggtttttggctctagttgtctagggattttggtcaacgtccacgaatctattttgaaaccaattccgaattcccaatacttcttaaatattgttagagattcgaattcgtcgaatgtgtgtcctcttggtttttattttcaaaaacattgacttttcaaatggttcgtttaaggcattgttgctggcggtggtcgcacggacaaaccgcttttgaaggcaggccgagcctaccacaaatataaggtcaaacgcaactgttggcccaaagttcgtggccatggaagaacccggtcgaacatcctcacggaggaggaaacca

SEQ ID NO: 5823 - DNA, 1024 bp, Heterodera glycines
  misc_feature (1017)..(1017): n is a, c, g, or t
atcgatcgctccacgccctcacaatgggtttaatgtttggcccgccttttccaaagattgggccaagtgcttaggcgaaccattcgtcatcatagaacgaaggaaaggaaagggatcgattgagagaagggagagaaaaacggcactaatccaccggaattaatccctaagaaataatgcattcatttactgttgcaaaattaatatacattcagtagtaaaaacacaaagacaataatccgagacgaacatagccgggacaagagcttatttaccattaattgatgtttgattaaaaattcttttggttccctaatcgtttattagtataattttatatactttttaataaaatatggaaatgtacagcatacatcaaataaatgtaatgtctgatgtgaaggacccgcaaaagacgaattcgccctcgcgaaaagacacgtacctgaaagaaaaaggaatttcaaatgttaattaaaatagtcatacattcgctggggcattgctctcgacccgctcccgggatggggcagaaaactgcgcagaatcatttgctttctaaaggggaaagtcagttaaagccatctgagaatcagaaacaccgcgtcggcttcggccattccttctcttcctccgcacgtttagcgtcttcatccgtcataaagaaattgcgcaacacaccaaaaatgggaccgtacggagcatcggggatttcgcaagaaaattggacatttggaggagacaattcgtccaacaaaacattcgatggatggcacagattagcgacaaactttttcagcacattaagttcgatgtgtttgagcaaatccgcagaatgggccttaaaattgtgcttaaatgcgaattggtgcacatttttaaagtccattatagaattaataacaaaacattttaagctcgccctagaactgttgggagacttgaactttacactgtttttaaactgcttatgcgcaaattcggaggcgaaatgtgcggtggggcgggcgggggggnggggggg

SEQ ID NO: 5824 - DNA, 3019 bp, Heterodera glycines
cgggttaagggttcggaattggccaaaaaggaggccgcattcatactcatgcggccaaaaacacccctagaaccgtttttttggaatttacagaaaagtttcaaaaagaaacttcgggaccagtaaaacatatgattgccgtaattgtgccacaataagttcgtaattggtttccaatgcttggtttttccccaggacaatgaattcctccacttcggacatcgacccccacttccgagttttggttcttgctttaacagcattttttcgcttcataccgaaactgggaacattttgacacatatgtacggtgagtatgaatgacatcgtttctccggcacttttattttttcaggtgcaatagcattcattggcattttcatttggtttttggtccaagccgaagatgtcgtcagttggcccgacaaattgatattctcttctttctttgttggagccattctctgcatgggaatgtcttttgcctttcacacggtccaatgtcattccgaagatatcggcagattgtttagcaagtaatccaaatccattttggacatggcatcatgagtcattgtcaagttcgtcccctgtgggcatttgcccatgtttaggttggactatgccggcatttccttgcttatcattggctcatttgtcccttggctctattacgcgttcttctgccgagttctcccgatgaccatttacatttcgatgatcttccttcttggaattgctgcgcttgtcgtttcattgttcgacaaattttcccaacccaaataccgtattttcttcgatttttctttgttccgatttctcatttgttttgcttcattaaggccctctccgtgcgattgtttttatggcgatgggattaagcagtgagttttttacattgttttattttcacttttcttttttatgcgttgttcccgctcttcatcttttggtcactgatggcattgtgtggatgtttgaaaaggcttctttacactggttgattttgatgggaatactgtaccttagcggagcgactgtaagtgatttcgctcatttccgaatccatttcttttagatttatatggtgcgcttccccgaaagatgcttccctgggaagtgcgacattttggtgtgttcattaattttaatgggcaaagtgcacaatttttgttatcgggtaattcttacactgaccatttttgatgtcttttacggcggaccttttttactgtattttctcctgatgccccccccccccgaaaattggcttctttccgttcggagttatcattttgttctgttccgtcatccgccaccattctttttccagtgtcaatcccaccaactgttccatcttttcgtcattttcgctgccgccgtccattaccacggagtgttagaactcgcgatgaagcggttgcaggacggttcctgctcggaacaactgatttcccacagcggaagtgacgaggcaaccattcagtggtggacgaccgattacgaccatattaattgaccaaggaagacgcatttgcattctgttcatgtatacggcgattaaattttgggttccaagtacaattagttgggtttttcgtcttagtggtctgtttgttagtcaccaaaaggggagtctcaggttcgagtcccatgcaggctataactgtattttgaggtttttgaagcaaataaatatatgtgaaatggtaacacagtttttaaagaagctcaaaaattttttaaaattttatttcctgtaaaaacaaagaagaacctcatatccaattgtgtttattcaaaatcgaattgttcttctccatcgctttcttcgtccgtctcatgtcggtcaccaatttcttgtttttgttcttcacggtcaaccatggaatttgttttggaaccaaattttcaccaaactgacccgcttcatttcatcaatttttcctgtgtcgagaagccaatttgacaaaaatgatgttccaagaattgacgcatttgttcttcgtctaggcccatattttgaccccctctatcgacggaacgggccaactccgtctgagccaactttgagtcaatataactcttgaagttattgaccgaatcaaacaatcttgatatcattcgaaagctcttcacaggctctattagcctactaaaaattacagaaaatttcgaactataaaaaaagatagaaataaaaaacttcaaaaattctgccttttttgcggttttcaactgacaacttttttgagagctgattaatcactgagaaatagcttataaatatcttctaaacatctagggctttcgaatgataccatgattgtgaagtttgaacaacaacgaaaaaagttatagctttttgaacattgctgagacggagttggccagacggagttgacccctaccgctctatcgaatccctgtttattttttcggtgcagtgacaaaggacccacagacgaaggacccatagacaaaagacccacagacaagggacccacaaagacagaggacccacggacaaggacccacagacaagggacccacaaagacagagtacccacggacaaaggacccacaaaataataattaattaaaatatattaaaaatggaaaaataaaatgataatcatcaagaaaaggagatattttgaaaaattaataaagtgtattcatttttcaatgtttaatcatcttcaatcggttcctcgttttgctgccgcactggatcaacaccacgaaatttaacgaatttagaagtggcttgcaaaaaattttccgtgtccatttgatggtaacgtccaatgagggtcaaaagtcgttcgtttgcctgacggtactccactcgactgtacagtggtggttcttggccgcaatccagcttgaccgaaattgcattaactcgcacaatttcctcacgaatgccatgaagaaacgcaaaaatgttgggatggggtgaaagaaatttagcctgtatctgatggtgccatgattcaacagaatttgtcgttct

SEQ ID NO: 5825 - DNA, 3094 bp, Heterodera glycines
caataatttttgaaatatgtaaaatcattacatattcaaacgttgcattttaaattgtagataggtcacacatatatgccgggtacatgaacctcatcatgcctatgatgagtttgtcacgtcctatctgagccccagccatcagagaaatgcctaattatagaagcacacataagcaaaaaaatttgaaaatctgatttcaaaaattattctggccataactttttagaacccaaacgaaattcttcgcaattttgcaggttaatagaggacacctaggactttagaatgataccaagaatgttagatttggtttataacgaaaaaagttgtagtccaataactgggctggcgccgaaacgacccgcgccgaaacgacctagtcccctttttcaaaatttcgatctttaatcggaagggatttatgtcttcaccagcaataaaatccaattctgagaatgattgaattctaatgacaaaaagtactaatgataaataccacattcgcgtcggtatttatgcgttttgccacttcctcctaaaatacgcagccaaactatacgagagattaaaaaacaaataaaaatatatttcagagggggggagggaggaggaggtggcaaaacactaaagtaccaaaatatcgctcaaaagccacaatacgtgagaagggagaaaccatctttaatttcaaaaagaacaaaaaaaggtgaagaggcactgaaagcagaaagaaattggtaatccccggttagtccttaaaaggatagaattttgaattgaatacgaagtgataaaagaaagagggaagaggaggaaacgaagaagtcgaaagccaatgccttccgcgtaaggcgaatttgtgagggagggacagagtgaagaaaaaagagatgtagcacaagcagaaaagctgggcacattcactccatttcttccaagggtccgttgtcggtcgtcgattggtgggggtggaaactgtgaaagatggcggggccatgtctgaaaaacacaacataaatagtggctctatttgcaattcagtgacccaggaaaccccaagaaaaaacatttataactaatgcgaaaataaattttctgcagctgttttagtaaaatgcaccaataagggaatttgtactttaaagaatgcaatgtctaatttggcttcttccttcgctttcgctcacattttgcgctgttgtctcggacggaccaacgtgggttggctgacttgttcgaggacggaaggcgctatctgagaataccttccgttttttgttaggggtgtctgtccctgctcacataagtgaatccttcgaagggattgacggacattggtggcaattcggcggtcggagaatcgacgggagtcattttggtgaatttggagtcgaacagagaggcgtcctcctcactggtgatgttcggcttgtacggggcttcgatctaaacattaaatctgtcgaataaccgtaactaaaaattggcatgacttaactctcgccgataaacatttgtccaattctcgacgtggtgggtgaaaaaggcgtgtttctttatctcttcggcgtcccccggcccggccccaaggcgagtgtccacgtgtcgcttcagcaaccgttttatctgaaacaatgaattggttggcagcagaacaaacttttgaacgtaaaataccaagtctttcgcttcgaaacttaaatagggcggaagtgtaaggcgtcccttgaggattttgtcaattgtctaaaggcaaaacaattttattcgcacgaagatatatttatcggatgccgacgatgactcacccttttgcgattctctgccgaaaaaggcggtcccccggtgagcatgtcaaaagtcaacgcccccaaactccaccaatcgaccgctttgccatgcccagttctgaacacaagaggagtttatttctgaagcaccaatggtaattgcctcatcagaatttcgggtgccatgtactcaatggtaccacaaaaagtgtgcgtcttttggtccccttcgatggcctctgaatgattattacaattggacagcggaaataccacttggacgacaacctttacacaggccgaagtccgtcagttttacatggccttaaatgggcaattaattgtccaatggcaaaccaaaaatacctttacagtccaacaaaatattctccggtttgaggtcacggtaaataatgcccttaatgaaaaaaggattggaatgtatggaaccacaggtattattgccaaaaaaattttattagtatgcattttgtcgtgttcattcagaaaaatattttaaatgcattctgagaaaatgcgctgtaattctcctatttaaaattacatgtgttttttgttgaaattttaattaaataattcaatgggacgcactcgtaaaatcaaaaaaaaaaaggaataaattttaaaacagtcaccacaagttaaacatgacaacctgtcgatggaggtgttcaagtgcaattacaatctctgctagactgaaagataaaattgcgtttttctttgttgttgtttttccttcgattaaaactcactaaaatgccgcagtgtcctccataaaagtgccctccctttccaaatgcataaacaattcgccgccgctcaaatactcgaggatcagataaagcttgccgccagtttgaaaggcgtattggaggtcacaaatgaagggactctgaaaaaaaacaaaaatgcaaacgtaatccgttttgagataaaatagtgttaggcgttttcaggggttgacgagtccaattcttacattcattttgggctttgggttccgaatgggtcgaaacgaatgtcagaatcaattaccgaaccctttcaatttttcaggagcacgagccccccccccccccccacttcaccccttgaaaccatttgtcgatttgttcgttactttgacagcttcgagtatatttctctcggccttggtgtgcgccgtgtctttctgattgcgaatgaccgtcgcctttttgagcactttcatggcgaagattttgccactgtccttcccagtcacttttcgaacttggaaaacctgaaaaatcaatcat

SEQ ID NO: 5826 - DNA, 3082 bp, Heterodera glycines
  misc_feature (61)..(61): n is a, c, g, or t
  misc_feature (75)..(75): n is a, c, g, or t
  misc_feature (139)..(139): n is a, c, g, or t
  misc_feature (944)..(944): n is a, c, g, or t
aatgaccgtcgccttttgagcacttcatggcgaagatttgccactgtcttcccagtcactntcgaactggaaacntgaaaatcaatcatgaaagtacaaatttgcgggatattcatacctttccatagctcccttacgnagcacttgagcaattgaaatcctccggccccacttttggttcggcgattcaccaactcgggatatcgcctaattcaatggtttcaacgacttccggcccatttctcaaataaaggacaatgatttttgaaagtccaacttttgctcttacatatacgaagaagagggtgacagagtgggaatttcatcctgaaaatgacaaagaaatggagaaggcaaaacttaggcaatacatattccacattctcatattcgttgtcttcgtcttccatgtcggacaatgcgtccgctgaaggccgaatttggttcctggcacggtcagtcagttcaatctcgaagatgccggccatcatcacaatgcaaaacacagtcagttgaaaaatgagggtttacggatggattaaattaacgaataaaagagcactaaatttcaaatggggtacttttccgttttgggaccaattctacgcgcttgtctgttgatttaaaaaatatatattcaacctttggccccaaaacggaaaagtatgtacctcaagtggtacatttgggtttgcggactcaaaaaattaacaggaaacgtgatcactgatcacactccaacgtatgagaccatccacagatttctcatgaggtatttttgccaaaaataatttgaatgcaaatttgaaatattcgttgggcgagggatgtgggaagacaccggcggaggacaaagcgccgtttaaccaattattaaaaactgtcataaataggaattcaaacaatcccgttttccagtattttaaaacgcagtttattatacncagtaaaattaggcgagataaacacgaatatggtgaatggatcagaggctgagttccggaccgagggattctgtaaatccaacagaaattgaaacagagtaaaaaaggcgcatttgtttattatcgaaatgaagttataataattaagctaattgtatttagaatacgaaaaaagcgtagcatcacgagggcatcaataaaattgacatgacatgcatatttttgtgaactgcaaatggattgaaataaaagaaattttttagcatgctttgaggcttctaggactgattcctttaaacatattttagaacggcccccctttaagaaaacggtaactttcgaccccctaaagtccaaaaaatttcaaaaacaaattttgtgaattttttcgaaataatttaaaaaatcagccttccaaaaattggaaatttatggaaaaaagccaaaaatgaaagcttttctcaaaattattatttttctaaactatacttaatactagagttgtacgggaccgggaattttgggcaaaaccgggaacgggactttttgggttgaaaaggttttgattacagaaatttttttgcaaagtttattggtgccccccaatcatcacaatgtgttatataaatatgtgcgtataaaaatatttctatcgatttgtgacacgattcttctcataactttcgaaaacagctttaaaccaagttgaaaatgccattgccccagggtcaggctcaatctgcaggcttttgtcggtgtaactggcacggcctgcctttgcttccatttttgccgtttctttggctcgttcttccaccgtcttatccaattaacctcatttattatatacgccacgaaatacctttacaatgtcttcccaattctctcctcgaaaacttacagctgcatgcaatgggtccacctttaaacaaacaaataggacaataatagcttttgaagcgactcaccaaagtgcgatggcccggctttgcaccggcataatattcgacgcttttcaatgcaagtttaagcgctttttttataacattggaacaaagaggactttcaaaggcattcgccgcagcattaagcattaaagcgtatagctaaaaggcaactgttagaagcaaaaacaagtgataattgctaactgctccggaagtgccaccgactgacgattcgaccaacttggacaactgcagaaaaagacccttcggatggtcaagcgctaattcaccattttccactgctattaaaattgctaaatttgatgaatactggataaaacaaaaacaaaatggacctgatgctcctatcttcatggatgtgccacagtctccgtcgccaactgaggagtcaagcctgttcaaatcgtgctcagcgttgattaaggcttgacaagcgttctcaatacagcttcttagcaatgactcttgaactaaaaatgtaaattatttaaccctgacttaaaatgaatactttttgggagttgtgggccaagactcaattggcaaggcctttcatcctcaatggaacgaactgaatcctgtccaacaatgggctccttgttaagacgagaggcaacccaaaacgatgacacagcagaatcatattcttaaattttaaatattaaattagtcgaatgatagaatggcaccagtcaaaacgtgtagccatttttggtcaacgatgcgcagaatcgacacactgaacccgtgcgcatcaattgatgtcataagcgtgcccgagatgaagcattggacatcgtaaccattcgtcactaaactactaattattgaaagttgtgcgtgtctttagggacataaataatcacaaaaattcttacatagccagctgatcacttccaatttcacaatgcccatttccaactgactaactgagcctaaaaatggttttatggagttgttaaatcgtggctaaatacccaaattattaagcagaatcgcaattggctcgcctgttaaattaaatatggagcattagtattttcaacgttttctccacttttcttaagactgagtcttttgcagtgaacaagccgttccaacagatcattgcaaatttccttggcagatagaagtttttccgctcaaccccggcttcaccgtgaactgttt

SEQ ID NO: 5827 - DNA, 4199 bp, Heterodera glycines
ttctctccattaacttttttaccatcattaccaattcgttaaattttgcatataaatagagaaaattaaacttctgaatacttttccattttgtggctacacctcaaaaatttaaaaaaaggcaaacaaaaggatgtgcaaaaaaaatttttttttcatttatataaattaatttgcaaaaaaaaatattttctcatatatgaagaatcaacaaaatgtacaattcagatccacagaagcctacagtaccttggccttttttcgaaatgcttacagcaatcatactgtagattgattaagttgaaagtgagcgccgactcttcttggaaatttaactgaatctgaggttattagtaacttctccatgctctaaatagtaggaaaaacgatgattttttaagaaaatttttattaaatatccccaaaaaaatcccaaaatttcgcaattttttcgtacatattttcattttttttttgttacaaaaatttttttgaaaaattaaaaatttttttgaaaatgtatgcctaaaaataggttttttcaaataaaaaaataccaaaaattatttttaaaatattaaaatatgattctaagcctatttttgtacctatttcagcatttacgaagaattttttttacaaaaaataaccattaaaaaattttatttacatatttggtatatattttgaccacttgtacatatttttgatttccttagtattacataatcccttatgtttgattatttattcaaaatttcaaactgaaaattcacccgcttcggggttggaacttaagtttttgcgtgacggccctaccggattaatcctattaaatttcattcaatcacgcaaatcccgcaattctaaaaatgagggatattcaaaagggattttatgtggtttgtttttgtttaatcccatttttttaatctaagacattttcttacacagcaccttcttgccactttgacagttatttttaatgaaaatttccgattttttgcaatttgacgataaaaaaagatgaataattaatagggcttccttttttaggcaaatgcctaaaactttgcgcactaaatacgcaaagataagcacgaaaaacgcgtttcacacccctaagaaatgacccaaaaaaatttcagaaaatacacccttaagaattgaaaaattttcaaaaaaatgatcccaaaatttaatatattttttcttaataaaaatttttggtttaaaattttgtccttatttaataatttcatttgcaattgaaatatttaagttttacttgttttaataccaaaaaagcgttaataaaattttttttgcctatttttgtgcctattttaaggtttttgtgccaatttaatgcctattttgcgattttttgtgcctaaaaaaggaagccctaataattaatgattgctgtttatttgttagtttataaaaatgaagtttttttgaataaaaaaaattcttcgtatttcagagttcccaagtgtccttttttctaagatttgtcctttatttgtcacgacctccttattttgtgcttattcttggatttgaaaataaaattacaaaaacgaataactgttttgaattatttatgtatcattttttatggaagcaaatatttgaattaattcgattttgaaaaaattgcgtttttatttcgttttcttgagtgtaaaatgctctaaatttcagtgaaaattttgttaaaaattgtcaacatttctatttttcctccggcggcgtctatcggcaccgccgggccttccaaaacttattttttcataaaaattgaccaaaaattgtcatattttgaataaaatttttcaaaatgctgattttttgtcggccaaatgctgattttgaaaattttcagttggcagccctggtttttccgctaataaaatattgttttaagtcgatttttcatatttttattgcgtttccttcacgctactattagttttagaaaaatcttatttttggggtccgaattttagtttttgagccattttgtcttattttgaaaaaaacatggaaactctgttttatttacctgctgaattttccctctaaccctccccctgcggtctaaatttttttgttgtgtatcgattatttttaatgctttcgatgtgaactgtctgacttctcgctgtctgcactcctacacaaaaacaaaaagaaacaaatattgctgataatttcgcaacttttaaaaaaaatcattgttttgtttttcatttttttgaccggcaccaccggggaaaaaactcataaaaatagagggaaaaattggcatagatccataaatttggcaaatacctttttaaacaatatggaagtttcagcaaatttttggccaacgatttttcaaaatttgaaaagactttcaaaaaatatcaaaaattatggtaaaactaaaattcgtttttttttaatttttatttttatcccttttataaatgcgcctcatttcagagctaatgtcaatggatcggatgaaacatttgttgagcacgggtgagcattcggatgtgcactttttggtgggggacggagacgcaaaagaggcgagtttaattaaaaataaaaatttaattttatttttcaattgcaatttcattaattatccacgttcccttttaaaggttttgccagcacatcagcttattttgaagagtgcttccgatgtttttgaggcgaatgttccgttttgacgccaaaaaagaaagaccggaaaatggtaaaaaaataataattttaagggaaaataccaattatgttatttgttcttcattttgtctctgctaatttccctaattaatttttcaattagtttctggtaattgtcctgatgttgtggagatccccgacgttgaagcagcagcattcaaagtgatgttgagcttcatttatacggaagagttgagtgatttgaatggagacaatgcaatggtagtgctttacgccggtggatttaatttttaatttaatttattaattgttgaattccctaattagccaaaaagtacaatatccctggccttattcgtccatctttgcaaattcccatctccgaattgcgcaatgttttctttgcgtatgcccaagctctccttttcgacttggaggtgagaaaaacaaatttatttttaataatgcttttgttcgaattcgggtttgttgagttcgaaacttgtcgaaattgtgtgagattcatgatccaagtgaaagcaatttttaaggatttttccatcaaatgtttgcgttacatttgtcaaaatgcggctgacttgttcggatcagatgattttttgcaaattgatcagaaaatattgtgcaatcttctcgagagtgatcgtttgttactcaacgatgaatttgaaatttggaaaattgtaatttcaatttaatttttaattgaatttaattttcgttttttttaatttaggcactccgttgggccgatgaaaaatgtcgtcagaatggcattgaatgctcctcgggaaatcgtcgttcagtacttggaccggcactgttcaaaattcgttttccaaatatccatgaggaggattttgccaaatgcgtcggtaaaatttttgaaatcgggaattaaattgaatttgttttggttgatatgaaattttacctttaatgcttgaatttcatacatggacaaggagggtcagaaatttttacataaaatttatgggaaaactggacaaagagaactgatgcctacagggtaataaattttgaaattttacagttcccttcggtgttttgtcaaaagatgaagtgatcgccgtttatcagttcaattcccatccgtttctgtatcttcgtggagtgcccgggctgtactcgttgaaattcccaagccatggacgaatttttaattggaacaaagccaggggcaaccgaagagggacactttcgatggaaattgaaaaaatgtcggaatttgcgggagagtctgtcgggagaagcagattcagtgatgccgtgtatataaatggatttccatggaaaattgaagcacaaattatgaattgcattgatgagaagaaatatttggggttttacttatggtgcgatgcaaaaaaaggtccaattttaattactattttaaaaatataatcattattaaaataggaggaccatggaactgcgttatttct

SEQ ID NO: 5828 - DNA, 1429 bp, Heterodera glycines
aatttcattacttttgcggtgagtgctaattgtgcatatttccttaattgacataattatatgcaattaaggaattgatggacccatccaatggtttttacaacagagaagaagacaaagtgacattggccattgatgtcacagtgaaagatgaaaaaatagagaaatttgtttctgatcccgacaaatccaatggaacaatttcgatggaaattgaaaatttgtcgggatttgcacgagacaccaatcagagtgaacgtaaaagcgaaactgtgcacatcaaaggatttccatggaaagtatggacacgaataaaaacgaaaattggaagcactgacaatgagaaatgtttgggcattttccttttgagcgatgctccagaagaaggtgctaattagacgctaattaataaacaatagtaattaatttgcattgtttagaaaattggagttgcaaatgttctttaacttttcgaattgtgtcgcaaaagagcggcgtaaaggattataagagagaaataagcaaagaaaaaatagacaataaaatgccctacaggggattcccgaatttcatttcatttgctgtgagtgacaataaactttccttaattgacccaattatgaacaattaaggaactgatggatccgagcaaaggcttttacgacaaaaacgaggacaaagtgacattggccattgatgtcagtgtgaaataagcataaatggagaataaatcataaattattcatatgctctgggaaatctcgtccttgaattatcatcctgtggactttttttatcatatttcttactgtttaaatttttttgattttataaaactggattggattaaatcatagattaaatgttgtatcagcgcaattgtaaatgcaaaaagacgttgtcctttttcttgccatgttttttaccataacaaattcgcatgggatgtccgccagcatactgtacccaccaatttccaagtcggaaagaatgttgacatttgtaacactttcttttgttgtttttttttgatttttcatatgccaatgccatgcaatgtattatttgtatccttacaaggctcagtcggctgaagatttcaaattttatacgtttaaatcgaattagacaggtcttgaaatttagagtccaaatagccctgtatagagtttagagccgaaactagtaaacatctgacaccacgtttaaacagctgtacaattgactaaataataaaattgtcacttttccatattttaatttttaatttttaagcgcagcttggattattaaagaatgaaatcatagcgtaattagtaatagtttttcatttttaatttaataagccccaacttcccggttcccaaatttctggtccaaaaaaattctgcttaaataaaaggaaaaaatgatcagtcattaggaatgg

SEQ ID NO: 5829 - DNA, 3961 bp, Heterodera glycines
  misc_feature (3897)..(3898): n is a, c, g, or t
  misc_feature (3910)..(3910): n is a, c, g, or t
cacgaaaatttggagggttatggtactcttccattccaatcacttcttccaccgttaaattgcgggatggaactgtaaaaagtgtgctaattaaattaataggtgtatttttagaattcaacccaattacaaggacccgtaaatacggtattttcgagttctaattatgattaaccatattttttatgccatcggacatctcataaaaattcatttggttatagtactggtctactacttccgctgtcaacaagccgaaaggaactgaaattttggtacaaaaataaaaatctgttttatttttatatcccgattcttcgaacaacatcaatttgaattttttgttttaatttagttgcttctgttcgcattgtgaagtgttcggcataattgtggctttttgtctttgcaatgccatcgattcggaagaggcgaccaattgacaaacaagaacaaaaacagaaaaagtatctgtgctcattcattttatgttgcctttttccattagttcgttctttgctttttgtctaaatttttacattttgtgaataaaatttgattttttgaatttttttgttgttgtaaatttcgggaggaatactcccttttctctccatttttctgccagttttcccatcgttttttttaaaagcaacatttagctattgatatgggtcgaaaaatgaactcaactacccattggcatttgaattggatttgcttatcttccccctcccccacctccattttcccatataatttttatcgaagtaaaatggtgacccaaaaaaattaaaagattaaactgaaggaattacattgaccattgatatcacaactgttgatggaccaaaaaaggacaaattaattttggttcaaagcaaatccaatggaacactttttatggacattgaaaaatcgtcggaatttgcacgattttgagtaaagattgccgtggaaaaattatggcacaaataaatccgaaaaatggaagcactgacaatgcgaaatttttgggcattttccttttgggttccgcttacaatgatgtggaaattaaatcaaattaaatatttattaataaaaattaacaacctttaattaataaatttatttgagcagaaaattggagttgcaaatgtttgggaacatttcgaattgtttcaaaaaagagcggcgtggcggattaccgaacagaatttaatgaccaattaattgttaaacaatagaaggcacatcaggggatatgccaatttcatttcaatgcttaaaaaagccgctttaataatccataaatcaatattgtaaaaccaaaagataaacaataagaaagaagctaaacacagcaggtccataggatgataattcaatgatgagatttttgccagatcataatgggtatttatgaattctcctcaatattcgcttctttcacactgacatcaatggccaatgtcacttgatcataaataattggaacaataaaagtatcttcattagtaaattctcctcttctgaaattctttacgccgctcttttgcgaaacaattcgaagattttgccacaattttccatggcaatcctttgatgtgcacagtttcgcttttacgttgactcccaattatttcacgcgcaaattccgacactttttcaatttccattgaaagtgtgccgttggatctgttgggatcggaaatgaatttctccatttttggctcatcaacagttatgacatcaattgccaatgccaatttgtcctctgctttgttgtaaaagctcttgttcgagtccatcaattccttgattaaccataattatatcaattaagtaaatatgttaaattattactcacagcaaaagtaatgaaaaatccgaatccccagccatttaattcattgtcaaaaacatggtcatgaagtgtgccaatggaattctcggtgccatttttttgcgagataattcgaaaagttgccgaacgaacgtagcagcgccaattcgaatcttaatgattattactcatcgttgttaattagcatttaataacagttaatttgcacctttttcagtagcatatatttttaaaatagtaattaaaattggaccttcttttgcatcgcaccataagtaaaaccccaaatatttcttctcatcaatgcctttcgtaatttttgctttaattttccatggaaatccatttatataaacggcatcactgaatctgcttctcccgacagactctcccgcaaattccgacattttttcaatttccatcgaaagtgtccctcttcggttgcccctggctttgttccaattaaaaattcgtccatggcttgggaatttcaacgagtacagcccgggcactccacgaagatacagaaacggatgggaattgaactgataaacgccgagcacttcttccactgttaacacaccggatggaactgtaaaatttcaaaatttattaccctgtaggcatcagtttttttcggccaatttcacataaatttgaaaaatttctgacccccctccttgtccatgtatgaaattcaagcattaaaggtaaaatttcatatcgaccaaaacaatttctatttaatttccgatttcaaaatttttaccgacgcattttgcaaaatccttctcatggatattaggaaaacgaattttgaacagtgcaggaccaagtacggaacgacgatttcccgaggagcattcaatgccattctgacgacatttttcatcggcccaacggagtgcctaaatagaaaaaaatatcgaaattaaaaaatgaaaataaaaaattaaattgaaattacagttttccaaatttcaaattcattgctgagtaacaaacgatcactctcgagaagattgcacaatattttctgatcaatttgcaaaaattcatctgatccgaacaagtcagccgcattttgacaaatgtaacgcaaacatttgatggaaaattccttaaaaattgcttacacttggatcatgaatctcacacaatttcgacgagtttcgagctcaacaaacccgaattcgaacaaaagcattattaaaaataaatttgttttttcacctccaagtcgaaaaggagagcttgggcatacgcaaagaaaacattgcgcaattcggagatgggaatttgcaaagatggacgaataaggccagggatattgtactttttggctaattagggaattcaacaattaataaattaaatttaaaaataaatccaccggcgtaaagcacagccatggcattttctccgttcagttcgctcaaatcatctgtataaatgaagctcaacatcactttgaatgctgctgcttcaacgtcggggacctccacgggacaatcagcagaggctaattgaaaattattagtgtaattagcggcggctaattgaaaatttaattagagcaattagcggaggactattgaaaattaattagggtaatttgcagagactaaattgtaaatgtcattcagtaatgtttttaccgaattccgctttttcctttttggcatcaaaacggaacatcgcctcaaatacgtcggaagcgtgtttcaaaatgagcttatgggctggcacaagcttaagaggattaaattttaaaaaacacaacaaaatttaccattcactaaatttccaatttttaattaataaattaaatttttaatttaaaaactcgcctcttttgcgtctccgtcgcccaccaaaaaataaacatccgcgtcctcacgcgtgctcaacaaatgcttcatccgatcaagcactgattgggacatgataagcaatatgaaaatcgtatttatctattaatgtaatgaaatgaaataatgggaattaagtgaattaagatattcaaaattggcaataaaataaataanncaaatcggctanatccttatgattttactggactattcagctggctaatcatatgccaagccc

SEQ ID NO: 5830 - DNA, 2196 bp, Heterodera glycines
atttggattttttagaatttctcccccgtttatttattcagccatggtttttctagcaaattttaaaaattttcccaatgttgggcctatgtaatgccactttttgacatgggcaaaatattgggaaatatttaaattcccacgaattttttttgcatttaaaaaaattcaaataaaattattttaaatggccacaaattttcagaccagctctttttccgtcacatttgctcgtcgtcgaacggattgggaggaacacaaaaaagggtaggaaatttatgtaaattttttgacaaaaatgccatggattttcgaattttttcgtttttttttttataaatttttcagcacttcttcgtcccccgtgttcaccaaactgttcagtttgggcgccaaaaatttgctgcttgcggtacaatgttctgcaattccgaccaaaactgttgccatcaggccgaaagtgtaaacaaaaaaatattttagggaaaatcgttttttttttaaatttttggactcgacctgtaccatggaaccaggcctggatttttcatggacatggacttttatccagaaaatccaagtcaaatatgaaaaactaaccaggtttaagttaggcacatacattaaaaaggggggggggtcagcggcagggctggccgtgattgaatttccaatcacggaaatccgtgagccgtgatcacggggctttaaaaaaaatccgtgacccgtgaaccgtgatcacggcaccccaaaatccccgtgatttccgtgatccgtgattataaaaaaaattttctaatgattttttatttaaatttatttaaaaaaacggaatttaatcgcgggaaaaattcccaaaaaatgttttaaagaaaccaaaacatataaaccgcttttttttgcggcgaccttttccaaaaaaatgactaagtttacgatttttggcaattttttgaggaaaattagagctttttgtagaaatctccaaggaaaattttttatttttaactaatttattaagaaaatttttcaaatttttcttaaatttaaccaaaaatctatttatgtagagaaaaaaatttcctctaatttgtaagctaacttttgatgctgaaaaaaatcttttggaccaacatgctcagtccttcatgacgatctgaacaccccaaaagatactgaacgtcgggaaaattttagaaaaaattcttagagggttgggaaaattttctgaaaattttgattaggcctgtcgttttaaatttaagcgacggagagaaaaaataggatttttagcagtttatatgccaaaaatggtaatttttctgccattttggggtcaaaatttcaaaaatacggtaaaatgggggtccgtctgccggtggtgccgacaggcgccgccgggaaaaattttgaaattttgagtgaatttgttaacagattttgtccaaaatatgtccaatcattggttaatttattggtctatggacgttttaaaaaataaagaaaaataattttcaatgttatgaaatttcttgttaattaaatttcaattaaaattatcaaaacaaaatatataaattgtccaatcccaatggggaattgaacccaagggacatacaacgaaagacagaaggcttaaccaccagactacatatatatgtttactttctaatttgtaagcagaaaagaatttatttatttttctcaaaaaattcttcacaccactttcctattttctctcaataaaaattccctatataaaatgccaatcacggatcaaaatcacggaaaatttgaaaaaatccgtgatccgagatcacggcaccccaaaaaccccgtgatttccgtgagccgtgatccgtgatcacggccagccctggtcagcggccaattttgcgaaatggtcccggccatgtaaatcgacgacctttttttttttgcttttcaagaccccatttttttgcggcgcactttttccaaaaattttttggtgaaccggggggccgacggtgccggtaggcgccgcgccgtcgggaaaaaattttgaaaatttgagtgcggtttgttaacagattttgacccaaaaactgccaaattttgcgatttttttgcaagtcgacgacttttttttaaaaaaaaaaccgtttttgcggcgtggtttttccaaaaacttttgggggacaggggggttcggcg

SEQ ID NO: 5831 - DNA, 2670 bp, Heterodera glycines
ccggccccccctcgatgcgatctggtcggacattttgggcccattgcgggcgaaatggggggggggggtgtctactccacccctattttttgtatggttaggcacgaaaacctggattttttctgacaaaattaaaaaaacatccaggttagacatgaaacagttttttgtcgtcccccgtccaattttcgaaaattttttatatttacgggctaggtctttctaaattttgttttttggacaccaatttgcagtttctacctctccccccgtttcagcgaggagtccttccgtttcatttgtgccgtggacagtgcaaccgctgaaaatggcaacgcggctgctgccgcttccgcgcgcggctcccaagcggcggcggtggtgacgcgtctgtccgccacgtttgcccgtctgtacgcgctcagctcggaccagttggaccaggagcacgcgttggcatggaaagaggtgggcatagcgccggaaggcaaacaaccagacggaaagaccacccgcattttaccggtttgaagccgaatattctatttatttggccgtgatccgacggtctatgttttgttagactttcagaccttttcccggcgattgatggactttattttgtcagacttttagactttgcgatccgatggcctttgttttgttagactttttagactttgtcctccatttttggtggtttttgagttttctcctaacacataaatgtgtacatcatgccacatttttcagttgaattcggccacttttcacatttctcaatcgaaggcaccgaatgcactgaatcaggcaaataaattttaaatatttattaaatttatttacccatttaactttttttgtccccccccccctctttaagccacaaattgacaccgttcggcacgctttgttaagcacagtccgcgcgacacttttggagaatggcaccggcacaacacaaatggcaccaatggccacgaagacagccgatcagcaccaggtggatgtgccatataaattttttgcatttttttaaatatgacttacttttctactcccttaccccgtcccgatttccgtttttttttttaaatttttttggaaaaagctcgcattaaaaatcggcgtttgtaaccccttcgtaaaattggccttcacccccaccctcgcaaaaatttccgtctacctccccccccccctttttataatgtaagctaaaaaaaaatttccccaaaattaaaaaaaacaaaaatttcccaaattggcaccccctaaaaaattttatttgcaaaaaatcccggaaaaaaattgttgccctcccttttcagcgtgaaattgccgcgcgctgggcgtcggttgtgcgccgttccgcccaatgctacgcgggccattccacgctgttgacaccgtccaagctgtggcagcgctgggacgacctgcgcacggcgctcaaaacgctggacatttggaggtagagtgggcgcaattttctgcgaaaaattggaaattttttttgtaaatttccccgtttttccgccccctcccccctaaagaatgacgctggagcatcgcggctgtgcccgactgatgcgcggcccgaccggcgcccatggcgttgtccaggcatttttgctgagtctgagtgccgccacattcaccaccgcttcgtcaccgcccgcggcggcaggtggagcagaaaattaaaacaaaataaatttcaagacgaggggagggcggcataattggaggggggggggggttcagtggaaacggcattttgatttaaattcaaaaaatatgccgttttttttagataattttcaattaaaattaaagatattttttaaattttgccaatagaaaacaatcattattattaaggctgcgaggtgcgaatttggaaccattttcgaaacttcaattcttagggggcttatttttcgtttttaatatttgttaagtgattatctactacaaaaaaaaatgccaaaatattttcaatttatgaaagttttttaatgttaaatcttttagataaacagtgcatttattttaaaaaaaagaaaatttacacttttcagttggtggtgcagctcacaacaaacagcagcagctgaacagtccacagcaggaaaaggccggagatgggaccatacggcttgaaattgggctggacccggagagtgaactgcaccggcacatccaggcagggcaggcgtacaaccaccaccaccaacaagcaccagggggcatggatttctccccgtcctcccctttttatttattttttggcatcttgaaacccatcactttaaattttttggaatttttccccaaaaggatttacggatttaaaaattccatttttctatgttttttttaatgccatgacacacctagcaaaaaaaaaaaattttttccatgctcataataaattgtcaggttgacggcctcctgttcggcacgtccggcgctgttcgcctgtccatggacttccagttggacttgtcgctgaagccgtttgtgtcgttgcgcaccaacgcatcgcctgcattgcctgcatcatcatcaccagtgttgtacgcatgcactgctggtgggcaaataaaatatgcattaaaattttttggtagattttttttgccaaaaactttgtcaatggcttag

SEQ ID NO: 5832 - DNA, 3486 bp, Heterodera glycines
tttttttttggtaaaaaaatgggggttatgtcttttttttttcattttttatgttccaggttgtcgatgccccggcccatgaacaacattcggtggacttgcataagcatggcggccccggcggtgggtgtctgcccccactgttctgggtggtgttggtgctgggtattgatcgccttccacctgtttttgctcaagtctgtctctctctcgagaaaactctcggcttttgcgtctccgagtctcgggatcaaaatccactgcattgatcactgaccaaattggataattgcgatttcacaaatttttctctcccatcccttccaggcttttgtacacggaatggcaaaacgtttctggcgttcccggcggcgcgccgtactcaaaatactccaaacgcgtgctgttccggcgagaatgaagagaagcgcgcggaagctttgcatttggattgagtgcttttgatcggaaatttatttcattgctttgatcacgatgtttctaagtctttggcgttttgtttcctcccattatggcatgcctttttaattgatatgtcgcttaattattcccatttgtcctttttcgctcctcctcgttttttgtcacaaagctgctttgaatttttatgaaaaaattagctattaattaattataatgacaattaattaattagctaaaaaattattattaatctcatctttgtgacatcatttcaaaacaattaattaatacattaattatgtatgcattttgctgatgctattgcaatttacgggtcatttgtgttgtcactattaaattttttattcatttgtgtgagggcaacgttttatgtatcaacaacctttgtaaaaataataaatagcaagaaatatttatttgaacgaatttttaggtgctaaaaagcgagaaaaaatcgttgctaaaaaacagaaaaatgccaaaaaattggaaacatataaagtaaatggaattgcatcattctttatccattccgatcagggaagggcgaatctcggcttaattaattattcacatttttaatacattaattagctgaagttattgtgaattttacgggtcatttaacctatatttggacaaattgatgataatcaacattaagcaacccattggatatgctcaaaaatgcattaaatgatattaaaacattgtataaaattcgacaaaataaattaaaattgtataaaattaaaattgaaaaaaatataattacataaattactttcgctttataaaataatttgtaaaataattttaaatttattaaataattatttaataaaaattttagaaaagcaaaacaataaatgctcttgttcatcattaccaatttaaaacattttgctttttttgtaattaccgtacatcctctttttatcctccttgggggattatttttaaacctcctcagaaaggggaggcgggataattggagactgggggattaagatagagggattaattttcaaatgcttcatagactgggggataattggagactgggggattaagatagagggattaattttcaaacgcttcgtagactgggggataattggagattgggggattaatggagattggggggattacagctttctttttctttttaatttaattttttcatgcattttaatcatgaggatttttattaaaaaaaaaagtgttgaatatatgaaatttggccaaattttacagatgacaaagcccttaaactgtacaaatttgtacggtaatttatttgtgtgttaggaaattgctttttcaaactttgtcaatttttcgtcattaaaattaccagagccctatttaataccaattatccccaaattagtacagtcaaccggtcattcgtaaaatccttttattccgtatttttataatattaaattatcaaattttggttttcccaatgaataataataataatcaccaatcagccacaaaatttattcattcctttcattttcatcacaattaacccataaaaaagagagaattctctcaataaaccaaattctgtgcaaattcagtgattttattattagtgaaaattatgccatttttttaaaataaaaattgtaaataattttaaattaaaaaaaaagttttaaattattttcgaagagcaaaatgcaccttttctatgtgttaattgctgctgcttttttcaatttgcacagcttcacaaatgggcaacaaccatcgcatgggccgtaaatattttaaatttatttttattttttaaattatttaatttaatttattttttcaaggcttcaatcgacggacggcaaaaacggggaaaagccaccagcagcagttggactcacatttggctttcccccgaggggcggacattgtgacgaagggtgggcaaaaaaatgaaaattcaaaaaaaaatttcaacaaattttaggctttggatttgctaccagggcatttttcagcagcatattggcacctcaggcagcaattttcgtgcgaaacgaacatttgttgtcagagacgaaaatgtaaaaaatcaaaaatcataagtagggcttggatttttaagggcgaaaaggtccaaaataaggccgtaaatacgggcgagaaaatcgcgaaataagggcgaaacgccaaaataaggatttctaaggtcgaataagggcgttaaacacaaaattttcaaataaaaaaaaatgtgtttttcgtgcatttctcgtcgagttgaagctgcagaaaaaataaggaaaaacttataaatccggaccctattaataagttaaaaacctaactgattttattaaaaaaaaaaaaaaattcattctttgatctaaggccttgaaaagctagaccgagactaatataactcgaagccagaaaccaacggccggggcatttctcttacaattagcaccagcgggaaaatctggcaccgtgcgaaagttttacaaaaaaaaattaaactgcgacgcggatccaaatattttcgatttaaaaaagtggattaatttgtattaaaattggatttgcttccgttttttccggtttcggatttttgccatagaaaattttctctaatagtgtctgttttttccaacggtgtcgcattttcaggtgcttagagtttaagcatcgaaaagttagctttttgtttttcttaaaatctttaacaaaaaatattttttatctttatatttaatttctttttctttgttattgcttttttgggtttttattttttcaatttttctaatctttttagagactaatgggtttttttagtcttttgatcttagaagttaatttttttagtttttttttaaattttaacttaaataataaataatttttaaatttaaattataattaattaaaaaacttatcttgtgtgcccctaataaaattgtcatagttttgagattaacattttgaacctcggaattcgatttccgatttctgaaaataaatttt

SEQ ID NO: 5833 - DNA, 1219 bp, Heterodera glycines
tagaagcatctaaaaatatctaatttacaataataatgagttttgaatctatttaatcattttttgaaaacttgaaaaaacatcggtcacttgaaaaaataaattctaaaattttgtacaggaaaatccaggttgtttccgttttgcctggacctggattttttttcacatttgacctggacattgatttcctggaaaaaatccaggaaaatccaggtccaggaaaaatccaggttgccgaaaaatggcctggacctggacctggatccaggaaaaatccaggcctggatccaggtccaggtcgatctctaaaaataatttacataatgacattttgccaacatttttaaaaattatttctcagtgaagaaatgataggtaaccccgccggatggcctccacattattctcttttaaagaattcactcaaaattacaaaatttggtcattttttacaaaatctattaacaaatcgtattaaatttcaaaaaatttctacggcggtcctccccccccccccaccatgttcctagttttttgaaaaaatagcgcaccaaaaaaaagcggttttgaaaagcaaaaatattcaaatttatggatcattaggagattttggttcccgatctctttttaccgtctgctgatccatttgaaaatcttagtcgacccatcagcccctttaaatgcagccccagcccctaaaaaatttctttttcaaaatgtcaggtattttttgttttttggaaattttttgaaatataattgaaattttttcgaattttccaaagtcccgcaatcccgcgcgggatcccgcaaattttaaatgcgggatttgcgggattaatcccgcgggatcccgtcccacaaaaaattttgagttccaatcccgcagcgggatccgcaaatttgaaatttccggtctctactgattaagcacttttcaaaattatttccaaaaatcaaaaagtcattttctgataaaatctttaataaattgcaactaaattttcctattttccccagcgggcaccaccagacaaattcattttttgtgagtagcttttacggaaagtaaaatgacgaattcaccatcttcattgatcaaccaaacaacgcctttcaattaatagataatttaattttttttcacttagcgacgagaaaatttgatataattaatgaggtcgggttggattatattttttgaaaactttttcag

SEQ ID NO: 5834 - DNA, 7709 bp, Heterodera glycines
atcagcaatgttgagattgacattgagctcggcctgcaggtcggacgcttttatgatacttcaggaaacctcaaatagggacaagtacacgcttgagattgtcgactgcaggctgatagtgaagacggttgatctgatggacggactcatccttgacattgcaaagaagttggaactggagcccgccagatacggcatccggaaaacgctgatgaagtcgctgttcattaacggtggacgatacgatttttctgccaatctgttcaccgaggaagtgcctcggagggtcatcattgggctggtccccacccaaatttacattgggcgcaatgagcagcaccccttttgtttcaatcatgagaatgtaagtgtcaatctgtcatgtatttctggcagaatataaatggccaggtgatggcatattataaaatgccaatttggcagggcatactcccggcttcagtgaatgaagttgaatcagatgattcaagtgaagaaaaaggtgatttttcactctggaacactttattctatgagaatttaaaaaaaaaggtattttcgttaaaaattttgtgtgaatcactaaccgatcggggttcccggcccccgacattttgccccccccccccccgaggggtcgtggagcaaccctaatttaaaccaattccaaatcactacaaaagtgtcccacttttttttttctgggtactaaacagcaaaagtgccaataattgtatataatctaaattatatgattgcactgcacaaatccaaaaagactgagtacacactccagaaggcaaacaaatgactcaaattcgagtcaaatcaaatgttaaactaggtaaaaaaagataaggacatacaaaaatgataaaaatatattgggaatgttacggtattttttggtgtgagacaagattatttggcaggttatggcattttggtgtcaaaacgaaatttcgaaaaaaaaaacaaacaactattataaaattgaattagaatttcgtttgaattttgaattaaggacggccaatgttcgatgtattttaaatgaaataattatttttgaattaattattaagtgaaatcgtttcacattttcttctgttataatgctcaaattttaagtgaattgaattcaaaagaagaatgaaaattgttcttactccaagcttcaaaaaatggaaaagtttcaaaagttaatttcttaaggatcttaaacgatgccgcctggagaaaataaaaattaaaaccaaaaacattcgaaaaatatgttaattattaaatggtggtaaatagcgtaaataataaaataattgaaaaaataccatatttactggcaaaaatcttattgaaaattctgaaacaattaaacagttttataattataaattataaattaaatttaattcatccatcctttgctaatctgacgcaattgaaacctgaagaaaacatgaagaaatcgcggaatttaagaaaaaaaaagattgtgattaagacttgaatatccctttgttgatcattcaccaataatttttcgaatcaggcaaaatctcgaaactcgaataatcgaacaaaatgaacaaacaaaactaattttttgagacggaagtttgaagtgtgagacaaaagcttgggatcttcggttttgcttattgttgaccgtgaaacaaaatatgaccattctcatctgagttggcattcgtgagaccaaagcccaaagatcataacaaaatgtcggcacttttcgccggtagaaaatttcgaattacggtcaaagtgcgaagcacacactgacaatgatcgaattttaaaatgccggaaagccgttcaagtacgagcagaggaattgttcttactgtatttcttatcgataatttacagtatagctaatccaatacattttcaaagtcacaaaggcacacaaattttccattattgtagtcttttacatttaattcattcagtcatttgcatcataatgtgtttccctcaatcttttacagtatctcttccatttccctttatataaaatgcttttaacacataatgcttattactttttgaaaataataatattaataatttactcaaaaaaaaaaaaaaaaatttatttttgctttttttttgatcatcacaaaaaactaattacaaattcatattcatttctgaccatcgtttagcaccaaccggcaccaaccaccccattgatggaatgcacgtcctaaagtgattcatccccaatccaatccaatccaatgaatttgactgttatcgctattagcgatcagcttacccgccatcccttggctaattgtgatacgaattttttttccgtcagcttccacgggtgcgggggacagcggtggacaatttttacgcgacgtgtcacagcgccacccaccgcgtgggatgtgtgcggtgcccgcccatttgccgcgctgcttctgccgcagggaccgcccatttgggcactgtcgaccaccgcatttaagcgctgtccgatcagcgaacaatcagtcagttccaaaatttcatccagctcctaaccaaaaagcattcaactgacaaataagctggggaaaggaaataggaaaagccaaataaaaacattttttgaaaatgggtcagcgattaaaaaatttttaaataaactttttgaaaaccctttcttttttttgtttttcattttaatttagaactcaaaaaatattttttggtttaatatccattaattttgtattttattgtaacattttaggaagagatttttcctctatttctgatcccgaatcccactcttcaaagcaaaccgtcccactctcgacgttcaatatgaacaagtggtctgcacttgtgtacgttttgtggggagtgggggcttaaaccctggccaaatattaattctctgtcctctttcagtctgttgatcgcgctgatcagcgcgctggacagcgctgttgtgcgacaacagcgcgccaccaacgcggacgcatcgaaaccggaaccgaataaccaaaagccaggtaaaaaaatgaatttattaaaaataaattaataatttggtctaggaactgtggactcggacaaaggaaacgcggacaaaagccagggagcggacacggatggaaagaacccggaaaagccaaaggaaagccaagaagtggaagaggatggaccaaatccaaaggagccaacgaaaagccagaaactggaagaagatggaccaaatccgaagggagcaacgaaaagccaagaagtggaagaggatggaccaaatccgaaggagccaacgaaaagccaagaagtggaagaggatggaccaaatccgaaggagccaacgaaaagccaagaagtggaagaggatggaccaaatccgaaagagccaacgaaaagccaagaagtggaagaggatggaccaaatccgaaggagccaacggaaagccaagaagtggaggaggatggaacaaattcggacgaggacgagctcactgaaagacaggaagcggaagttgatcggatgcgtgtccgtgccggtgccacctccatgcatgggcttgacaaacttgcgccaacgccaccgccgagtgccacttctacaaatgccatcgcaatacgagaaaagcgcgtcccatggctagcactcgctggattagcgatacccattggagaaattgtgataccattcgtcaccaacaaattatgcgagcatcgtacccaatattgtccttgtgggaggggaaggtgcgtgccggtaactacgtacaaggcggacgaatgttgtgagagcaactttgaatggaagtgttgccccgatgtaagtattaagttaaaaagaaattattatcaaaaattctacattaaaatagtccgggagtgagaaggcgccgtgaaattttcttgaaaatttgagtggaaatgccattgtctgttcttgagcccattagttttatggcaaaaaccttttcagttttttgaacattagcctttttatttatttttggtgcaaagaccaaaacctagttaactttttaataataaattcaaaagaccaaaaccaaaatttggacattttttgaacaaaatcctataagaagcatataacaattttcaaaaaatctctagcaactatttgcctttatcaaaattttaaaaataaacgtgcattgcatcacctccttttagtgtttttttttcatgaccaatatctttttaaatttctggtaatcattttggttttatgcaaaaacggttttaaggagccgactacgccagcacctcaactggtattaaatttaattggaacatttatcaagtcttttgattgtataaatatagggaggtaataattgtttttaaaaaaattaaaattattaaggaaaagtgcgtgcctgttagatattattgggactggatttgtatgggattctatgggcataatgaaattcttgcgagctcacctaaatgcaaaaagtggtacgagcaatcattcacgtgcatgtgcgattttaagagcgttgattggtttccagaaattgaaggaatttgtcgaaaggtatctaattatatgcataagcatgataatttacaaacgaaaaataaccctaagaatcgatccaaaaattttcaaataaaccccaaagaaatgaaaaattttttaataaataatctcaaatttttataaaaaaattactcacttttggaatttttgtgcatttaagacacaggttttttccaatttttgcacctatttttgcaacaattttggcattttcggtgtttttagaatctcttttggacttttttggcaactgttttagtacctatttcagcatttttgcacctcaaaatcccagatctaataataatataatttaatttgaaggattgtaaaacagctacacccggagcaatcgccgaaggactctgtgactgtgggtatggaaaccattgtgcagtaattgagtaagtcaagtttagaaaattattcaaaattaaaagatgaagataattcataatacatgttaatattcctaaaaaataaatgtcaaaaatatatgaggacattaccggaccaggccaaggttgtgcctgaaattctcctggccaaattaatacccgcgccacccttgctttatagtttttaaaattatcctaaaaaccataaagctagcatttttaatttaaaaataaattttatgaaacaaaagagaaaagttttattttaataaaaactaatgaattattttgtttttttggaaaatatcgattgtaaaataatgttcttcgctttagcaaaagccgagaaattggaaagaatttctacgtttggaaatgtagttgttgtccaatttttttgggttttggttatgccaagctccgcgtctgttatgaagtgaaggtattgcaaccgtaattcgcaattgggatatagacgggcgaacatcagctcgctcgaagccgaagttcgaaacgaagccaatttctgtcgaaactcaaagccccaaaaacgcgatttggaactcggaaaattttcaattcttaatgctttcgcggtttttgagttagtttaaattttgtggtgttagcggtgccgatatccgccgcggggaatttttaagtttatatatgatttgttctgatttcagataaaaattacgggatttgaaaaaagtgtcattctcattccttgagcccatttttgaggttttttctcgaaactttattttcacaaagctcgaacgaagcccaaaaaaacgcagttttcgaagctcggttccgcccattcatgattggacagcacaaattaatcattgtttttttcttttaggaagtgaagacgccgccatccacaacgacaaccgtactgaaaaatttaaaaataataatttacaactaaaaaatgaaaatttttaattttttgttgaagcttttgaaaataaaatttttaaaaagcatttttttccttttatttatttcattttatttgatttaacaagattaatcattaaaatcaaaacatttagacattgaaaatcccaacaattggtccagaatttgcaaacgagacggtaaaaaatttagataattaaattaagtaacttaaaattgaacaataaaatttatgtagacaaaaaaaagaaattgtatggaaataacaaagattaaacatcaatgaaaagaaaccccaaatagaaaataaataataaataataatatttttttattttcatgacttaagataattaattttcattgtgtttttatttttggattaaaatgaaaaattaaattattattgttaaatattgtgtcttactttaataattaaaagcaaatacaaaaaaaaaatggcggcccctaaaatgttgattttattttttgcagaagaagctaagcgagaatgagtgcaaaattttggcaacaaaatattgcccgtgcggtcatgccaattgcgtccaagtcgaacctggttacattggcagccgatgttgccctgcggcatttgagtatcagtgctgcgttgaggaagtatatgatgccaaagaaaaaggtagggatgagatttgaggctgaattttgaaaaaaaaatggattcgtgattggaatcaatcggataggattagcgagattcaaatccaagcttttcctaggcttgagtccttgtcgggaccctgatccagaatgtcattttagagtcgggacccacgcatgatttgggttttttaagaaatttaaaatgttcaaagtaaaatttactaaaataaataactaatagagtaacgaaattttctgctaaaatagaccccattttaattaccaaaaaactggcaaatgcccgatttgttgggcaaaataacgcccatggaatgaaatgattctcaaaatcccaaaatttgtttgtgttgcttttatccaatacacaacaggtactatgtactgcaacgttgctcaaaagatgtactttgggacagaaaaaaatgtcgaaattaaatccacattctgcgaaccatcttctcacttctgctacatggcgcactgccataaaagtaagtaaaagtctaattgatcaaaaataattaaaaatcagttaataaaggtattttatgaataaattgattaacaaaaggacagtaatggtaagaaacagatggcataaatcagcagatgtttttattaagagtcgaaaatagaaaagtcaaaatttttgaagaaagaaaaatgttggcgagaaaatatgtaaaattaattaaagaattaaaatttaaacaaattaatgttgcaaagaaatttgtatacaattatatttatataataatctgaaaatcataaataaatttatactaaattatttaaaaaatgaattaatacaatttatcaaataaaaatttaataaatattttttttagattttctttatttaaaatatttttaaaattaaattaaaacatttgctaaatttactgaaatgataaaatattcacccaaatgtaaatatgacaaaaaagggataaatttctgaaaaaggttaatttcatgtaaatttttattttcagcatcggacccaatgataagttacaccgagtggggctgcaagcggcacaaagatgaatgtggcgtggaactccgtttaaagttctggctgagtgttgcgatggtcaatagcgatcggtgaccgaaattcgacccaatttacgtgttcg

SEQ ID NO: 5835 - DNA, 3946 bp, Heterodera glycines
tttatgtgcaattgcttattgttacacttaaagaacgttgtgcagaaatctttagaggctataatgagccataaacacttgaaattttgtgtagtcttatgtgccgtttctcccaaaaaatctaattatcctcgtcgcatagggctcaacatacacgaaaatttaattaaaataggccatttcgctaacgagagagggtataaatagcaagccttttccagccaaaaccccatttcttctattcatttggaaattctgcaaacatcctactgcgcgtagctcctcttacagcatttacttcacagctctgcttactatttacctattacaatacttgcatcacaaatatcttataagacatattttaaaataatataattcatttatctcataaataattaattctcattaaaaaattaaatttcctttcttaattcataaatataaaattactctcaatataacaaaatgaagcgtgtctccaatacccaatcttcatctttctccccaaaaaaatctcaaactaataaatgcattcgtaaaattgaccaatttacttccaaaagtcttaaacatcatttcatccgctctaaatcaaaatttgctatcgaggaaattgaaaaatgtgcagatccccaggttgaattccgttcatgcgtgcacaacgcggttgaggatgctattcatgatgcacaaaacaccattggaggagcaaataaggtaggtgtcataatttcttcggagcttttagaccagggtgacatcatcatgcctataactccaattacatcaaatgtcgtcgatgctgtatttaatcaattttgcaaagtggagcagagcaaagctaaacacgtcaatttttacggtgccccattttttataaccgtcactgtcctgaacactgattgtctaccccgtcgacgaacgaccaaaggaagtgcccctccaattcactcttcccaatcacacatcttcaaaattaacaacaacgacaattattgcctttttttatgcactggaactgatgcgctactactcattatatatcaggggagtaatttcaaggaaacaatttagatggctcaaagataaccaaactactgttcttcgtcaaaaagtactacttttactccgcgatgccgggattccgacaactgaaacggaatacgatgccgaaatatacatccatcaagtgcaaggattatggagcataaaatatcccggtgattttgtaaatttatgtaattataataaatattttaaaaatttaggcgaatacaaaatttttattttcaacgactatcaaacccgacccatcacaaagtctgacgtcattgactaccaatttccaattttactttatcatcacgacaaacatttcgatggcatcaaaaccttgccaaaattttggaacaaacgctactattgcctctcctgtgaatcagcattcagcaataaaccacaacattcaatgaactgcacatcactctgtcatggatgtcgggaggtgggcgttgactacccatgcgagccacaacagggatacttcaaaaaatgtgatcaatgtaacaacaatttctacaacaaggattgctatgaacgccacctacacaaggatctatgcaccaaatttcagcgatgcgaggactgtggggtaatttataatgtaaagtatcacggtaaaacaggtcaccaatgcggggaaaagttttgtcgactttgcaagcaattccatgtaaaagaggatgatgaggataatccgtgcagtagctgttttatccaacccctaaaaccccataaacttaaaccatacaggatcatcgcttatgattttgaggcgaacaggataaaaaagtaggtaataaatttgaacacgaggtaaactttgtgtcggcaatcatcatttgtaccgattgcatcaatggaaattggaaggactcacttaaaggatcctcttgcaaaattcgtggaccccaccgcacaatcaccttcgcaccattcgacttctcaaacacgatagtggaccaaaaagtcaccactcaaaacccactgcgcgactttgtccaatggctactcttcgaccacaacaaaaaatttcccacggttgcctttgcacactttgggggccgctacgacatgaccatggttatcaaggaagtcgtttcgcaaggtaaaaatttattaaatatttaattaatttttatcaatcaaggtattcataaccctgatattatcaaacaaggaaaccggctctatgaactgagaatcaatcaaaatgaacacgggcctttgaccatacttcgcgacagctacaacctaatgcccatcaaattatctggactaatcaaatcatttggtctcaaaatacaagtaaataaaaattttaagtattttcgtaattttaatttttaggataaacaatattttccccacatgttcaacaaagcatcaaactacgacaactttctctcccatctacctccttgcgaatattattgtcccgatcaaatgaaagtcccagaccaacagaaatttaacgattggtacaataataattacaaccaaccttttaaccttaaggaaaaacttcctgaatattgttgtaatgacgtacaaatccttacccatgcacttgtggaattacgccgggaattcaagcaactgacacaacggaacggaaaacacgggggaatcgacattctttggcaagcaatgaccatcgccagcgcatgcgtcaagaactttgcactcaatcatttgaagcccaactcgctcgccatcgtaccggaaaaaggttatacacctcaacagaaccaaagtgcccttgccatcaaatacctggattggtacgcccacataaacaacatcaatatacagacggctcattcccgctacggtgaatatgtctttaagcgagaaggacaggtttatcaagtggacggttatataaaagggactaatgggaagagggataaaattattgaggtaaatggatgtttatggcatggatgtgaggagtgttttgaggacttggacgaagagacgaggatgccaaacggaaagacgctgcgggagattagggagagggaggtgagaaaacacgagatccttcgccggtacgtcgacttggaaattgtatgggaacatgaaatcaatgagcagttgaaaaaggacgcagcaatgaaggattactttgacaattggaaggaccgttcccccatcaaaatcagagacgcgtttcatggaggacggactggaccaatgaagctactccacacagcaaagccgggacaaaaaatcagctacaaggacttcaccagcctttatccatggaccaacttttctacaagttatccactcggtcacccaaaaattatcaactttagattaaatgagcaaactgtcaactggcgagctccatccgacaatccatacaagggacttttaaaagttttacttttacccccaaacaggaatatcaatgtgaccgtaatgcccgtaaaatttgatgagcgactcctcttccctctctatgagaagtgcgccaaacacatcaccaatgaacacccgaatggcctcaaagacgacaactactcgtgtccacacttcaatcccaatgaccgtgcctttgtctctacctgcactcaccttgaattgagtgctgccttggaggtcggctacaccgtcagaaaactcttccatgtcctgcaatacgaccaatggagcgacaacatcttcaaatcttacgttagcgaaatgatggccctgaagatccacgcaaccggcttcccttcatggtgcagcaacgaagaggagaagaaggaatacattgaggagaaccgtcagcgatttggaattttgttagacaacgaaaagatgaaggctgaaccagggaagcggtacatcgccaagctctgcctcaactcactctggggccgcttctcga

SEQ ID NO: 5836 - DNA, 2111 bp, Heterodera glycines
  misc_feature (2017)..(2017): n is a, c, g, or t
  misc_feature (2056)..(2056): n is a, c, g, or t
  misc_feature (2080)..(2080): n is a, c, g, or t
gagcagacggtcaactggcgacatccatatgacaacacgtacaagggaccttttaaaagttttacttttacccccaaacaggaatatcaatgtaaccgtaatgcccgtaaaatttgatgagcgactcctcttccctctctgtgagaagtgcgccaaaaacatcaccaatgaacacccgaatggcctcaaagacgacaactactcctgcccacacttcaatcccaatgaccgtgcctttgtctctacctgcacccatcttgagttaaacgcagcattggaggccggctacaccgtccgcaaagtcttccatgtcctacaatacgaccaatggagcgacaacatcttcaaatcttacgttagcgaaatgatggccctgaaaatccatgccaccggcttcccttcatggtgcagcagcgaagaggagaagaaggaatacattgaggagaaccgtcagcgatttgggattctgttggacaaggaaaagatgaaagctgaaccagggaagcggtacatcgccaaactttgcctcaactcactctggggccgcttctccatgcggaacctcctctccaaagcaataatcaacaacgacgaaagcctgattcgccaatataccgacgacaagaaaatcgaattagtggacttggaaatgatggatgaggacaacgatgtttttatgctgacttaccgaccaaaagaagaatttgtcgacgaaaataaatactccaatgtcgtcatctccctcttcacgacatctgcagctcgcctctacctctacgaagctcttaaaaaagtagccgacacccccgactgcgaaatcctttattacgacaccgatagcgtcatttacgtgcaccccgaggaaaacgacccactaccaacaggaaagggacaccttggagaactaacagacgaaaaccccgaccacaatatcttggagttcattagtgctggctgcaagaattatgggatgaagctgcaacgcaaggacaccggtgaaatagaacatgaattaaaaataagagggttcacccttgatgcacaaacggttcaaagaattcattacgatactgtaaaagaccaaattttacgttatgggtccgatgaccccgcggaccccattattgtaacttacccccattttattcgccctaatcttatccaaggcaaagtgtatactcattccctcacaaaacattatcaacccatattcacaaaaggtattattaatgattcattccaagtcctcgaatttggttatcgcaaatgataagtatgcattctcaattaaattttctgtatattagttttcttattgttcccttcttttctttctctctgtttatatcactcatgtgggacggaatgacccctggttgatcctctccaacactccaggccatccatctgagatgaaggtggacgagctgttcattattgtaatgcgcagcctggtgcgtgagtgtttggattggggaccgaagggtgaagccgttccctgggtgtgtttactcacttttaagggaactctaagaattctgatatgccttcaaatctatcaaaagagttgcatactttctttttataatttcctttattctctattttacacttgtatttttcatttgaatgtttattcagaaataaaattgaaaaatgtgtcattactaatattaaaaggtataaattaaaaaggtatttaatgagaaaaatagtcagggttttgtaacacaatttgtaaattattaaggaatagaagatacaattttaaaaaatacacgaacttgtcgtttttaggaagaaaagtgcataattaaacacattaacatgtatgcagaattaagcactggaagatacaatttgaaaattattaagcaattgggaatgtcgtttttaggtagaaatatgcaaaattaagagaaataagttacaatttgtaaattattaaggaatagaagatacaattttgattatgtgcacgaacttgtcgtttttaggtagaaaaatgcataattanacacattaacatgtatgcagaattagcaatggaagatancatttgtaattatttagcatttgngaacgtcatttttaggtagaaaagtgcagaa

SEQ ID NO: 5837 - DNA, 6403 bp, Heterodera glycines
cagcagcagcaaatgattggtactggccactttttggagctgatgacattgtttttggcctaggccctccgatggacactgaaaaagcaaaaatttacatgaaaaaagcggtgatggagacaaagccaatcccgagatttaagcgagaaatgattcaaagtaattagtcaaaaggaaaactcaaagaaaaatttaaagaattataagaaaaatattaaatttaaatttttgaattaaaaatatttttataatggaaaagatggaagaaaatattttaaattaaaaatatttttataatggaaaagatggaagaaaatatttaaatttaattttttatttgaaatatttttaaaatagaagttgaaaaaaacgataaaaatgacaaaaataaaaaaatgtaaggatttataacactttgtacaaattttacacaccattgctttcagcagcagaacatttagtcgccgccaccttttctgcttctttggttgagttttccgcttcatttgccgcgggcgattgtccaaagcctaaaaataattatttatgattttcggcaacagatattttacaaaattaaaaatgaaaattaaatttaacacattcttttttttaatattattgccaccatttttttgctgatgctccgttttcccagcggtgccgcccgtcgacgaatgtgccgagccggccgatgatgccgctccagtcaccgctccggcgccaacgccagcacgcattgcgcgtacgatcaacttgcgcattcgctcaatgatcaacgcgtcgtccttttcgccgggaatcaaatggagcagacgctgatcatcaaaatattttgcacttaaaaaaacagggtgggaatgtttaaaatttttttttaacattttaattttaattaatgatagcaggattaatctaattaatttttttataatttgtagcttaacaatgaaattgaaaagataaatcggtaaggtttaaaaaaaaatgcttcctaattacaaataatttgatcagaaaataatttaattcacctcggcaatgtcttttgcttgaactcatcgatacgccgttcaatcacctaatgcattttaaaattaaatttaatttttaaatttaataaattaaattaataaacacctcgggaaacaggccacgactttgcatatgccttctcagcacatcctcatcataatccaaaatcaacgccatatccaccggtctgacctgaacatattcaaattgatgagataataataattattgttagcagctaatctggcaaagaaacagaagccaatgtgaccagggttttacgctaattagactattacggataatcattatgcggtcattagcctctccaccccctcccccattctctgtggcttaattggtgtccagctgttgaagcaggtgagctcataaaaactcatgtccactcattcaaatttatgtgccgtgccgtctttcgtgccaacaaatccattaatctgctaattgctttttaattatttcactcacattgcgttcaaagtcctccacttgtcgtgcctcgcgcggaaagccctcaatgaaatacgcttttgcgtacggttggcggcccatctccgctttgactaattgctgggccaattcgttggggatcagctcaccgcgctggtagcgctcggccgccactcgccattccgatgatcggtccttgtagcgagcaatcgatgtgcggatcaaatccttagaagaaaaaaaaaggggggcgggggaatggattagacgaattcgcgcttttagaaccttttatactttttttttgcgcaataaacccataaaaaaatttaaattattttcaaattcgattgaacaaatatgcgcatttgagagtattgaaccgagttttaaaagtcatgctttttttttaccccaaaaatcgtgaaaataattgcttgatcaagattctagtcataacttttttgaaaaactttattacattcatttttgtgcctaccggcatgcaaatgtgtgcaagcccttcatcgcgcagctcctcctgcaatttggccgcgtatcgtgttttgccaccgcccgggccaccttgaaatatgttagcagatttaagcctcacgtccaagccctggcaattaaataaatacccatgaatagaataattggtgcgtccggagcaatgcaagcgtccttagccgcctgaactagcgagctgggccttgatgagttggaccaggaattgacgcgacttcttgtcccattctgctgctgagttgagctatacacacattgaaatgaattcaatcttagaaaatttttttgtgtggcaatgctttttaacatattatataactaatagaaccaattaaaaatttttaaataaaaaaaatgattaaatgaaaaaatgaaaaatttgtctgctttttaagttttaatttaaagaaaaaaaaagtaaaaataaaagaagaactaaataaatatatgtagaaaaagatgaaaagagatttttatcttcgtttaaaacttttagcattaattatattttgtgttcggacttgtaggtacttaaaaagcaaaataaatacataagtgcaaaagaattgctacgaatggtaaaatttgtgacaaaaatgcaaaaaaataaaaaaaaaattttgctcatcagcgccaaaaattttctcataattttataaatttaattaatttgaggacggttttgccgataggcgccgtcggcttaaagcattttccgcagaaaaatatggcgaaaaccgttgggcagtataattaacagctttattggtttcgcattgaatccaattcccaattagcaatgaaattataattttataattaccgaaataattctttttttaatttaaaaaaggtttcaaatttaaaacaatgccttttccgcgatggatgacttgcgtctctgctagctcgctttgacgactttggactgagtgccgtcgcatgtggcgctacaacggccgacgcaacgggcggacgcgctaaaattttaaaatttaaaaaatcattaatatttaattttggctcctaattaaattttaaaagaaaattgaaagaacaaacgttcccagtcaggcactttaagttggaccaaacaccgagaacgactcattaattatttaagaagattccaatggacaaaggcaatttgtttattaatctttaaacaactgaacatttaaaaaggttcagaatacaaattttaaattcttttaattaattttaaagatttcactagctaaggtattccaaaaaatctatagcagcatattttcaatagcgatgagtcaccggagaaaaatttggaatttttaagaaatttgaaaaaagaaaatttaaaataatgatagatttttaaaataaagataggctgaaataagttagaccaaatacagtacaatttcttaaaacgtatagatgatccgataccacatggtttaattatcttggcgagcattttttttctaattttctcgagttggaaaaagagggtgagagcctgataaattaaaaaaaaaaaatttaattttaaatattatgctttaatagacaggtatttttgttatttttgaggagttaaaggaacgagcctaaaatttggccaagacttgttcgtctgtccaagccttttgccacataatgtgacggaaacaattggacgaaggaaaagcacggcataacaataagcaaaaaaataaaatgtgagacaaaccatcgaccgggaagaaaataaaaaagtaaaataagaggagagggacaatcaaatcaatcatacaatgataaaaatttcaaaaatttatttattttagataattaaaaatcttcatttatacagggcgcgataaaattttacccaaatttttagatttattttttcgatattctcagtcccgcgccggatttgctggaccattccgcaacagcatttttattttggaaattatcctaattagtacttttttgacaaaaattcgtcataatggagattagcctaattagtacttttttgacaaaaattcgtcataacttattgaaagttgcctgctaacagagaattttaaaaggtgatcgaacggatatctaggattttgatttgattttctttaaaaaaaagttaaaattgaatttttttcgaaaattcctcccgctcatttgtcagtttgcccaccgccgtccgccgtttcattgtccgtcgattggtgccgtttcaccgcaacactttcctccccccgtttcttcttccccatattctcatcaacagctgaggaagcagttgttgtgccaatgtcgcctttttcgctgctgtttgtcgccgttttttcctcgctcattttgtttggttggggcggcgtcacaaaagaatccctcaagagaatattggatcaattaaaataaattagggtcattaaaaaagcaatgctaaaatgctaaaatttttatattttgttattttaacagtttcttattttttgcattaatataatgaactgaaacgtctttcggaacttaaaatatgtttttttaatagtttgacaatttgttggttgaattttaaaagtttcaagctaaaagcgatgaaaggataaagatgaatttatatttattaattctttcaaaagttaaataacaattaataataaaaaacaaaaaattaccatttaaatgccattcctggatttgttcgaatcttttgaatggcattctccaaaaactggatggggtcctctggcttgttgtagataaggccagccattaggccctgtggtggatggggaaggaattatttattcaatcgacagcattttgtatataaaaagaaaatgccaaaatggcacaaacaaaaattggcacagctggaagtttaatttcatttttattcatttttaaatatttttaattgtcataaattttaaattatgattacaattattagataattttattttatatggataataaatgtacctcaaaaagttgcgggatcgcatggtcctgcaaatagcgtttggcttcagtacccattgtttcgtgaactcgacatttacgtcttttttgtcactttcattaaatttttatggaaattttttacaacaaaatatttctgtaaaaaaggattaaatttattcttcctcaattaaataaatatttaaaatgaatagaaccagaagataaatcccaatttcgctttttaaaatttctatttttacttaaatttgagggttttcaacatttccccgttaaaagggagcgaaaaagccttaagcaaaaccataagctgctggccaactgtacacctccaagatgattaatatttttacgaatttggagctaaatgttttgccggctgaaatatgtcgcgtcccatcacaaaattccgaaatgaagccgtgaagtgattttgcttacgcatttaagctgctctgatgatgctgctaataggcacccgcccttttattggccgaggggaaggctttttgtggataggaaagagcttatgtggcacagccgtgggaaaagaggatcatcccttcctgtgcccatttggcaaattaaacgggcgatggggataaaaagtcggcacatttatttaatttataaatattagtgaggggaagggggaagcccccggggggggggggagggaagagaaagggaagtgcgcggaatatttcaaataaaaatgttggcatgggaaccacccgaataatctgtgcatataaggcaatcacaaaaatgaggaggatgaaacaaaaatataaggcggagggggggggggggaatgggaaggaatccagaaaaaaagggtgaaaggaacatggaaaggaaggaaaatgagaaattttaattaattataaatcctagactttctgctgggtttttcaaagaaaaatttggctttttttgggaaatcattgacaaaatcatagatttttgaacagttttgacgtcagtttgttgataaatggcctaaaactacccgagaaaagtgctttcctttgtcgggatcatgccaattttatgacgggggaggggggggggggggggacgggccaacagcgtctggccatctgcgtctgagacaactttatgaagccataacttttttctatgttggccaaatcaaacaatattggtatcattgggaagaactttgaaaaatgaatatttttttgtataaacatttggttaaaattattctttcagtagagtcttgagcctcgcctgctttcagattcctcgcgaatcgtttttagttaaaccccatattatccacaatttcttcaaaattggcatttacatttttttaaattttttgctttgccacaaatgggaattctatgtaaaaaaataatcaaatatgtaaaca

SEQ ID NO: 5838 - DNA, 3154 bp, Heterodera glycines
  misc_feature (3102)..(3102): n is a, c, g, or t
attataccattttgttcacgttcggatggcatattcattatgacataacggcatattgggcatgaattattcccaccttgaagccttaaaaaatatgaatcattcgttcgtttgaatcatcaaaatttaataatatgaaaatataatccaattgggttttcaaaaaataccaagtgcttaggcaatcttcatgaaaaatatgctaaaaaatgaaattttaaattttttaaaattctaaattggcttaacattgcatgctggcaaaggcttcacacttgtgccactcggaattggatcgagacaaattgcacaatcgaattcagtgccaacaattgttgacggaatttcgttgaaagcatttaataagcctaaaaaatgttttaaaatgactaattgcccattcttaaatcggaattttaagcctataaaagtgtatctgtccattattattgacattattattattttgcaattactcaaaattatacgtcaaattaattatttaaaattcatataaattattttcgtacttattccattaattgtttgctgcgtttgatgaatcgccgccattggcgcccgattaaaaaattggttgattcgcgcatggaaaaatataaatccgagagttattacaaaaaccgtgaccaaaagtgccagtaaaattactaaagccacatttaaaagtgaaaatgctcttctgtgacgtcgaaatgagcctaaaatacgttaaattgcttcatcctgaaatattctcaaaagaaatgaaaaagaaattcggcacggaataaaaataaaaaaagaaaattttttaaatcgaaaaatcaaaaatcgaaacaaaaaattgttatgagtacaaatttctgtatataaattggtttggattaaatgggatttgaatgtttttatggattaactctcatggaatattcaaaattaattattataaaaatagaaattctaaattaatttattgcacgttttcgtctctttgccgtgccatcctcgcaaatttcaattgtttttgccacaaattgcaatttttgctttttcagtgtccatcggagggcctaggccaaaaacaatgtcatcagctccaaaaagtggccagtaccaatcatttgctgctgctggtgggcgaacggtgtcggccgccgctcttaaaacgatgacaaaagaggcggcggcggcggtgccatcggcgccggcaaaagtgccgtcgaggggtggaagtgagcgaagggaagggagcggaagcggagaaggtgtgggcagcagaggaacttcacaacagagcggcaacagaaggtcatccgcatccggcggacaatggaagacgcggaatggcggcgaaactggtaaaaaaatatatactgtagcaatacggtttctcgctgggacacagattatcatcttaactgaagttgctgatcataacagtatttgcgcataattcatggattggattgtgaatgaaggcgttatgttccattttttattacgaaataccgtgtaccgattttttccggattctctgcgtaaatctcaacagaaaatctgcttataaaactcggttaagtgttcgaaaatgtttaaaaattattggcaattaaagagatttttcaagtgaaaatcaactccctaaaataattagagtattttatttccaattttcagaaactcaaattcgaaaatcgccgtcaagcagtgccggaagtcgcaataatgaatcatcaaaaaggaatggcacttcacactccgcgagccaaaagaatgttggcactgtgccgcccaatgtgccgattgttctagtcatcggtagttttggactcaaaaccgaaaattttcgaaaagtgattttagcagggtttaatttgaaaaataaaatgcataattaaatttttttttaaataattataaatttgctttttctcagcaatttttttaaataaaatttaattggtttgaatcaaggtaaaaaataagcaagtgattgaaaaaaaaatcagtgacgtgtccaacagcgctcaaatggccaaactaagctttaaccaggctcttagcgccagttcagatttagttgtaggaccgtattacatttgtggaggattatggactttttttaaataaaaaattaacaattttgtttttaattattgttcatcaagaatcaatgtgttttcacaaggttcatttaaaatggcaatgaccaatgacggggaggctaattaacgaaaaagcattcaattagtaatttatttttgtctttaaggagcgccgggctccagcaaatcaaaatttgcgcaaaatatcgccaaaaaatatgatggattcgtgttcatcagcatgggcgaactgttgcgcagaaaagtgcagcaaaatggggagaatgaattgtgggcaaaaattggcaaaaagatggacgccggagaaatgattcccatggtgggcgaagtccaactttttttttaataaatatttattcaaatatattattaaaaattttatttattatactactcgtataaaatatggtgcgtttaatctgcaaaatttcattaaatttcaaaagttatgactaatgaaattcaaaaaattttggttttcaagtttggttgctttagcgtaaaattataagcaaaattttgtagtttttttaataacggcatagcacctaaaaatacgccttaaatggttgcaaaacaataaattttctattttttttttaaatcatcatattttaaggaaaacctcattttatttcgtaaagaaatttttcaaataccttttttaatctggcatattaaaaccaaaaaatgcactcactaatttactaattaatgccataatttgtaaattcactcactaatttattaattaatgccatcattagtgtgttttcgcctttgtcagagaatatgccgtgaattgatttacgcgtctgtccatgaacgctgtcccaacagttggggcttcgtcgtggagggctttccgcgcacgttggcccaggccgaggacatcgaggcacagctgggccacattgacttggcactgctcatcgactgcacggaacagttctgcaaggacgcgttgcgaaagcgntacacgcgggacaaggaggagggagcggagagggcgggtaatgggggaaaaa

SEQ ID NO: 5839 - DNA, 1172 bp, Heterodera glycines
accgctcttaaggcacttttgagtttcggtttcgtccgtcaaaaattttcgtttccttttgatttacgtcaaatgaaatttttacacccttaagagaatgacttttttggtaaaaaaatgatttcttcatgttttgtttttgtcttccaaaattttttcgtttcgttttctttttgattttcaaaacagcatctcactctttctctcatttctttctctacgtatctctcttgctctctatctctccctttctttccttacttctctctctcactctttttttctttgacctccctttctcgccctttacttttcctctcccttacaccctttctttatctctctccctaggtctttctctatatctcttcctcttaatctctatctttctctttcatcctttctcgtaaatcctctatctcccgcttcacaccccattttcactctctctctctctcacttcctcactcccctttttcttaatcactatctccctttctctcttaatctgttatctctctaactcaatcactatctcgtcttttttttctctccactccacctctttctctcatttcctctttctgcctctctctcctttctttcttctctttttcttcattcttcctccgttctctttttaaccttcactcacaattatttataaataaacaaaatgacaaaaccaatgccaattcaatcaatgaaaaatgcaaaaggtctcgttacatcagcagcgctagcaaagctcatttgtcagccaatcctccctctccgtctctcctcatccactcaataaacatattttctgttcacaattcaatttttatagaaatgtttatttttaaatttcaaaaaatatgtaatgtctgccccgtcaaaaatttaaaattttccttttatctcggaaatgattctcgatagcaactattctaaacaaaagctcattgccaattaatcattttaatggtgatcatatttttcaccagtttcttgctgactcccggaaaattgaactcaccattcaaaaggcaattcggtagagaatttttgtttattccaataggcttattcattttctctagaaagatttgcccaaccccctaatttatccgatttttagtgtttttggtggtgttcaggtcaacatgaaggagtgatctgatcaagtc

SEQ ID NO: 5840 - DNA, 4974 bp, Heterodera glycines
attaggcattagaggaggcaatccaacgctatccgccaaatccgtggtcagtgcacgcggccccccctatggctgtgtccatcacccaaagcacggagagcggcacgctctactcattggcacagatccgtcgcattgcgaacattgcgcattcgcatggcattcccttgcacatggacggggcgcgattcgcaaacgcagtgagaaaccgtagggacaaaattgtgcgtctaaatttttcggaattttttggttataactttttgtaaatttttttttactaaaattcctcaaaaataaacataaggctgccggacatttcgacaatgccgtttcgacaacaaaattaaatatattgttttaaatataattttaattttttctaaatgatatggacggtgaggatttgggagttttattaatttaaaatcaatttaacagagaaaaattttgttgacacaaaacccgaaagtaccaagaattttttagtcaacaaacaaagttatataagtttgaattatttgggatttttcggtgcccttagatttgagtttaaatcgggtcataaactttttccgcacattttgcatggtgcgcagtgcgcatactttcgatatgaaaaaatgaaaaggaattaaaaagcaaaaatggcaatatcgatgttaaattaatatttataatttatttagtttaaaaaatatatgatttaccctttcctttttacataatgaaaaataataattaaaattttgctaaattaattaatttctaattcttcagcgcttggcattttttttgtgtgcagattatagaactagattttttaacttttatttataaaagaattgaaaaaattaatatttcttacttaaaataattttcaatgaatttttaaacgaatgaatttttatgaaattttcgcttttcttttattagcagattttcaccaaaatgttcttagtgaagtttaatgtttaacaaaattttttcaatatcttgaaaattacagtgactttttgaaaaattagtaaatagaacaataataatttctttttctgttcataaaattctattattatattaatttaatttttatttaaatttatcttttttattcatttttattttttactagttttcaaaaactttgcaattttttcattaatttttcttagcataaaattttcgaatttttttaaattttagttagataatttttgaaaatattctaaaatattttttgattaattgggttagtattttatctacccatttgtttaatttctgagttttcattgtttatcattttgttcaattttcttgactttttctctctcttttttgtccgacccgtcgccaagtatttcgtcaaaagcatatagggccaaatctctcaattttcgagttttaaaaccggttcaaaaacaggttttttggcatttcgcaactctagacatttttcttgcttagtctcctcaagacaaatcgattggtatatcacttgaccctttttttcacggggcgttcactacagtttatcctaaattaaatttaactattaagaaatatttgtacagaaaataattgtttgtgattttatttcattgaatagatttgtttaattataatcattgattaggtttttattggctattataatgtttttacaacctaatatttcctaacttttcattaacaaaataaatattttaaatatttttaaattagttattaatttattaaatttgtctctaatcttttttttaccaacattttattatcatttattatgttgctatttaaagtttttatcattgattatgactttgcttaacgtaaattaatttggccattattataataattcattaaaaaacccaaaattactttggcacttaattatttcgtcactgattttcgggcttgcttctttggtttcaaaatattgctttatgttttttaatttttcctcattgaacaattattttttgcttgaataaataataaatcccctaaaaaatcacttatttttaaaatatttttgaattaattgtttttttcatcttcgaaatgtgtctttaccaatgctcaattccttcacaaattctttctgtttgcattggccatataaacttttaaattagggttgggcccccgaccccgaaccccgacgcttccaaccccgacaaccccgaaccccgacccttaatcacgatcggggtcggggttaaatatacacccctaagaatggaatttttgtgggggaaaaggcaaaaaagttataagaaatttgaattttttttaaccattttgccaaattttattaaataaagtaaatttcttttttttttattgtgtattgtgtggtatagtggttattgctttaacaataacaattcttttcttatgagttcgataccggttgacttttctttttaatttatttttttgtgattaatatagttttttaaacaaaattaatatttttaatattttttacaaaatataaaaaattaaattaaatttcacagaaattcataaatttttgctgaaaaactattagaaaataaagattaattttgacaaaaaaacaagaaaaaaacccaaaaattatctgaaattcataaattttttggtgaaaatctgttacaaaatagaccttacgcccctcaaaaaccctttttttaaaatcagctcaaaatcgaaaaaatttatctttttttggagaaaagatgttaacagacccatccaaattttcaaaatttttccagcggcgcctatcggcgccgccggaccctttctcctaaaggtctttagaaaaagagcgccgcgaaaaaaaagataatttgaaaaccaaaaagaaagatgatcagaaatttttgggcatttttttgaataaaatccttctatttttatttgggggccaggcgccggaggaaaaatttgaaattttgactattttacagattttcactgaaaattagcccttttaaaaatgccttatgcgattttaattaattctatactaaaataattatgaaataaaaaagcacataaattattaatgaataaaaaaataatataaagttttttgactatatggtataaggcaaaaattggaaaaaccccgaaccccgaaccccgacgcttgcaaccccgacaaccccgaaccccgaattttccaaccccgacgttgggggctcaaccctattttaaattcatcaaatcgttcaatgaattcgttctttttcatttcttaaaaactcttttccatctttttatttttttaaatttacttcatttttccatttgtatatattttttcgacttgcgcctaataattttccaatttttgactcaattttcgtttcattgtttcttttaaattttccttttgctctcaacttttctttaattgcataatttatgaattgtttctcttttttgttgatcatttgggtgtgttccatttttccactattttgattaatataattattaaattccgaatttttatttttgtcccatagttcgccgaatatttaatcgaaatttggtcggattgtgcctgtttcactattataaataagaaaaaatattataaatattaaatgccacaaattcatttttgcaattcggaaatatttatgaataaaataaattttataaatgttatattatatgaagattaacaaataatatatttaacatattataaaatcaatttttactattttttaattgactttatttgttttaaaatttttaaaaaaataaataattaattatgtttcaaaataatttcgacttaaaataaatgcataggaaaagaaaaatttaggcacaaattccaattttctggacaatttttgttgagaaaataaagttatctggaagaagtcaaacctttaataattcaagacaaatttttaaggacatgaatacttcatcaaaatttggttggattttccggtttcaattttttatgcaaagaaaaataaaataataacaaacagtaaatagcacaaattcatttttacaattttaatgtgaatttttctttgaatttcttaattttatagcttccttttcaaatataaatcaattaaaaatcaaaaatgatttgatttttcagatatgtcctatcctgttttggagaaaataattataaacaaaaattttatattttttcaaaatcttcctgaattttagggacgcaaaatatttaatgaaaaagatttatacaaatagcaaattaatgaacttttaacatttttgaaaatttccaaaaaaaattaagtccattataattgaaaaacttttgaatacatatataatttactttgtccattttggtgccataaaaattacattttcgaaattatgcaaatttctttctcttatggtattttggcatcaattcttttttccattttataaatgtcactgcagaaatgcccaattcctttgtaaattcgttctgtttgcctctgtcatataaacttttaaattcatcaaatcgttaaatgaattctttcattttctcatcaataattcttttccaaattattattttttccatttgtaaattttgacgattttcgcataatcattttaacaattttccttttaattttttgctttggagtggtaatttgggttttcttttttgctcgttttgctcaatttttgttggttttttgttaatcattatttattctttttcatttttgtcccctcagttgccaaatatttcttgaaaatttagtcggattttgccgtattcattccataaaacaataaatattaaaagccataaattcatttttacaattttgaaatatttgaataagaaaattccccggcaaatctttgtcaatccaccactcccttttcatatatgctgttaccgctaaattcttttcgaattggttatattttgtttttacaaatccaaataattctttataattc

SEQ ID NO: 5841 - DNA, 3902 bp, Heterodera glycines
cttatgcttcgctatttttttaatctcattaatcgatttcgtaccaaaaattccccttattttattgttttacctttttgtttctaatcattgtttcggccctttcagcacattccttcagaatttttctaatcaatttttcaatcatggcgcctgtttcttctgacggtttttccaccttttcaaaacaatattgtaaattttttccttgagataattaattaccaaaaagttttggtacccaatttcttcgggataaaacccatattctttgaccatagctgcagcgagctaaaattaaaaaacctcaatttatgtctaatgctactttatcatttttaatttaattacattttctcattttttaaagacttcgtagcataacgagtcttattcataactttttaatttttatatttttattaccgatgtagctttttttatgtcggtttccgatccgttgaaacggcggttataaatgacttcttcgccaatggctccagcgagtagaatttcaatatctcccaggaattcttcttttgacacgcaatgggtgttaatcctttttttttctgtctgaatattacaaattttattaatgtattttttgagaattttccggaaatcacgcccggaaaaatcacaacagtacataaaaacgtccatacaaacacaaaaagacaaaaacacatccggataaaattacgtccggacaacaatcccgaaaattttttgtcagatattggtgaaatatttaaaaaaaatttaaagtctaatctttaaaaaaaatagtgatcaataatttttttaaaacccacgaaaccactcccgtcgtaattgacggtcatttcgacagggtcacaataatccgaattggacattaacacggcatggcacgcttcatgcgtaccttaatttttagaaaaacgacaaattttagttataaaatatgtccaataaataagaattatttaatttaatttacaaattaattttttttcaaaaattgttaattttgtcgattcttgtcggagtccaactgtttggactccaatgtccctctttcccaaaatttcaacgatttggtcattttcatgttgaatttgttgtagaccgatttcaccactctttccgtcaatctaaagtttttaaaatttgttttttttcatgcctttttagtacaaattttttttgattgcttattgttttgacagcaatctcaaagtcgtcagtaatggcggttgattttcgctttgagacgacttcgagaaaggcgtaattgcagacttcgcgcaaatcggccccggtcagaccttcttcctcgcacaatttggcgattttttcataatttaaatctgccttcggaattttttgtgcaaaaatttccaaaatcttaaaaaaaattgtgatttaaaacttagaaaaaaatttttaattaattcattaatttttgtatttagctattttcgtttttggcattttacgttttatcataaaaaaatttttgattctaaaaatcccaccataaattttcagtcttccctggggcgtttatttgcaacgaaggactcctcccatttcttttataaatagaaaataatttttggaacttacactttttattgactcttgatttggtgcaaacatttttatgtagtaaaattttttaaaaaccgctggcaccttaaaataaaattttaaaggctttctaaaaaaacttatcatattattattattattattgttattattagtaatttttatttcttcattaattgttaatttcattttctcacaataattttattatatgcttatcaacaacaatattttaatattaattaggataacataatgaaaacacaattaccttgtaatcagatgtgctgattttaacaattattttaattttcccatccaatgaagaaagcaagtcggcttgaatcatatcttctaaaaaagaaacaattttgtataataattattattattttattcttcattttgtatttgtattctattatttatttatttattttgtttttaaatataattatatttctataaatttatacccatagcttcgacattttcaaataacagtattgttcgattctgacggctttttgccaaatcgataatttcttttaggcaattcttgttgttttgcgctaattcaacgaaattaatccaaattatctctgccccatgttttgcagcaaaagtcctataaattaaatatcaaaatttaaattttaatgttaaatcaccggactagcagcgttttgccgcacccagccgggccaaagaggagaatcccctttttcgtcgtaatgtcattatccagtaataattgctggttatcaaacggcaccccaaaaatctggaattttttgaattttaccttccctcatacatcattttttaattcaattaccgtttccagttctttaatttgattttgatggccaaaaaccttatcatacgataaatcttttggcttctaaataattggattttttaatatttttaaaacaaaaagttacttcgttttttaattttagttgaccttcttttcttttttcaacgccagtttgttgaaaactcattttcttaaaaatgtagtaaatatctaatttttttttgaaaatttagctattattatttttttaaaattcttccacatttcttcgtaatagttggaatagatttattaattatttattatcagaaatatattttgtttattataatctgcatttttggtttatgtctggccaaatttgcatttatgattaaaaacagatgagcagcgcttattcatagtgttaatggtataaaaaaaatctaaaacataaataaaatatcacgttttaatttattatgaaaaaataaaaaatgtgtttatgaataatgttgatcagatataattacattacagaaatataaatgaatgatctcgaccgcaagcatgttcgggtattcgtttcttgacactccaacatagatacattgcgctctatcagcttgtttttcaccattttgttttggcgctgagtatcaccgagtgactactaactgctgcaaaaatccaacctgctaagaaggattaaaatctttaattacaaactatttgtcttaatcataaaaaaataaaattttctttttatcaatattttttatatggtatttttttgttgatgttgttgtgatcactaaatggtaaagaagggtccattaaatgtaatttaactttatttcttattttggcaattgttattaaaaaagaggtttttaaaaaattatagagaaaattaatgagttctcaatgaagtttctgaaagagcatgcatacttcattctataaaaaaattgtattttattttttgatcattatcagttttattgctaattttttaaagaatatatgattggagacatacgtacagagaccacatatgcgtttgtaatataatttttttagctatttatttacaaaatttcttttttcaaatgcgtctacggcgtggccggaaaaataagggtcttacattagccaaaaatagtcaaaaattttttgcggttttgagaaatgcgcatgatgaatgatttacgtgataggatctatataatactaaattttcacatttccttccaattaaatttttccttattagcaaacaccctaattaatgctcatttataaatatttttatatattttatttattttatattggcggttccgaagaaaacatggatttcagcatagaaaagaaggacgaacaaaaaaatttgaggagaatttcataaaaacgcatttttctcatcggcatcgtttaaaaccgaaaaattttgatacgaatcttctaaagaaaaaaaaaattcaaattctccaagctg

SEQ ID NO: 5842 - DNA, 3486 bp, Heterodera glycines
caaagggaagggattaagcaaaaacaattaattaatcgattaaccatcaaaagacgtttatttgaacattgcttttaattgtgtttatttatccttttcagatcagcatcaatgcccccggggttggcccgcggcgggtgatcaatgcgttcagttgcaatttgtgccgactcgacgagaacacgcggaagacaaatgcgaaagtatgggggcacaattagtcgatgtaacggacggagaaggcgaattgaacgaggcgatggtggaggacctatcagaactgcttcaagtaatttagggaggggaatgagactgaaaatggctttttggaggaatcgctggaggcaggggtcaacgaactgatttgggtggtcggggcgggaaagtggcgatcggagtgggacgagtcgggggagagagtgcgcttcagccgcagagaggcgcaacagcagcggcaggagggggaggaggaggagggcatggagaatgtgttggcactacaaaggcgagtgaggggcggaggggacagcccaaaagggggccccgcagggagtcactttgaaatgtgagtcggaaggaattggcaatggcacaatgccgaacgcacttttcggtcagtgttctgctccatcctccctctgtgcaccctttcatttgccaactttggcccctttggcgccgtttgctgctctatgaacagtctctgctccccaaaggtttcgcttcccccccccccctcctccgtttcattcactttcttctcaatccgctgaaggtgcgcctctcctggaagagcagccgcgtccctcctatttcttcgaccccaattcctccgcctccaattcgtcctttctcagtttgccatgttccgcttcgggcgtgccctccccgacggtccgttggtttcgcaacggaggcgaagaggtcagctggcaattagcatttcgtacggttcggcaatttttgcctttctttcttcctcagattgacttccgcttctcctctttcattctctccgccggtgctttgctcgtccccgtttctcttctgtcccccgtttctccctcctccttccattgctccgtttccaattctttcggtattttcgacttttctttttctttcgacttttatttcttttcttttaggaacccttcgtggccattcgaccatcgttcggcccgcattcattgagccctttcaggagatgagattggatgcttatccgttgatggggcacggacgaagagcgggcggcacgcggttggaatgcaatgcaccggcacattacccaagtgggaaattgagagggggggagagggaagaaagagagggagagagagaaagaaagagaccgagagagcacgatgaaaacccaaaagagagagagagaatttaagaaaaaaagagaggggagggagagagaaagaaagatagctatagagcacgatgaaaacccaaaagagagagagagaatttaagaaaaaaaagagagagggggggggggagggagaggttatgaccaaaagttacaaaataacgaagaatggccgaaatttttgcctttttctattttaactagagttgtacgggaccgggaattttgagaaaaactgggatcgggacttctctggttgaaaaaccggtactttttggctggcaaaaccgggaaaaaccgggacttagatactcagttgtacgttttttcagtaccagtcccggtcccgtacaactctaatttttattttttgacgttgtatatttatcatccaacctttaaaacaaattatttgtgtaatgtcattcaatatttttgttcagtcatatttatttgtctgatttttgaatttgaaaatttttaagaaaataagtaaactttttacatcttttcctttctcgtcctttataaaaaaaatcttcaaaaaacggaaaaatttgaagggaatcgaaactcaaaaaccgagattctcgagcagtctattgctgaggaatggtaagcaaacaattaggaaagttacatcgtaagctaccgtatcaatgattacattttgattaaatactttttgttaaattttgtctccaaatattattatttaacaaccctttgtttgcttctgctattccctcacttcgtatgcctttgtttttctctttaaaatgcctttttcgatggcattttctttctttgccccctttttatttcccttctaaacaatctctcctctcattcagtgcttttccattgaaatgcttttcctcggggaatatttcttccccgacatttccttttcgacaaatttaatttgtcctgctcattcgtctttttgcttcttttatcctcctcgaaaaattcaattcatttcttctttttcactcaaaaattcatcccttcccctctctctccctcttccctcgttctctatctccctttttctctcttctcccctctctctccctcttccctctttctctatctccctttttctctcttctcccctctctctccctcttccctctttctctatctccctttttctctcttctcccctctctctccctcttccctctttctctatctccctttttctctcttctcccctctctaccctcttccctcttcatctctctccctttttctctctcttctcccctctctctctctccctctcccaattcccctcacttcccccccccccactgcaccaaattattcatatgcgagtgtcagtggtcctcatttcttcattttccatttccattgtttcggaaatgaatttttccagttggacgactcattgcatttgcagccggcggcatttccagctgagtaaccgccgcatcacttaacgcctcgctaattgcttcggtgttttcggcgcgagtgccgaatatttgcacattctttagcggcatttctgtagcactttctgtgccttcttagaacgcacccaaaagtgtgcttttccattttgcttttataataattattatttttggctttctttccctctctctcctctttctcttctcctcctttcccttctctcccatctccccattttattttcgctttttcttttctttgtgtttcattcttccaattccccccccccccctctttttccattaacccaatttccaaaagtgcatcggtagcaaaagcaatttaagaatcgccttatctccccccccccatctcttctgcttttttctctctcatttatttatttttttaatttacttttaagctctcttttcccatttttcaattttttttcttttattactttaaatgcttttccatttggctgttctcacattttgttttgtgtcctcaggcaatgggtaatttcggcggttcattcgctgagtgaatcccgtccgtaagcaaactaatgaatgatccctcctcagactaacataagtcacctgctgctgtccgtccagtatcagcttctttttcttcacgtcaatctttcgctttac

SEQ ID NO: 5843 - DNA, 3384 bp, Heterodera glycines
caactgcatccaatcctcatctcattctcatcaattcacacctccatctcccttccactttcctccttctccgcctcttcttccatttcctcctcctcttcctcatgcgtcttccgtctgtccatttcatcgtcctccttcctcccctcccgcatccattttttcatctttctttcctatgcttctctatcagcggctcttcctcttccgcattcttccacaccactcccctccccccttccctcaccactcttcctttctcttcttttcccaatgaccgattacacaagtactcccccccctttccccccatttgcgcccatgggagggaacaaaacattcgcattccatcccaaaccggttcataatcaaagcccccccccccctcccattgcattcgctggttcgtctgcctattgcagcttcattccccatagcattctctcccccctcccctttcgttttgcttgtcttccctctccccatggcttttccccattcctcggcactttttctcccaaatttccccctttttcctctctttgtttatgtgtttgtttggtttcccatatttaaggtgttccatttctcaaaatgccacttttctcctcccttttgccattcccatggctttactttcgttccatgctccgaattcattccttttttagaaatgtgactgcaaaattgacttccgctcgacgatctctcctccccccctccgtcccttttcatttttcccatttctccttgggtaattattccgattggcacgtgtaccatatcaccaacacaaacggcacaactcacaaaatggcaccaaatgtactgatggacaaaggagggaagggcagagagagaaagagatttggaggtaagggaaactttgggtacacaaattgaattgatttagcactgattaagcgggtgataaactgatgaaaagtgaactggcaaaatgatcagaaggaacagaagaaacagcgccgactgatcagctaacaaaggctttttggaatgaatgatcaaacgccaatggctaccgttttggtgtcctaccgtaggagcgatcggtccatcgatgtgacctccttagtgattactgtactgtatcttcccctccttttgttcaccattttaccgcactcatcgcacttcaccaacacactgctcatttctcggcacggcactctgcactgatcagtaaagcatagagcaatactgtatactcactttacttttctaagcattatttttgtttctaagcaatcacccatttcgatcacttttgccgttagtcactcactttgatcactttgcttctgatcactcgatctgatcacttcacattttcacagtcactttttgtttgccatttttagtctatgtcactttttgcactttggtgctttggcgcacgtttgtccacacattctaatgctttacacatacacagttagcatgtcaaatgcagtgtttttttcactgttaacaataccgtaagcacatcgcattgctttacagtacccaccaattgcacaattttcacctcacttccctctcacttttcacattttgcattttttttttttgctcaccatcgcctctgcacaattaaatatcacattttgtaattttcacttttgaaccaaattttttgagtaccaaaatgacaatacagtaatcaaacgacgtattcatttgtgtccggaaaaattgaatcgaatttaaactttgaataaatgtgaaattttcaaaaaatcaaaaaaaacttggatgtaaaagtgaatgatgtgagggtttgaaactgacgagaatagggggggaggagtcactcattaagtaattgatgctaattaggaatgttagataattttttctcattgaacatttaattgctttcttagagtctttcgcattttcgtgggtacgcggcggaaactatgggaaatttgttgaagtttctacacgaatattcatttcaatggacggcactcttttcttctcgtataatgtgcgggaggatgaagacaggtgagaggcagcagaagcggagaaggaaacagctgatcagggtaactgatcagagcatggaaattgaccagagtaactgactgatcagacaaactgatagaagagactgataggaaaaatctgatcaaagcaatcgatcggacataatcagggcaactgatcagagcaactgataaagagattgaatatctgaacaaagcaattggtcagagtttcatctgaacaactgatagatgtgactgataagaatatctgatcaaagaaactgatcggaacattatcaggggacaattataacaaatgatcagatggtgatcattgtggcagatgaacaattagaggcaatagacaattagcagattaactgttagtatcaactgatctgcagaccattatttcttattcctgatcatggtattctgccatttgtcaatttgttttttcaaaatgcttttcctttgacttttcccagtttcgcgtgcactttgtccctcccggccactcagtccgcccaactcggccccttttttcgtctgctgcttccgctcggccacatcagtccaaatttgcaattgcctcgcggcaaaacacttcaccaccatcctcatgcgttcgccccgcgaattgacgagtttcaaccccaaatattcccggaaatgccaacacgtggtgacactgtgtttttggagtgttttgcctacggattgtatgttttagaataattgttttaaaggattaaaataaataaaaataatttataaataaaacgccatttacgcaccgtttcattcagtcccgtgccgacttatcactggtcacgtgtcgatggttatcctttgccccgtttccgccatcgtttgctcagttttggtcgcgttctccgcctcgaccgtgccgaaattggcgactcgggccgttaccgatgctccgtacagaaccgacttggcatggacagtgccgagattcggctgaccattcattgttggttcaccagtgcctcttcgtccgcttcttcaaatccattttcagcgcctccggtgctccttcgtccgctcattagccaaatggtcgcccccggtcagttgacaaattgcaaattggtttcttattacggggcgttaatccatccaatgataaatgattatttgatttgctcaggccactccatcaccttcaaatgtccaattgccgatggtgtcggaatggtttctcaggttgaatggtttctcaacggagtgccattggtgccgttgttgatggaccaaagtgatcggcaaagattcaaaatggcatctgatggacatgagtatgtccattcaaatgtgactaaacggggtccctccccgtttg

SEQ ID NO: 5844 - DNA, 2399 bp, Heterodera glycines
catcggcagatgttttcggggtcgccttacatctcttgccttcaattttgcttttccttttccaaggaatgggaagagaatacacagttcgttgtccgtggacaaaaccttcaaatacttcgatgggcaattggaaaatccgcacgaaatcgcccaaatcaagggcaatggaccgaaaaaccgtcccaacatcaccctcacagacttcaccttccacctgcgcaattggtccttcgacacctcgtgctctcataacagggtgccggtggacatccataatttgttgtgagggcggtcattattgttgtaggcatttttcaattcccatcgccgaaggctccattgtgcaatatttatgggatctaatagcctgattctcccctgcagttttcatttgttataatcttctaggaatttcaaaaaaaaaactaacttttctttattaaggatattatagccttccctctcccccccccccaatccccacagtggtttttggcatttaacccattgtttgccattcttcccaggccatgtcggcagattcgcgtgtcattcgctgttcggcggtgccactgccgagttgcgtcctcagttttcttcgttggcaatttcagtggatgagattggcacttcggaagcgaaaatcagctggcgattattgggaaaaggcacaaaaaatggggagaaaaacgcgcaaaagcgacgacggttttatgggaataaagtgagaaaataattaaaaattaaaaagaaaagtattctcaatttatttgtcctgcattcttaaaagacttttaaatttcattttcagtcagaatttgcccaaaatcacaatgtttttgtcttggaaattcgggcaaaaagagagcgaagttggcgcactgtgaaggaattgcgaatgacgtcgacggaccgtccgaattgggcggggcactttcgcatggacggattggaggcgaacgaacgctatcaggtgaattttgccaaaacggactttgatttggtaatggaatggtcgctccagttccgattgcgacccttcggcgaaggatcgcgtgccgtcgccctttcgcaatgggtgcgcacggagcaatcggtgcccgtggaagcagtccggcacattcgcttccgaatgttggacgacacgcatgtgctgctcgagtgggagccggtggagaaggtcgtgctgctatccttggcataaaacaatgccatccttcgacagaatcatcagtcggcgcccgatttacgatacaatgtcacatggaacacttttgggatggcggagggacaaagcgatggcaaaatgcaaagtcgggcggttaatgagccgcgtctggtcatttcccttccggcacaattgggcggagcaaaaagggcggaatgtgccgttttggaagttggggtgagggcagagaatgaacgtggcccgagcaaagagagaacggacacaatgatacgaacatcgtcaaaaggtgggtggggccaactgaagaaattagttaattggataattagagtctaattaggacaagattgaatatgttaattaaggaggcaattggcaatagactaatttattttctgttttagaacctcaaaggtacgcagtcgacctgcgcttggacagtgtcaacgcaacgcatttgaatttgagttggaattggcaaaatgttgacccatgtgagaatgcattaggagcgaaagtgagagttaattaataatggttgaatgggaaatggagaaagaaagttcagataatgtgcgagcaaatcgaagagggcaaagggaacagaaggaacggagggtgggtgccttttatgccttttatgccttcgtttttcgcttaaatgccaaatgcgagtgtccgtttcagtcccaattcgactctctttcgaaatgattcggcgtctgtctctgctccgccctttcagtccgtcccttcccattattcccattggctcgtccattcgctcctccctctgcgcgaatacgaatgtcgcgtggctgcgtttgaccaattcggtcggatgggcccaattcgcaccgacggagtgagagcaaagacaaaagagagagcgcccgaggggaaggccgaaattaattcaatgaaagtgggagaaaaggtagggaaagggaaaatgccgaaaaggggagacaaaggcaatggcattttggggcaacggaacgtacgcacttttggtggattggaaggcggtggaactgacaatgagactgacggagggagaagcagaaggaggaggaggaggaggagaagtgaaagaggtggaagcaatgccatcaaaagaggaggaacggtcatgggacagagggtacaaagtgagcggaagaaagaagaaaagggcgggagaagggggaagagaagggaagagagt

SEQ ID NO: 5845 - DNA, 1381 bp, Heterodera glycines
ggacaaaagcatagaggagaagaggatgaaaagaagggcaaaaggaaggggaggggggaggcagaagaagccgcccgattttggggctttgtaatttgggaacccgacatttggtgactcttttaaaagcaaattgcgcctacaaaaaattgtccaattttggcaaatatatgataataaattaaaatcatttttttgattgatatttgtccgattttttaaataagaaaatccctaaatgtcattttgtcctcaatttgtttctcatatttttcttttttgtttagctttttgtgtacgtatctgaaactgctgaccaggtgtttttccattgcaaataaatcattcggcaaatgccaccgttccgttcattttcagcccattctcctgaggttggcagaagcggagctgaacgacccacaaagaccgtccgcacgaattgatggccttcggccgatgtttttgtacacaattcaggtgataagtcaacataatgtggactgattgacgagagattaacggtttaagagaaattgaatgattaattggacaattattaattcgaattggcctaattagtcactcccccaatgattgccataataatagtccattcatcgtttttccttcccgtcagatcgccgcattcaatcccggcggcgttggtccgttcagtgagcgcatcccggtcagaatcggtgcgagactcaagcagaacccggatttggtggctgagatggagggcagcggcgcgacgccaaacggcaaaatgcggcgatcgctggcgggagaagcgctaatgcgatcgctgatcacaacggccttactcatcaaattgtgtcgttggcattggaggcggtgaccaccgatcgacgaaatgagcagcgatcgcgaagaaaagagatcaaaagatggctaatcactttttatgcaatcacttcatttcaaattcattaatatttttttgtttatttactgacaaaaaatcaaataattaattatttcgatgggaagcgacggttttggtgaagtgatcaacggcggcttattcccaaactaatttcttgagaaggccaaaaaactaatgggtaaatgagttgccctgtgggagaatgactgatgggcgaaggcgacgtgtaaagcggagatttggataaggcggaaagtgatcagagagagagagagagagagggaaaaggcaacaatctgacaactcctctgctggtgttgatcactactgttgctgctgatcgacttatccgacagctccgtcctccctccgcgctgtcgcgcccgccgtttgcgtcgtctgtcggtgtgacatgtctctcccccctcccacctccccttttccctccgtttcgcctttccccccttccca

SEQ ID NO: 5846 - DNA, 2516 bp, Heterodera glycines
ctaaaaaggggtcaatggtaaagaatttattttttcgctaaaataaatggtttttttctaaaaaaataacaaaaaattcattttgctatttttatgtgattttcttttaaatttattgaaaattatcatcagcaagacctattgggaaaaatttaaaaaaacctaatgattttccaattgctttttctggcattttttggagcaatcaatgataaaacaataaaaaaaaacgccaaattttccaatttgcccactcactctgaatgaccctcggagcactgagttggccgtgtagtcgtcgtacagtcgtgtctgaatggcctccaaccggtgaatttggtcgtccgcactggccaactttttcttgtcgtccaccgtgtgttcggcctaaaaatatttttttaaaccaaaaaaatttttgtacggggaggagacttagacgggatgggggtgtaatgtacgggtgggggacaactaggcctcaagcccgtcgtatacggcgtataactcttttcaatagttgtcccccgtgaaaaaaaaattttttttttgtttgttaactttggatagaaactccagccaggctcataaaaaatttaattgtaagctaaaatcccagaacctgggcctagcaaaaacaaagcatagtccagccagactctaactttttttttttcaaaattccactccatccaaaccaaccttgaacattgcatcggcacccaatttcaaactcattgttcggtccaccggtgccaaattgtcaattgtggacggatcaaagcgaatttcctgacgacgaacgccctccaccaattcatagtcaaaattctgggaaaaaaagttgaaattaatagtcttttaagttttgatataatttttaatatcaaaaaaaaaattgccaaaatagattgggcaccattaactttttacctttgggtctgtccgaatggtgaaatagttgtcacacaaatggcacttcatccggaactcgtagattggtgttgtgtaatacctaacaaaaatggaaagccattattataaaaaaaaactgtaaaaaagcagaggttttcattttttgaaagctccttcataacagtcccacccctctcccctaaacaaacaaaaaaaaaattttttttagagggcttacttaacatttttttttcaaaaagatttactttttaatatgaaaatcaatctaaaccttaggaatacatcaaaactcaagtaattttactttactaacccttaaatatcctctaattgtaagagatttggtcatttttttagcccctaaccctttcgtcgaaaattgggaaaaaaattttttgttttgttccgcttacatgccaactttgcgcttctccgcgttgtagcgcacgctcatgccgacatggttgttgcagccgaggcaccacacattgaacggcatctcaaagctaaaaggttggaaaaaattttctaaattttttccaggtataaaattgtgtccgcgtcttaccgaatggtgaggatgccttcatttgcacgcttgccacgctcgcgcagtgcatgcacgccatggtaacggttaagcgttttgtgcgtttgataattgaagtcgggtgggtaataatgattttgtcccttgcgttcacccattttttttttcaaaaaatcagtctaaaaatagaaattttaatgattgattgacaagaaattaaccaaagataaataaaataatgtgttagtgaagcttttatgttaaaggcaagagctgtggttgtggcttaactaaatttttcattaatataatttcgtaattaaaataaataacgccaaaatttgtaaatttaaaaactataaaggcaaaaattaatcaagttttgagtagagttgctcggtaatcggtaattgcaaaaaaaccggtaccggtactgaccggtactgcaaaaaccggtaccggtaccggtaccaactttttccaccggtaccggtaccggtaccggtaaaaaccggtaattttccaacgtaaaaatttttggacaaaattttccaaatacaaaatttttattcagttttcgcgcgagtacctgttttttagcattagaattgttcagaagtatatgtatattcaggttgaccaagttttttttttcaaattcaggacatagaacactaaaattcagatatagacctcaaaattcagattattgcaaaacaaggggtcagcagccaattttctaattttgcgaagggtctccggccatgtaaattaatgtaaatcaatgaccttttttgctttcaacaccgcttttttcgcggcacgtttttctcaagacttttggggaacaaggagggccggcggtgccgataggcgccgccgggaaaaattttgtaatttttaatgcgatttgttaacagaatttgtaaaaaaaatgaccaattgattaagttttgggtttttaggatgcttaacatgaaagaaaaaagttggaatattctttaaaattaaaattttaattaaaataatg

SEQ ID NO: 5847 - DNA, 1237 bp, Heterodera glycines
  misc_feature (26)..(26): n is a, c, g, or t
  misc_feature (29)..(29): n is a, c, g, or t
  misc_feature (61)..(61): n is a, c, g, or t
  misc_feature (136)..(136): n is a, c, g, or t
tcatcatccccgaaaatatactgccncanccatgttgatgcgccacatttttcctgagttngaaagcattttaatgtccgaattttttttggcacctcagccagcgaagtgcggcattccgttgcaccacaccctnttgggtatttccagtgcgggtcgtccaaccgcagtcgccattttgcaggtgtttcagcgcacacatggacagcataaatgccaagccgtgcaaccaattggtcaatgaatgctgagggagtcggtgaatccggaaatttaataattttcagatttttttttgaaatcttcggcacaaaagggtgataattatttttctaattttggttttttgtttgtttgggttaggaattcggaaaaaaaatcccgaattatgagggaccgaccacattggatttttaataattttcgaaatttcgccatttgcaaatagcgcgaaaattttccgcggcaaaaaatggcaattttcaaatgccacggcaaataaaattgtttttttttggcagtttgtgggctgctgaactttctcttaggtcattttcttaatctaactcaaaatcggtctatttttcgactcgggcgccgatttcccaaaaattcgcattaaaaccaaaaaatatgcacctcaacaagtaaccagaccaagttgggcaccgcggcaagtgtttggccaagtcgggtgaggtcggctttctgttccgggcgtcgaacggatggagtgacgaaaaaaattggagggggcctcgaccgttcaacaaaaaaatttggccgccactttttgttttcgtttagggaattgccaatttccgatgggcattggcatgacggcgtaaaagaaatgttataaaatgtgaaaaatgccagtaaaagtaggacaaagaggaagaggcgaagcaggacgaattttgtgaacaatcttcgaagaattcgactcattcaatcagcaaaaaacaacttcagcaggaagaaaggcattaagcaaatggtcgccctaataatcatatttttttctaaaaattatgtttatccctgatgaaatttatattttctgacataatatattgtattgtgaacattaaaaaaacactttatttttaagagctttttgtccgtgcgtgcctagtcaaaaaaacataatgccaaatttttggctcttttctctaaattcaaaatttcattgaggtcccaaacggtgaattggaagctgtggttactgtagtaa

SEQ ID NO: 5848 - DNA, 3777 bp, Heterodera glycines
tttttatgtttttataagtcgctctaaatcaaaaattgttcggagaaaattgtaaaaaaaaatatgtaaaaacataaaatccgatctatattaataaaaatgaaaaaagaaagtttttgaaaagagaaaaaaattaaaaataaaacaagaaaaattgcataaagaaagaatttttgattatttaaacacaaccgaggcaatgaaagttaaatttaatattttttctcgataaaaaatttcatatttaaaaattttccttattcgaaaaagctataaaatattttaatattcattaaataaacaaaaatgagttttttttgattagattttacgtgttttcctctctaaaaatcctttaaaaaaatttttaaatgcctttttcggaattttcgtgcgtttttttcaattttttggtgcctattatagtgcctttttcgcgattttggtgcctttttagacggtctctaatcattaataccattatttttagaatatgttaagcattgagccgcaaaagcgaatgactgccaaaggaatcattgactatttggaggggaaatgtaagccaaaggaatatgagaaaaacgcagaaaaaatggcattgtttggcgatgtgtcggctgaaaaattgagggaattgatggaaaaggaaggatttaagcgaacaacaatgaaaaaagtcaagaataatttaaaaagtgccgaagaaaatacaaaaatatttatgcaacagttggaagaacgaagcgaattttgtgagaattaatcgccgtcctttgggtcaattgaaagagaaacggcacaacaaacggaccaattaatttaatattgcaaatttcagtttcaatttggcaaaattttccaattttgtcattttctaatttattgacttgggtggtcatcccattccctaatccctttcgtcttttttctgagagcaactcgctcaaattatcctttcgaatcgtaagtagagttgcacggtaatcggtaattgtaaaaaaaccggtaccagtactgaccggtaatgcaaaaaccggtaccggtaccggtaccaactttttccaccggtaccggtaaaaaccggtaattttccaacgtaaaaactgaagatcggagaacaccaaacattgctcaattccatttttgataggcatattggattcctttgatacacaaaaagctaaaaattatcattttccttccccattttgttaaaatattgttacttttaatatttttcatcaaataaacctttcgaacacaaattaccaactaagaattatgtttgattagatttgatcagttgggaataaaaagatttttgaatttggcgccctcgtttcaatactcatttttttttataatgttaggcaatttttgtcaaaatgatgatatatgtatgcactttaaaatagttagtaaaaataataaaaaattgttaaacccacgcggactcgaaccatcagtcaccacttcgccatcgtgcaccacttgaccaccatcacagaagtgaaaacacagccaaatgttcgatttttgaggccccataacttttttgttttcgctatcggccagtaaaattaaaaattcacaatagaaatcgaccctcctctatccagtggtatatcacacatatgcattttccgactaacagctcgcgaggttcccttgttaaacatttaggccccattaaacttccctaatgtgaagaatttatcatctctatctcacgccaaaatataaaaaataaaattgttaattaatttttaaaataaaattgccacaaaatgtaataattattttgtcaatcacattaattaatgcgcagcatttgcacacatcaatcaactcgtaatgtcgtccgacattattgtcacgacgcttgttccattactttgtgtcacactttcactgctttccttctgctgctgctgttgttgatgctttgtccgttgatgcattgtccccctgcttttcaacatgttcacaatgtcgtgcatttgttgcccacgcgtttcgggcaaaaacagccacaacggcaccaagcagcacaatgatggcacaatgtacagcgggacgaatgcccacgcgctggctttgcgaaagattagcggtgttgcccaacttaagggattggcaaacaaatgaatgaatgaatgattaaaaagggggggggggattggaattcccattttttagtgccatgaattcttgtaatttttacgacggggtatagtaaatacggcatttcgatgccaaagatgataattttgagaatttttgaaaaaatctaagggctaaccaatattcagagatatggataggcgccctaccctggttaaaatatgtcgtaatttgttaaaaattgatagaaattgaaaaaatatcccattttctttatcaaaaaaaaaaatttgttggcctaaggcgaagtccgtactcagtccagcaattagcaaactgactcaaaaatgtatgtgctaataatgttagcagcgaacaccagtgagataagccaggacgaatgtggcgacggatggggaagcagttcggcgcaaataaaataggacaaagggccaagggcaaagctaaaaacgaaaatttaaaattttccgacagttttttttttgccgaccccaatgaaatggcgaacagaaaaatgcatggaaggcacagccaacccaaccaaatggccaagtgttttgaggcccaatgggaagcaatgtacagacataggaagccgatgttgagcatcgcggaacgaataatcagcggacgacggttgagcctagcgaggggggggggagggggtagattttttaaaattttcctaaaaaattaaaaaaaaaattaaatcatgtacttcaagatccactattttggagatttattttgacattttgggtatgcatggccatgattttttttggccaagaccatgggccataaaaacaggaaaattgaaaatttcgttcctcattaaaccaaccgagtttatttttttagaaataattttcggattcgcccaatttctgctgaatttatagaatgattaaaatataatcataattttttacatttccacaaaaaataggccggtgagtgaagaaagaaaatagacagccaccagcacataggaaattggctaaaaaaaattggaaaaaatttagtttgacaggacaattacgacggtatggtacttcaacaacagaaatgctgaaatgttcggaaagtatttcagtggacgactcgagcacgggccaaccaccgacagtgatctgtgggggaaaaaaagaatacaaattaaaaattcacaaactaagaattttacaaaaaaaaaaattatagaaaaaaaattttgtaagaaaatttcataaaaaaaatttgaaattttctagcgaattttttttcaaatttttatgatgaatgactaagtttttaaaaaatttccaaaaaaattgctgaaaattttcaaaaaatttcatgccactgatcaaagaagttggaacccaatgtgttttttaatgcattctttaggatttcttagtataaaattcttagtacaatatgatcattgatcactaattggagacaaaacatttgatcagagggcaattttttagcaaaaagcaaaaaaataaattccgatcactagtgatcggaacaaatgtctatcatcctgatcatttaaatcgtgcctgaagtgtgcagaagccgatcagcacagcttttcggcgttcactccgtgcaaacaattgacccaaaattcctcca

SEQ ID NO: 5849 - DNA, 3572 bp, Heterodera glycines
tttcaaaaaatttgatcaagtttgaaaaaaagttatggacgaaataatttttttttacgatttttagtcataacttatttcgaaaagcaataaaattttctttcatcagtatgtagatagagaacattaagggctatgaatgatcccaagaatgtttaatttggtcaattttaacaaaagttaagacgatttttttgtctaaaaacagtacgagttgggcagtacgagtggtccctgaaaatacgaaactggaaaatgcgacaccgagagaaagttttcacaaagaaaatacgacaccaaacttagatttttaaaaatataaatttatatatttttttcaattaaagtctggaaatgagcatcagtacctaaaaagacttgttaagtgtggataacaccactgattattaaacgtgaaaaattggcaaaataaattagtataaaattggtagctgctcttcctccaccttccattattattttccatttgccatttacccattggttttcgtctctttttgttcgactttatctccctgacaattccttcaaaaaatgattctgtacgttttgtagatttcttcacaattttacctttttgaatttcccattttttagtctgttcgttgtgccaatgtttgttgggtgttgtgacattctttggagttattgggaccgcctcaaaaaaccaaaaaagaaaatgtaaaaacatttggccattcacacgaacaataaacacattttggtgatgattttgcacaacatttggccaatgaccgaaaaaaacattcgtgggatgcgattgtgtgcggatactttctaccatttgcgacagttggccccgtcaattctcaacgattgtccattgttacgcgttatcaatttccaagtcaccgatctcttcacagaatttcctgcagatgacagtgccatggcatcggatggacaagcggtggccaaatggcttttcactccacgttcggacaatgtgccaaaggtggttgatctgctcgtttgacacagatgttgggaatttggcagtgcgaattgaagccttcaaaacggtaattttcaatgatcatttggctcttttacattgtttgggttcgtacattgatttcgacctagtcgaaccccgaacctgggttcgaagaaaaaacggaaacactaatttcgcatttttggtcttaaaatcattactgttgtaaacttttgctttttcgtgccatcccgccaaccgaaaagtgtcattcattcattgatcatttcgtattttcttaatcaatttttccaaattttaggcatttgcctcggcttcttctcccgtcaatttcttgtcgtcatttgggttttcccgccgtctttggccgactccgttttgccatttgatcagacgaacgaattgactcgggaacatttggcattgaaaagaagcgttaatagagacgactgttttctgttggtccgttgtccaattacgcgaaatgaaagcaaatggacaaaatgggaagaagaaacgattggaggggacttttttgatcagtggaatcgaattgacattaatatttgggaggacgaaatcggagatgggtaagcaaacgctttttcaaaaattcaattttattatgtatttttgttttaagccttctcgacgcaactcccggcccaaatgatcagcagcagtagtgaatgaatgaattgttgagaagtgatcgatcaatatgaattattgaattggaaattgtcgtgctcattaaatattctttttttgtgatcaacatggatttgtaatgcgtatgtcttaaggataaatttaatgatttccttaaaccgaaatccatcggtaaaatcaaagtaaaattgaaaaagtgcactgaaattgtgcagttttgaacgcattggtcaccaccaattttcctaaacaaagcaagccaacaatttcacctatttgagggaatgggtcgtttcggcgccaagccaaaattaaaaaatcatgaatcagtgggaaatttttgagcgatttaaattttcaaaaaattaaaaattttaataaaaattgtagaacaacaacaataaactaacaaaagaaaatttaacaaaaatattcgccttgcgcttatgaatcaacggaaactgtgccatttcaattgatgaacgatcggaccaacgaaaagctgaccttgaagaaaaaaggcgatcatggaaataccggtgttgattggctaatgaagcgatgccaaattggggagacaaaggccgcgttaaacgaaaattcggcaatttgaataatatcagctttacgttttatggaaaatgcattgggtgagtggcaacagcttttgctgctttaataatgaaattaaaattgcgcttaatttaggccattgtctccaccggcagaagaagaaaaagcgggacaaagcgtcgaaaaaggggccccttctgacaaatgagtgacggacaaaagaacaacaacaaaaacaacagtgatcagcagaagaaatgaattaattccagaaataaaagatcataatatattatgatgaaaggacttttttccaaaattagattttatccaaaaattgaaattttaaagcaaattttttcaagaaattttttcggcgcgctttttccaaaaaacttttggtaaagaagggggtccggcggtgccgataggcgccaccgggaaaatttttttgcatttttaatgcgatttgttaacagatttttgtccaaaaatgactaaattttatattttttgacaaattttcaccaaaaaatgaccaattttatgcttttcagcaaaatttttaatgaaagggaaaaacgtaaaaatttggaattttttttaaaaacccgcaaaatttttcgatttttctaccccctcttctcttacgatcgacaattttcctcacaaatttatgacacctatttcgacaaatttcgaacctctgacccggattcgaacaaaaattctaaaattcaattttacaaaaaaaattcaaaatatgaaaaaatcagttcaaatacatggaatactatatcttgccttatgaatcgattttcctttttatttcatgcatcattttgcatgttttgaaaagtttttctgcgtaaaagtcccacaaatccaaacaattaattacctaaatgtatttaaacaaaagaagaaacaaataaataaatatgtgaggcaattactcgatcaatttccattcctaatgatcaattatttctcctttcccacttattcatccattcatttcttctgctctccgctgggcccgggattcattttcagacgattttttgcattcttttgtcccgaatttggtggagacaatggcataaattaaataaattattttaaacaaaagaaaatggagttgccactcatccaaattgataatgaagatgaaatctgccattgttcaaattgttcgcctttccattctcccactgaatagccatcgtttgcccaattttgcatggtgtcattatccattttctgtcccatttatcttcgctatcgagggccaatgtcagcttttcgttggtccgttcattcacca

SEQ ID NO: 5850 - DNA, 3566 bp, Heterodera glycines
  misc_feature (3509)..(3509): n is a, c, g, or t
aaataatttcgatttcgcctaaaaatctgattcttggggagtaaatgagtgtatttttgaaaacatgaaaaatatatgcagatcattaggcggttcatttttcatttttactgaatttttgttaagaaattttcagaaacaccaaattacgcacaataatatgttcaattaagcgtacaaattaaatgttcgtattaagcacaaaaatctcgttagagcaaaattaagcaagaaaatttacgctagaggcaccaaaccaagttagaaattcgttttcggatcaattagttagtccaaatttgcaaaaaaaatataataaaattggtccctatttattgacgatataagtaaatacgattatacagacgattcgtatttttatgacagtttaactgaagaatttaagcccattttagccctgtcaaaatgaccgggcccgagtggccggccaaaaatagcccgttttactgcgtggcccgggcaataatttataataaatgaaataatcttgaaatatatttgaaaaaaaaatccaattttcactttaaatttccgcggctactgttttgaatttcaagtttatctcggttgtttattagggctaacaacctttgtttcccatggcattcaaacccgcatgatcaccgtgatactcgaatttaactaaagtgccagcgatgagttattctcccccgcaccctctcacaaacaacgcgtgtttcctcccgcctcccccggcatattttaattttttttttttgtatttttaattaggtctccaaatctctcactactgccaattctcattgactctgcatgctctctgtctgttatttggttttctgatcatctttctcgttcctctctctcacccactctctctcatctctctctcccttcagatcatttggtcaatccaaaaaccggtgctgaaatgggtcggacaattttttaaattaagccgataattagtattttatgattaaaaaatagtctcgttttcttcccatcgaaaactaaaaaatttaaaaattgttcaaataacacaaactattattctcccacttccccatttctgccgaaataaaaagtgaatggaaggccaaaagccagaaacaaaaagctagcagcgaaccgaggcagagctgctgctagcgattcccaaattacgtatcttttttcaatggagcacaattttgctctaggagccaaagttcacttttttcgctgtttgtttaaccattggtgagtgttaagccccgagatattctttgcttctctgcactcactcgttcgtgccacacactttttttgtgtttctctgaggcggacggaggaatggatgttccgcagtagaattttgcccgcggctggcgctaaatgaggtctcgactgactcaatcttcggcacacatagcatacacataatgtttgccattccttccctcgctacctctccttttttgtggtggtatcacagtgttggtgaagaaaaaaggcgaagagttttaattattttttttcgaaaatgcaaaaaaaaatcttaaattttattaatgaataaataatttcgatttcgcctaaaaatctgattcttggggagtaaatgagtgtatttttgaaaacatgaaaaatatatgcagatcattaggcggttcatttttcatttttactgaatttttgttaagaaattttcagaaacaccaaattacgcacaataatatgttcaattaagcgtacaaattaaatgttcgtattaagcacaaaaatctcgttagagcaaaattaagcaagaaaatttacgctagaggcaccaaaccaagttagaaattcgttttcggatcaattagttagtccaaatttgcaaaaaaaatataataaaattggtccctatttattgacgatataagtaaatacgattatacagacgattcgtatttttatgacagtttaactgaagaatttaagcccattttagccctgtcaaaatgaccgggcccgagcggccggccaaaaatagcccgttttactgcgtggcccgggcccccgtgttttttcaacatttaccgggcctgagttgccggcaaaagccctgccggcaccctaacccccgggctcgaattcttactaagatttgaattttatttgcatttttgttaaacattttcctgaaaataggtataaaaaatgtggacaggtacaaataaaggtactttactagatcggactgtatcagtattatggatggtttggcagatcaggatcccgaccccgattggtcgcgaatctcgactttttggatctcggcttcagtttttaaaataattcaaatactatcccctatttttgcaatcccagcaagattgaaaatgaacactggtatgaatttttaattttgaaataaattttttggttgtatattgtattttaagtttaatcaaatattgatttttttttttgttggaattttacagtgttttagatttaatttttgtcagtttttagtccatatttcggggcaactttagtcaatattttatgtccatatttgacgttttttagtccatataatttcaagccctagttatcaactaaatttattgccagattattttgcccacagacattgtctaatactgaaaaggcaaggtgtgaaaaaattgcgatttaacaaaaaaagaatggcggcacaaatttgactgtccctgacggcgaaagtgttgtgcagacagactgttaattacttagaatccttaaaacttttccgaataaaggtcaaaaaccgggattttaacttcttatcccctcccgatacgattcctaaatcactatcaagacaataacaaattaaaataggaattttttagatttaattttaaagaatcaaaagaaataatttaaaataaatgaaataatcttgaaatatatttgaaaaaaaatccaattttcactttaaatttccgcggctactgttttgaatttcaagtttatctcggttgtttattagggctaacaacctttgtttcccatggcattcaaacccgcatgatcaccgtgatactcgaatttaactaaagtgccagcgatgagttattctcccccgcaccctctcacaaacaacgcgtgtttcctcccgcctcccccggcatattttaatttttttttttgtatttttaattaggtctccaaatctctcactactgccaattctcattgactctgcatgctctctgtctgttatttggttttctgatcatctttctcgttcctctctctcacccactctctctcatctctctctcccttcagatcatttggtcaatccaaaaaccggtgctgaaatgggtcggacaattttttaaattaagccgataattagtattttatgattaaaaaatagtctcgttttcttcccatcgaaaactaaaaaatttaaaaattgtcgaataacacaaactattattctcccacttccccatttctggcgaaataaaaagtgatgggaggcncaaaagcagaaacaaaaagctagcagcgaaccgaggcagagctgctgctagcgattc

SEQ ID NO: 5851 - DNA, 1382 bp, Heterodera glycines
ttcagatcatttgtcaatccaaaaaccggtgctgaatgggtcgacaattttttaaataagccgataatttgctcaaaaaaatccccgatcgcctattttttaagggcgtcttctcttcgaacgtcgatgtcgaaaatttatttccgaccactaaataattaaaatagccactaatttagctttcaattcaaaaatttatttcttcactctctatggcctcccttctgaacacctcctgttgtctggtaaaatagagaaaatgattttttaatttaattttatttttttgcagttattcatcaacatcattctcattggacgtgtattggcatcagcacaaagtgaaccgggcgaaaatgagtggttcagcaatgatgtaattgttttatgaaaaaaggcgtggggcggtgggggagggggcaagtttaactgatttgactaagtttaacctaaattaggacttattatttaggaataaaaataaattaaatttaaatatttctatcattgatactttgaaaatcgcccacattaatacacgtgtaacttcgtcacatagatatttttttaagttcggctcaccacgattttgaacgtgttgcttttcagctcgttttatagcgtagtcggttgaatcccggcatggttttggcacttctttccctgcactttttaagcctgaaaaggcaatttgagtttgataactatgatcattataagagattaaacggacgcaaacaatctttcttttaatttttctccaaaacaggttcaaggcttcttaagcatattatcacgtaaaaaaatttcttttacattttcgaattcttttcatcaatcgagaaaaaaaaattaatattccattgaacttgaagtccatgtccattagtgttatcttactccggttttatgcctttttcaaaataccattctatttccttcaattatataacattttagacaaacatgctggacaagagcgcatttactctacatgccgcagctacaggatcggtcgataatgatttggtaggtttgccatttttcgcattcatgtcaaacgacattgttacgcctgaaagtccaaataagaataaaagaatatttattcaaaaaattgacaaggcgaacagagtcaaatatcgattgggaacaaaaggggatgaaataaattaaaccgatacattcggcattgacttcatccaatgctccatgaggaataggccgagccttgcagtagatcggtttattggcttcattagtagatcggcttattggcttcattagcaccaaactgacgataagtgaaagatttggaaacatcagctcctttgtgatgatttacagttcttcgatccaaggcatgccgagcaaatcctgat

SEQ ID NO: 5852 - DNA, 5442 bp, Heterodera glycines
atcgggaagaacccgactggtcagaaacatggacagccaacactctggtcctccaatctaacaaccattgtgatgattgatcaaggcagaaagccgtaggtcaatcgccaaatggacacctccaaaaactgatcggacaattggtcgaatcaaaactaattatgatcgggacacgcggtccattccaaaatgggaccatatgatttgattgaatatttgcagcttgagacaaaaagcggggcccgccccgccggtgtttcccccgtccgattaccgtaccgaataaacccccgctgcccatcgccccatttttggggtacggcgcgattatttccccggcgggggacaaaggccccccccactttccccacaattttcgcataaattgctccgcactcggctggaaaaaatggaagagaaactgaaggacaacaataaaaacgaggggaaaaagcgaaatttatgggcaaaaccaaaaacccctcgggcgatggacggacggacgaaagcatccatcggtcagccgttttttgaatcgaatcgcccgaggggaaaagttgtggcggacggacggacggattgatggcggtgggaaatgaacacggattttgaaagggaaaagtgaacggaaaaaatttgggaatggagaatttgagttattgcaattaatttaaagcaattaaaataaaataaattaattaccaattatggtcagtcgctaaaagtccttttaatgtgtaattaattaattttatttaattcataaaaaatataatttaaaatcataagaaaaatattttgattgttcaaatattttattttttgactattcatcgctaggctccaattttagttgctaaaaactgccaaaatagttagttttttaggttttaaaaaacccaaaaaataaaaaaataggtttaaaaaccaaaaattggagcccattcatctctagacatttaacattatataataagagttttatgagtttagccaacaataaaaaaatgaatttaatcgccgcccattaccatcttaattaataactgactcattctcagtctcctcttgctgctttgctctgattagccttatttggcccattttcagaacacttccagcaacagatggccgccgcgaccgcaatgcaatcgcaacaacaacagcagcagcaacagcagcaacttgctcaacaggcgaccaccgcggcggccgcgttgcggggcgaccgcgcgagtgcggcggcgattgctgccggcgcatacggtggagtggcggtgagcggcggctatggtggcgcgacgacaagcggcgcattcggcgccgggagcagtggtgccaatgtgaacggaccgccaatggcgacggcgaacgtagtcagtgagggaccatggcacaccttctcatgttcctccccttgtcgagattataattcaaattcattccattttgccaattttaggtcggccaaatggccatcggcaattccgcgctgtcccagctgaacttcttccagcggtccttccagcagcggtttggcaccgatgggctcggcaacggcatgcaaaacggcgtgagcggcactagcggaagggggtcagcaggaaaatgaatgcggaatttgaaacgagacagctgcacacgctaactcataaaacttttggggagatggacatggaaagactcggacttttaccactaattaacggggggtttaagattatatccccatttcaattttttcaaaaatgccgttagtgggattcccataaaacggtgttatattcccggcattgcttgtccccccccctaaatattcctacaattcaattaggtaatttagcagtttatttgtgtgtgttcgtgccacttgatcaattaatgagcactctgatgggtcgttctgttgcttttcagtttcaacatgatcactccgttggaatcaatcaaacacttcagccagaacagccagcagcaacagcagcagccgaacagttcgggcagtacaacagcctccggcaatttctgagtgtcgccggggggcaacactttgcctgaggcaaagtttaagagacgggaaacgaaaatgccaatggaaaatggcaaaaaaaaaaaaaaaagtaaacgacaaaaaaaatgagcagccaaattgtgggccgatctctccgccaatgttaaaaaaaaaaactaccgcactcttcgccatcagctgatgatggacaattgctactgtaatatgtacaaaataagtgaatttatttgcgagaaatttttgagttggaattattagtgaaattttatttaaaaaataattattttttataaattaataaaattaaaccaaaaaatttctctccttttccgtcccttttttattaacaaaatattgtccatttttaccatcgttttttcaattgcccaacttctttttgttcaatttcattgatttggccacttttttagaccctcgcctaattacgcgtagttcaaaatcactggttagccccccccccccgaattttgccaaatttgttttgtaatttaattgttttcgccccatttcgggtcatattattaattatattattattcagtgtccatcattaatttctgttacttaattacctttttcttttttttttgtttattttccgttaatttgccactttttcttccttattatttattctccacacaaaacaaacattcattttacacaacacaacgaccacactttttaaggccattaattcattaaatattgggcaaattggcccaaaaattacaaaaaaataaaaaatgattttcggagtgttcgattatttatgggccatttttgccttttatttgaccatttcccccactaatcttttggcattttgataaaattctcgtccattttctgaaaattcttccaacttttgctcctctctaaacagtagacaaatggaaattacagttacagttacagtaccccttctcccgatttttcattaattcgtcacaatcgccgcgtcccccggcccaacacacaaaaaaaacttgcccagcccgaacacttaaattaattaattaattattgtaattgcgaatttcccattctcttcgaggcatttttattttattttattattattttattttgttgctacgcatttcgaaggaataaaaaattttaaattaaacgaaaattaagaaaaatgagagaacattaaacagcaaaatttattgaatgacaccggtaaatcagaaaaaaataataattttagttatttttgttggaaagtaatttggaaaaggaaataataattcatttatttttttaaataagacaaaaattattttaaacattattttactcgcttttttaaataaatttatttaaaaattattcgaaaattgggagaaaaggaaaaaatagttgtgaaaacaaatcaacaaaagggcgtaaaggacgggtgccattccgacgaaaaagaaatgccgacggacgacgacggcacttccgctgctcatttgcttgttgcatttgtcgcccaaacagctgcacacctaagcaaatttagaaggtatttattggaggacagatttgtttgaaggggtcgtgccgaattgttttcgtaaaaccctcaactttttcaaaaaaataaaattgtgataacttttcttgaaatattaaaaacttcttggatcatttgacaggtccaagtgtttcagtttgatatataaaacttaagaaatacatcaagaaaaatatgatcataaaaaaacaatttttaatttgtgcctactttttatgggaacaaaatttcatttttgaggttttatcattaatattttaaatctatcgttaatagatgaatattagagagatgtttaatttgattgttttcaagaaaagttaggataattttaagtggcatttgttgcggaatgaccaatacacagatggggaattaattattacttttggattgaatcaacttttactctggaaatttgcatttttatggcactatattttctgtgccaatcccggttgcatttttgcccaaaattcacctgcacgggttggccatccatcggattcattgggccgcccatggccataaatccgccgccgccgtagtaaatctcctcactggacgactcactggtgagccggaacagttcggaggcgaggacctgggaaacaaagtgaaaattaaccaaaaagcaaatttggcatttcaaaaatgcaaatgattaacactaattaattttctcaaaaaatatgtttttgagattatttaattagcttaaagctgctgtaattttaaaataatttttagataattaaaattagaaatgtttttgcccctttaaatgcccacttctctgcacaggtcgaactcggcaaagaatgcgatggttctgttgtgatagccatgccgcgaaagagtgctagcacagccgcgcattgtcaatcgtttacccgttttacgacccaaaaatcaaccaatataaatttacatgtttgttatccctcccactaccgtacccattataatgaattcttgtgaaagtgtcaggcaaatgccacggcatggcaccgtcccaatgcccgtgggctccattggatcgtcgcatttggcactgaagtttttcggttcgtagaaatgcctaaaaactgaaatcttcagcaaagcagatgatctgttctccattttattgtcaatcggtgccataaatatgtaattaaatcctttggttttgatcattattaagcagctgttgataattgttggcactgacttgcccaagtcgctgtccttgaacagttccgcgtacattggcgacatgcatgaaaagcaccggtgcgtttgggcagcgccggcgccgtgaaaggcgccgccgccctgttgctggagggggtgcagcaaatggtcggcacggggccgagaagagaaatgttctggcaaagaaccggcacaattagggagcaaacgcaaatgaaacaaacaaaacactgaccagaataatgcaattttgccaacgaaagtgtggcgaattggagaagcatcaacggcaggagaacagtgacggagaaaagaaacggggaaaacggtagcgaactgatactacggtatttggtggacacaaagtacggtagggagagggagacgaaaaggatgagggaaaacatcagcggaaatggaggaggacgaggacgaagagcaatggacggggcaaaaacggtgtgaagaaacgcatcaatgaattaggcggtgaggcgaagcgaattgaggaaaatgacgaagaagtggttaaaacgaattaaaagccctaattaagagacaaattgagtagctgacaaataaatgatggggaaatgaataaaattaaaaaaaatgtttaaatgaaaatgacaaaaaatctgagttaggaaaatgagtcccggaa

SEQ ID NO: 5853 - DNA, 994 bp, Heterodera glycines
gccaatcagcagcagagggaagaaataatctctaaaaaatgcaatagcagtcggacgaatctgagggaaattgggggggggggggaggatataataataatgagggattggagggggggaggggggaagggaagggggagggagtgcttaaaaagtgccacagacggggcaaaggcgggcacttctgctgctgatgggagaagggccaaagcatcataaaaagggacgatgacgacataagtgacgggtgggaacagcagaagaagtggacatgccaagttggacaggaccaacggtggaaagggggggggggatgaagcacttggagcacattgggtttgacattttggcattgcctgacatttttatgatgtcattgttttacggtgggccctgatcacttgctaaaactgcgagagagaaaagaacatagccttaaatttagaacccattttgatacctttagatgatgttccttttggttttgtgagcctttggccttttggaaattttttaaatttttaaaaaatggacaaatcaaaaaggagagcgtgcctgaaatgcttgtcattgcagtttttgtagtcatttcggggccaatttgactttgctctcgctgcgccctctcttcgtgccgactgtgctcattcatttatcattccgccggcgcttaatgacaacgccggagggcattttggtgggaggcgaaattgggggggaggggaatttgatgaatgcgcatttaattggcccaggaaaaagccgggcagcggtgaatcaaagaaagacaaaaatgaaaaggaggaaagtggaaaatgatggcatcggtgggagggaagccatcggcgccactaaacattggggtgtatttgaagccaaagaatatctttgctgggtaggacttgaatttggaatggattttctcaattttttacaaggaagcaaattcaaaggaatgctgcaattgactcaccaccgattccaagactctcca

SEQ ID NO: 5854 - DNA, 2234 bp, Heterodera glycines
  misc_feature (57)..(57): n is a, c, g, or t
tttccccccatttcttttgggtgcaaaaagcggcggagctctggtgaaggacccacnccattcttcgtcttcttgtgtcgatggagcgggaaggaaatggatttttggcacaattggcaccacaaatctcttcactgagatggaaaaagggggaacaaaatttcgggggggggggcaaaaaacgaaaattataagcgaacggtcggtgaaatcgaccgatttaaaatatttcattcccggcaaacaaaagcattgaattttatcagtatctctgctggtctttgaacaaatcactcaaatgcgatggcatttttaaatttctttgaatgtctgtccaattttacgccgggataaatgacaaatgaatgaattaatgagtgatattgaagcattggcattggtatttttttttgtgttggactgctgactattgagcttgggactgaatagtggcggtggcattggcaaaattaagttttcaaaaattacttttgcatatttttctctgcgttgggctaccaccgctcgcgcattaatttatgcgccccggggcaaaaatggaaatgccaatgccaataatgccagaggagcaaagccaatcggttaaaagagagtgatgaatagggcccggatttttatgtttttacatattttttttgcggcttagttatggcgagagaagcccaaaaatagcattatctccgaacaatttttgatttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaatgttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaattaatatgcaaaaacacacttattttttcaatttttaacacatattttagcacatattttggcatttttgggggtttttagcacatatttcagcattttttagcacatattttattacatatttcaggatttttagcacataaaaatccgagccctagtgatgaaagttgggaaatgagaggataaataaataaatgattgagtgtttttgttgcccgtgcgcgacaattcataaattattcagtctctttttttgattggcaatgactttgtgaggtcgacttaagtgccaaaagaggagactaattgagaagacaaacgattgtcaaaaggcaaaaataataattcaaatggcaaagactttgaaggttttttttgaaatgaaatgctgaaataatcggaaaatccgacacaaattaaattaatgtgaatgccaataagtcaaccaaacaaattaaaaccaagcccaattttaataattaataattaccatgatatttataaatattttaatttttgcacaaaatcaattaaattttcccgcatgattttgttttagccaacgcaattcataattcgttttatttgttggatttatcgtaaaagaagcagtgttaaacgcatttgtttttgattgaaaaagataaagaatgtgatttttggaatttatcaaaaaaaaactcgatttttccaattttttaacacatattttagcacgtattttggcatttttgggggtttttagcacatacatatttcagcatttttttgcacatatttattaaatatttcaaggtttttagcacataaaaatcccatccctattcataatttgtatttataaaattgatttttattttataaattatgtttgttgaaaatgccgatctcaaatcaacattaataagatttcattttaaaaggattaataatttcaaatggcaaaggctttgaaaaattttgaaattaaatgcaaaataaatggaaaatcctacaccttgttcttaaaaattattgatgacatattttttacatctatgctttttttaattattgttaaattccaatcattaatcgctactaatgagttttggcaatatctgacaatgacttc

SEQ ID NO: 5855 - DNA, 2703 bp, Heterodera glycines
aaattagaaagccaagaatgtccaaatcttcaagttgaacagtagagctgcctttgtagtcattttgttaatatatgaagtctattggacgctgattgcatattggtagtcttcgaattttattaaagtcaaagggtggttggaaaattaagtcatgaaatcttgatcctggagtttttcgggatcaatgatcacaaacccatcatcgagttcacaattccaaatccataacctaaatttgagcaaaaattcaagttctaaaaatttgaatttgtacttcttgtttgagttcggcttatagtgattaggatttggtataagaatgatgttaggttcgagatcttcgaccacgataagccagggaataagttttcacgataccaaatttgccctttttgtgaagtggccaactacggtttattattattttatcttcaaacccgtttttggcagataccgtatcccatcattctgttttctacagtactgtcccattaatccgagagtctcttactttttcaggggttggcttatttttccaatctttgtgaatttcaacaaatattttttggcttatcaattgctgattagtgatttcaaccagttttgttgtttatcaatgtgttgcaaaatgtgacttcagagcagtgatggaatggaaattgttaagatgaccaattaattcattcagtttttccattaaattgccgaggagtgttttactttaaaattaattatttttcttgatttttaatttttagtttatcttttttttcttttttcttttccttttatatttttaaaaaaaaatttaaaaaaataattaaaaaaataataataaaaaaattattttctcaagaaaaataattaattttaaagtagcctgtcaactaaaaaaacaaagaaaaccaaaaaaaaaggagcacaacgaaatgcctaaaaaaagtaaaaaattaaatatttttatttcaaattcgactaaaattacgaatcaaaaagagagacgaatcgattaaaatttaaatgtacttttctattaatattttacatttctttaggtgatatattaaataaggaatggcaaaatgttaggcatcgggtgggaatagaacccactcgtccacccactcatgggcagctctaccattgagctatcgaggcacatccgctctttctttttatggatcttatcgctttcagcattttaagcgtccagcagtcagcttattccttacgattactgtgctttaccgtattttacgggtttaccgtgggatttttgcatttatgttacggtatttgagtgttctaacttctaacaccttctcgttctccattattccgctcaaaaaatgcgctgctaaattcagttggaaatgcttttggcggcggttctaagacaaatgttggcactttgtcaaaacagcggccgaggaaatggtgcggaagcaatggccttaatattttggccaattttcataataattttaaacaaatctcacgagaatagaaaagatggcgaaaattgttggagagatttgttggcaaattcttgcctaataattcagacaaaattttgtaaacaatttcatttcggacttactcagaaaaggcctcaaaatttacgctttttgttaaaatgttttcgatgctgaaagaatgccgaagggatggattcatctgctgaataaaaagaaataatatattttattttataaaaatggaatattatccaaaaaatttttttgagcctttttttcttcttttggaggaatttgtccgcttcacagctgaaaagccatttcgtttggccctcaatttgccgttttggtcattcggtccatccaattaattgaagaaattcgcctctttgagcccaattgacatcactttaccatacccgtgcccatcacacttacccgcagggcaaatgatccctctaattggcctaattctcggcgcaattcgtcgcattgccatttaattcgtggtaattgagcgatgcacaaacagatgggggaatggcttggaaaaccgatctcgaacaaaaagtcgaaacttcagatttttcgcatttggtctgataaattaaaattaaaaagttatgtgccaaattctttccattttcgaagttttaaccgacttaaaaccgtttaaacccattcccgctactggagacccttttttcagtgcttaactccttgagacaaatcaatggtgtataatttgtgatattttttcttttttggggggggggggattgactatatgtacatagttcagctaaatgccaatctttttttatgaattcatgtgtaaaaatcaaatatatgttacacgtaaatggcaaagtccaacatttagatcacataatcatcaatacctaaaataggcataaaaaagtaattcttccaagtacgaacaatttcatctttccgtgccttttcaccgatctaaattttatttttcggcattttcttcgctaaaaattcaaattttgcctcaaaaagtcaaaaaaatcacgaaaaaagtcgcaaaaactcaaaaaagtcacaaaaatcccaaaaagtgtaaaaaagttaaaaaaagtcacaaaaaatgcatgttcgaagcttcaaacaaagtttagaacactttttaattcattttaagaccatttagagtcagcaaaagaaaagtcatttgacttaaatcccagcccta

SEQ ID NO: 5856 - DNA, 5322 bp, Heterodera glycines
tgttctttcttttttcctttcttcgcattggctatgataatatttgcgtttgcttcaatctctgctgcagtctgtgaagacatcggctccatggttgcggcgtccaaaacttcacgaacaacattcttgttaacatttttctcagcattcttgtttcggttacgtcgttggttctaaattatatgacattaataatagtaatagacgtgttatatgcacaccttttctgcagcaactgcagactttttgctggagcctccgagtttgccagatacttctttgtttttcatcgtctccgcgcacaatgcattctctttcgcgatatttgcgtttgctttgccactttcattcattactctgcgctcgtggcaccaatcctaaatttttatgatttaaatatataactgtcgaagatttaaacaaccaacctcaaaactcgtggatttttgcatttttttaggaatcttgtctgtgaataaatatattataaattgcaaaaataaatgagcttacaagtcttatcgaaatttttcataattttatcaaaaatatgtgtcatgaaaatctgaagattacgtaagatgtattatgacaaattcttattgtttacatattgctagaataataaaaaaaataaaaattggcattatgaaacttttttagtttctctctttaacacagtctctcaacactctaatagtactgccccccccctcacacaaaatggtagccatccctttagtcaatcttaaagggatggaccatacctttaggccatccctttagtcaatcttaaagggatggatccatccctttagacactgttaaagggatggatccatccctttagacactgttaaagggatgaagacattatttttaaaatggatccatccctttgtcactggtaaagggatggagacattatttttaaaatagtaaaaaagacgtttagtcaatcttaaagggatggatccatggtaaagggatggagacaatatttttggatccatccctttagtcaatcttaaagggatggatccatccctttagtcactggtaaagggatggagacattatttttaaaatagtaaaaaagacgtttagtcaattttaaagggatgaaaaaatccgtatggtcaatcttaaagggattgatccatccctttaggcatccctttagtcaatcttaaagggatggatccatccctttagtcagtggtaaagggatggagacattattattggatccatccctttagtcaatcataaagggatggatccatccctttagtcagtggtaaagggatggagacattatttttaaaatagtaaaaaagacgtttagtcaatcttaaagggatggatccatggtaaagggatggagacaatatttttggatccatccctttagtcaatcttaaagggatggatccatccttttagtcaatcttaaagggattgatccatccctttaggcatccctttagtcaatcttaaagggatggatccatccatttagtcactggtaaagggatggagacattatttttggatccatccctttagtcaatcttaaagggatggatccattcttttagtcactgtaaaggaatggatccattatttttaaaatagtaaaaaaaacgtaaaggactctggcgtgtgggggcttggttaataaagcccccccacacaagtctcatagcctacccaagaggcactgatgtcgtccatcagggtcacagtgatcttccaaggcggcctttattggcacaccggcccagccacttgcaccttagaatggcgaactggtgttaaggcagtcttaaactcccaccaggaccacaagtgtcgaagcgctacctcctccccttgaccttgggcttacctgtcccttagacagggaacagcgccgcagttggggagggttccactcctaaaaagcgccgaagcactttctgattaataatgaaaaatgggctatatatagtactttgggcttgggaaaggatggatccaaaaatattgtctccatcactttaccatggatccatccctttaagattgactaaacgtcttttttactattttaaaaataatgtctccatccctttaccagtgactaaagggatggatccatccctttaagattgactaaaggtatggatccaaaaatattgtctccatccctttaccactgactaaagggatggatccatccctttaagattgactaaagggatgcctaaagggatggagccatccctttgatccctttaccactgactaaagggatggatccatcctttaagattgactaaagggatgcctaaagggatggatcaatcccttaaagattgaccatacgtcttttttactattttaaaaataatgtctccatccctttaacagtgtctaaagggatggatccatccctttaagattgactaaagggatggcctaaagggattgatccatccctttaagattgagacagttagagtaatctctacactatttctctattactctagtatctctaactgtttctctctttaacacagtctctcgacactctaatagtactgccccccccctcacacaaaatggtagccatccctttagtcaatcttaagatgttgtccatcctcctagcaaacggtatggggatggtggccatccctctagcaaacggtatggggatggtagccatccccatagcaaacggtatggggatgttgtccatcctcctagcaaacggtatggggatggtggccatccctctagcaaacggtatggggatggtagccatccccatagcaaacggtatggggatggtgtccatcataggattcatcactatacgcagggattctgaggctttcccgaagagctaaacgaaatctgatttcagattcgtgatcagcgtcctaaataacctctaaagacatatttctggaagtttttgggcgaaaaaatttccccactcgaaaaccatgtgcacccccctatggtcccgaattccaaaatcacttttatttttataactttttactaaaaaatgataaaaacatgaaataaaatttatcaaatagagcaaaaaattgcggatttttgggctatttttattttacaaaatatcttttcagaaccgagtagtgaatttttttctgaaaattcgaaaatttccagaatttctggaataacttttttcatattattgatagaaaactcaaataatatgcataaaattctccgatattttctccattttttgagcctctaaacactaaaatagacctgatctgaactgagttatgaattttcaaactttaacccaaaatcccgagggcaaaaaaagtgaccgattttcaaaaaaatttaaaaaattccaaaatttcccaaacaaaaaacaaacatcatattcgtgctcagcaccttattttaccccagaaaaatatttttcaccccacttctcgccctaaaaaaattttttgaaaatttctagggggcctagctcgaaaatttttgaaaattttccgacatgtaatataccattcaatagagcttaaaaagctctacaattttgctctaaggcaattttttgctaaaaccgacccctgacgagttatgggcccgggactcaaatgtcccgcttaggccaaaaaaattttctatttccggaaaaaaaccgaaattttttcaaaaatcccaccaatcgatagagctcgaaaaacggttgcttgaaagtggtctcggttttccccggaaaaatcggcaaaaaatgataaaattcaaaaaccccaaaaccttctagggggcctagctcgagaaattttgaaaattttcaaaatttttaaatttggaaaaatcgggcttaccaaactctacaataagttcgctggccaccccctgctcagttcaaacgctactgagttattcgcccggtactgaagtggacaaagttggtactgaatttctagccaagtctacaggctttcctattatgggtagaggcctggaattttttttgacttttagataacacttcaacttaggttcctaccagcagacattttttggttcaggttttaggaaaaaagttatgggcgttcaaacgcacgcaaaaatgggaaaaaagtccctggtactcagttggccctcggatcaaaaaacctatagttttcccggatgcgccgtctcgagctaccccttggtgcaaaatttcagcccggtgtgcccagccgttcccgagaaattggttttagcgatgaaactccttatcattctaacatatatataactagcgggtgcgtgaaccgtcggctatttagctgggaaaaagcgcttcgcgctttgggagcttcgctacctagactgttacgggggaagaggtacaaccacgggtgggaaggtacaattgtgatcagaagagttacaactacggttttttcagggatttttaggccgcttcgcggcctcgaacgggcgctttgcgcccgtttttaaatttagttgggccttttcggccgcttcgcggcctcagacgtgcgcttcgcgcccgtttttcatattttgttttgctttgacgggccttcgcgcccgtttttcatattttgttttgctaagacgggcgcttcgcgcccgttttttaaatttgttaagctcagacgggcgcttcgcgcccgtttttaaatttagttgggccttttcggccgcttcgcggcctcagacgggcgcctcgcgcccgttacaacggtgttagaagaggttcaatagtgatcagaagaggtacaacagtgatcagaagattacaactttgataaaaagggtacaccagtgattagaagaggtacaagtgattagaagaggtacaaaagtgattataagaggtacaaattagaagaggtacaacagtgatcagaagattacaactttgataaaaagggtacaccagtgattagaagaggtacaagtgattagaagaggtacaaaagtgattataagaggtacaaattagaagaggtacaacagtgatcagaagattacaactttgataaaaagggtacaccagtgattagaagaggtacaagtgattagaagaggtacaaaagtgattagaagaggtacaaatttgatgaagaggtacaaatgtgatttaaagaggtgcaaaagtgatttaaagaggtacaaaagtgataaaagaggtacaaaagtgattagaagaggtgcaacagtgattagaagaggtacaaaagtgattagaagaggtacagcagtgattagaaaaggtacaacagagattagaagaggtacaaa

SEQ ID NO: 5857 - DNA, 1451 bp, Heterodera glycines
aattagagcccggacgggcccggggctccgacgggcttttcactggcgtaccggtcccggtgccgtttttttttggaaaaaaacgggcccgggacgcccggtaaaaacgcttttttttgaacgggcggcccgccccggtcaattttcgaagcccggtcccgggcccggtcaatttgaccgggctaaaacgggcttaaattccgccagcgaaactgcccaaaatttgaaaatttaaataattattttggcgaaatgtctttaattcaaaaatttcaatagaactttggatttttgaaatttttgggcaatttcaactgttaaaaagaccccaaaatccatacgaaattgaacaacattttcataactttctttttacaaaaaaaaaatttcaaatttcatgaaaaaccaaaaattttcttaataaatttcattaaaagtcaaagtttttcttcagcgtcgcctagtacaaaaagctaaatttttttctaaaatgtagctcaaaatagcaaagtttgtcattttttcgtgtaaatctgttaacaaaccaaactcaaattttcaaaaatttacccggcggccctgtcggcactgccggacccccccccccccccccaatgtcgtcaaaatctttttgaaaaaatacaccttaaaattcttttgaagagtaaaaaaggtcgatttacaatggcttgacatttctaagctaaaataaaggactataaaattttttcgaatttttaatcaaaattccaaaaattttgaaaaaagcccggtcccgtatgggcgcccggtcaaaattttggaccgggccgggacgcccggtaaaacgggctttttttgaacgggcggcttgccccggtcaattttcgaagcccggtcccgggcccggtactttcaaaattccgcgctctagtattttacataaataaggaatccctggtaataaataaagaattctcgaatgaaaattgaaaagatttgattcgaaagtattttattagtcggtcgaaatctctgggtctaaaacattttcgttttaagaattttaatggaaaatctaagagcttttgcctcaaatcttccatgtccccaagaatccggcaacattccattccgttatcaaaaagtaataaaatttacgtgataaagtaatgccggccaattgtgtcaaatccatctcttcagctgattcattctcacatttttccttggagcttaaacagcctccgaatatttcataattgaacaaagcaaaaataagaagcaatacaatttttatattcatttaattttattcagcgcattttgtaattggattaaaatgaaaataataaaaaatgtttcccaactgaattttatgctaaaaagcgtcaatattaatcaatatcaaaaaccacttacgtataagcattttattgtttagctcatccctatgggctgatactccaata

SEQ ID NO: 5858 - DNA, 5166 bp, Heterodera glycines
  misc_feature (5024)..(5024): n is a, c, g, or t
  misc_feature (5090)..(5090): n is a, c, g, or t
ttcttagggggtgtatttttggttttattgcatttttgtaagggaattttccaaaaaatgtcgaaatagtgacaaaacgccaaaatagtgatttttaactattttagtgacgaagtcgccaaaatagtgatttctagtgaccgataatgacatcagaatcgaaaaattttaatgcagaaatgcgttttttgagctcctttcttcaaatcaattgagcaaaaaaatagttaaaacctaaaattcacagccctactaatgaggcaaacattaaaattaagggagtgggtttcgctccttgaaaaacttgaaaattttaaaataatgatcactttcgttctgatcaccacaagcctatttttctggtgggaaaattccaggctctttcctttgtcattttgctgcagtttatttccggatcgattttcaagggttttttcacgaaaaatcacataaaataaatttacatttttggcatcatttgatagcacttaaatgttaatgcaaaacttctaaaaaatttaatcaaattccaaaaaatacaacaaggaaaattattattattttttagtctttttggtcatattttttgatataaaattaaatttttgatgaaaagtcggaaattttcggaaatttttttaaattttttttttcaaaaaattagtaatttttgtacaatttctgttaataaattgaactgaaattttcaaaaaatttcccggcggcgcctatcggcaccgcccgaccctaaaaaacattaattttcttgcgaaatttgctcaaaatcgcgtacgtacattaagaagcggcgaaatatttatttgtttttttcatatttcttaaaaattcccccctccaatgactttggcagttcataaagttgtttatttacatattccaatcgaatgttttggctgcgatccgtccccacatgaatatttaattcggcaattcattcataatgggatcattcatcagtcagcttcatcatcatcacctttttgtatgtatcagcaccatcattttgtatttgtattgctattattcacataatttcataatcatatttggatcaatttttatttgcttaccaaaaaatctgttttgctttttcaatggttttggatttagttttaccaaaagctgggccgtgtcggcggataccaaaaagttgtgaattgtaaaaataataattcaaatttggattaaaaaatatccacaattttctactttggatatttttcaaaacaaattatttttcgaataaattaaacacccgaaatttttgttttagggtaaggttcaaaaaatttaccaaaatattgaaataccaaaattttatttaaatatttaatcaatggaccaaaatatttttgacatagagtttttcatgcattttccaaaaatataattcaacaatagcgttttaaaattcttaatccaatctttttaaaccccccttaatatgggaagaatcaaaaaacattccaaattacgcttaattgcaataatggacgacattaatggttcgaattctcaggccctttctgctgctgaccaacagtcaatcaatgatgatcactccgttaatcaagaacaggacgatggtaaaaaagatttattgcaatattgatttataacaattcttttaaattttgcatacagtattataccgtaccccctcttttcatgggaaaatccaattaaacatggaactaactcattgacaaattaagtttagtagtaaatttatttgcttttagtaatcattcaactctataaattcaggacattttcaatcttttaaattgcttatttttctgagaaattggacattttggagtacaatgaaaaaagaaaaccatgtggaaaatattcagaatttatttaaaataaattgaatatttttaaatggaattacattttcagacatcaacaatgtatacaagcacaaaggccaaattgaatttcggatgaccaatttcaaggcattttcggagggcaccgagccaaaggaagtgctcagtgagccggtggtgtacatgaacggattgccatggcgcattttggccaaacacaacgatgacgcatcatttggcctgttcttatgctgttttggcgacgagacgggttaaaattaatgaaattgacccgatgataattcatttaaaaagaatttgatagataaaatccaaaaatgcccattttgagtataatttgcaaacaagtcgcactaattatacattaattatgtttaatgttttcagacatggcttggaattgcttggccaccaagcagctaagcgttgtgtcatgcgcaaaaagtggacaaaaatgccaaaatgaaaagggaaataccaacgattatgacagatttgatgccaagaaactacgctggggctggggaaaaatttgcaaaatttgaggcgagcacagaatttttaaaattacatttatttttaattgttttttaaatgtttggtaatttaaatgtttgtttaggatgtaatgaatgaacaaaaaggcttttacgatgccaacgatgatgcagtcacattcaaagcgcaagtggtcactcaaccgcccaatgggatgccgtaagtgacaaatacagtataccaacttacaatattcggtgtctttgccaaaatttattgcttaacgttagcatttttgatagtttttaaattaataagtaactttttaattgaaacaaaatacaaaattttgcttttagtgggcttcgaactgttgacactttgcgggtcaacggtcaattggtttacgtgaacaaatttgtgagattttatacttaatatttgttttttaatctattctttaattatatatatgctgggtttgctggtgcgggggctttagcctcaatttttcgattttgagaggctattgatgattcttgtcaaaattcggcttttagtggccggacccttttgtattgcgcccctaaaaccctgcttttattttcattattttggtatcatttattcgtttttcatctttttagatgttggctgcctattccaatttttttcgcgaattgttttttggtgacaaaacggcagacattcaaatcgactcaatgaatggcaatgccgtgccgctttttgaacgtttaattgccacaatggaaccgactaatgcagctttggacggtaaaatatgctcaaaagcactttaaattggtgctagtgcgtttcctaaaagcgccattttaataaaaaaattcaaataaataaatgtgcatagaatttatttatttaaaaaaatttgtcgaaattccaaaatttttcaccaattttaattgtttttctagggatgcatttatttttatttcactctttcaagagaagtatttttgtgatttttatctattgtcatttaaaaaaaaaatacgaaaatcttggcacatttaggaaacgcacatggatggcacttttggaaatgcaccagcacgctttaaatttaaaattattactaaaatttcttgaaattttcaaaaattaaattttatgaatgaccacaaaaatttaaatttatgtagaaacctaaatctatgcaattttcagatgattgtgttgaaggcgttctgatgttggccagccaatttctgttggattgtgttaaaaatcgctgtgccagatttttgttggcaaacagccgaaagtcggcaattagcaaattccgattggcccatcagtgcggcatcaccgccatgaaagtccataaaccaattaaatttagtgccaaattaaaaattgattttaaaaattgtacttttttttattatatatcacttagtatctttggaattagcttttattcacagttgcgattctgtcaactttaggcaaaaaaaattgttaatttttccgaaaaaaataaaaattttatatttagaagcaagtgctggatgcgatgaacaaatcagattttgaaattaccggtcgaaattatatggtcgctctttttgatcacaacaaaatggatcgctacgcgttgaaggaattggacgaacggcacaagcaattgtttgccacttcgcctcagtgaagggcggataagaaacaaagaagaaatttgttgatttaaaaaaatcatttgcggatttttattatgtcactttttgacattttcaatttcatttccatttaaattacttaaattggtttcaattctcattagcttaaccatcttcagcatttctttgctctaaataaacatttaaattgtgacaataatttgctagcaaatttattgtttttaattctaaaaaatagaaaatttatcgataaaataaattcctttaattttcctctgtttaaacactcggtctttttcattttatctctaccacacactcttttcttttcatttctctgccaatcactctttcccttctctgtctgatttgcgttgctgcttggccaacattcagccaatcagcgattgaagtcgttgcgtgcgtttcttccaactcagctgtacgttcgcgtcccaattcgatggctctcctaatcaaagtggccattttcttcaacatttacacacattttcacttttactttttatttatgtgatatcattctaaaaatttaaacatttttccgattttttaaatttagctttttttatgttatgtatataaattaaatgtaatttttatttttataaaaagaaaagccaaaattaaaatattagataatttctgtctacgaaagtggccgaagcacatgagcaagcttgtaaataagtataaaaataattaattttttaccagatattatattgaaaaatgaaagatgtctaatattataatatttatgcttgaaatcaaactaaaatttgtttgtcccattaaataatcaaaatatttgagaatattttaaaaatgcagctgatgttgacggaagctctgagcaatcgtgcggaaccatttaaggtgcatataaactaggaatggcataatccatctcatccataatcagtgcaaggtcgtttcgtanagtccgccatttgagagattttttcgataaaacatggaataactttgcttaaaagcagccaaattntatattcttggtatcaaaagtttggcagaaataatacttttttctaaagttgaacaaattttttcaaattttgcag

SEQ ID NO: 5859 - DNA, 1270 bp, Heterodera glycines
tatggttcctcatatttttgtttaatttacacatttcttatcattttttaaagaaaatcgatacaaattgagcctagtaatattaaaagccaacctttttgttgaaaatctgttaacaaatttcactcaaattttcaaaatttcccccggcggcgcctatcggcaccgccggacccccttcttccccaaaatttttcggaaaaagcgcgccgaaaaaaagtgattgagaagcaaatctgaatttctaatattcatttagcccaaaatgattaattgtttgaaatgattgaagaaaatttgtttaaaaattttcattaatttaatttagctttaacttttggatttaattaaataaaaaaccaaaataaaaatttaattttgtattattttcaattgaaattaattaaaattcaattaaaatttttttgaatttttaaatttcccggttggtcccggttcctggtcccgtgcaaaaatcgaggtcccggtctcggttttgcccaaaattcccggtcccgctcaactctataactaagtaaaaggtgattcaaaaatgcttttggtatatttccatatttgcttaggaaaagggtcctattgcacttttttgcggtccgcttttgcaaaaactttttgggaacatggcggtagggtccggcgatgccgataggcgccaccgggtaaaattttgttaatttttaatgcgatttcttaacagattttgtccaaaaaatgaccaaatttagcgattttgagcaaattttccaagaaaatcaaggttttttaggtccggcgatgccgataggcgccgccgggaaattttttgaaaatttcagtgttagagaaaattgctttttactgatgatttgcacaacaatataaggaaattcttttcgctcattccgcattagttgtttttatgccgaagtaattttggtaggaatgatctttccggtgcaattaattagatattcctgagtgtctttggtttacaaattgtttaagaacaaaaaaaacaaattagataacccaaaatacgggagacatttattaagggtaccgaatattagtcaaaaaatatttaaccttagggtgttgaccaaatcatttagttttggtttaaaggccaaaaaaagtcagttttttggatctttgaccataactttttttagtaaaataaaaaattttgacattttagaaaccaattgagcattaattaaagagacagactggcctttttcgctcacaaatatctccgctccccccattt

SEQ ID NO: 5860 - DNA, 2217 bp, Heterodera glycines
tttttaaaataaaattctcgtttatcaatttcgaagaaaaatattttaaaaaatttcattttacttcaaattttaggacaagaaaaccagaaccgaaattgccgtgaagcgaaaattaacgcagagaaaatacaatttcacttcaaggtgagcattttcttttattttaaatttaaaattattttttttcttttcaaatttttatttaacttttttaaaattaaatatttcctagggattttgcaccgctcgagcgtgtcgttgtcaagtcaattccgttcgccgccggctcgcaatggcaatttcttggcgcgctttatttttgcacggtggtcagtgtacggtcgcttactgtagtagactgagcaagacttaacttgtccagaatgaatctcggggcccaaattaatcttaacattaggcctggtaattaatcaaagtaaagggacagaaaagcaagtcgagaccgataccaaaattaaatcttctttatcaaaattatttcccaagattggctttaatggcttctattctataccttactcaggtgatcaccaccattggatacggtcattccactccgatcacagttggtggcaaattgttctgtatgatgtacgcgctgggcggcattccgctggggctgatcatgttccagtcggtcggcgaacgaatcaatcacttcatcgggcgagtctattgggcaaaattaaagcatcttttaatagcaatacaatttttgccatttttgggggatttttaaagatgacctattctcattttggatattttaatggtttaggttggcattgtgccaaatcggccgttggctgaagcgaaaatggtgcatttttggattatttgtgtttattttacatttttgttttgatccgaaagtgacatcgattggcttgtccatgtgaagtcgcgtcatttgctgtgcgtttcctttgccattggatgtgtgaccatttcggtggcgagtcagttttttagcatttataaaaaattttccattttggtttttgactttttaatccaaaaaaatcaaaaaaatattctcagcctgtgtattccatcaacacgagcgatggtccgtgttcaattcggcttactactgtctgatcacgcgtcagttgccaagaattagcaagggaaaaacactagcagagtggttagagcatcccgcgttaagcgagcaggtgccgagggttcgagtccgctccacgtgggaacgtgggttgatttattttgcacttccactgcacaacagagaaacacaacattggaacacttgaggaccactacagtagtagtgctgggtttcaatgcttacccgaacacatcccggaccttttttgtgcggtactccctccctttagttccagcctaccgtatatcaagcacacgcttacgaataacaaaaacacttctacagtatccacaattggtttcggcgactacgtgccagcgcaaacggaccagcgattacacaaagagccattttacttggtgaatttcgaatattttcaagccatcgaggcctggcaaaattgaaacgtcaaccaacaaaaattgctgcgaagaatttttttcattaatttcaatccatttctaatgctcattacgttttattttccataatccgtctcacaatcggctttatttaagtccagccatttggccggacagtctaaaaattactttgccacaaacgaatggttagggcaaaacgcgtaccacgacaattgcacgaaggggagcattcgttcctttcagtattttttttgaaataaaaaaggatgggggagaattaaacattcccatctttacaactctccttttgaggatagagaaaagatgtaaaaatgtgagaaatagtgtggaaagaaatcctaaaaaacggataagaagagaagtaaaatagaatattacggcagcagacaaccaaagatgaagggcatacagtgacactacgaaaacaaacaaaggcgtatgggggggggggggagctgaattcaaaaattcgattttttggtgtattttctttttttagaaatcctgaatttatgaggtgttttttcaagaatttgaagacaagactatttttttgccattttggtcaacatttttttttcaaaaacatggtaaaatgggggtccggcggtgccattaggcgccgccgagaaaattttgaaaattttaatgcaatttatt

SEQ ID NO: 5861 - DNA, 3189 bp, Heterodera glycines
aaaaattattgtattcaatttaattaaagaattggcataagtatcggcggtggcattgaccaaaaccatcgacagtccgtctacagtgattccgtccgtaccgttttattaattattattcatttaatttggcattaatttatcttatctaatggaaaatgaattcaatctattgaaacctatgatttagagatcggaccggtcggtttttttcgggttttttcggtatttttcgattttcggtttcggtttttaaccgaaaaaaaccgaccgagaaatttttgagtttttcggttttttcggtttcggttttttaaccgaaaccgttcgaccgaaataattaaaaaaccgaaacaatcgaccgacttttttgacaaatcagttggccatttttttaacaaaattcattaaaaattcttaaaattttcctccggcggcacctatcggcaccgccgaccccccaaaaagctatcttttcttaaaaaattagcccaaaatctcaaaagttggcctttttgttgaaaatctgctaacaaatagcattaaaattacaaaaaatttcccggcggcgcttatcaacaccgccggccctaaagttatggcttgagctcacaattaaggcaccaaaaaagcgcaaaatggcactgaaaaaaggcacaaaaatcccgaaaaaggcatgaaaaaaagcatttaaatttttttattaatgatttttagggagcaaaatacgtaaaaactaaccaaaaactaaattttgctgatttattgataattcaattttataatgtttttcaataaggaaatttttaaacctaaaattttttatcaagaaaaaaaaatgaattttggcgttcaattcataaaggtatattctctgaatttttttagatcatttcttaggggtgtatttttccgatttttttgaatttttaatggaatttttcgggaaaaaatgccaaaaaaggcaccaaatcgctaaaactaatctttgtggtttttttagaatcaaggagcaaaaacatgttttttggctgcctttttcaattattttcccaatttatacaccattgatagagcttcaatagctctacaattttactcagaggtgatctttcgctttttctattgataaaaatggtttattgtttttttgggaaaagataaaaaaattcaaaaaaccgaaaccgaaacggtataccgaaaatttttcttcggttttttcaatttcggtttttttcggttttttaaccgaaaccgttcgaccgagaattttttgagtttttcggtttttttcggtttcggttttttttcggtttttaaccgaaaccgttcgaccgaccctcttgtccggtctctattacacatttctatttaattaacaatttaatttaattcatctttttatagaaattatctttaatttttttaaaaatgcttattccttacttctgtaaaataaaaataaattattttttgattttttcaatttaaatttatttttcaattattttaaatacaaaatttgctgaagggttgacggattgttcatcactgacggattgtctacagacggattatccgggagccttttcaaccttggcggcctatacatttttaatttttaaaataattaattttagcgaaaaaatagagacagaacggcgacaaatgtgccgaagtgacgacggtggcagcaaacggcgccactaccgccgccatcgccgcagcgatcgccgccgtcgcaccgcgtcactgtctctgctgcgcgacatttaccgtacttactgctggacccatccttcacactttacggtactttttgattgtaaatgtgtagaagtatgtttttactgcgcaataattttgtcgggaatattggttcaattagtttgcttgaaatccaaaattacaattaagcgattggatttggataaagcaaattcttttcccatttccgccctttaaatccaaaaagtatttcatttcaaatatttcttgatgcagaaggtgattgatcacaatgatgattgaaaaaacataaagttatggctctattgcgagcataaaaaaagagacacgactataaaatttgttggatgaatatgatttggtagctcttatattcctccattagcctgcaaaattgcaaagaattccgttatgttcaaaaaagttatggtcagaaaacctcaaaaaattgaatttaaaaaaaatgttgaccataagaatagagtcgattggctattgtaaattatcggcttttttggccctgatcgccaaaactgatcagcaaaaatcgttcaaattttctatcatataacaaaataaataacgaaaaaacatttgatcaatttttctgatgaattgggggtcagagcaaaaaaaaaaagccgaaaatttacagtagcaaatcgactatgctctacacgataaaagtggttttaaagtgatttggacactcatcagttgggaatgttccattgtttgactaatagagaagactctttgggctatcaaataatgtctcgaatattaatatggttcattaaaattgccaaattattttatggccgtgtaaactgtaatagagccttaacttatgccattttgccactgttttcactaatatgccatttgtccgtctcccatggctcctcctcttttatgtttagcttttttcattttccgctgattttcacaggtccgtcgtctacccacgccgtacattgaacatttggtgaacaccactggctgccccgtcggtggtacgtgggaaaacgaagatggcacggaacgatgagcaaacgaaaaaacaaacaaatttcaaaaaattgagccataattccgaatcgttgatcattgaatccccggcatccattgaaccaattttggccccgaaccgaattcgaaaattttaacttttgttattttttaatttttaactttttttttttgtgtacataaaaactctgcacgtattattttgcattttttttaattttaagctatttaaactaagattgtgatttttcgaaaatacagatgaggatcaggattattaaatttcagtaatagtttagctggtatcacacctttttgacagaaattttaaaaatttgtaaaaacatgtcttatggttttctaggtcgctgattttcgtacctggactcgaaaaaaagtgaaaacaaa

SEQ ID NO: 5862 - DNA, 1107 bp, Heterodera glycines
gaattgtctcatcagctgagttgtcatcagctgcctagtgcagaagccaagaaaaagctaaatcggaaagtaattgtaaaaaaataatgatatgttttcatattacctacctactgtatatatgatgtatactaatttaaaaattaatttttttctttttaaaattctttattttatttcagtgacaaaacgttcggtcaccccagaggaagcaagccaaaaaacagcaccataaagaaaataaagaatcaggaatctgaccaatttaatatagtttaaatgagtttgcttttcaataaaattttaattatccaaatttaaaatttattttttcatacatattaaaaaaattccttgtttttataaatttcccccatttgttattatttatttgttcaattctgttgaaatgaaaaatcgggattttaatcttaatccgtgctaaactaggggtttcaatcacagtatactattacggcctgataccgatgccggatcctaattccgggctctaagaccaacagaacatttaatttttttaaatttataatttaaggtgacagaatgaaaaatacattctattattttaccatttttaccgtctttagcaatttgcatgtaaaagcattgccgtcaaaagataaagcaggtaatctgtaaatatttattgaactttctctaagttcgtgccggaatgttcaacaattcaattatcattcaaccagggccgtaaatggcgttccaaaagaatttcctgaaatacgaaatccgctggctataccccttatccaatttcataaaagattactaatatccttctcttcaataaatttctaattttaaggcaccagaaatggacaaattgcagattcgttggcagaccaaatggagaaagtgttgaataaaagagaatattcggatgtataattttgaagttttttatatacaattgaaaagagccttcaaaaatttcaatgattcgaatttttatcgaaaaatccgaccaaaagaatctaaaaatacaaaaaatgatcgaaaatttttgaaaagactaataagtagggcgttgaattatatggatataaatcgcaaaatatggccatattc

SEQ ID NO: 5863 - DNA, 1396 bp, Heterodera glycines
ccccctgtcccccaagtttttggaaaaaccacgccgcaaaaacgttttttttttaaaaaaaagtcgtcgacttgcaaaaaaatcgcaaaatttgcagtttttgggtcaaaatctgttaacaaaccgcactcaaattttcaaaattttttcccgacggcgcctatcggcaccgtcggcccccccggttcaccaaaaatttttggaaaaagtgcgccgcaaaaaaatgggattttgaaaagcaaaaaaaaaaaaaaggtcgtcgatttacatggccgggaccatcatttcgcaaaattggccgctgacccccccccccccctccagaccatttcgcaaaaattttggtcgaccccccccccccttttcatgtatgtattcgataaatgcaaagaaaacgttcaaaaatgtttaaatatgctattaaaaatcatttttgaggaaaaaacacgataatcttaaatttactcattttagcgaaaaattaatctgaaaagcgaaattttcgcttttttgcttattttcgaaataataaccaatttttaaggaaatttaaatttaatcaaaattttcgacaaaattttgataaaaaatgtctttttcggaaaaattttccgattttggggggtcaaaatcccaatttagctgatgggggaccgttctaatagagttttttttaaaaatgccaaaacatggacataaaatatggacataaacgcgaaatatggaaaaatatagaaaatatggatatataaacccatcctagaagcttcaaacaaagctaaaaacttgtttttcgtgcgtttcaggcctcccacagtccagggaaaaaaatggatttccattaattcaactccctactaataagttaatttaaaattttttttttaattttacatttgggttttgtaaggaagaagctgactgggcgttaaaaggtgaaaacggtgttgataagataaataaatatgcctcggtagttcagtggtcggatgcccacggattgggtgtaggcgcgggttcgatttccacccgagtcctaacatattcaaattattattgtttttaattgtagataaaattactataattctcaaaacttttaatatttttttgggattttttaagattgtagaagctcatagagcaattctctccagtgcttccgaagtttttgaagcaatgttccgttacgatgagcaaaattcaaagaattccattggagaaggtaataaaatatttcattttaaaaccaccattttattaaatgtatttttaatttaagattatggcactaagaaaaattcaattttggtgcccgacattgaaattggggcgttcgaagcgatgttaacatttatttacacgaaacattttaacggattggatgccaataatt

SEQ ID NO: 5864 - DNA, 1267 bp, Heterodera glycines
  misc_feature (1147)..(1147): n is a, c, g, or t
  misc_feature (1211)..(1211): n is a, c, g, or t
gtttttgacattttcgaattctcaatctttttaaaattaattttcgtgtttttacccaatttcggcaaattcgtccctcagaattccttttttaagtgtcaaaaacgtaccaaaaaaattcgcagaccgcttaaaggaagaggattagctaacaaataagctcgaaattttcgtctcacaaattcgttcgcaaatatttcattaatacaactctttccaattttttttttttcgggcaaattttgaattttatcccttagaaattctttttaaaaatgatcattcgatcagaaaagaagcgcaccaagcctaaaggaatactaaaaaaaaaagagagagagaatgattagcttattcatcaaatttttatcctctcagacaatggcgtcgttcagcggtggccgcctttttcctttctgcaacaaattggtcaacaattttcgcgcacttttgcagggcgccaaatggcgaacggttggattggcgcccttttttgcctatttatggcattttgccagccaatattttttttttatattcgaatcatttatttcaaaaagggaggtgtcaaatgtgggtccgttgttgatcatttttatcgcaatgctcatcctcggcctgggacgcacaatgccatggtaagacaaaaaatattttttaatgtttttaatttatttttaaagatttgtttcaaatttttaatgattattcattgaacgggttttattgcataaaagctcaaaaacagcattgttacctgttttctttttaaacagagcgaattttcagtggaggttttttggtacatattttgacgattttttcattttttgcaaaaaaaaaaaaaacttttttggcactcaaattcttggcaaaatgtcactcatgattttattttttaatctaaaaattaagtgaattttttttttaatttgaaactttaacagggcacttggcattccgttgattgatgacaatgtgaaacggcacaaaatgccaatgtattttgccgccatcaacttcttcaaaatcatggggccgtcctgcggatttttgtgaaaatattaattttaatttaaaaattttttaatcttttttctctgcagaattggtgctgctgtcaacaaattatattacacttttcctnggtaggtttttggcatttttttatttttattggagttcgacatttaaaaaaaagttgagcctanatggaatctgggattttctggataaaagccaagaatcggcaaaaaaaaactcggac

SEQ ID NO: 5865 - DNA, 3209 bp, Heterodera glycines
  misc_feature (13)..(13): n is a, c, g, or t
  misc_feature (22)..(22): n is a, c, g, or t
tctgggattttcntggataaanagccaagaaaatcggcaaaaaaaaactcggacctttcaaggcctggaagacctggtttttttgaaatctgttgaaaaaaacaaatatgagtataaaacaattaaaattatttgcaaaatttttccaaaaatccccgaaatattcagtttttggtgaaacttgctaacaactctgtccaaaattcccatattttccctcgactatatgcggcgttaggaaaaatttacgaaatttttttatagaattttcttggtccaggcagactcaaatttttaccatatttatttattggtagaaaaaaaaatattcgtttttttgtttgaattgcaaatattgtctattttttggctttttaaatcatgctttttgttttttgattaggctccgccccccgcgggctaactcctcaggacccgacttggattggcgcctggtggatgggctttttgctcatcggtcttatgatgattgtcccctccattacgctgtttttcttcccggaatcatcaaaaaagtgcaaatttatcaaaattaaaataaccaacttataaaaaatcaaataaatatagaaaaaaaataaataaataaagtgtaaattgaataaaagcattaaatatttataaattataaaggtaatttcaacaaaagacattttttttagtttatggaaaattcaataaaaaaataaataattgaaatacaaacaaaaatttatgatttatgcaaaatccataaatatttttgcagaaaaactcagcaaaacaaagtgcatgccacaaatggcacaacagtcaatggtgagagattataaaaaataaaataataaataaaaataatctaacattttttttgtaaggaatgccgccgccgccgccgctccattcggtgccggacgtgaaagagaagaaaaagttggcactttatgaccgccatgtgaaagccgaaggcaccacagaccttggacttttgggtagtccaattctttaataataagatttgaaatcaatttaattttaattataaaattaatttaaaaatataaataaaattctctttttaaacattgtccaatttaacaacaaatttaaatttatttaattttaattacaaaattaatttaacataaaataagaaaatttatttgtaatcataaaataagttaaaaattataaaaaataaaattgtaaattttaattcatttccaatttaagcataaatcaaatttatttaattataaaattcatttaaaaataaattaaatattaattgcataactacttagtaattttaattaatcgttttcgtcttttcagcctttttgcgctcttacagtgctgttctgtcctcaaaagtttatgttggtgcttccattgcccgtgtgttggacgttttcgcattcaaaggatattttgtatgtaaatataaaaaatattaaatcaaattaaaaatttacaaataaatttaaaatagtcatgaaaatatttttctttatttattttttaaaatcaaataccattttattttaaatcgttcattttttgcccaaatgaaattttttacgcaaatttttttcccaaggtttttttgcccaaatttttggagaatcactacggtattccacaatatcttgtccatctgtacattgcactgttcggtgtcaccggcttcgcgcttggcaccggaagcggcggagtgattatgcggtgagcgggcgggagcgtcataattaattaattaattaattaattggactctattgcattttaggcgtccaatcaatggctaacttttttttttttgcttattgatcaatgccaacatttattcgtgtcaatcgaaagcttaaattttaagcttttgtttctactgtgacaaagaatatataggcattgattaagtaagaaagaagttatggccaaagaaactgaggatagcattaataaattaattatcggtcactaattggacgcctaaagtgcaacagtgccattaattatgccattatggatttacttttcacatttttaagcattttaatttaaaaatatttttttctgagaaatttctcatttttcccaacagaaaattgcgattgaatggacgaaaggctgcttattatgtgctgatcgcgtccaccatcaacacggcactggtgatggccaagtcaatgctcgggtgccattccgtggttaacaagtgaaaatttttttttaatattattcaaatgaaaataccggtaacaatatttttattttattatttccccatttttaatttttgtaattatttattctcaatttatacatatgtttaacttttctttgctttttaaatttttcttattttttacatttttaatttattaataagtaagttcacctttttttttaattttgtcaattttttatcttaatattataaaatatgtgagtttagaaggacaaaatttaatagtttaaaaacgacaatttaaatgttgttttaactttattatttcccatttttgaattttcttaattatttattctccattttatatgtttaagttttctttattttttaaattttcttattttttgcatttccaatttattcaaaaattcctttttttaaatatgtgccatttttataataaaatatgtgaatttttatttgtttttgagtgaaaatgtttagttttatgtaacttgtttcttgtttctttatttttcaattttttctttacaatttttatttattttttcatttttttttcaatttcccccccagcattggccgcgatggcattgtcactgcgttcaatttcacgcgcgagtgcaacatggcgtgcggctgtgcgcccgacacggccaagctgtacccggtgtgcgacgtgcagggcaacgccttttattcgccatgccacgcggggtgtcggcacgcggaagcgccggacgacgaattggtgaggggagggggattttaaaatgtataaaatacagtatgacacaaaaagatgggtacactacggtcacgccttcccccgcgaaaaattaaaaaaaaattaaacagaaattttttcaatgaaaaatattagaatacttttctatacgaaaattttaagcaaaaaaaatttatgaaaaattattgttttttcaaaaaaaaaaatccaaaatcgttaaaaattttttttcttgccttacgaatt

SEQ ID NO: 5866 - DNA, 2027 bp, Heterodera glycines
  misc_feature (69)..(69): n is a, c, g, or t
  misc_feature (110)..(110): n is a, c, g, or t
ttttttttaatttactaatttaaattttattaatttgctttgttttaaatcttatctattatttttatntaattgaaatattaaaattgttttttttccttttccttttncatttcaattattaattttcgctttatttttattttttactgttctaaatttttttaatttaaaatttattatttttttaatttgaaaacaatgtttgctttcttttttaatttcatttaataatattttttattttaattaatttattaatttttttactgttaaattctcttatttatttttactaatttttattattattttttaaattatttaaaatttattttcaggaggatgatcaacaccaggacagtgccagcaattcaaacacagcaacaaaatcgtcaaaagttgacacaatttcattggagaatattcagcaaaaagaattggacaaacaaatttaatttaaaatttcatatttttgcttttttaatacggtttatttgaaaaaaaataataaaaattttattttatatttatttcattaaaataaaatttatttcaaaggaaaactaagctttaatgttattatttctaaattttcttgttttaattatatattttaagtcatttcttttctctattaatttggcattttaaaaattcgctaatttggcaatggcattttattgtttggccactcactcaaattttgcttttgttggcactttggacaaagtcaaacaggtgtaatttgtgatcaattactttataaatttaattcagaaaaatataaagcggctttgaacccgcgaaagcaaatttctccggtgctcaacacctaatccacttgaccaacactaaaaagaaaaaattctaatttctgaaaaaaattacgctcccatcgccttcttaatggaagaaattactttttcttttgatagacagatgaaccaaatgctttttaattatgctaaattgtttttctctgtttccttttttctctcctttttgtttctctaaccttttctcacaattttccatctaatttgtctttttcttttcctttctctttttctctcctccccactccctctcgcttaaagtaccgctttctctctctctctttctctatatcttaagcttttcctatgcttgtctgcctttaaagtgttatcttttcaactctactcctctcttcccacactcactttcttcccattccctctccttttcctcctttctctctctctctttttcttttcattctttctctgtctcttacttccatgcttctttgcctgcctttcaagtgtaaatcgccgcttttcactctctttgcttcaacattttttctttccttcccttcctttcttccaatcgcattatctctccctctctctctctttctctgccaataacactgcttttcctctacttctccttccttcctaatgagttgctttgcttcatctctgtgtgtatgtctgtgtgtgccttttaggcccccgggggagtcaatcaacacaaacacacacacatttcgcgtacacaaaacagccggccaagcccccctaagaatctgccacagggggataggcccaagagtgagtgccatttaagcgcaagcgcctctcttagagaagcggcggtgccacggccgccgccgcgtcttggccatctgtcgacggcaccgttccttcctcgtcgatggccaacccgccctaaggcgctgtgccttgcgggcgtgccgccccccgcactccctatgtaatcattggtttttacatacatttctcatttcctgccgccgtaaaagttttacggcacgctccccaccctaccctttagcctagaataaaaattatacctatttcccgttcgtgctcatttttaaattttattgccagattttccccattcttgtgatatttttttcatcgtgatttatcgggattatgatttccatatttttttaagccaacagaaaatggagtcttggaatttcgttttcccatttttttttgttgcga

SEQ ID NO: 5867 - DNA, 1008 bp, Heterodera glycines
ttgcacatgtttttttttttgaattttccattttttttagtttttctaaattattttttcgctgctattgcttaaagatcagacttcttttttcaaatgattgaacttctttttctaactttccgtaaaaataaaaaatttttccaaaaatattttccctattttaaccaaaaaaaattaaaaaaaagtttttacgattcatcaaagaaaattccattcccatgacggaaacgaatttttttttccgtctcgtacataaaatacgcaaatatttgctcacaattccattgccgccgccgccgcttctcccgcacggccgtcgccgcgccgcccccggcggcgggggacgcaaaagcatttttcatctccccagcagttgaagcgggcgggcggcaacaacgccgatcaaatttcacaaaatgtgttcaaaaaaaagaaattttttttttacgtttttgaaaagcccaaaaatatattattatgcccattgttttcacagaagttggaagaaaataaattcattcttaaaccgctgaattttcttccccccccaaatgccagacaatttaaaatagcaaaatatttatttatttgtttatttatttgtaaaaaaaagttcagcagcagaagaacaaaaatcactaaatctgaagaatgttcagttttttaaatttatttaatgaattttgttttaataatttttcttatccagtcgatttcacagtttttacgataaaccattttccgacttttctttttttcatcccgggtctgaaactcggacatttttgtccaatatttggtaactctgcaccgatttaaaatagcaaaaataaaaatatatatgtattaggcatgtataaaatttaaatcgaatttttatgatttgtttggatggattatgactaatggcgaggatttctaagattttacttatttttttctgcggctttaactggacgagaatgcacgaaaaacacatttttgttcgaaacttttgcattttat

SEQ ID NO: 5868 - DNA, 2080 bp, Heterodera glycines
cccccccccaacccctaatacttttcccacctcctcctgccccacatttgtgctgttttgtggtccaaattattatgcatttatttcgccgtcccccgccgtttcccacactcataaaaatatgattattattttgacacggcacgacgacgacgacacctctctaaaattggattggatttttgtcgatgttccgccgccagtggcaaattgaattttctttctttccttaacgggtcaaatttaattaaaaatttcataaattttatttatttatttttcattttatctcgcttttttattttattgaaattatgccatctggtaataatttttttcatgatgtgttcttcccaattcccatcaaatcaaaattgttggattgatgtaacccaaaaagctaaaaaaaattttctccggtcgaaattttggacgaaaattaaatattccgggaaaaatcgtaaactaaagaaacttaattttcttctaatgacagtttgcattggatttttttcttaagaatttcaaaatgatttttttttttttttgcaagaaaaaatgtaaaattttaagaattttcttttcgttaattttcaagtattttattattttttgaagcttttttttttgttttactagcaaaaaattcattttataattttttaagaaaaaaattaaataatttttttttaatttaaaaaaaagtttgtacgaaattccattaaacgatttatgccatatgacacagcacggggcgtacgtcttgtggaccacccaaaataattttttatattcgtaaattccattttttattaattttcccgttaaatttatggtggttatgttatgtgatattcaaagtcgcttatcttagccgtatcttatcagttgttccatttttcatgagaatattatttcccaccaatgatttcaaattaataaattcaattatttaattttgacatttttttatagaaaaaactttcattaaaaaatattttcgattaaaatattaattttgataattttttttagaaaaaaatccattaaaaaaattttattgaaggaaaatttttaattctaacaattttttataaaactttcattgaaaaactgtttttggttaaaagtttttttttaaaaaaaaactcattaaaaatattgtttttcattgaaaatttttaagttgctttcttaaaaattggcctcattaggtggaatttgctggccaagaaaatattggttcgttggctctgacaatctcccgaaaattctttctttatccattctctgctccccccgtccgtcatcgacttcgttatgatgatgaattaggctcattttggccaaagaagttggttgacagctcattaatatcttccgccgatggctttagcatttttggccaattttgctaaaattcttttccataaaatttaaaaattatttttcaactaagtttagtttattttttattttttgttttctatttttactttttaaaggaactttactatatttaattttcatttgtaattttttaaattaattaatttaaatttcgttagtctttgcttttgtaattaatttttcacttttttaacttttaaaatttttggttgagcttattttaattttttataagaattttattatgtttaattttcagttttaatttaatttgtttagcgtaattaattaaattatttaaatttcttcgttaatttttatttttgttttcaatcttattactaaataatatttgctttttaatatataattttaattttcgcttttctttttatttataaagttccataaacaatttttcctggcattttacccttaaaaatattttttaattaattttggaatttttttaatggatattctaattgaaaaatgtccccgaaaatcccccgcagttttaatccggcctttgtctgttcctctcctcatttttcctcatcctcccattcattcatttatcttccaaatctttcccaccacaaaatccgcttcatcactccacgggttttgcggggacgatgtgccgtcgttctccccccccccaggggat

SEQ ID NO: 5869 - DNA, 1241 bp, Heterodera glycines
  misc_feature (1205)..(1205): n is a, c, g, or t
aatcttcagaagatcgatgccgcgcaaagaccttatcatcaattccaaatttccgtggttttgtgccaaatcttttgttgaatttctcttccatcgccaaatcccgaatcaatggtctgaatggcggcggcttcaacaaatcaaatgtggtcctgggctttcgtccgagcagcatttcagctggggactttgaatttggaaccgaatcattcggcgttgttctgtaggtgatcagaaacgtttcaatgatctcttgattcggcattccttcccccttcaattttcggaaagcccgcttaaatgtgtccacaaatctttctgcctgcccatttgacattgggttgtagggcgcagaaaagagatgggtgatgccattggctgctgtgaatttggcaaattctgaactcgaaaactgagttccattgtctgaaacaatcgtttcagggatgccgtggcgcgtaaacaaataacgcaatttgtcgagcgttgccgtggccgaagatgttgtcatttcaaatacttctgggtattttgaaaatgaatccaccacaattaggaacatttttccgtaaaatggcccggcatagtcgatatgaattctttgccagggctcggatgacttcggccacgaatgaaggttcactttgacgtgcgccttcgcagctgcttggcaaggctcacatttttggacaaattcttcaatgttttggtccatctttggccaaaatacatattgacgtgccaattgcttcattctcttcattcctggatggcctttatgaaagaggtgaagaattttgctctgaaaaatcttcggtatcaccactctttcgccatacatcaagcaatctttgaggattgacaaatcatcctttcttcggtgaaacaatcggacgatttcctcttcttgacccaaatctttgtcgtttggccaacctttttggacgaattgaacgacgtttttcaataaagcgtcgtttttggttgccaaaatcaaatcatgaaattttattggcaaatttttggtggccaatttcagaaggtcttcctccaatcccgtgttcagatgcatcggccgagacgatgatctccaaattcgggtcataatgagtgagcagcaaatttgaagtcaaaatttcctttcatttatcaaatgctttgcggcaattttctgcccaattccattccgcgtccttcttcagcangtcgtcgagcggttttctgacgaaccgcatgttttg

SEQ ID NO: 5870 - DNA, 5525 bp, Heterodera glycines
gcgtttgatgtgtcagcaattgctgaaccaattgttgctgttgcgtcaatgtgtcaatcaattgttgaattgtcgcgttttggttggccattttcgtcgaataaccgctcctggcgaaacctcaaccgcctaggtttcttggtttttgtgtcgaataaaaccgcgcctggcggaaaccgcaaccgtattggtatctgggtttttttgtagaaattccacgattaaccgcggctggcggattaatcggatcgacgaatttggcttgttgaaaataaaggtgcctcctggccgaccttttttttttgcagacaaattcaataaattgcactcagcaatttattcaaataggcgctgagctcaaatgtagggcgtcgccaatttgttcggtcctcgaaatgtcgaatggacgaacaaataaataatttattgatgacaaattaaaataacaaataaataagtcggaggacggcggaggagagcaatttgggaaatgtgaacacaaatatcaaactgcatgaatgaaatgaggggagggcaaatggtcacaaatacaatcaatagaatgtgtctgacagtgaaaggtcagacacaacaaataaatggaaatgaaacaaattaaataaataaatgtcttatcgggttccacccgaacaatttttaatatttattatattctttaaagaacattttcaagaattgttaccaaataaatttgggaaaattgtttggaaaactcgtaaatccttttttgacccccttttacaggagtggaaaatgcgattggtgactttcctttttattacacatttaaatatgaacgaaatagtggagaagatggaaatgaatgtaaatataaccatgtagacgcaaaagatgctgagttagaggaacatttgtcattttaccatgacaatggcaaagatgaaaagttggcgatacttttgaggtcgtattataatgagaagaaagagttggaggagcgcgaaaaaaattttgcgcaggtgaacagtttgaacgacttgagggcagtattgagggcgcatgataatcggcacaaaggattggctgagcaagaatattatgagcaggtgatcaatcaacaacatatgttcggtttcttgcaccccatttcggagggaaacttggagaggcaaaaagtgatttatgacgctgcgaaaaatgagttggacgcgtacatgacgaagatgaagggccaattagagggacagcacaaacaactcgaaaatgatgatgatgaatttagttcgaagattaagcaaattgagggacagccagagcagtccgaaaaggatgatgacgaattgaattcgaatatgaaacaaattgaggagaagcagcccgaacaatcagtgataatgaagtacatccgaaaaattgcgaagaaactgaagacttgtatgaaagggcatgtcaaaaatggaggagataacagtaatgagaaatgtgaggattagatgcaaaatatgagccatggagacaactattgtctcttgtctcgggggttcctgatcagtctcggcggcaatattgcatagagaggggaaatttcaaatttgcggtcccgctgcgggattagaactcctaaattttgcgggaagggatcccgcagttataaatcacgcaaaatcccgcatttaaaatttacgggaccccgagcgggattgcgggattttggaaatttgcaaaaatttaaaaataaaattattaaaacctccaaaaaactaaaatacatggcatgttagggatgaatccataaatttaactactttacattgctttttaacattgctttttatgtcgttttttgcaaatctagatgaaattattgagatgaaaaatggctttaattcgattgaatttattttataaatttatacaaaaatatttggcattctgtcctttaaaatttcaaaaaaattcaatgaaagtccccgcagaatccatcacaaaaaaatcaattttgcgggtcccgctgcgggattcgagccaaaattttgcaggacgagttccctcatgtaaatcccgcaattccgcaaatcccgaattttccaaaaatgcggtttgcgggttgggaccccgcaaaatcccgcgcaggatcccgttccgctccgccaaaattacatatgcatttacttcggggaatatctaaattataaaatgtcattttttatgtttatccgatgatagtttcactgcactgaactaagcatctgttatacagagaattgcaacttttaaaattaaaatatcattagaaaaggatccaaaaatgctaaagtcttcaataataaataattttattcattgttcaatttgtcaaaatgcacgatgcttttgtccctagtgatgggcagaaaatggatttaattattataattttagttgaccaagaaaaagcaaaaaccaaaaaggaggattaaggaagtgaagaaggaataaggaaggggagaaggatgaagaggaggagaaggataagaaagaagaaagattaattaggtcaattctctttaaaattaatttgttttcttggcatttctctacagtcttgtgattttaatgatttttatttcgaagaagtataaattggcatgcaactaatcaacttgagaagcgcgcaaaaaaacttacaaaaaggatgaagctgcgagcgacagcgatttattgggggtctaatagaatctttgcttccaactagacaatttctaaggttttcagtcactctcattctctcttgttctcaaattacaaattacggtttttggtgttttggttttggtattaatcacgattttttgtcatttctttgtctccattctcgggagaaattcttgatcttaatcccgatcgaaatcatttctcaaatttcaatgaatattacaaatttgtatgcattttacaaaaagcaatactctattttaattaaaaaaatttataaaaaggaataataattataatttatttttacattgaaaaaaaattggttgaacattgccaagtatggggctggagaggagtccccgggaaaaattaatgggagaacggtgtgacgatgggaatgatgctgtcggtcggcgtgggctcggcgttcgaattcgatgtagcacgggtggacaaacgctcaaagcggtgatggagcggagtttgtcgacttccctcctccttggaggatgagtaattggacggactgcggctgcgcgtggcagaaaaagaggctctggggttcaatttccgtcaattctaacggaaaataatcatgatgactatggccgttcaatcaggtcggaattccggtgcggaggcggcgtgtcatgctacaacgggacgtcccacgaattcctcggtcctgaacatagtcggcagctcgggacgacgcagaggagtccgtcgctggtctcgccactgatcagcaaccgacatttgggctgaacttgacacgcccgtgccgggaggcagtccaaatagtgccaaacgactggctgatggttaacgaaggatatcttccgcctggcgtcgtccattggtgttaagccaccactcagtccagagtaagcggagacgccgatgcagcaagacaacgagaaacaaaaaaaaaggggagtggtcgaagcaagccgataatggcggaggacgccgtaagattgattagattggagaggggatggatttcccttgttccccgccttgccaacactcaaatccttctctgtgaccaaggggggttttgtcaaagtttattgcgtgattggattaattggcgcaattaaaaggaaggatggcggaaaagtagtgagagggtgtaagaccgaaattggaagaaaaaaaggtgaagagtgaagtttgaagaagagaagcaaaaggaaattatataaaggagagggtagggtaaagtaaatgggtatagtaggaagggacgggagatgcgaggcgaaggagaaacaaaatccaaacgagacaaaagaaaaaagggaacacaaattgggaaaagggaattctgagcagaaaagtgagaaaagagaggcacgaacaaaggcgggtgaagggaaggagcaaaagtgtgaaaaatgcaaatgaatgggaaattcatgatcaaaaatggaggagagagcgcaattcaaaaacctaataggcgggtgacaaaaacaaagtgttggccaacccggggggagaagggctcaaagtccaattgtaaaaacgaagaaaaaaaggggcaaaatgggaggacgagagaatagtgaaaattggtgaaagaatgaggatcgatgaaaggacataaaaaagggaaataacattgggcttccgatcgcactctcgtcgctttcgcgacagaagggtcaaaagtggagatgattgagaacaataaatgaatgaatgtagactgcggggaaaggagggaaaggcagcatttaaataggcagcaacgagtcggggattaagagacaaatttgaaatatttcatttgagtcccatcaaataagtcctcatacatgatacatgacaattacctagtattttaaatagtttatttttttagtaacttgtgtttttggggaacactttaaggaataataaaaaaagaatactggagattaatgtatattaatttacaaatgtttgttctatcaacaagtatttctatatagttgttttaatttgtagtttaattattgcacatgatggcagttttaaggaacgtctcagcatggaattattggagtgccgagtctgaaagtggtcaccaaaaaaggtattttccaagaccaccaagtaacataatgttttaaaagtaatcttgggaaattccaaatttaattaaactgggtaaatcgaccacgctgagtacgaatatggccttagatttaaatctgtaggttctcaatgagcctgtacagctctaatttcatgaatggggttgaagcagtacaagctcacgtagcaaagataggtcagatttaaggccatattctaattctatggtcaaaattgtacataaaccttcattttcgttatatcagatttgttttttaccataaaatatttgagaagaattaatgggccaattcccaattttggcatggttagtagtgctgttcgagactctcggtctcgagtctcgactcgagaaaagtctcgggtttttttggtctcgggttttcaagtctcggtctcgattttcgagactcgagaccgagaccgagacttttttacacccctaatgatttggcttttcataataagaaaatgagcttatgaatgagaattttttatggcaaaatattgacattatgccaatttaaaataaagatgaaatattttattcgtttcacacacatattttagttgtagtccttaatttttaacttttttagagtaatggatccggaaatttctgataattttccggctgaaaatgagcaaagcgatgaagtgtttattgatgaaaatgaaaacaacctttcaaagcttaaactgactgaaccctccgcttcatttttgcgttattacca

SEQ ID NO: 5871 - DNA, 1131 bp, Heterodera glycines
accgcacttcgtttcaggttcgagagcgtttgtcgcatagaaattttatcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaagagatagccatttttctgggatatctattaaatataaaaattatttgaaaaataaatggccatggcg

SEQ ID NO: 5872 - DNA, 1049 bp, Heterodera glycines
aaaaagagatagccatttttctggaatatctattaaatataaaaattatttgaaaaataaaatggccatggcgctccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctgggatatctattaatataa

SEQ ID NO: 5873 - DNA, 1051 bp, Heterodera glycines
tgcatagaaatttctcaaaaaaagagatagccatttttctggaatatctattaaatataaaattatttgaaaaataaaatggccatggcgcaccgcacttcgttcatgtttcgagagcgtttgttgcatagaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaattctcaaaaaaagagatagccatttttctggaata

SEQ ID NO: 5874 - DNA, 3607 bp, Heterodera glycines
  misc_feature (38)..(38): n is a, c, g, or t
  misc_feature (3579)..(3579): n is a, c, g, or t
gcatacatattaaagcaatggaagacacaattgtaaanttattaaacatttgggaacgtcatttttaggtagaaaaatgcataattaagcgaaagaagttacaatttgtaaataattaaggagttgaagatacattttgattatgtgcacgaacttgtcgtttttaggtagaaaaatgcataattaaggagtgaaaatgcatgcagaattaagcaatggaagttacaatttgtaaataatttatcatttgggaatgtcattttagatagaaaatacataattaaggacgtgaaaatgtttgcataattaatgattggaagatacaatttgaaaataatttatcatttgggaatgtgattttacgtagaaaatgcataattaaactaacgaagatactatttgctaaattaaagaaaatatattattaagcggatcgatggtaaaatttgataaaaagtaaggaatagaagatagaattttattgagtgaacgaaattgttctttttaggtagaaaagtacataattaaggagtgaacatgcatgcagaattaaacaatggaagttacaatttgtaaataattaagcactcaggaatgtcatttttgggtagaaaaatgcataattaagagaaagaagacacaatttgtgaaatattaaggaatttacgatgcaattttaagaaaatttatgaaaataacgaatatatggagaaattactaaaaaatgtttacatatattggtgtgcgtgtgcgtgtacatacatgtacttgtgtgtgcgtgtgcgtatgggcgtatgtacgaaaaatgatatttagacatatagaagacggtttgggataatagagaacaacagtgaaagtaaacagatatagaagagtagagaaagtgtattacggagaaaaggaaaataattcaaataaacccgaaaccaaaagctaaatactagattttgtaacgaaaaccaaggaaggtagttttcttcctatgttacctttcaaaggaatcgatttataggataaggggatgccgtgacctcacccccctctctctttctcaaattatttggttacactcttcctcatctttgcccttcctctccaacatctccttaccggcgcaaactcactctacccgttcccgttttcagcttcttcctttaacaattcaatgggaaatgtgtttttactaaaaactctatgaaaaaatcgaattgtttgccaacacaaccataccttgtgggacattggttactggagggacaagcctaatcagatattggctaccggagagccgagccttgtgaggtattggttactggatgctcaagacttacgatgtattggttactgtagagacgaatcttgtaaggtattgtctgcccgagagccgaacattaggatgtttggctaacaaaaaaccacacgttatatatatgtttctgttttttttatgcatatctatgactattataatgaattaattaatttaataaaaaaagtttacacccccaaaatctgcattctttttctgataatttagaattaattgtcatgttcatcattcataccgtaacggagttaaatctgtaaacaaatgtcataatcatttattattcgtcacttccttttgtcttattcactctacaatatttttgctagttattttttatgacttatacactcccttccttaattaatcataatttataaatttcactctactgaaacatatgtaaatctgttgaagttgatgactatattctcagattccaatattatgcttcatagatataatttcattataacccttctttctgcataaaatcttcaattggtaaaaaattaaggaacaattaggtctaaaattacaattatacagataccatacatacactaccagaaaatcttagtaatttatcataatacttaaccatactaaataattgtaaaagcatctcaccaaacattgttccgcctttgaaatgattaattgatttttagctatattacacaaaataatttacgactcattattaattaaaattcttttacgtcattctcggtaatttggaataattaaacaacaattagcccccatatcataataatatttcgaataaacatttttctagaatataaaaattaatttaatttaatgaatattataaatttagaatttaaacaaaatagtgatggtaaaaaaaaaattgattttaagaaaaaattctttattttatgcagttgaaaaagacaataaaattagtagttactaccacctccccccttccggtccctttaacctagtagcggtcagtcattagcgctcaaattatcacaaccgtgcgctcaaatggcccctgcgggcgctcatgtggtacgcgcgagtgctcaaatgacccggcgtcgcttccctcccgacagctgacgccctttcccttctccattaggctttggttttgcgaattatttattttatttttaatttaaattatttttaatcaataaaaacccttcaataggtttaggttcacccccgcacccatccaataggtttaggttcactcccacacctattcaataggttttggttaaccaataggctttggtttggaacggtggttttccaacccccaaaaagggggggagtaactactgaaatgcacagaatgggcaacaatgttttgatgatgaccacatttgcgaacagcagtgtgtgggacagagtgacgtgagttgtggcaatgaatgatttatcacacctttttaattggcacaattaattaattatattttcgtttaatttttcacttttttattgctcaaatttattggtgatttttcattacatattattttgctttttagagtaacagttgtggccaattcttcccaacatcgccaaattagcaatctctccaatttgttcggcgcttccctctctttggcaccaaatcctccgcaaatgtgcgcatttgatggaaaactcctctagtagcgtttttaaattaatttgtgaattgccatttagggtcgaagtgaacaaagtccaaccctggtactacggccttatgaacatccgacccggacttaccggcaaagacgggaatgagcttcaaagtgaatatattatgccttacaaaaatggagtgccggcaattaaagcggtgagaaaaatttaattgattagtttaattggaattttttacaattaattaaatgaaagttaaatgaaatgtcattccaaatttaggtctcatcacttcaccaacaaatccaacctctgctcaatggctttgtgatcagaacagtgaaaggggacgacctttggctgtccatgagcaacggagacggaccaatggtcgcccttcacttcagttgggcggagagcagaccaaccaaagtgaacgccgtacttgcccaaattgagagggtaagcgaacgaatcagccgacggacagaagagtttctgatcagacaagtggagaaaggggcacactgatcaatgaatggaagggcattcgcattccaatcactcaaaagtctcctctgatcattctctttcccttgaaagaaattgcnccatcattcgatcgtttttctgactgat

SEQ ID NO: 5875 - DNA, 3270 bp, Heterodera glycines
cacatttgaacgagtttaggtgagttattttattaaaattaatttataaaattcgtaaatttagaaaattggctgagaaattggatcctacgcacaaattcaggaacaattttataaatgaaaatatattcgaatcggagcatttttaagcggcagaaattgatacaacaaaattattaaaagaatattttacagatttaaaatttaaagtcacatgaatttgaaagcataaaatttgaaattataaattgtttttcattgtcaaccacgaacaaacttctgatgctggaaattacggattgtctttaaatgaatttctaaatttttaagaaaatttctatttttttcttactataaaatttcctccccggtgagggtattttccttcgacattttccaaatttctccagccagtccgacaatatcgtcgagaatttccttcccaatcccgaactttctcttcccgagaatcggggatcaaccctctttcaccctctgttgacggcttattttattctgcgaataaataaaataaaatgagacaatttggaaaatgcttaaatattcaaaatgtaaaatgtattttaattgaattttattaatcacctatttatttgtttgtctgataattctgacaaacttacagatttaaaataagaaatttgataatgcaaattataccaaattttgtgaattattttctaaattaattaaattcactttgagtcttccccctttaattcgaaaactgattttctttattttttcattcattttcagtgaaatagatgaaattttgaaaatgaatgaataagttttacaacgcctcctcactaactatatgcatattcattaatattaaattattttgcagtttttttccgtttcttttttcgtttatccaattttttggctttgaattaattaatttttttttattactattgctattaagcaacaatgccatcattgctgtcataattgacgtggttaagtggtgaataatcgatggtggctttcattcattcattcgtttaatgctaatgaaagttaaattacacatgattaaataattatgaatttgctggcatttgctatggctaataatacgtgcgtaaatgtaatgctcacaatcaggcaaatttaacataaaaattattatacaagggctggcattagggttgggggaggggaggggaggcaattaaaaagccatcgcccctcctcaataatattttaaaaaagcagctaattataagcattaaatgatatttcaaatttttcaaaatacaaaattaattcctctttttaaattttacatttattttccttcttaaaaattccctttcccaaatccctcagctttttcagaccaattaattgactatggtcaggatttcgtgcctttttgtggttgcgacttattgtctcaatgggctgcttctcagcacgacaattatggcaaatagcgatgaggaaacggagacgaaaatgccagcaaaaagaccacgaaagcaaaaagaaaccccggattattatttaagtagttatttgccaactgattattcccgtagctcatcttcggcagagccagacaattcatcggacgaagattggaacgcaaaagaagaagcggacacgaaggacgaagaatcacccaatgtttcgttggccaattcatcgtcatcagctgctgatgagaagcaattgctgggccacaaagtgacggttcaaaatcgaccaaaaacgggacaatcggttcaaaataagccaaaaaagcaaaaatcggttgaaagttctccggaggacaatgaaaacattgaaagattaaaagcggaagtgcaagaattgatgagaaaatccaaagcaaaagcagcagcaggggtcggcagcagcaaaacaaaaacgaatcttcaaacgtcgaaaagtttcaaagaaagtggggacagaggcaaagggaaaggcaaaacaacagaagaaacaggcgaaccatcgaaaaaaatgaaaaaagcgacgaaaggcaaagtgccaaaaaaacaaacatcgtttgatgatcttaatatttcggaaattttggcaaatttggataactcatcatcggacgaagtggtctcgaagagtaattggcacaatgctaattaatcaataattaattaattggccatttcagaaagtaaagccccagcaaattcaagcaaaagtttgaaattgagttcgccgtctaaaaataaacagaaacagaagcaaaattcaagcgacgaaagtgtggaaataatcacacctgtgaaaaaggaacggatgcaaaagagtaaatgctcaattaaaaagtataattagtgattaattgtcattttaagaaggcaaaggagtgaaagtggagaagccaacagcgagtgaaaatgcaaaagcaatggaaacgttgaacattaacgccggtaggataagcggtgctatgacgttagtcaaaaaccatcataatgggcgttagtcaaaaaaccatcaaatgaaaatattttttgatataattttgctcaaaagcatctaaatttttaattcttgatatcattcgataggcctaagggttttctattagcctacaaaatttcaaaaaatttcgttaagtttcaagaaagttatgactaaaatcaaaaaaacttggttttttgagcttctcaggtcataacttttttaaacttaaagaatttttttttaaatttgcaggataatagaaaacacttaggattatcgaaaaatatcaatattataaaatttgatccattttagacgaaattatgaataattttctgtcaaaaattattcatttgatgtttttttgactaacgcccattttgatggtttttgactaacgtcccagcaccggataagcgccataataattcaaagacttctttcttgagagcgaatacgatgccaaatccgaattattatgattgctagcaaaggcacagccaaagccttggttttttttgggggggggggggctaattgcaagcccattaacaaaggataggtaacccaagtgactatgggactttcgaactaataaactttcagggtaactaggtagaggtggtgctaggacgaagttcgaatagtgcaagtaattaaattaaatttaaaaaaatatatttaaatgctaaattaatgattttacttaattaatagggatgaattcccaaaaaatgattgccgaatataattttttttttcttgataaaaattttcagtttattgtccttattcaaaatc

SEQ ID NO: 5876 - DNA, 1618 bp, Heterodera glycines
  misc_feature (1580)..(1580): n is a, c, g, or t
tcatacagtttaattttttagttagcgtatcggaattcgtataaaatccacaaaagatttgcaatagtatgacctaatctgattgtagtattttttgaagctctggtttaggattcttcttcagtacaacattcgtgatgtcgaaccaacaaatcggtgatgtcgctgttccggcagcagttgctctgaatgaacaacttaatcaagtccgcattacactttattttcgcggagtatgttgttctccctcttagtacacacaatatcatctatgagcctatatcaagtccattctgatccgtccagtcaagatatgtatgattttgtcttatattggtcactagtttgtccatattcaggaatatgaatacgaacaaaatacatcatataaatacggtggaatattgtatctaacctattataatacgtacatggcaattgaccctcacttgctatattcgaacaacgtcccagcgcgggtagaggtcacccaccccccccccatttgaggaatgaagttccaaaggatcaacaattgcttaattaaaatatctttttggaaattgcctaaacactgagtatttgtatattcttgcttcgttagactgtgctttcaaatgaaaccaaaaatgaacggcttattcggacatagtccaagaaactcaagattgatagttgatgtactcataaaattttgattagactcattaaaatccattggctcataaaagtcaattgggctcataaaatgcattagagtcataattttcaggcacgtctaaagcaacgccgaaacgtaaaagaaataacagaaaagcagaatgatggatgagtggcagacagaaaagagattgttgggctgtgtttgcgtggaaattactaaagtttcctcacctttcagtgaatgtttggctcttttgcagttttcccgattcataggggacagaaaaactttccgcggtaacttacgccatgtaatttctcagcgaatggttttcatattaccgtatttcttgcccctgggggttctattttcaacccctctgaggggctatttgaaatacggcatttttcaaaagtttaaatcctggttgtaaaaaatgaattggtcagctttttccattagtcccctaatgatctaacgattgtctgatagagtcacttcccatcagaatccaatccgatttttttttttttgcctaatcaggctttggcctgctatcgatgggcaaaagatctggttttggacgcctttttgtgaaagtcccatcccgaagaaaaacatattagtaatatgaattttgtgtcgtttcggataaactgcaatagagccgaaattttgggcttttcctttcatcacttttcactttcgcacatttaccattcgatagccttttggattttctctatagttttttgaccataatctttttgaaacctaacgaattacagtctaatagagaaatgataaactggttcaattgagacagctattaaaggagttattctcaaaaaaaaagctgtcgcccggttgtccccctaccgtatgcttttgccccatccttcgaatgactaatgangcactagtcctactgctttaaacatattgcgctttttg

SEQ ID NO: 5877 - DNA, 815 bp, Heterodera glycines
atttgaaaaaaaacgtataaacaaatgttttgtttgctccaccggaatggccggaacgaaaacgaagggacggaggacactttcgggaaaaggagccaattgggggatgggatttggggaattcgcaggcggatgtgctgctttttgggcagaaaaatggcgaaattggggatatttgttgggaatgcaatttgaaatgacccccgaggggacattttgtgtctcccgtcccgtccaaattagttattgaggaccaaaactgatttttgcttgcggcgaatggtggcgggggggggaggggaagggtacgaattgtgaaagagaaaattggggggaggagaatgtcgaaattaaaatggagggaagcaaaattgtctaaaaataaattaatttcgttatgtcagtcagaaattttaatttgcgccaattgtaaaaaatggaaattcaaatgaattttaaattataattccaaaaaaactgtcattaatatcgtactaattaattagtgtttttggagtgattgtaaattgtggtccgaattcgcctcatttatttttatgaacacagcgaaagataataaaacggacggagaaaagaccaaagggcgattaatgagctttgccaataattgaataactgcaaaagttgcatgttttgttctgcgggtggtccgttggacaaagaaacgatttgagggtcaagggaagggcggcggagatcaaagggagcgatttgagcggagggcgaaaggggcggagagagggcgaccacaccctcgccccccccgcaccccccaaagatcaaatttgctgatt

SEQ ID NO: 5878 - DNA, 4003 bp, Heterodera glycines
aaatgctttcaattagtctaaaaggtctcattaaggggttaactttttgttaattgcgttgaacggtgtcatggcaattaataagtacattaattgttttgattaaaattgtgcgaaaagccattgacccgcgctgccctccccgccccaatttcgtttcatttcacacacaaaagtcccaatgacccgttcctttcactttccttcttctacttcatccattgtcgagtcgacctgtgctaatcggatgggcaaatagcgcaacaatccgtcgactatttcctcccctcccccctcgtattattttattatccatcatttattaatgacccccccccctacttcatcatcattattatgtttgtttttgtcttagcacagcctccaaactcacaataacccgcattcattcattgtcctaacttcgctaaatgaatttgaaggaccacagaaaatagttaatccaatgagaaaataaagaaagtgcggaatcgaattactccgccagtaacacacaaaacttaagggatggataccgtaacatttgtacaaaaacccactcatcggtacaaaaattggggtgaattgaagtaaatggaattaacagaacaattgcagtgccatctcagataaaattctttcataaatattcaccaaagcattcaattggcgcttctctggggtaaaatgatgggatggatcatcagttcattcactcgtttcattcgatgtgttttgcgccgtttccttccgttttgtgccgcgttcgctttcttcttcggcacctcttttcgatggcatcatctccccgttgtccaactgcaaattgccccaaaatgcaacttttttgtgcaactcaaaccaagtctctcacccttttgcttttggtccgtctgttctggaaccaaaccttcacctgaacaaatgaaattcaattttggtttcttcccataaattcgctcattccgtcgtatttttgcagccaaaagatggcattttatttaatgttttgacaacgaaagcgggttcaattactgacaatgaatgagctcataagagccattaaggtaacacaaacatttgcatttattagtccccaaaatgtccgtgccgtccgtttcctttacttagccaccgaaactgaatctgtgcgggccaatttggcgcagtgtgtgcatattttgtttgtgtgccgcgtggcagagcactaattgagcccattttcgtcactccatttcccaaatgatagtgccgctgggaatggcacgcccatacagcaaatatcattaccatagtaaatgggtaattaaattgtgccgacattggaaggaaacggtgaaaatgaaacgaaatgaaacaaggggtcgaatttcacttttgtaaggaaacaaagcaatgccatttaagaaacaataaatgccaaagtttgcaattaattcgttttgcctatccctttttttcacctgcgtttcggacagtgccaattgtttggccaacactttccgctcacttcccaccaaatattgacttccattgaatgcctgctcgagtttgacgagttgagacggactgaacgcagtgctaaagaagaaaggaaaggcattcaatgaaacaactaaaagcataccgaattcgtttggccttttgcatttgttgaaaaagtgggaaggcattgccattgccaagagcaatcgctgaaaggcgaataaaattaaatgaaaaaaaaacaaaaattttttttttcgattttgggcctatttctcgaaattttaaaagataaacaaggttgggggcataattgcaataattgaaagcgaaatcccaaaaccgaaaagtaccgtcgaaaagtcaaaaacaaaaaataaattacgcacccacccgaaagaaaagactcacacggattcagaaagatggaattcgcagcatccgttggcgaaatttgctccggcgaatcggcattcaccgttttcatcgtcgtcattttggcatcgtcgcccgcaatcatccgaatgcactgcaaagcccagcgggaaatgaccagcgaagtgtcgtcgtcgcccgcccggggaccgaattcggtgtcaacggaatcgaatggacgcatttcgaaacaggaacttccctcgtcagtgagacagccatggcatgacgaagcggaaacgacggagggacgaaaggaattgtggcactaattggggggggggggatttgctaatggaatggaatggcaaaatgaatgactttggaagtgccgctgttcccttctccggtggaaaggatactgtccacactgaaattcgcaaaaggcattctgtgcagcaaatagagaaaacttattaaatcgttgagagaaggtgctggctgaaaataaagagaacaaaaacatttgtaagtgtaagcaaataattaactttgggggtaaaagtagagagcagcgggaccgggaatttgggcaagaccgggactttttgggttgaaaaaccgggactttttggctgggaaaaaagccgggaatttcccggtcaaaaccgggaccttggtactcagttgtccgtgtccaggtcccggtcccgctgcactctaggtaaaaggcaattagccaaatggactttgctaattattaataatttttaggtttggtatttatgcattaattagttaattatacagagtaacgaaaggcattaattgtcctccgatttgactaattcaaatccctaaacgcacgcacagacagagaaagccaaacaaacacaagaacaaatcgagaacagcagcagaaatacagaaggataaagaccaattagaagggagggaggggggggggagaaatccaacgccaacagcagcagggggcgggtccaaccagcgcaaaggtaacgaaccaatggtaaattactggtcttgtcataaaaatagtttaattatttttttttaattaaaaattataaacatttgattgtctattcagatttatcttgaaattcaaaaattttcgaatattggtctgacaaaaataaaaatcaagggcaagaataatcttctcaattgaaaaaggggacgttcgtataactctgcaacgggtggcgatgttgttcaatgtttggcaattcgatggtattattgtgctaaaacagatgagtaattaattaattaaagtaataaaaagtgccattctcacttcctcgttcttcacacctgaattttgaagaacaatcaaatttaactgtttaaatttattttttgtctcaaattaacttacaatgaccacgattttcttttttgttcaaattcattcgaagcaaaactgccaggaagacgatgaacagaatgagcagaagcgcaatgctgccaaccaaagtcatccgaggccaaaaagtgttggtggagtcacaaggatttctaacagattctgaatgcatttataactattcagaaaatgaaccctgtaaatgactaatatgcaaattaattactctttacgactcgcgaaaatgatggtgcaaggacggcacgtggcgtatctaaaaatatgcaaatgaaatgacatttagagcatcacaacggatgaagtcgttgaattcagaattcgacttatcaccaaggacaacgtgttcggaaaggggagaaaaagggcaaaatttaaagggaaatatgtgggcggaaggtgccatgccataacatttttttaaataaaattatttaaaaaaaatacatagcagtcaccaatcaacaccaccattggccaaactcactgaaatcacccaaagtgattgagttgcgtaaatttgtgttcgtttccgggtgttgcacttcgcaggaaatcactgttttgcggttgatttctctgaaattaattttcttactttttaaaataattttttttgttcatttacccctgtctgaatgtcaagcgggcataagtgtacaccgtgccgttttcccattccttccgtccatattcatggtccgtcgtctttttgccgttcacgaataaattcat

SEQ ID NO: 5879 - DNA, 4847 bp, Heterodera glycines
ccgccacttccctaccgccatgtccctaccgccaattccctaccagccatttccctaccggccacttccctaccagccatttccctaccgccatttccctactaaggcatttgggccatttccctaccaaaattttttttgaaattttttggcaaaatttcaaaaatagaaagggtattttcaacattttgatgtttctcgtgaattataagacaataagttttttgtttaagttatagattagaaaatgcaggcaattctaacacaaaagaaccgtacaaagcttcaacacaacgggcattcatacatttttcacaagctgagtgctgaaggtgaagttcgcttttggtcgtgtgaacaccatcacgcaaaagacatccgttgcaaagggcgccttcacactaacctcaacaacaacgttttgcgtgaagttggaaaccaccaatgtgaaccaagtgcagctcgaatggaagcgcaacgagtgatcactaaaatcaaacgccgggcggaacagacaatggaaccaccagcgacaattcgctctttgtcactgcagaatgtggccacgccagtacttccgcaactccctaccaagaatgcgatcaaaaaagttttttctcttttttttgttatgagatttttgtgcttaggtaatcaagcgtgtacgtcatgaaataaacgcaccaccgccaattccaaacacgctcacagacttaatcatcccagacgcatacaaaatgtatgggcgcaccgaagaacaaactgaacaatttttgttagccgattcgggagtttaccaagagaacgggagagaacagcggtaaaacacatgcgcactttttattatttaaatcgaaatttagaatactgatatttggacgtgagtcgaatggtcggtgggcgaatgaaatgaaagagtgtttcgccgacggcaccttcagcatcacaccgatgcctttccaacaagtgtacgcaattttggcacggtaagaaatttaaacaatttaacaattttgaacttattatttaagtcggaatcgctggtcatcccagtgtgctactgcatgctgtccaacaaaacgcacactacatacgagcgtatgtttcgtatgctcgttgctgtgtggccagacttcaacccggacagcgtgtcgatagacttcgagacagcggcaatcactgcgctgaatgtagtcttcccattcactgaagtgcgcggatgtctgttccacctcgtccaaaattttcacaaaaaaatttctgaatttgggctgaaacaggttgaattcatgacaaaaaaaaatcgaattttcgaaaattttagcgctatcaaaatgacccgacattcgcagaaatggcacgatgtgtcacgtcgctcgcgtttctcccaattggagatttgacccctggaatcattgctctggacatggctcttcccgacgaacttactcccgtccttgactggtaaattgacgatctcacaaattgtttactatttattgttctttaattatatattaggttcatcatgaactacacgggtcgtcttaagcatgatggaaaccgaacacgcccgcgatttgacccaaacatttggagtgtttacactcgaacattgcaaggcgatgaccggacgaataaccattcagaagccgcgaacagacgcctacaatgcgcatttgcctgttcacatccatcgatttggcatttcattgaccttctgcgaaaggatcaaaagttatcagatgatgacttcgcgaagtgttcaactggacaagaaccaccgcaaaaggcaaagaaatatcgtgaagcagaccgccgaattctcacgatggttcaaaattatttgccacttaacaacgcagacaccaacattttcccaattcatcaccctttcaatcatcattttattattacatttttgatcggaatttctcgaaattatgaaatgagaccgtgatttgaaaaataaattttttaaaattttcttggatttttaatttcactgtctttttaaacttttggtatggaaatggcccaaatgcattgggtagggaattggcggtagggaatcggccggtagggaattggctggtagggaattggcggtagggaattgggtcgatcccccaaaattcattttttgatttacgagatgaggtcagcccagcacggcagatttggaaaatccgatctctaagaaaaaccaaaaatatgcaaacatataagtgccaacttttgttggcaatcacaaaaaaatttcctcttattttttgagatatttatttgaattaaaattttactatttagtacaatgcatcgctcgtatttaatgcgaagaccgaatgacgaagatgacagttatgattatggagaacaggatctcgttcgagccaaacccatcgatgctcggttttcgagaaatttgggtccaacatatgcgggaggaaaggatttcgttcgtgcaagcgaacattcgcaaaaacaattttatggcagtcaaatggttgtgggaagtgagagccaacagcacaatgaggaatttggagaaggaacttcaaaagaggccgacgacaaaagcagccgaccgatgacacacgacgaacggaacaaaatcagcgccagcattttgaaggcggaacttcgaggagacattgtaacggaaaaaaaacattttttttgaatacttggcaacaaagcaaactttaggagcgcgtcaaaaagttgaaaagaaaactcgaggaaggcattgtggaaaatgaaaatggaggaaatgggaaggacgaagagggagaaggaagagaacggaggagagaagtactgttgcttagcatggacaaacggagcggtgtggtgatgccggccaaaggaccgcaaaaggtaagcgaagcaattggttgggagagtataatggcgacattcgtcgggataaaatgaataaacgtttaggagaaaaattgttttaggcattggtttcagtcgtttcgatattgtggcgaaaaaaattgagataatatactggaattgtaagaaataatcgaaagcttcattctatttaaagaatcgcaatgagccctcagagaaacgacggattgggaccgttgacgaggaattcggcaaacacatggaactcagccaaatggtcgcagaagagaagacaaccacggcggagcaacaaattgcaatgtttaaccgttctgcaaaggtaaattgccaaatgtataaaaaatattataaatattttaatatcagtaatttaaaatttaaaagattttcattgaaactcggcttatggcaaagcggagttcatgcaaatttcatttttttcctttctgttaatgttttcatgatctctaggtttgttccgatagtaaaactgatgacgattgggttgtggacgacaacatgatgagtcatcccaaaaagcggcgtcatgaagagaaggaaatagtcaggaagaagcgcaacatggtggaaggtgggtaaatgtaaaccgagaatttgaaaatttgctaaatttcgaactttaatattttttgaagattataatgaattttaaaaaataagtaaaactaattcaaatgacacaaataaggtttttgcgaaattatctctaaaatgggtcaaaactactggccaaaaaataatacaaatgaattggcagcatgattagtatcattaataaatactagtatttcctcatcaaatcaatttggttcctcatttgtcaatttctgaaccgctttttgagttcttgaattctttccgcaagtcttttgagaatcagtgaatttaattgtgctgtcggtggttccgttgccttttcctgcgtttccgatttttgtgccgtttcttcctttgtctccgtttttcgacctccactttgttcttctcttctcggctgtttttccgttgttttttggctccgttgctcgttcattcttccttcactttgccgattttccgcggttgtcttttgtccgttttcatttgtccctttttcggtttgtttcgctgtcgacgacgtgtttttgcgttcgttactttcgtttccaattagcaattgcttgccctccttctcatcaaaaatgaatggctgtttttcctcttcgttttcagctcggcagtgaattttttcatggtaagttgcttttttgaaaggtcgcatcagtcgtgggttgtcatactggccttcgaccaacagttcacagaaaccgacttcgggattctgaattgttaaaatgtttttgatagaacacaggaacaactgacttttccttcgatcgattcaaagaaattcacagctttgcactttgaggtttccaagcaaaactgcagacattgtgaatgctcttgaacaaatttagttgcaatcatttccccaaagtacacaaactcggggatggccacactttcaagcccaaatggacaatctgcaatagattattctttttcctttttatgatatcctaaatgaacaatgcctggttcgtcgtatacgatgtcataaaacggaggaaatttcggaggattcatatgggctctgaggtctccgaaccattctgttgtacagaaaacaaagccagttgaagctaacacgttaagcagaatgtaaaattgggtgtagaaatggttgaaaatcatttatctgttcgttaagggaatagactgttcacttgatataaattaatcataaaattagaaatgaaagggctgaatgtattggaaaatgtaattgaaatttgaacattggggaggtctccaagtagaattcgcctcgattgtggtgcgctgtgtatttgttaaaagggctgtgcgtgaattgtgtcttctccatttgcccatca

SEQ ID NO: 5880 - DNA, 8267 bp, Heterodera glycines
  misc_feature (5064)..(5064): n is a, c, g, or t
  misc_feature (5071)..(5071): n is a, c, g, or t
  misc_feature (5086)..(5086): n is a, c, g, or t
  misc_feature (5112)..(5112): n is a, c, g, or t
ttccttccaaatggtttggaagagaaccactggtctctctcacgtgtaaacaactcagtaataacagttgccaatgaaaaatggcaattttttaggactttataagaaatgttatccggagaagttccatttttatttggcaattttcttaagtgtttgagtctcaatgatgttaaaatttatgtccgatataaagcattgaatattaccataggagttgtccaaacttaaatcgtttaggacaatttcggagttattaaatgaatttgcaaataaaatggcaaataattccgatttctcttcactttcatgatagcatttattttcaaaaactaaatttggtatttcaaagggattgacattgtgtttttgaatgtatttaaaaattgaattttttcccttttaaatagccttatgttcaattaaattatgtatttttttggtttggatttttatatgtaaagtaatgctatcataaagtgctttttttgttggatcaattttacactgtctatataattttgcctcttctttaatggatgccaataaatgttgtggatattttggagctaaatctttttttagtaatttttttattggaatacactcgttcaaggcattcaacaaggcgctattgaaggcacggcatttttcatttatactaaaatgtgaaagagaaagagaacttaatctagcagaaattacagcatttaaatgtgatacattagacggagtaaaccgtcttaggcaaatttctttaggctttgctcttatttctggaacactcagcacaaaaagctgtgctaaatgatctgatgaaaatatgccaccttcaacagtacaatgttttacaattttatcatttgctgataagatcaaatccaaccatgatttacccctagtgggctcattcgtggcatttataaatgtaaatttattaaaaaagtcgcaaaatatttcaccaatatgatttatagcgtgtggttggccttgcctccataccaattctcgatttgacaaatttagatctcctaagattatataattttcacactaaaatgtttgtataaatttaaaaagttcttttgtatgttttaaagtggttttgggaggccggtaaatcaatgcaaatcttattgatttcagattttgtaattgaataattaaaatttcacaattaaattttgtaccagaaaattttacaaaaaaggctatctcatttttgattaaaataccacaaccacctccacgtgaactgttttcggattttcttgatgcaaaaatataattataattctccttaatccatgggctaagaggaattccctcattgtcttttgtccatgtctctgtgagtaataatatgctaatttttttatttattaaagccagtgaaatttcatcagttttgttcattatagagcgaatattagttaagcaacagataaaaccttctaaagaattaatatcccctttgtttagtggtagtgaattagaattatttatattttggtaagaattttcttcttccgaccggaaagtgtaatctactctttttgtaaaagtgttttgtttttttttgtgatttggtgtaaaatttaaaaatttgattcacgaattgactgactccggaagatgtgcacttcatctctcaaaataacgttcccagcatacacaatccaatcttgcccatctttctgtcgtttttcaacgcattgcaaatgcaggcgacggcgttcctccaattgtgcctttgtcagcgattcacggagacggacatggtgcagagacgaatcagcagcccgaatggtgttttgttttttttgccatgcagcgagagcctgtttttggaagccacgggaaggcaagagaattttcaatgggcgaggacttttttgggctgggttaaaggaacgacccatgcgataggcaatggtaccgcattcgatccccagcgaatcgaataagcaattgatttttgaccggtccatctctgcccgctttgctggtgaactgtcgttgtgctctggcatgccaataatgacgacacttctctgtctttccaattcctccgctgaaattggcatgccttcagtggagagagcagtggagcggagttgggaaatcgatccattaagcaggtcaatttgagaggacaaagtggtaattagggtattaaaaattggcatttggtcggaggtaaaagaggtctggagttgtttcaatgcttccactgtagtcttgaccaaagtcatttgagagtcaattaactggtggataccatttttttgggaaattggagaatattcggtttcggggcagggtctttttgtcattgaatatttaaggcgaatgaatatttaaggcgaatgaatatttaaggcgaatgaatatttaaggcgaatgaatatttaaggcgaatgaatatttaaggcgaatgaatatttaaggcgaatgaattagaacccgcaaaaatcaaaatttctgagccctggtaaaagaatgacttttaaaattttttggagcatagaattttacatggcaatgaaatttttagtcttctttaggaatttgagtgaaaaaattcaataattataaaagttttttttcataatttttaattagaaaaaaatttaaattctgaaatttataggctatcagaaaatgcttcatgtcgattctgtacaaagaacatcaaaaatattttatttgcttgtttctgaaaaaatattctaaagcctataaatatgttcctgcaggaatatatgcatacatatgaatattacctattagaatactctttttctcttccttgcctacaatatttctcaatttttatttttctataccttttttataagtagttgaatattgattagttgaatattgattagttgaatattgattagttaaatattgattcacgatgacaatcaaaattatatattcacaagctaaatttagcaaaaaaaaaaaaatttacaatatatttccctactgttggtttttatttaagtcattgtgcctcaatattttttcattataatttctcttaatttagtgttttttctactcaattggaaattctattttctttacatttattgattaaattaaatatatttatttttatatttaattaaaataatttattaattccttggcttcaaaagaaaacttgcaaaatatacacaagaccaaggctaacgaaatttattttaatttgtttaatttttggaaaatggacatttttttcttaataattatcattaaaaatttcattttttaaaaggcacattatttaataatgaactgattcgagcgcgcggaatatttgtataaaattttctaacatgaacttaaaataagttgacaaaagtgaaaaatgcacaaaaaaggcacaaataattgtaaaaggacaaaattatttattatttttcgacagaattttttacaaagcaagaaaaaaatatatataaataagaattaacaatttttttttcaataattagacaaaaaattttcaaaaattattaaaaaaactaaaggggatacatttttgtggaagttttcaatttttaaaaaattaattaactttttcataatattgtaataaaatgagtataatgcatactggtttatagcaaatataaaattgaaaaaatgattttgaaaataataaaatttaatgaatattcagtgttaacagatatcatcatataattctctcatccgtttgatcagtttcgcccttttctgttcgttctgttgttgaacagtgccgagaatgttggtgatcaaaaacaattgaaagcacagctcgtagccattttgatgggccaccatttgtctgatcaattccagtgatcgatgttgatcaggatgaatctgggcaagagaaaactcaaaaatttaattggttaattgcagggtaataaaattaatttaaaaaattgagtgagatttaatttttatcatagctgttaaaaatgatcagagaagtaaaaatgaaaattttattaattggtaaagtaattttacataaatggagaaaggaatatttttgttcattaaaataagaaaaaataaatttgttgcaaaaatcaaaaataaaataaaataaatttttaaaattttatcatctaacccacaaaaaaaaattcgttaaccccgcttatttaaattatgtcaccactttgccaagctgtgccaggacagagtgcagttcggaacagtacaatgccaaccaatcgtcaaaatgaactcgtctcagcggtgcatcgacactgacgtaaatgatgcgcaacaaatcgttgacaccggtgcctacagtcagaaaggatcactgtattttattacagccagaaagattattgtattttctattttaatttaaaagcactaatttattcctaattgaccagtgtgacaaatttgccagtcgaacacagcactcagttgatcagcaacactttgtccattgcacgtcttgaaaaacatgttatttgacctacaaattgcataatttgaaaaaatataaattaaaaagttaaataattaaatttaatttaccaaaaatccccatgaacaatgactggtgccattgaaaacaatttgtgttgatcaggctcatagcgaccatgatcgttgtaatgctttttcagcgcctcattttgcccggcaaaactttgcgcacaatccggcatggccatcatacgttcaatgatgtgtagatcctggcaattttagcggaattaattaatcatttgtaaaattatccattgattaggaatttagatagtacagttgtttgtgattgatgagccctaattttggataatcctacccgatctaaattagacactaatttaaatcttggataaaaaaattgtcaggattgaataatgactagatcaggacagactcaaaaaccatttaagaccagagcattaattgcattagttagttcaaccacttttgctaattatagagactttctagttaaggatgtggaagaaaggttcgaataaaatattatggtttataaaattggcattcactttntcgtcanagtcaagttcggctntaagcgtgaacgagtccaccaattcncctgggcaagcacaggcataatgcgtggaaatgtgcaaggccacggatggcacttccgacctagaaaaaaaaatgctggcattttgtaaattaaattgtttttttgtccagtttgtaaatgagattcaaatcttgaatattttattgatccaatagtatcgattagtttttgtcctggaaaatcaaccaaaatcttttttgtcctggaaaaccaacctaaacttttttgtctggaaaattaacctaaaatatgtgaaaatggacaaaaaataaatatattaccgaatttaatgaattacataggaactgccctctgaaatagggggttaaaaacagagcccccggagctttaattcagtaaatacggtatccaaattaattacttgggcatgttaccgtaaaaacaacaaaaaatagttttgtcaccacctgttctttggttagaccttcactcagatcagtttcgatgatgccatccccggcaacgtcttccatcaacaaatagccgcccgccaaacagtccggcgatgccgcgtttcggcacgcgtacagctcgggaatgtgaaagggcaacggcacgggcatggcacgcaacaacggcacaaccgtggcgtaaaagtggcactccgaattgtgcaccgtgtacatccacatcttcatgtcttcctacaaattttgacatgaaaaatttgattttttaacaactgagtctcattttcatgaaatattttcaaccaacaaatttgttttaattatttaatggccaaaaataactgattgattatccagtaatttttgcatgcaaattaattgggaaagttttaaaaaaaaaagtcgagatcaagaccggaattggggatcaggccgagataggatatcaggattcaaatttggttcttatcgggatcataatcatgcaatttttttcaaaaaggccgggattgggatcaggatctctggaaaatcgaaacgatctctcctggccctaattgtgaccgactcctcctcttcccatgccatgattttaagaattttgttaattaatttttttgttttttttaaaacccgaaccgtaataacggagttaaagcccagccctgtagatcatataaaaattaaaaaacattcgcttcaccttagccttctcgcttccagtatgcatatccaaacgtcgtgatgtaggcacctgaaaaatttttttttcaaaataattttttgtttaaataatttgacaattggccaactttgaaaatgcatgaaaatgccgttggcgttgtggcttcttcggtgtcatccgcttgtttgaattgaatttgaatgcgataaatgtcggacaaaaagccgccggtgctcagctggacaaattgtgcattttcgacattggccaagccggcggatgggcccagtttgccaacagtggctaatttatccaacacatagccaacggtaaaatcggcatgggactgatcaatggcactgtccaaattgtccaaaggcatttttggtataatattttaacaaaattatattctaaaatattaaattatattagcatattaattaatgaaacagtgaccagtaaattaaatttatttgatttggataaaatatagtttcaaatatttaatatataaaaacaatcatttaattttaaaatgataattttttttttgaaaattggataaattgaaggtgaagagaaatttgaagaaaaagcttttaatgaaggggaatcgaggttatatttaaaaaatgtggagacagtgaggaaattaaatgtgcattagataaggttaattgtaatcgatgaaaagaaaggcaaataaaagtttatgcctttttaaaaataataataataaagtaataaaataattttattgttttattttatttctttaaaaaatttttattcattatatttcgaaatcaaaaaaaattttgcattaaaaaagcaaataactttatacctttttttaaatataaaaataataaataaactaataaataagttataaaaaagtgcatttaattgaccgacttattcaaagaaatttccgcccaaacataaaacgaaccaataaaatatttaaaaaaaataataaataaattagccattgaaacaattaaaatatttaaaaaatatttaacattaactatcatgccaatgaaaatatttcaaaattaaaaaaatttatttgaaataataaccttaagtttctaatatacatatattaattcataatgacaatttctcggttgatgaaataagaatgttaataaaaaaaggttcgagtcaactaataagcgttttaaaattaaataaaaatattaaaaacaaaagtgctattacaaataatattatttaaaaaattaattttgtccgaaaaaaaaacaataagacacgaaaaactattaaaagtgataaataaaaaatatatataaataaatatatatatatacatatatatatagatatatataaatatatatatatatatatatatatatatatatatatatatatatattaatttccacaaaaatatttatccaaaaatatctttatctaaatattattgtagacttgttttcgattttagctatagaatggaaaaggtttttgccagaaaaaattttctattttcgtcagataaatgccattttcttgtttttatacaaaatttcgtgggaaatttataatttttttcaaaaattttgtcatttaaacaaaagcaatatattttaggcaacttgtttatcttttatctcagacgctttcaccagattgtttaacatttgttgtatttatgccaagctcaactctggcaaatgccaacattcgtaatgaaaagcaaacactttaaattaataataattattaatttatatttgtaattttttaataatattctttaaaaatttaatcatttcacttaattttcggattactatatatggtcataaaatcaagaatatataatgcttctaccttcccttattagatgatcattttgtgcatttctttaattacctaaaatggcacactaatttatcggaaaaggaattatttagtttaatatagcaacatcaacaggtgttaaatatccattttcggtccaaaaaagcgttaaatgtcattcttgtgaacaattaca

SEQ ID NO: 5881 - DNA, 4365 bp, Heterodera glycines
tatattttattttaaacaaatcgtatatgatacatgacatgaggatccagccaggagcgagcgtcatattacgctggggtttgcggtaagttggaccctactaaatacttttttaatatttgtgattttataatttggttgtatatttttataggcaaatataatcttgtatttccgacatatatattttttaatttattttgatttattttcaaggtattgtatttaatttatattcaaaattttataaagattaaatgcaaagttagttttataataattaaattgttgtgtttttcatatgttattggaaataatacaaccaattatctttcttttcttttgtctttttgtattataaaaacttaaaaataatattaacaattgaccagtttcccgttgaccgactgtagttcattctgtttacttataaaaaaaatttttaaagttacattgctaatatttgttttatatttcttttgaaaattaatttttattcgtattaagattagtaattttttaatttttaataaatcaaatttgttttttcaaatataatttttattgacaatcttttaatattaattcttatctattaagtttactatgattatttttaagcataagtttaatgcattcttaaatttataatttttaaattatttcattcattattgcgccgacaggtatgtcaggtttctataaacaatttcagagcggaactgcttttataattgattacattttcatttttatagatttacaaaactttttgaatctcatataattgattataaatagaacagccctcataagtcaatattcattacttaagtttaaattctataatttttatggaatattataatttaattttgaaaaaatttttgattatttgggtttatttttttctaaattttctggaaagatagaaatttcatagtatctgattattctttcgttaggtttatttcatatgtaatagaaattctcatagtatctgattattgtatggttaggtttatttcatatttcaaaatttttaattttgcatgatttttcttgagtttgttcacacaattaatttttgaaaacttgaatgttttctataaaggttttttcaatttatattattttaaattataattatttttcattccagttttttaaactaatagttatttatttgaataaatttatatttttaaaatttttcattttttatttaattgcaatgttgtttccgatgcaaagtcggttgtatattctctctgatgaataatattaattgaattacaataaatttgcataggagtttaaaagtttatacaaaaatatctattaaaaattgaggacttaattatataataaataaataatatttgaaaattttgaaggacagttcttgccaactattttaatgaaatcttcaattaaatatatatatttttatatttatctgataaaaattgacgctggaaataataagaaaattctaaaccaagtaaaaatattcattttaataatatgctgcataacatattgtaaaatctattaaatatgcccgaatgattatagataagttgaagataagaacttcatcaaattttattggaattgtttgtattctacaggatgaaaaggcaaatacataaaataaaatgaattaaaagtaaaattctattctacgcatagtaaattatcttttagcaagtgtatagagaactgaaaccaaattatctaagatgaaacattgaaattaaatgtaaagaatataaaaaagaaaatttcatagcatttcttaaaaaaaggaaaataaaattaaaattaaaattatttcttgagttaagcaaaggagcttagaatcaaaaccgaaccagatgcacaaagaataataataatgaatgaaaataataatctaaattatttaaaagtatgaaaatgaactaaactatgagaaaccttaagcaataataaatataaaaatctttgaatcgtaataaattataaattttccggttaaaattttaaattttttttaaataaaaagttctactggaaataataagaaattataaaaataagtaaaaatcagttaaataaaaatgttgccatgatataattctaaaatacttttttttttgtaatgacggaatgttataaagcggaagaaatgaacttcgaaagtgccaacaaaaaactcacaaaggaaggtccccaggtgtccgtgggatttccgaatgaaatttgggggtggatagagtacccttgggttcttaagaaaagtgtttttattttttgctgaatgagtacgagtgccgagttatgacgtgccaaactttttatagtgaataaataaattacatatttattttcacttcattcaagtgtccagtggtgtagtggtacgcgccagtcagcgtatttaaaaatatgttttcatatctaatgatattttgtgcatctatctattgcacctttttaatataattttttaattttaatttaatagaattaaaataaagattttgtttcataagatttttttaataattaactttgcataaaaagcaaaaataaaaattgtttaaatgaattagcatgcagaggattcgaacctgagacccagaaaaaatttgactaacgcactgcctctgcaccataacacacttgtaaagtaatgcaacaattatttcttttctttggttataaaatgccaaaactttggcacgtcataactcggcactcgtactcattcagcaaaaaataaaaacacttttcttaagaacccaagagtactctatccacccaccaaatttcattcggaaatcccacggacacctggggaccttcctttgtcatttcgaaagcaaaaatgaattggcgcatagcatgaagatgagcgctgtaaaaactaatagcaagaaccgagtgctaaatattaataataaataagtgaaagaaaatcatacaaaaaatatgctgtttttcttgtcataaagtattaagaagtttaataggaaataaaaatttctactttcgatttcttaaataaagttttgcattaatcaccagtctacctattcagcagccggaatcggaaatgaaatactagattccaaggtaatatgaaagattcttaagaaactttaaaaaatttgtaaaatagatagtaataaattatataaaattacaaaaaaatattaagcaatattaacaaataaattcgttaaaatattattattaataaaaaaatgtgcgaaagtttactaaacaattcgatcaaataaaagcagtttaaattaaattgaagcaatcaatgccgtaagacttttccattactttttaccatttatatattaagattttaagttattttacttaaattagaaataattttaatgaatgtatatttaattatagcaaaaaaaaataaaacaaataaatgtcattcaaattaaaaaaaaataaaaattttcttcatattatatgcaaaaactaaaactgcaataactcgtcataaaatttattagtttttgtttaaataaaaattatattaaatgaaattgaaatctaaagaaagaaccttttaatcgattatgcggtctacgacgagagaagaaagttaaaattacttaggtttaaatttccttattttatttttattccaaacgaatttctcattgttgaataaaaataaagagaatttttttaattataaaaaattaatttcattgaaactattaatatacacgtaaattaataaaacagaacaaaatgttaaagttgttgatttagatgttaaaataaaacaattatattcaatgaaaattaattggaaattcattataataaattcaaattaaaaaaataaaatatctagacaatagtaaataagaaaaataaggcattaataatctaataattttatttgagataatgcccaagcaatttgctatttaacaaaataaattatttattcaacatttgaaatagaaatttttaggacaatgcagaaatattaataaaaacaaaattattgtatgaattgaatttgaaaaaattaataaattaaaagcgcaaagtttgtattaatttaaaaatcctacgctcaaatacaaaaagataacaaatgattggtttcttctctctgacaatattagaaattaaaaatattcctaattattttgaaaataatgtaaagtcatttaatatgactcaaagtgaagatcacccgaaagatatgcgataaaccaagtaaaaataatcatttaaataaaataacatattattaattatgccagaatgattatagataaagtgaaagggtatacttataaaattctattctacgcatagtaaatt

SEQ ID NO: 5882 - DNA, 1412 bp, Heterodera glycines
aaatttgatcattcaatatcaattgcacgaaaaatgccatgtaaaaatagttataataaataataaattgaagcaaatctgagatttacataaaatacacaacaaagattgatataataaattcttaatattataataaataaaaagattaaataaaatgatatcaaagaaacaaatcaaagaaagtaaaaattttttgaaaattaatcataaaattctaattgtactttattttttcaattaaacttggattaaaacttcgttcatcacacacagctcattacaagatcatatattcagagttttgataaacaataatatatgcatttttaattacaaaatttattttaagttaagttataattaaagctacaataataaaaaattcaggatttaatcagtaaaaatataagattttaaaaagtcaaccataacgtcttgttaataaattataataaacataaacaccataataaaaaatttaaattaatgttaaataaactagttaatatactaacgaagctaaactcgatttaaaggtgacaattttctttaaaattgtaaattaaaaatcgttggatttataaagataaacttgcaagtaatttaaaaaaatcctaatttgggtaagaaaatattgcttatatatcttctcatatgtagaaaagtaaaacaatattaaataaataaaaataattttgggagtccacaaaccccatcaagcctcaagctttttcaacacgaaaaatatcaaaaaccgcgaggttcgagcatcacctttatataatgcattaatgaaagctgcttaaatataactaaaaatttaatttggcttttaaaataaaaaataatattattaagcagttgaaatagaaaaataaaaactataatgtcactgtgggagcattgaaaaaaattgataatactttttaattaattaaataattttctaatcttttttaaagaatgatacgagaaaaagcctgggcatggtttttaaaatcataaaaaagtaaatattttattgaaatgattaaccctaatattaaatgaatagaaaaataaaagtagcagaatattaatataataaattgaagaaattggaattaaacatcagatttttaatattataaattcttctttaatttatattattgagaccttggtttttatttttaaattcttcttaacataatctaaataaatttagactcacgaaagttgataaggatttgatgcaaaagttgtgcaggagttgtaaagttgtttaagaagttgtaaaatttgttcaacttttggcgtcattttttcgacacacagtgttttggtcaggcatgaacttataatgccggaaacagggccccaaggggccctgtgaaagcgccggggccgctttcaacaccggggccagc

SEQ ID NO: 5883 - DNA, 1552 bp, Heterodera glycines
ttttttcggtttccttttttttaaaaaaacctccccccccccccccctctcccccgccaaaaacttttttgttgttatgactgaattttataaatcggaagaaccaaccaacttgcatataatactaataaattagaaaccaaaaaaagcaattggggcctagcaagaagatgagcgctgtaaaaaactaatagcaagaacacccagggcggctggagagaggggatgcggtctcgacaacgattttaaccaaaaatataatacaaattgaacaggaaatgttaaatgatttattaataaattttttaataacatacaaaaacttttcaaaaaatttgacacgtagtgtaaatctaaaccgatcaacttaaataaaataaattatcaaatgtactattactgaaattgtttaaattatctttgaaaataataatcaaatatagtctagttaaacattttttcaattgcaagaaaaatgtcaaaaaatagttataataaataactgcagaaatatgagattaacataaaatatacaacaaaataatttgatgattcttcattgagcagagcacacatctctctataaatcgattttctgatcttccataagacaagaatatatgcatttttcattaataaattataattagcttcatactaaaaatctaacaaatattaaaaaaattagttaatacattgacaaagctaaaccctgaaaatattaatatagaagattattggtaattaaaaatgaataaactcgcaataagaaattttaaaaagccataatttggatatgaaatacagaaccgtgagctgtagctaccaggagatggctcgacctggtggcggtactaatgatataagcccatggcgcggaaattcatataaggatcgtacatggcattccttagtagagcaagtagggtcaaaagtatacgtgaagtggaccctgcgtcgcgtctttatctgacctccgcttattattaacaaaataaacttaaaaattctaaaaactttaaaaaatatggttaattttctaatatatatatattattatttctacaaattttggtttgcaaagcatcaataaaataagctataagaatatagatccttcagtttaagtaaaaaagcttataataaaaataaaataattattttttttaatgcaacataaaatttaaaaggatgaacaaccattacaaaacgaacccaaagtcgcggcgagattcgagcataatacataaagcattaatagctgcttataaattaaaaaattcatttggatttataaaaaaaaaattatttattcagcagttgaaataggaaaaataaattaagttataatgtcattgtggagtatttgaaaatataaacacatataaaataaacaaaaaatgtttttgaaaaataaaaagaatgatatgaaaaattacttaaaaaaactaaaatgcgcttcaagcccgccaagcgtaaaaacgagtctgtgaaagaaggagacaagcagggggggatattaattcatgtttgatcatttcaagttcaatta

SEQ ID NO: 5884 - DNA, 4696 bp, Heterodera glycines
cacatttacagcaacagcattgcatgcaccattctttttacgcgccgccccggggattgcccttgggcgctttccatggacagcaaatgtccgcctcagtgtgcggcactttgccaacggacgatcagccggcggcgccgccgcagcattggcacccgcagcagcagtcaaacaacgaaagcggagatggcattggcattagacggtgaaataataatcgatttgatgaattttaatccattttaaagccccaccgagagcaattttgctttttggagagatttccaataaattatttaaataaaactcaaaattaaacttttttatatttccgccgcagtttcgatgctcctcagcaacaccacccaatcggacaagtcaatgcgtttacgcccagcaaaatgcccagcagtccacaggtcggagctgtacaacaacagacgacaaacccgtctctgtcgaacacaacgactgcgagcagtacaccgtcataaataaataaacaaaggagagggcggaggaatgaattcacacaacttttctaattaatttcgtgcaattttctattttccgtcaaattttgcctcaaaaatgccaaataattctaaaaatattaattgccgttctgtttcttacattatgccattcaattgaaatgccatgccaattcctgccatatgaacaatttctcattaataagataatattcaagaaaataaaataatttttcattactattgaaagagaccatttcccatcatcagaatatcatagaatacttaatatttaaaaccctctgattacggtaggaaggctttgtagtaccatactaacgaaacatgcggaaaaagctttgctccggctttatgcaatgtacaaattttagaatatagtgcttgtttaaagactgttccgcgttttgtttgtaatttcgtcactttctttgcccccttccgttgcctttggtaattccgttaccgtacccttttgcgctttcgccgtcctttggtcctcttcaaagattactgtattgcagttttatttttaaattgcactcacttcggaagcgaatccgtctgttttggaaccaaactttgacctgtccaaaatgtgccgggaatttatgacagtgccagttttgacgtgccaacctgtgtctgaacaatgggacggacaattattccattttacattatttttgattatatcattaaaattaatttattttaatttttaaaccctaaaaatgcgccagaatggcatttttcatctttgccaaaaagtctccgtcaaaaatgactgaccgggccaaggccgagctgttcggagaagtgcgcgcgctgctcacccaccaaatattgttggacacggaactgcgcctcaagcgcgtccaattgccacccggagaatgacgttcggaagcgttttttcttccgcttacagtacccgagttcgtccgtagtgattacggtggcaccatccattgattgaacagcacaagcgccatccattaacgaagtgtcgttgctgtgaacaaagccatcgattttaaggaacaaaactgtgaatggctccatctccgggatgggatttgaaaattgcggaaaccccaaaaaatcaaataaatacccagtacggttaataatgaatattaagggaaatgggtggtcaattaggtttttgagctgctcagtttaattggctgaaaatgcgtaattaatgaccgcactcacttaattagcattgcctcactaattgaccactaacactccccatcttttttggcgaatttattaaatttgcgcttattccctccccccacccgtgccattgcaccccaaaatgtgctgttgttttggctggtcgtcctcctccttttctgtgcagaaaatggtaacactttttggatgcgtcggaatgactcattttgcgctgcgcttttttcgaatgttttggtgttttgcctccctttcctccacaattattcattcattcacttgttcacattcgtccatcattccattcatttgacatcaaaatataataaaaataaataaaactgccaattatttacaacaaatttattttattgccccgcggcgtttccctcagcccttcgggcgacaaatgctttttctatttgcaattggaggtgacaattaagtgcagcagcaacaacggtttgggaaggacggaaaagcgcgaaaaaaattgggaaaggataaagtggcggcattttaaacaaattaattaggggggggcatttaattggcattgggtgaatgaaattacatttagggagatacgagagaacaattaaaaagcaacggagaaagggggggggctggaattaggtgaaaaatttggaatattaattatctttttttagatattataattattgtattttaattttattaataattcccaattatttccgtttaattaattagctcatcatttaaagattttaataatgctttaatgacaatggctgctgatcagttcctttcatttgacactgacttttttgaattaatttaatgatcagccggggctgtgatttttttgtataaaattcacagtcgcgaaaaactttggtttttgtatatcagataggaggatttttgtaaaaaaaagttgataaataccgtatttactaaaatagagcccgagggactttatttttcaaccctttcaaggggggaggtgctgtattttaggaaatacgatatcaaaaattttcaggcagctaaatcatttgtcgctggaattgttgaactgtagaacgccctgtaaaaaaaagggttaatgatatatcaatcgattcgtctcgaggggctaagtacgaaaaaatatatctccatttacggaaatggcaaaaaaaaacggtttttgaaccggttcaaaactcaaaaaatggagagattttggcacttgaaactattttaaaacaatcaaattctgtttttcgcaaggtcacattttgctcttttcttgcatttacaaattcttgagaccttaagctttcggtcaataacaagaatgaaggcatcgaccaagtgataaaaaagttagagctaaaagactgatgatcggacacataaaccactcggtactccgctagtttgtatccacattttgggtcaaattttttcaaaactttttctcggagcacttcaaggatcctgtcactgggcagcatacaaacacaattgaatcgacgtggcagaagttcaagcagcaacacaaaacgagatttggcacgcaaagatcacttttttccacatacatttctgattttttgtggcgtaagcaatttggaggaccggacattttttatattttgtggacccaaatcgcggaattgtacccaataagcacataaatctccttttatttgttatttaaagcaattgcgacaataaaaaaagaaaaaaaaatttttgaaaaaatttgacccaaaatgtggatacaaactagaggagtaccaaccactcatggtggtgaccaaattgttcaacaaacaataaatcaatttcttcggatgtctattttttaatctgttttattcacaacaacacagtgcaacaataatgagctttttgctcagacctaacaacgtctatcaaatcggactaaaagtagcagaagactgatttgagccagttgaggaatcctcccttcttctttgacttctttttcggtttcttttgttcagaatttggagtgcgcgaagaagcatagtcggcgggcgtcggccccggcccaggcaaatcgtcgtcggcaatttcagtcattccttttgaaaaaaaacaaatgcgctcaactcggaattaaaagggaaaatatgcattaatggctaaattcttagtagattttctattattaaaacccataaaatcccgtaggttttaataattaaggtacttttcctgttttttgaccactgaattattatttttttttgagtctccccctcctttaaataaaatcgctcttaatttcataaccctttaccaaaaacccaaatgaatcccaagctgctttaccatttgcattttcacgattcgatttgtagtcgtcgggaataggcaacagatcgggcatgggcggcccgtagattcaggcatttttaaataaaaaaacattagtttagtgaaaaaaaatatggatcgaggaaaacaaatgaaatcaggaacattatacctattcgctttttaaacacaactctaacaaagtcataagtagggagtatttttaggtttttaactattttttctgcggctttatttcgacgagaaatgcttattttggaagttagccactaaaatagttttttgccactattttggcgtttcgtcactatttttgccactattccgacaacttttgaaaaatttctcaacaaaaatacaagaaaatttaattattttgggaaaatccgatctaatttcaataaagaaaaaaaaatcattttcaaagaaaattcaaacaagaaagaatttcaaatcgtgttggctggcctcttttattgggacgggattgacccaaggacccaagggggggggactttattggcttaatttccgccccctcccccgtttctcttttggcaattttatgtaaattttgggatggggaggaaatggagcaattgacatcacttccatcattccatcgaatttattccagt

SEQ ID NO: 5885 - DNA, 3431 bp, Heterodera glycines
cctttgggcgatcattcggcgggcgccctttgaggggcaaattaaaaaataattgccacaacaatattcatcataacttacatttttgtgcctgcccgcggccaaattagcttaatcccccgcggtgttatgacggaaaatttgtggggcgaataatccgtcacgcggcgacggggggagggaattaaattaaattttgatgacatacggcacgtttgggcatgatgattattatgggttgacttgccctgccaattaattttaaattgacgaggagcaacgaacgcggcacagaataattttacataaaaggcgggggcggggacgcccccagggcggggaatgcgtcatcgaacgcgggcaaaatgtgccacggggacttattcatttggatgatgcgcggcaaagtgccattttcaacttttgccagccgcaaaagatgaaggacggcacagccggcgtgagtcaagcaaaaactgtgcatcttctttcattccatcggtaaaaaaaactaccgggtttcgttttgaagatggagttgtacatcaaatttgtctgctgattttatacttttggttgctttaccctacgttgaaatagctgtaatactgaccatatatgtaataagattgccagatttccatatttcattttttaattttcaaataaatatcaatttttaagcacaggggtttaaagacgaaattataccgtaatttactatattttttttaattttcaattttcaaattatgtaatatttagggtcgctacttttagtgatttaactattttttttgctcgattgttttgaagaaaggagctcaaaaacgcatttctgcgttgaaatttttcgatttggatctcactatcgatcactagaaatcactattttcacgcttcgtcactaaaatagtgaaaattcactattttggcattttgtcactattttttaactatttcgacatttttcagagattttattagcaaaaatgcaataaaatcaaaaaatacacccctaagaatcgatctaaaaaaataaaaaaaaaatacacccctaagaatcgaccaaaatttttttttaaatacaccactaagaattggaaaattttttcaaaaattctccctcaaaatttttttcttgacaaaatttttgatttaaaaaatgtcaatatttgctaagagaattttataaaggaaatgtagctcatttgcaactgcaatcagtgaataaaaattatttttgcttaatttttggctgaaaattaggtcactatttggtcactattttggcatttttactcactattttagttaactatttcgggatttttcgtcactaaaagtcgcggccctaataattatacctatatttgcagatttgaaccgtaaagcttcaaaaatccaaaaatttcaatttggaaataaatgaaaagagggatcttaaatcatgttgttacggtgaaattttcatttaacggaataattatgaaaattctctcaattttttcaaaacttttcaaaaggtaaaaaaattatatatattagaaaaaacaaacaaattacaagcttttttcatgtgaggaattaattaatcatctggataagttaattacctcataattaaaaatataccacgaaaagattatttattattatgttattatttaatactgaaaacagacaaatggcatgctttttcatgtgaattaattaaacgtctgggtaagttaattaccacataattaaaaaaataaatcacgaaaaaattatgaaaattgcttcgttattataatgtataaaaaattattaatttttatttaggcgcatttaatgaaaatcgtctgggcaaatatgaaaaattatacaatgaaatctgtttataattaattacaagttgctatgtatgttacatcataaatttatgattttcatgtgaattaaaaatgggaatctttgtttacgagggataattgagcaattgacaaattttttttctatttttttctataatttaaaaactaaattattataacttaatcaatttaaatcgataaaacacattacgtaaatgcacatttttgcacaaaaaaataatatgcaataatgttttaaataatttctattaaattaataatgaaatttatgttagagaattcggagttaaaatttcttttataaaaccacgggttaaaagtagggaccaggtcgttttgatccggtttgactggtttttggaaggccgggccaggaaaccggttggttctgaaaatatcagcccggtcaggcatttttgagaattccggtctctaatttaaattcccagtcctagttttagttccggcctaaaaatacacagcacagtacaatgaattggtcgtctaaatttgactttttgcccgaatccggtttcggggttcgacataggtcgggactaatgtcagattcagattctgcgaccttaaaacccatacaacgaaaaaagagagatgataagtttacagggacccatctcttttttaaattttaaatattctgctcgtttacatacatacctatttttttgtattttttatttttggcttggcgccaaaacgtcggcgccaaaacgatacggactctaaaaagtaattggtctgaaatttgagttccgatgatagaaatgccaacgatttcggtgtctcgagaagaaaggcaaaagaattggtgagatttgagtccctatcaagaaaatgccgagatttgtggtaaatttgtatcacgatgatggaaatgccgaaaaattggtgtgatgagacccgatgatataactgtcgatgatttgttgagattgagtcccgatgagaaaatcccgaccgaacacacaaaaattgttcaaagccgtacttcctagcgggttgagaagcgccgaatgctcatccggtgcaccacaaaatggcgccgccgaaaatgtcgccgaaaacaataaaaaattttaaatttcaagaaaaaattaaataattgaaactttttgaatttgtttttctcgacagaaaacgcacaatcacgactttttatgttaaagttttgataaaaaaacaaaaggacgcccatggttttttcccggggacctaaacagcaaaagtgctaggcttttcatttgattgacactcgagataattgctatagttttggacgtttttttaaacagactaatttgccatataagactcatttttcataaatttaaaccaaaaaagactaaatttatcgtttcgttattggcaaaacttggaattaaaaaattcaaatggaaaattgacaaataaattaaaaacattatgccaaaaacacattttcaaaggaaaatgtacaaaaactgaaaatttttttttggcaagattcgattccggccgggtaggcattttcaaaaacgacaggtttcctggcca

SEQ ID NO: 5886 - DNA, 4725 bp, Heterodera glycines
tcccaataaatttatcttagaaaaaaatgatttatccccttaattttcttgggtggctgtcgacgattgtgtttgccctgtaaaggacaatctttgtgtacggcctacgggctatagcaagccggtgatttgtgcccataaattggtgcacaacatcaccggcttgctttcctctccccccactccaattggtattttttcctgtaaatttttatcgctataataaaaaaattttcaagcttcatctcccgcccctggcacttccgaatccgtgctggtgcttactctgctccagcttttcatgcttctgcttatggtaagttttcgtctgccattattttccattaatcggaaaataataattgatagctgatttcagctgggcatgtgctgccttctgcttgcattggcctcacgaagccgcagctacactgtcaacgggcgtcgttccatttcgcgcaggtcgcgccgccgcacgacattggctgcctttcaggcacactcttcggatggtgggttctttgaactttagctcttttttattttacaatttgcattttattccaatttcagccggtgctcgcacagctgctgagcctttggcggttcccaaccgtcctgtggaggagaaggagtctacttctcgtcgtgtgccgggtatttgaaaactctcccattaaaaaagttaaaaaatatttttgttttgtttaggctgatgcgtctgagctggagccaaaaagtggccaacgagggaaaaggatgaaagaatgaaggaaggaataaaaaaaatttcggtttcgttgaacgatcaaattaatttttaatttcttcataataattttaaaaaaatctttttacatgtcttttgtatgatgtgaaaggggataggtaaactcttaactctccctctgagggcattcctaccaatattaaatatttaatttatttaccgaaaaaaaacacataataattgtaaatgatcagtggtgttttctgcttgaacattgatggttatcattcggcgcttttcttttgctttggcggcgccaataagtctgtcgctcgggcgtttttcagtgtgcactctgcacacagttcaaagttgacggcgaagcgtccatcctcagtgcgcaccacttttgcgttgttgttgtaaagtctgttccaatcatctgaattttttaaaatttctaaaataaaaaataaaagttttataacctgagcagaggtagaagcccaacatgtactttcccttggcgagtttccatagttcgcggtcctcgacttttcgcactttcgtcggcggctgctccccattatttcccgcactgttcaattggtgcttacgattggggagttttagggaattcggtgtgaggacagcggctttaatattggtctcatttttggcgtcggagctctttgacggagaaaatttgatcggggaggacattttgttggaaattttttgatttttttttgcaaatgaatcgtgattttggacggatgaactttgcgaactgaaaagtgggcggagcctaaccgattgaaaagtataaaattggcccgcttttgaaattccaccccatttggcgaatcattctaaatttttctcgacacaaaaaaaaatggccatcaacatgaacgacaagaagggattgctcaagcagctcctcggcgagtccgacatcaccgtaacaacgtctggcctgacgatcagccggccgcgtctcaccaacccgcgttttctgccgtttgaggagagcggtcgctgccgctcctgcaaggcaaccgaagtggaggtcgatacgatggtcaccaaagagggcataaccctttggtgtacgcgaattgacaaagtgcagttcgtgccgtttgatgtggtctacgatttgccgggccactgctttttccgagtgaagaacaaggcgagagtcttcaacattccgtacggcgacctgccctcggacaacacctgtgatcaaattcaactcacgcttcacgctgatgaagaacggcgtctcaagcgaaaggcgaaagctgcgctcgacttggttgagcagggtcttatggcagatgcaatgcatgatggggccagctggaagaaagccaagactgccatcggggtgctgaacaaactccctgctcgtaggaacacatggcgacaacgaaaacaaagaaacggctgctttgacaacatcggaaaaccagcacaaagaacagcaaccgccgacggcacctccgtcggaagaaatcgtttccatcgtgccatctgatgttggatctcaagcactgcccagcggtgaagtgaagctggaagaggagaagcaggcagatctcggtgacattgataagacacttgacgaattttttgcaagtctcaaggcgtcaaccaccagcatgtaaagatatttaaatcccacaattttttaaagtttcctcacatggtaaaaatgttgaattcacaagcattttcaaataaagatatttgttttaaacttccatgcggtataatcatttctggtccctcctcatccggtaaaacccagtttcttctgaaattcattgctgagtccagcgagttaattacaccgaacccagtctccattctttattgctttggggaaatgaactcagcggtaccggtgctacaaaaagcgggagttgatgtttatgcgggagtcccatcggaagagctgctcaaacgcatgccaaagtcccttttgttgatactggatgacctcatgttgtccattgatgagcgatacctgtcggagttgttcaccaaaaagtcccaccatcaccaatttgcggtagtgtttgtcacacaaaatttgttcgagaaaaggatcaaagttgcgcgcctatccgcccaatacctggtactgatgcgcgctccaaattcactgttgtcaatccgaaacattggagtccaacttttcccgcgtcagctcgacttctttctggatgcttaccgcaaagcgaccgcccgcccctacggttacttgctgatcgacatgcacgcatcatctgacccagcgctgcgtcttcgcacaaatatatttaaggacgagcaggaggaagacgaaggcattatagtgttcattcccaaaaatggaggaccatagtcaacagcagcacacaaaaataggacagctaataaaagacaattcggactggttgtgtgcattggcaaggaccagatcctctaaaaagtgtagaaagatggtgtgtcacgcaaccagcgaacagctgttagcactcgtggaaatttgtctaaatcttgtcgcttcgcgtttccaactgactagccgacagaaaagaagactgatgccctacgtggaaactgtgcgacggatgagcagagcgagaagtgaacgcggtgcgagacgtgtgcttgtgcagaaaggatcaggattcgtggggttgtttgccgccctcctaacacccgtgctaattgaagtagcaaaatcatttgtcaccaaaaacgcataaatacccgacaattttgttgttttcgtttacattttttgcaaaatggctaataaatttttgcttgttccacaagaaatttatcgagggttaacctcagcggcggatacgggagtcatcaatttggatgcagtaagacatgacttggaccgtgcaaggggtgaacggacgaatccgtcaacaaagaatgtccgatacaatcaacagcttaggcgctatctgcaaatgagaagggagctgacagatagaccaaccaaagtggagttgaccaagggattgagtgttttgttgaagcgagatgggggtgctgatgaggacgacgaagtcgtcaacactcagccacggcctcccgctccaccaccacctccaccaccacctcatcactcatctcaacaacaccaccgtcgccctcccagccttcccgatcagcaatcttcctcatctgacgatagtcatccgcctcgtccaccacgtcctcagagaacaaagaaaaaccatcaatcttctctgaaacatggtcgtttgaaccaatggcagcaaaggcgtcgtgacttacaacaacaacaaccggtagtacgtgatctcctcgctgaagcagcagctgctccgttacctgaaagtgacgatgacgatgaacaaatgctggaaggtgggtatctgctgccagcaccatcacaaaattatggagacataccagtattgcctgactatgcagatgaaattgaggaaatggacaccgcccaacaaagacttgcaagcagaagaaaattaaaagaggagcagagactagataaaaataaaaaatataaaatttactattcccctccaccatctcccacactaccacccgtgtacaaacgactagatcatcctcctccgcctcgttctatacccaaagttgaactgaaaagggatccacaaccaacaaagttgaaaaaatccgcctcgccaccgcctccaccattgcctccacatcgcgcaaagagagaaccaaaaatagagctcgcccctcctccacctcctcgcaatgtctccaaaagggaaccgaaaattgaactagctcctcctccccttcctcctcgtcacttcaccaaaaaggaaccaaaatttgaagttgacccacgaccatccacatcgaagcaagccgggtacttcccgcccccgaaaatcaaaaccgagccaaaacatgagttgcaacctacaaaaaggccagtgccataccgtatcccgaaa

SEQ ID NO: 5887 - DNA, 1401 bp, Heterodera glycines
  misc_feature (1263)..(1263): n is a, c, g, or t
catttcggcgtctgattcacttaaatgccatggcttttgtttctatcaaaacaaattccataattttgacaccagtcattaatctctttctgagcaattaatcaacccattttagctttgatttgctggtgtttcgtgccttcgctcgtcgctggcagtacaatgctcgagggcgtaataatttaaaatattttaaaataaatttgaaatttcgtttttctttcttgtcggaccctctgattcaacctgtgccggggtataaaattcgctacaattttcgaaaatttcctttggtttcttacaattaagttttttggctaaaatctgttgggtatcaacatttccctaacaaataagatctcttcgatggtgatgcgtctggcctctgctctgtacagttatgccccggaaattgtcgcctcgggcgttgccatctttaccacctacgttttgggacgcaaaaagaaagtttgcgactgatcagcagccgatggaacatagaaagcacaaaacgatgagactattctattacataaaattaacatttccatatatttttttttgactatctttaaaatcaatcatataatgtatttgtattcctcttttccaatttgtaaaaataaatgttcattttttggtcagtgatcagttcaaaagagagatttatttgaaccttttaaattaaatctaaaatttaaaattcaaaaaaagtatttttgaattttacccaaacatgcaaattaattctttaatcactttcttaatatttattataaatattatttccgtaattagaaacaattagtcgccattaaaattcctcgttgtcagcatccggctcattatcctcagcaacctgcaattatttacagccgatcaatttgcttttgattaacttttcattggttccccacctcctcatagtctttttcaagtgccgccaaatcctcgcgcgcctccgaaaattcgccctcctccattccctcgccgacgtaccaatgcacaaaggccctttttgcatacatcaaatcgaatttgtggtttagccgtgcccacgcctcggcaattgccgtcgtattagaaagcatacaaacggcacgatggaccttaaaaggatgtttgggagaaacaattaattgtcttaattgtactactattaatcagaattagtaattggactaattatgtttacacgcgctaagtctccgcctggaacgacagttggcggctgatagttgatgccgaccttgaacccggtgnggacacctgtgaatcataaaaaattgagaccaaaaaagaattaaataaaatgttaaaatatattttcaacaaatatttaattttaataaatgagttcgcatttgtacttattctgaatcatgaaaaatgcttatttcc

SEQ ID NO: 5888 - DNA, 5657 bp, Heterodera glycines
  misc_feature (5619)..(5619): n is a, c, g, or t
tcattcccgtctagaaaattctcaaaatgaacattggaatactattgtttttttggccataatgtctctcctctctcccatcaaattggatttgttggcactgaccaatccacaaaatgaatgccacgcttcgccttcacagaagcaatggccgcgttcacatcctttggcacgacgtctccacggtacagcaaacagacggccatgtatttgcccttgcgcgagtcgcatttgaccatttggttggccggctcgaagcacatgtgagtgatctcggagacggacagcgcttcgtggtaagcctgtggaaaagaagcaaacggattaaattacgatgtgaattaatcgaaaataaaaactaagtttttaattactttgtccgccgaaatcactggtgcgtaggtggccaaagggaagtgaatgcgcgggtatggcaccaaattcgtctggaattcggtcaaatccacgttcagagccccatcaaagcgcagcgaagcggtgattgatgagacaatttgggcaatctgacaaaaaaaaagtgccactttttccgtaatgccaaaaagcgaacgaacgtaccaatcgatttaaattggcgtaggagggcatctttaaaataaatcggaataaaactttaaattttaacaaaaacacctccacgtctaggctctttctgcaaatgtcgtaaatggcctcattgtcgaccatgaacgagcagtccgagtggttcagcgtggtgtgcgtcgttagaatggagttgtacggctccaccaccgctgtagccacttgcggtgccgggtaaatgctttaaaagtaattaacgatctaattaggccctggggatcgaatcggaattttagtcatacaaaaatataagttattggtgggcccattcattacctgaactcgagtttgctcttcttgccatattccaccgacagacgttccatcagcagagagctgaagccggagccggtgccaccgccgaaggaatggaaaacgaggaaaccctgcagcccggcacaattctcagcctaattgggacaaatgccatttcagggtacaaaaaagtataaattaagaaaattaaaaataattaataattattattcttaattcatttgcccttcttctgttggcacctgttttctcacacgttccagcacacgatcaatttgttccttgcctaaaatctttcttaatgcttttccccttcactttctcccatttgaattcaccgattgtgtaatggcctcgtgcgtaattgttggccgcgtcctccttgccggtgatcaattgttccgggtggaaaagatgccgatacggcccagcacggacttcgtcaatcactgtgggctccaaatcgacgaaaattgcgcgcggcacatatttaccattgctgctctcggtgtagaacgtgttgtaatacttgaacgagaaaaatcaaactaattcgggagggttttcgtgaaaagtccgattggtttaaaatgcattaatttacaggatataaaaaaaattgaaaaattacggaaggtaccatcatttgccaatttggcactttctttgaccccccccccccactcacctggcactttgcctttgaattatgatttgccgacatattagaaatgtattggccatcttccgctgcgctttccccagagcaagtgccgtcgtccttcttcagcagatgcccatcattgccaatcccatgctcaaggttgtacagctcccaacacgcgtttccgatctgtacgcccgcctgtccaatgtgaatggaaacgcattcgcgctgaaagagaacaaaaattaataaaatataaataatatattttttattttagagttatttttggacaataattataaatacattactttaaaaattattaaattaattttaaaaattaatttttatttttttctccatttaccccttcggaggatggcattccaatggattttggctttagttaatgtatttaaaatttgatttgctctgctgaattgttttgctgcacttttaaagggtgccccccccccccccaaatttccgatgcgtgtggcatttgtattggctgtcaatttgccctttgcccacttcttcagccgatgcttatctgttgtctgcgccgtcgtcaacagacggtcacttccccaattttgggttttgctgtacttttgcgtgtcattcggtgatggagatgaagttttagataattaattaattaatgcattaattgactaattttatagaagaaatttgcataatcaactgtcatgtaaatcaattttatgggagagatatttaagggatggaaataaacagttgctgttttttatatttccccataaattcatttttgaattgcatgaattttggtgcacagtttacaaatatatttattaaaaaaaattattcataataaaatttaaatcaacctaaagaagaaagagacagaaaagtttaaaaattgcaaaaggaaaaaaaagaggtaaaagtttctatatttcggtgtcttcggcagcagtttctatttgcggctgatttgcttcttcaatctctgccgctggcttatcgtcttgctcattttgttcatcaacaaaaatggaccatttgaaggcattggacggaatcttaaattaattataattatccctaatcggacatacttataaaatgattcattgattaacacctgaaaagccgattggactttctgcttggccgcatagagtgaattttcgatcacataataactcaacgcgctttgttccgccccattgcccctcaataaatcaatgaccggcccaatttgtgcgttgacaatttgccgtggcagcccaatcgccgtttggaggtccgttgacagtttggccaaagtgtctttggcacgtgtgcaaatttcgatgcgttcatgcaacagtttgtgcagctcctcttcccatcgcttcatctccgttttcgctgcgctattaagcccatccaacgccgaaaccattgccaatttcagcggtttcgatatttcatacgcagccatcgaagtttcaaccaatttaatgcggtagttatccttaaaagtgttaagcattgaaaaccattaattattacccccctccccccgctctctttccaaactttttctccgtccgtcttcgtccatctgtcaattctgtcactgatctggcgccactcccagtcgaatgtgtcgatcaattgcatcagttcgtcgcctttgatcggcggttccgcgatggctttgatctttgccgccgtttccctctccaatgcgtccgttttcgcttccaaaatcatttccgtcagaatttggcacattttctcgcccgcttttcgccctatcgtggcatttcgtttccttctcactctctgcccatcattcatttttaggtcccccaatatttttctcggcattatcaaattgttctcgctgtgtcgtcttggcattttcttttcaacatttgtcccattttctccactatttttgtcccaatttgaaatatgcgcgtccccagtgctgtggcgtctgacagatttgcgtctcattgattgccaatcatccgccgtctgcgttccatttaattgtgccattgcattttcaaatggcgcctcgttgaaataattgttttccttaatttctctcctgattttagcgattgtttcgcttaattccttcaatttatcttccccatctttgcactttgaatccacaaatttttccaccgggtcaatgccaatttcggtggccaatgtgccgaattcgatcgacaatcgctccacaatgtgcacaacttttggcacaatgccctccaaataagttcggtccgtcatttggccaaaactgtcggctcccttttgcagttgctcacagtaagcaattgccgcttcaagcggatttgccattcgttgcttaattttcttaaaaatggtgtagaaatttgctgggtattggatgggctcggtattgacaagtgcgacgagctcggaaacttttgcgctcaaattttgcaattgttcctttaaatccaaaacattctgtggcgatgggtttggcatgattgacagctgctcaactcttttgattagcttgtcgcatgaatttttgcaattgtcaaaattggcatgccaaacaaagccagcaaccccatggaatatcataggcaaaaacaacatggagatgaatatatgtagtggcatttatgaaaagggaataaaataaaatttatgttgctttaggttgccctcgaattgcttaaatggcctaccaaagcaccgcgcgtgccaatgccacgtttactttgggcactttctcttgccacattcacttcaccacacacgcccctcctcatgatgaacataaattataggagtatctcagtgtgggtgttctccattgagaaatgccaaagtaccaatgccacgtacactttacttggcaatggcaccacctactcactcattaaatgcccactcatattgaaatagtgccatcaatgaagtatttcagttagaatatcatgaatataatgcataattttttttttctatcctagagtatttcggcaattcctaatttttatctaattttgggcgattttctttcggaaactgagcttctcagatggattaatatttgtccgttattcatcgttttttattttttttatttctctcaaaaataactgaatttcataattttctaaatgtttcttgaattttgaacagaaatgaaaattttaatttctcgcaaagaaatgacccctaccgcgccggcggggaaccgttcaactcgccgacgccgactcgccagtaaattgtgcaaaaaaaatgaatgaaaaatttaaatttttaactgtaaaataaaatttagccgtagacaaaaagattaaatttgaaataaaggaaaaaggtaattaaaaatgaagaatataaatagaagagaaccagaaaataaactaacatctccagaatcgcacctttccattcgcactgattttatctatgacctatagaaagataaatgatatatccttaaggataatttgtgtttctattcgccagatgatttagaatttgttgcgcgttttggtgtcatgacaactcgtacaacaagttgccttttatacgagttgacattgactcgattctttcctatttggttgcaacaattcaaaccttttttctctattttttcaaattttaatctttttgtctgcggctaaaattttatttttcatttaaaaatttaataattcatttttgttttcgcctttttttattgggaccaataaagcgtacgattaccgtatctgtgtaatgagaaatgttttgcataaattcaatggattttataaaagaaaaaagaaacaaacaaaattatcttttatcatttcaaatgcaaatacttttttggaaatgcaacgaaaattgaatgaacaataattttattatggaattagcaggaacataaaaataaacacaaaaaatagaattaaattgaaaattaaagacattcccatgaaaagaagaattaattccaatgcgaaaagaggcagaaagtggtgggacgaactgcttgccgttctgctgtctgttgngtttgcatcagtaaaaagtgagatcggggaccgtacaa

SEQ ID NO: 5889 - DNA, 1176 bp, Heterodera glycines
ataacacagttttgccatttgtcgtgtcgccactcactctatgaatgtggtcggctcgttgtttccaagatgttcggactctttggatttgcattccccggccgccaagtacaggtagaacacgctggggaacacaaccgaagtcagcgcaaccgttgaaccaccgaagaagtcgaggacgggcccaaagctcggcacggactcggcagtcagcacaatgacagccattacggacgagcggaggacgacgcgtttccagccgaaatctgttgattaaagctgattaaatcaaatttattaacctatttaatgaccatgggggacggagaacacttcctccatttcctggttcagtgggttgatcagcagcgtaacagtgagcagacaatgcgccgtgatcatcaggttgatcgcctgctggatccacactgtctggatggaattgatcaccgactcgcggatgctgttaccgtacacagtgccgcacacgattacggtggtgaagttgaacacagaaataactgaacaacacgataacaaatgcatataagtatatgtagaatattttttaaataatttaataattattcgcatatttatacccccgttaattttaaaatttaactcactgaaaaatccgagaattgccgatttgttgaactcggatggctttttcatgtcatgttgaatggtgggaaaagcgctgtggcctccgtaggtgaacaacatggtgccgagagcggacaaataattggtgaggtcaaacgaaggcaattgcctggagggggcacagctgcgccaatccatcatggcaccaatgcaaatgaacacaactgagaagaagcgattttcaaaatttaaattttaaaaaggcccccaattttgtaattactggcaacgattgtgctaagcattccgcccacaatgaccggccaaaaatcgttgggcgatttgagcaaagtgacgggcaaaagcacaagcgcaatgaccacgatcaaatagcagaagctgatctccttgtcgagaaaggcacggatgaagtcgcgaatgtttttggcacagagcagcaggaaaacggtggtggcaccgtactgggtgacgttgacgcaaatcgatacgatagttctggaaatggaggcaaatacagacaatgtttagatacaatttgatactgta

SEQ ID NO: 5890 - DNA, 6811 bp, Heterodera glycines
  misc_feature (80)..(80): n is a, c, g, or t
ttcattttactagggcttgaattacatggaagaatttgcttcttttttggtgcatcatttaattaaatttcaaaatccanaattaatactttaaaataaaatttctcccgcaaatttgaacaatgaaattgttgcttcacaatttcttttcatccaactttttgaagggtgtcaccaatggttacccacttttgcttcgtgcaaccaaaattgaggtaaaataatgaacaacagttaattctcccatatgataaactcatttggttgggtgttgacttttttataaatttttgaaattaatttgccttcaatttcctattttttttttgactccgaaaatcgaaaaacgaatgggctcactttttgctatataacaacaaatttttaactataagcaagacgacaattaacataaatttccgagttttctgcttttttgtgcaaaaaacgaaggacaccgcctcattttttagtctcctaacggcgcctctcttttttgtatatgcccaaataaattgacacaattttctgtaacatttttttacattttcagcgaatcgacggcacggaattcaatggcgattttgtgaagaaaatgatgccccggcttgactacccggcgctgatccaagcagcaaaagcggtggacgaaagggcggcggacgaattgcccaaggaattgggcaccgattgggaaaaggacgacgacttcctcaaaaaggttggccattcctgtttttgtcagccagcaatggcatattacaaattttacggaaatgtccaaaaattggggcccaaataaaagaaaaattccatttgggactcggttggcccggaaatttgccctaaattgcaaagggatggttaataatccttaaaaaacatccataagcgaaggatttgaaaaagtaggtccaattttttaaaaaatcccccccccccctcaaaatttagattttttctgacaaatgagtttcgtccatgaattatgcttggtttcaggtccactctctgctggtcagttacgaaattgtggagggcgaattggagtgtccggagagccatcgaattttcaacatcaaagaaggcatcccaaactttttggtcggtgccgacgaagtcgaatgaatgaatgatcatcagtttatttgtacaccatttctcgaatttcaaatatttgtttttttcaataaaatgataaatgctgattgatttgccaaagtttgtgtaaaaaataaagccatttttgggcgacaaattaaaatcgacatttttcaacaaaaaattttccactgaaaaaaagtgtgttggaccttgtggggattgaacccacgccttctcgcatgcaaagcgagcactctaccactgagttaaaggcccgatgattagacaacctttcattaagctaatatccagcgacttttgctcatctttgtgttcttcatgaccttgcttatccccttctgcaaaagctaatgcgtacagttgttcaagagatgtgagtgcgctgaaaacttgtcacaaatactttatgccaagaatgagtaaattcaaataaatcgcaatggcaaaccatggaaaataaatgtctttctatatctcatgaatagggttgtaaattatatggactaaaaagctcaaaatggccaaatatggactgtaaactgacaaaatatatgtgtaagccctcaaaaattcctaaaaattgatatattcaatatttgcttaattaaacttaaaacataagataaacaaccaaaaaatccaattaataatagacgtattgttttccatccaaataaatagttgttaaatgaattagaagcttttaccccagaaaaatgaatcattggaaaaaatttcaactttttgttcgaattcaggtccggaattacgcaaatccgagttcagattcgtaatcagcaccctcgaaaactgattttgagcccaaatttaaaaaaaaagttaagggacacccattctccaggattgtcgaattttttttccaaaatgtggggggggcaaactacagaattaccaattaagcctgtgtaatgcatatgcacctgcagcaagaaattaaacaagtcctatttattcatttgtgaatgagcaaaaatcaatacaaccacattcaaatggcataatacctaatccaatatttgatcacataatcgcatcaatcaatcagtcaaccaatcaattcatttcttctgtttgttgctgatcagtgatcacttggcctaggggaactgtcgaagagactgaaaacaaaaacaaagtaaagatgtaaaaagtgtttggatttttaaaattgttcacccattgtcgactccgtcgcatctttcgaagaagctgaaaatcatttaaaggcacaaattgtttacggatttcaatgcttactggatcgaaatttttaagggtgaaccaaaatgtcacattttccctctaaaactagttgaccagcctgctgctgcccaccttaagccgtctgtaaatttcacgcaacgacagcctgacgggttcttcgcccccgatgaatgtagtgggtcgcaacaagaattcgcgtgtcatgtcctgttcggtgaacccgtagatgtaatccaggtcggcgatgttgtggccacgagtcttaattcgaaaaaattgttacccttcacatgcccggattgtggatgttggtcccaaccacccgacattttacaaaaaaaagcatataaatgaagaaaaagaacagagaatccagtcacaaccaaggtaaaagtaaaaaacgacaatctttgttgctctacatggaaaccaaaaaattatattcgggatttgatttataaaaacagacctggaaactccagctgtttgcggctgcacctcacgcatgtcccgaaaaagccgcttcgcggcggcggcatccaattgggtccgcgtcagcatttttttttgctaatgaaaaaaagaggtatattaggatgacaaatatatatatatatatatatatatatatatatatatatatatatatatatatatatatatatatgtttcagtatgttatacaattcaatacacaaatatgcatacgatcaatattaaagttcatcggcacatttacaatgaatatttatttcatccacaatatattttcatcttccgcttggattgcgcacacttccttctcatccctcctcattcgttggccatcagttcggcgagcagtttgggcctagaaaattgttgaaaattaaaatttcaaaaaaaaattcctcaaaaactccacccaatgtcgctgtccttgatggtgaagcacagcaaattgtccaacatttggtttgcctccttctcccacgcgttcactgtgcactgatcagtgccgttccggcatcgtacaatcacggcatcagcaggcactcgcgaattcagcgtcagccgctcgtccgtctcttcattctcccgttccatcttctggaagttggtatggcatgcaatgtgacaaatgacgaggaagttgacagggacggcactcggagcgatgaaaaactgtaaaatgattgaaattattgaaaaaaaattggaatcaaaaaatgcaaatatacggttttacgcgtcccatgaatgactatcatcctcagtttctttgggcatatcttttttcatacttggtcaatgcctatattcttggtatcaaacgaaagcttaaagtctacagaagcttttgtataactaaattctcggctaaaagcaatagacaaaaaattattcttgaaaatactcgaaaaaccttgaatttcatgttttctcattgtaatttcttttctaatgcaagtaattgctgttttcttggatttataagatcccgagagttcaagcttttgattggtaccaagaatataagcattgaccaattaagaaaaaagttatggcctaagaaactgtggatggcatgggacgcgtaaaatcgattagaaaaatgaaaaaaatggaagcaaaaaatgctgtaaaatctttcggaccgtgattaagcttggcatgaacgaagcccattgcggtttgcgccacttgcgaattgtcacaattttcggacggccatccttgcgcggtgtgtgcagccagcggaacaggttgtgcttcggcttctcatcgaactcgtccggcgggttgagcagggcattgatgtgcacagcgctgggcggcggtcggatggggaacatgtgcgtgttggtgatggcacgaaggttagcacagtcgaacagcacattcggcgacacatggcgacgcaacagcgcgaagttgacggctttcatgtcgttcagtgcgaggacggcgtgcgaaatgagtggccaaatgcgttgcgccatcaccgcccagcagcggaggtccgtcgaatggatggtgaactgcacagcgatgccgcgattgatgacacgttgcaggcactgcagaaatgcgatcacttccaggtcgacgtacctggaaaattagggaatttttgaaaatttgcaaaaaaattttgttcgctaagaccaaatgtagatggcactgaagctaatcacgccgcccggtgcaggacacgtggcgagcggcagtcgattgatcaacgcgttgtcgtccataacggtgacagccgccgtgccgcccctgtcccatccgcttggtgcacgatgaacgcccagctcgcccagcctccacttgcgcaggttgaaatgcgtggctaccagcttgccgaaacgtgcgtcgatcagtgcaaacttcgtgccaacttcagcgcggtcaatccaaaacagagtgtccagccaaacgtcgtttgccacgcagctgctgaaaattgcaaaaatttaaaatccgattttttgtgaaattttaaattcgagcggcttacaggtcggccagcgcagcatctggatggtccgacattgctcaattgtcgtcgttttcgttgtacacagagaagggatgattgatgaagatgaattgccgataattaataatggaaaaatggcaaccaaatgaattttttgtgccttttatatatgaatttatccgaaaaatttgactcttccgactaaaaaatttgctatttaaggcccacacattttgcttttccacgttcattccgttcattcattccatccacttaattattcgtcctcctccaccgccacttaaatcgtcagtttatttaggtaattaattgttttgttatgtgcattttcattgtgctaattgccccccccatttttcagcgaatggccaacgcaatgtacgcggcacgggcgcgcgcggccaaggcggaaaagcgtcaagcgcagctgcgcaaggcggccagagcaagggcaggaaacgtaagtttagattaaaaaaatttaaaaccgaaaataattttccccaattgttttcccacagaccgccaaatcgcgacgagccgagcgctgttcaatttgctggggccgactgagccgaatcacgcgtaccacgatgggctgccaccatccgctgcaccgacgctgcctctacaattgggtgcgcgtcaacttgttttgtccgatgtgcggctacaactacacgcgcgggaggccccgtgatcgccatggacgacgcaccaggggactccatcgtatgacgccggatcaggtgcgacgtgaaatggaccgcatgcgtcatatcaggcgctgatggaggaggaggagaggtgggttttgttgaggtgtgggacgggggcagcagggaggacgagtgtaatttttggtctgtttcagtttggtgttttgtgggggagggagggtaatgccaccaccgatggtatcccaccccccttttcgaaaaaaaaattttcaaaattttttagagcggttttcaaggtcggggaatacgattctaacatccatttgggccgtgtgttgggggagggggcggaggacgtgcaatttttggtcctgtttcagtttggtgtgttgtgggggagggagaaattgaaaaattcagaattcattggactcaatttatttttaattatcatttttttgaattttcaggcccggaaacgagaagtcgtcgcaatcgcatggcaaacggcggaaggatggaaagaacggacgacggatcacacaatgaatgattggccgagtgtatttattgatgtatttgtgatggatattcactcatttgttgtctcatataaccatgtcagaacacacgcattgtttgtatcacttaccattatatttgtactgaattgaatgcataaaaattctgtttgctattgctgtttctccatttgcgccaaatttgaatttcaaaaatagaatttttcttttttcgactaaaagtctaaaagtgaaaattttgattttcgggtctaaacgcacagaaacggaatggaaaatcatcaaaataaaattttgaagcacaaatttgaaaaaaaagtgtcagattttggtttcgttttagagcttttgcttagtttaaaaaattagaatttgtcttgcaattgccgattatcccatggtgagtgttctttgcttacccgcgcctcccatggcatttcacgagtgtccccataaaatccgaaaccgttgaatatcctatcaaatgtagtaggccccaaaacattttatttttcagtctcaaaaatgctatttggacgcttaaaatgccacaggacgaatgaaatgccgtgatggttggacgcataaatttaaagaagtccaaaaagcaacagtttcaattcacaagtgatttacaagggcttacagctttattgtccgaatacattcatataatatatacatatttatgtacacataatttgggtgttgca

SEQ ID NO: 5891 - DNA, 1436 bp, Heterodera glycines
taattagtgcgtgagtcattcctaacacgaaaagaaaccttgaaagcggcggtgagtctcccgtttaattgaataaattatcccacaaatgcatcgacgtcactctctctctgttcaagagtcaccgcttttaaatgctcaatttgtcatcatcacagctcagtggtggatggactgggtgtatttttcattccggatcaagtcctcgacttaatgaattgattataatagaaaattacgactcgatgatgccaaaatcgagtggggcgctctagatttctttactcgagatttaatttaaacagaatgctaaaatcgagtgtggcatactcgattttcttactcgagatttaattatgcaattgaaaacagaatttttgcattcaatattgcgcaaaaatcaagcaagcaatcaagtcgaggggggacgtgagttgatccaaaattaaataggaaacgcgcctctgctgcctgcagatatttccacatttttaggcggggatgggccatttttatccccgcaggcggagggggggggcgggagaccatcacattcaatgccgaaaaaagctcaccactataaaacacgaatggaccaatttttatgcacacgagaagaacacacgtgacaaaaaaaaatgatgggacggacggacggaaaggggagggaaaggggatgagttggaagaaaaaaaatgtgagcaataatggaagggttggagaacttatggggggcaaatgggtggtggtggtggtggtcataggtcggctgactttttaaaaagtgaatttggaaatttttgtgaggggcgaaagttttgtcggggcggtaaaatgctaattaggcagattaaaaattatttgtatttttagaataaaattttaaaaattggaaaaaaaagaaaataaatggaaaataccgggaaaatttgaatgtttgatgattcaaaatcaattaatttattctaaaaaattggaaaaataaacaaacagaaaatattatgaagatttgcattttcaatttcaaaagcaaatacctaattaattaattagattctcttggaagagcaaaatgtttgtttaatgaaggaatgaccaaagaagtgtggtgcacttcagcaggaaaaaagataaaaaagttttgctgttatgataaaacaaacaaaatttcgtaattaaatgcacattaattaatgtgagttgaatcgaagctcaagaccacaaatgatgatgaattcgagactgacaaattgaggcacagaaaatgggtggaaattttcttatcctcaacttaaacttttcccataaatttattttcttattttagccgattcaatggataatgttgaaatttagaataaaaatttagtaatgcgttgatttaattatttattgactaatatgataaatggatttatattgacagagagaatttc

SEQ ID NO: 5892 - DNA, 7283 bp, Heterodera glycines
  misc_feature (13)..(13): n is a, c, g, or t
ggagacgacgacnggtggggaaaatggggaggggtccttctccccaccccacccctcgcccctttttgaatttaaattccttgagggctttcatgggaattttttttttcttataaattgtcgggcgggttaaaaattgaaagaagacaagaaagagaaaggggtacccaaagcatttggaattttttttgttgtcgcaaacaaaaaaaacaaaagaggaccccgtcgtcgccgtttgaattttactgcaaattcctataggggcaggaattattattattttttgaattggttagagattaaaattattgtatttaaatgtgtaaagatgtgagaggaagtaaaatatgaaaaattacagcatgtgttttaattggattaatcgggaataaggccgaatggaaaactcaataaagacccgaaatggcagggccaaactcatcgaaagacccggaagtgaaaaatcattaattttcaaaatgttcgaacccgaaaatcgcccagccttaatcgagaagaggtttaaaaaaaattaaaattaacgtttggcagagagagaaaataaaggctctcctttaaaggaaatggagttaataaccctaggaatttcaattttcataagccccggttttttgaaagaaatcccaatttttttcattattcaaagccttactgtttttcacaactgtcggtctacccaaaagtcatgggggaaaaactctattacgaccaccaccaccaccaccattatttttcttcaagcacaaagtcagcaaaacaggctccacaaaacgccggccgaccgtcggcgggcggaacagaacgccaaacttttgatggcttttcacattcatgcggcgcaacccatgcccatgctgtgtgttatatgcaagcattgatgggagcgccgtgatgaaagtgatctgatctattctgtttagcggaatggctctactctggacaatagattgggattttatttgtgacagggcagaaattttggaaaacggatcacaggataaagcctgatcagattagcataaagcctgaattcagcgtaagttttatgaatagaaaattcgtgtgttacgcctgacccacagaaccggttcaatccggcaccaaatttttcttgtgccaatatcaagcatgccatgaaaatcaattgcatatcagggaagtgtcggaatccgattcccgaatttagggctatcgaaagataccaagaatatgtatgccttaatatttttcgggactagaaaaggaattgaaaaaaaaattagacgaaaattgtcatcaattctttgattggttttggcgaaaagtgtggccaaaagcgggggtcatcaaaggcaaaatatttatggccaaattgatgagcgaaagtgctataaagattggttgttgtaatagcacaatttcttgcaggaaaagcacataaaatgcaggcacacacgacgcacgcaaacattcattcattcaaataatttgttgtaataaaaatgattattgcaaaaatgatttttgttacaaaattttatggccaaagggtattataatatgtggccgaccaagcaaatgaatgggcagggaaattaattgttatgtggccaaaaccataatccaaaacacaacaatgaagtagggtttcaagggcccgatccgggtattgccgggtccagaaaagccgagtccggggtccaagtttttaaaccgagtccgggtccggaaatcgtcttcaatcagaccctaaaaaattactcattttttcaaaaaaataatgaaatatttcactaaatatttaatttatattttagattaattcaatgagcaaccaaaaatattttaagatttagtaaaatatcaataaaattttcaattttacaaagtggggaacatgaattgtgaagagtattttcgtaaaaattgaaaaaaaaatagaatttatgcacaatgaaatgaccatctgtgattatggagcaatataccgttattaggtgcgcttttttgcaagccaaccgaagaaagaatttgtgccagatggttttggtaaaagtataaaaaaaaaaactaaaaaatgcctggggaggggatcagcaaaagtgcgagaaaaaacggctggcagattgatcagtgacgaaaaacgcaaatgtggtgtcagaggctctcggtcggttaaaaaatgaccaatggtcgacatttcttacactaattgtataaattatggtgtaaaaagcgtgaaattgaaataatttaaattgttaataaccaaaaaattatttgggataaacaacaaaacttacaacaacaaaaaatgataattcgttcaaaaataagaaatttcacaactaattaagacggttagatagcctcggagcccaatgaaaaaaacgaaattgactcccccctggtccacttgaaaatatgaattgaccccccccccccccttttccatctcaatgatcaatgtcccgagatgagagaatttgggatttttcgggatttgaaaccattctcgagagagagctaaagaaaatcgcatctcaagcaaccaaaacataaactcttaggaaaacgagaaacatcgtcctcaacccaacaatttggagcccaaattcatgggtttacatggaaatttgttgggtggttctgttctgtgctgatcgatttgtgcgcgaaatgcaaaatgcgtaacttaaataaatattttttttggagacggtggacaacaaatccgaagacaatttgcgcagggaattggaggagaagcgagcggagagcgcaagaagaaaaagaagaagccattcattattcattgtgcaacatcagcagcagaaaatgggaaaaaattgcaggattaaaagcattttatgaacaatttttgtttgaaaaacaataaaataattgtaaaatttaaaaataaaaataaaattttagtgtttatattgccaagaaaatggtgtccacataaattttttggtgcttttcaattttgtggccaaatttttctcatcgacaaatgactttgactcctttgtgctggcattaggcctcataaatgttttgggtgcgcattttttgcatatttgcctcattttgattttaaaaaaaattcaaaatttggccataaaattgaagtgttgtgccaaatttgaatttgatggacaaataaaaaaattgtattatattttaaaaattgtgcaaagatttatcccagcagtaaatgctttgtgttgtcaacaaatttatggccaatttgaatgaattggtggcccgttttggaggaaggggctaaaatggccaaaaataaagggatgtgctgcacaccgatgatggtcatccatccaacgccttcccaacccatcaaataatttggggcggatgacgcgcggcgcgcgcatacaatggacgaggcggggatggacgacgagcggtcgcgcagatgtctgtccgtgtcagtcactccgccgcggtgaccccccaggggatctaaggggcaagggacggacggggccaatttctgccccgggggacagttttaatacggtcttttgtgtcttcaccggtctctgcttttaatatatattggtggtggtgttgtggatggaggtgctctttgtttgtttacacacctgccgaccaaccgaccaccctcaacaaactctctgctcaaaatgagttagttcgttgtgcgttcgatgctcattagtgtgttcctgcacaaattagggccaaataatttggggattcctaattaaattaattgttgtttttgactattgttgaacagccagctaacggggattggaaaactgaataatggcatcaagaactaactgttcattacctataatcaaaaaaaatatagaaaacaatttgaaaacccagaattaaaaataaaaataattttttagattattaattttcattttttattggtttcatccctcgttggccgttgtcactttaaattgacgctcacgccaatgccacacctttaggatttagaatatgtagctaaagttttagaagttacaaaatccagaaaattttggatgattttgaagtgaataataaatggtgtgtatccatgcaacccatcggccgggctggggatgtaaaacgaaattattgccctcctccggcagccggcccaccgaccggcggcgggatggacacgtacgttcataaaaggtcatgcgtgaccgtttatgacgatgacgatgacgcggaccgaccgaccgcaccgcgcagcagcagcagcggcaaaacgcttagggcggaaaagtgcggcgccgccgcgaaaacagcgcccaatttaagcgggcgaatgaatgaatgagaatgtttgctgtttgttgttgcgctgtgtgtatgtgtgaaaatgtgcaccaccaaagcaccagcaacaaaattttcattttatgggagaggaaattttggcgacgacgacaagaaaattggattggacggaggagaagagggcaccgatagtttgttgaatttgtttatttatttgagaaagaaagaagaaaggtcagccgaaccgccgcagcgttgagcaaaattttcaaatttgcacatgcaaacagtatgccaatcggtcgggaagttactgtatcggacggcgacaggaaaatgcatccatcacccgtgaaaattttttagaaatttttaatgatgcctgaggattaagtagtgctgctgctcctctgttcgagagcgaaattttttcaaagactagaccaaaaaaaaattaatttttcaaagaattttctctagtcgagaccgagtttttctagaaagcagttatggtagccctaaaaaactactggtacacaaaataatctttggtactctttggtactaacaataaaatatgatgtaaaattattctattaaatgaaagtatagcgatttttgaattgtttttatgttgaaaaactttttgattgcgaaattttttagtgtttggccggagttttgtattattttcttttcaaaatttaaaaatagaaaatgatggccagcataaaccacacaaaaataagccgatttttggtgaggaattttttctacgatgggtccaaaagacaaacaaaaataaagaaaaaaatttttgcgaaaaggcaaaagaattttctcgaggacttttgagaggatttttgtgagataattcacgggagaaagtgaacgggcaaagaaaagaacagtaaatattcgcttagattgttgaataaaattttaaaatatttaaaaaaataaaaatggagttaaaattttgttaaaaatgtgaggcaatgaaaaatgaatgaaacaggaggcattcttgatatttttgttaaaaattcagataagaaatctttaaggcccctttctctatatgtaactaataaaaagatttacaaacaatttaataaatatatatatatataaaaataaagttaatttgttaaataaaagtaacgtttcgttgcgtgacaaattttaattgaaaaaattaccaaaacgccaaactttccaaatagaggaggattaaatcagaaaatgtgtgcatataagcccctcgtgatattttatgtttagttcttaaaaggaatctcatggcgattctgtgtattattcgctgggaatgttttgttccaaaaatggcatttgccgagaaaggccggtccgttatgtgtgtgccaagatgggatttgttgggaagaacggcacacccccgccggggggggggaggggaggctaattgaattccgattttaacgagagagatggggatgggcttagcacaagcagcaaaagggaggaggtggtggtaattggccatgggttttgtcaaaagttaaaaaagtggatttgctactgctcaaatccacataaatccctactaatccccctcccccgcccaattatgcaaatttgctaaccattttgggggatgaactttgttgcaaaaatgaatgaaatttgagaccatcaaatctgcagtgagtgctagtagctaatttattttgaatttttgaaaaatatccaggaaaaggcgttataagaattctagatttatttaaaaaagtgaatcgaatagaaccgaaatttaatttaagttaactaatttaaccctgaaaagcgattaactaattaatttaacggataattattcaatccatatcactacggtaaaaataaatggtactacggtatcaaatttaactcaactaattgaggccaaaattaaaaacaattccccgacaatggatttccatggtttcttcaaagagagatgaaagagaagaaccagtgaaaaatttggcttggttcgacaactcacagctggagggcaaatggatttatgtgatccgtacgtccggacaaatgctcagctccagctgcgcccgggggaggggggggggggggagcggtgttttcaacatcttttgagagggttcaaattttcgccgttgaaaacccataaatcttatttgattggttcaattttaaaaaagcgataatttatatatgtttgattgttaaaaccaaagattttaatttttttaattattttttaagttaaataaagctcaaaaatttaacttaaaaatccttttgattcaagaaaagttaaaaaaacagaaaaaaaataaaacttaaaataaaaaaaaaccttaaaaaaagaacaaaggaaaaaaaataacccagttttcttctaaaaaaaaaattactttttgaaattattgttttagttaaataaagttcaaaaaaattaaatattgtatattaaaaatacaaaagtatctatttttaaattattattttagttaaaaccctcataaatttgtgaaaatttgagagaacaatttagacctacgcataaaccaaattttgttttgtgaatgaatgaatgaatgaatatgaattatatttgatgttttctttaatatttaaaaaaaaatagtaaaacgattattcaaagaactgaacgaggcgaacagttcaatatgaaaatcactgaacatttgttataattgaaaacagagttcatatcgtatgcttttttgaaaagtacagtacctttttgtgcttttaaaattagaagcgtaattttttaaaggaatattaaaaaatgaataaaaattttggcatttattctgtcaattagaatcttttttaggataaaacgtgttattaacaaatttgtgcaaaaatttaaaataaatattttaattaaatttacccctttttaatgcatctgatcaatttttggtgtgttctttgaatttaca

SEQ ID NO: 5893 - DNA, 2403 bp, Heterodera glycines
  misc_feature (2295)..(2295): n is a, c, g, or t
cctaatcgagacattgtggctttcgagcactcttctactctgcattacgatgattgtcggctgtgcatgctgctcattacagtaattaaaaaaatatttttaataaaaattagtcacgcacccctccaatagaagcacttcccaaaaatagagtataaaattcaattttccaaaatttaaaagttaaaaatataaaatctaaataatcacaaagaaattttattggactcaaaaaaagaaactacaccacgtacaacaactgatctggacgcgccaaaaagccatctttttccggaatgggtcaactgcgtcccgccagctgtgggtcgtttcggcgccgaggtttcagtgccaaaaaatacctagctcagtggccccatgacttgctctggttttgcatgttcacctttgcgtcgttgtttaattaattattatttttttatttggctttgtgcaaaacgttggcgccgaatcgttggcgccgaaatgacccatctctccccctcacccgcctctccaatagagcctcctcccctctttgaaggggtttgaaaagccgaaactcggggtgtcgtcctcccccctattggtagaaaatatgaataattttcaataattttctagattcactcgaatacatcaacgacaacgaacggcatctgtgggtgaagacattgaatttagcgaaaaattagccaaggacgcatcgccaagctttgggcccagcatttatttggacagcgttagcggggctccggaaaagcttgtgtaaatggcgaaaataattgaacgcgatgttttttgtatttctcttttaataaataattttttactaaaatatagaaaataaattgcgaaatattgccattttcaaaaatgccgaaatcaaacaaaataagaatatattggggtgtttggaagttcttgccctccaagaaaagtttttttattttaaaaatcataacaattcaagtaaaaaagtaaatttaaccaaagtttgccaaattattctcatatattagccactactcttcaccaattaattacggttttcttggcatcataaagttatggcctcgtgaattggccaattgtcacgcaaaaacaaactcacattgcaggaggcactacctagccccaaattaaaattttttttctttctaaaaagttgtgaaaacatgttttatggggtttttatcgtcgctgatcacgaatctagaacataaaagtgaattttgaaaatttgtgttttctactttttgttcgaattcgggttcgggaccgaatttgatcaaaataaatgtttgattcgtgatcagcgaccctaaaaactttcacgactttttagaacagaaaaaaaaatttccaaagggggggggggggtggaccatcggcagttttacccttaattgctgtgttatgattttttgaataaaattttcttcgagggcaagaacattccgaactccccaatagaaacaaatttttttatgaaatttaattaaaaatccattaaattaagtcagactcaatttattaattttatttttatgtataaaaggaataaaaaatctaggaaaattcggattttttttaagattttttaaaaaatctttttgatatttatttaattattattttatttcgctgataaattttaaatatttttttataattatttaaaatgccagaaaatgtttattttagaatataagaaatatgcatatactatgaatatatagaaaaaagcccacaaaattatctaagcatataatgaaaattgaatcattccgccataactgaaaatatgccaaattcaattaaaaaaaaattcatcagcacgcatagcacaggtaacggtagcccatatacagaaaaccgcagcgttcccatgttttgtacgtgccgcaaggacatcccaaatatttcgcgctgttcaacacagtgccacaactgctccaaaacgggctgcaagaaaatggggggagtgtattaatttgaattaattaaatttaattgctataattaacaccacttacggggccgacgcgcggtaggccgacgcgccatacgtgcggacaagatgacaaaagcctggtccctcataaactgagcagcgtgaactgcctagagttgctctcttaaaaaaaatatagaattaaaataggaatttaatggcaaacactaaggccacaaatccccgacttttttatgtccttccctgaccctgcattcccaaccgtttggtagaccagactttatttgccctttccgatcctgaattcccgactattntgtgcccttcccacgataataactaactccccgatgttgcgatatccggaaaatgtcttacttctaagcatcacaaaaaccgtcgtcgcactttgtttgtcccaattg

SEQ ID NO: 5894 - DNA, 1683 bp, Heterodera glycines
  misc_feature (23)..(23): n is a, c, g, or t
aaacgggctgcaaggagatggtngaagcaataattttgcattttgattatggtcaaaatgcaccagaaaaatttgttttatcgaaaaattcgctatttatttttcttcatttccgtttaacccctgtgcccaaatcaaatttggaaaaattcataattttcatatataaaatccgttttgcccacgcaaaaatgccataaaaatgtatggctatagcttccctagattagcgctgggttactacgtcatagccttgttcgacctgcacttagctatttagcgcctagcccaactgtcgccccaattttgtgaaattaattgcctctaatgaatgctgcacacttacggggccgctgcgcggtatgccgattcgccgtataagcggtaatgacgacagaagcctggcccctcccaaattgagcatcgttttttgccagcagtggctcgctaagatttatttattttaaaatttgaatttttaatttaattttaaaaataaatttacctccatacattcacagaattggttgtcacagctcttttgtcctatttgcttgttgtagcatctatattttaaagttgataccaaaattgaagaaattttgttttcgattaatttaattgaaatttacctaaaaaatgtcgctaattatttttggggataattttgtaaaaatttatatgtgtttaatccaattccttactcagtctgcacgtagcaacaattgttcatccgatcttaatttttaaaaacaattaaataatgcattgaataattaattacatttaatcatttatttacttttccgtgatgggcaatccgtgtccaccgccgcttcggtgagtgtctgaaatattaattttgaaaatttaaattttgattattttaatttggccaattaatttttttacgtcggtaatttcccatttcattgacacgccgggcttttcccattgccatttggtggcacatgaccacatatgttccattgtctcatatttttcgcccgaagaatcgccaccataattgttgttgttgttgttctcatgtgagtagccaccaggtggaccggcaccatatttgccatcgtgctcatccgacttatcgtatttgccagaaatgccaaggtgaacaaatgccaaacaaaaaattgccaaaattgtcagtgccatttttcttataatatgggtaattaatttaattgcacaagtctcaatattccctagcatgtaattgttttctaatgaacaattatgctaattgtaagcaaaaattggtaatggtaatttgtaagtttttcgtattatttattaaattggttataattttaaattaaaatatttaaaaaataaatgtttttaataaccaagatttattttgagtttaaataaaatgagtgaattcaattgaattgcccatttctttatatatgcagtttcttttctgcaattagtttataaactcattaacgctaataactcattagttaatcaaacaatcataacgctactaattaaccaattaatttcaatcaagttattgtagaggaagtcattttgcaattaggaaaaatttggaaagtttaaattgtgcgcagcagtacaaaacgtttagcgaatggactaaaaaacaaactttgttcaacccaaaaaataggaaaaaataaattgaaaaaacaagtt

SEQ ID NO: 5895 - DNA, 1333 bp, Heterodera glycines
  misc_feature (46)..(46): n is a, c, g, or t
tagtaaacatgaaatgatcagcagaagtgccgaaaatttaaatatncaatgattaaggatttcaaaaatatgtacaaaaagtggtaaaatatgttcataaacatgcaaaaaaattacctaaatatgtacaaaaaccccaaaagtactaaatacgttaaaagaaaataataaaatgcgcgccacttgagaaaatgtcaaacactttatctaaataattgggctaaaataggaaattctaaaaaaaaaatataaaaaaaaaattacaaaaaaaccgaaaaaataatttaaaatggaaaaggaagacagaagaacaattaaatgaaaatgaattggaaccatgaaaaatgatcagcagaagagcccgaatcttgcgggtagttcccaaggtgttttgataagataatcttctgcattttcaattgttttttccaattttgccttttctgccttggccttttcattggcattttcgcataaatttttcatttttcgttcaaattcctttcgaagtttggcaatgtttgtttgtatttctgtttttgatggattttctccacttttctcctctttaattccataattcaattcttcctcattttgcaatatcatttcataaaattgtaatttattttcatcagttttcaaaaaaaaaattcaaaatttctctcatattttttacaacagaaactaatgaattacgatttccattgtcaaccgtaaatattggcttcaccgctggcacatgataagctaattcagcgttttcaccttaagaaacaatatttattattaaaaaatcaaatattactaattaatagggtcgcaacttttaggtacgaaaaatctcaaaatagttaacttaaaacggtggggaaaaatgccaaaaaagtgacaaaatagtggcaaaaagtacgaaatagtgacgaatagtgatcagtctaaaattaagcaaaaataatttttattcacttattgcagttgcaaatgaggtacattttcctttgaactatttccttagcaaatattaaacatttttaaaccaaaatttgtcaaaattgggggaacaatttttaagaaaattttccaattttagtggtattttagaaaaaaattttaggtcgattcgtaggggtatattttttggttttattgcatttttgttaaggaattttccaaaaaagtgtcgaaatagtgaaaaatagtgataaaacgccaaaatagtgaattattttcaatattttaatgaaaaaacgccaaaatagtgatttctagtgactcatagtaacatcagaatcgaaaaaatagtataacactaaaaattgcgaccctacta

SEQ ID NO: 5896 - DNA, 3811 bp, Heterodera glycines
  misc_feature (3757)..(3758): n is a, c, g, or t
agaattttggatcctccattattagtcttatatggttgcgttcatttattttattggcttcccgtggatgctctattttccaattttctaccgcttttttaagcatttcctccaaatttttgtttctcacattgccaattcattctcataaaatacacagtgccaaggtgagttacatatttttgctttgaatattcaccaatttcaatttcttgctgaccttgcacaaatgcaattagcatattatcgtcgacctaattaataaaaatagattagtaaaattaattgcccctattaattaaattaccgatggatttgcatttgaaaatgagaataaaaaatgataagaaataataataaaggaaattaaagaaaaggaagaaaccatattttttttttaatttacaaaaatgaaaaacatccaattcagctcgccttaaaaacggaccaattttcacttaaaaatcaatttgccaacaatttaattaaaaaataaatgtaaaaatgcatttataaaattatgacttaatacatctaatagtaaaaatcaatgcaaattttgtctaaagtaagaaaaatgtaattatacaaatattatttctaataaatgtagagtaataagtccaatgttgtgaacagttcgatatttttaaattttagttgcaaatcatttcattaattgacaattttcgttcattttccaattttcttccaaaattgaatctcgcctcattataattatgattatgaaccaaaattattgaatgagaaaagattgaagaatttaaattgaattatgaatcaaaattgattataaaacaaaaatgaaagtttaaacggaataatacgacattcggatgattttgcaatatttagttaatcttcgtgctaattatcgcatcgagtgaaaaacgattatttcaaattgatgtgtatggagacggtcgggacgaaattgttgattgaccatcagtaggattaacaaaatcaaatctattttttattttgagccatttttcaaggaagtccaattacttttaaaaatttagtaaattttttttatagcgtttcaattggtattgaaacgatttcgacaaaaaatataataattagggttataaattatatggattaaaaacaccaaatatggacataaaatatggactaaaaaagcccgaaatatggactaaaaagcttaaaaaaggccaaatatggaccaaaatatagactaaaaactgccaaaataaatctttaaaaccctaagaaattccaaaaaaggtatttatattcaatatttgcttaaacagacttaaaaatacgctaaaaactgctaaaaaatggatttaaccataaaaaatgcaaatttctataaattttagcttcacagttgcaagccaaaacatctcaaaatttttgtaataatttcattttttccaaaaaagccaaaatatggactaaaaacgcaaaaaagtcgaaaaatggatttattcccgaaaacccccaaaatatggatttatatggactaaaaaccttcaccaaaccaaaaaattttaatgtagaaatgcttttttgagcccctttcctaaatgaaatcaagaagtaaaattaattaccctaattaattgtctcgtctgtagaacataaatgtaactcgcccgatgggaatcgaacctacgcactttttattttatagcaattatcaaatcaaataaatttaattaacacaaatagcaaaaataaaaagttaaatgaaatttcaataagcgaactttttatttttcaaaaataagagctcatgttaagaaaaaataaaaaaaatgatataagcgatttcccgaaaaagcccaataatataaaagaattctattgaagttctacaatattttatgaattattttcgatttcaccaaattattacaccaattgattataattataataatcgcattattgtaaattaaattaaattaaaaaatatttaaaccaaaatgaccacaaaaagtaaatataatggttgttttttattatgatgattatttatttatttgatggccatgacgagttaatttaatttaattattttggtgtttattttaataaattaaaattaaatctattattcgtttaataaaattttaattttgaacatttaattaaaatatgcctatgatttttagcttcatatttttccgaattcaaagtgaaagcaataataacatcataatatgtttataactaaaataccaatacaataattattttgacggcaatttttaatgaaaatctttctgattaacaatagcacaaataacggcggcccaaatacagaaaaccgcaggtctccgatgttttgtaggtgccacaacgacatcccaacgatcttgcggtggctaataaactgccacaactgctccaatatgtgctgcaaatggggggaggattaattggcaattaattaaaattaattgcccttaattgacctttggtgctctgttggtctatatttgtcgtatgaagaaccgccgccaccataatggttgccgccaccaccataatggttgccaccaccataattgttgttgtcatgatgatagccaccagaagcaggcggacgagcaccatatttgccatcgtgctcgtccgacttatcgtatttgccagaaatgccaatgtgaacaagtgccaagaaaagaattgccaaaagtgtaaatttcatttttaaatttgctaaaaaataattaaaattgaattagttgagaacatgaatgaacggagatgatgatttaataattattgtaagtaatttaaatgtttatgatgaaataaatgaaaaattatttttcaccaatttttatatgcaattctttactgcaattagtttaaatgcccattaatcctaaataatttaattaatcaaacaatcataacgctactaattaacgaataatgaatgcaattaatttcaatcaagttattgtagaggaactcattttgcaagcataaaaatttccaaattaaattgtgcgcagcaatacaaacgtttagcgaatgggcaaaaaaaacaaaataacttcacataaaaaatggaaaaataaattaaacaaaattaggagtcaagattttctaatggacgcctccaaacccaaaaaatgaaaaattaattaaaaagtaattaaattaatcataattattttataatgacaaaaagcgaaaattgataatatcattgagaattaaaaataaagctcaattgacatcataaattataaaaaagattcaataaaccttaagcaaatagagtaaaataatttgattattcaattgtaaaaaatcgataattttggattcgaaattcgatgattcaggaaatgggtaagtttttaatcaaatatcatttattaataatttaaatttagaatgctgatgcttttgtattctgaatttataaaaggtcaggcgacaaattttggaaattttctattttgcctaaagaatatccgaaaaatttgcttgaattcaaagtgcaaatgaggattaatcgagtttttgctgtcctggacgggtttgccatttgaacaatttacgcgacttttgagtaccatcttggccttgtgtatttgatgagaaagaatttgcactgtaacaaaatttgaaacgaatttaaagaaaaataaccaaaaatatttacatatttggacattttaaatgaatattttttcccggtatatgctgaatgaactcccgatcccgctcccgnnaaattttacccaaaacgggagtaaaaatgtactggtaagaattgatttttttt

SEQ ID NO: 5897 - DNA, 1427 bp, Heterodera glycines
attaaaaatggaatccatttatagggcatttgaaaaatgtatgtgaaatatgtcaggtaaaccacacaagtaccgagaaaacgtgtgagataaaaagagagagagagattgaggaggagagaagagggcaaatgagagagaagagaggaaaggatatagagagaggggagaaagtgatagaaagagagagagagaaaagagaggaagcgatagtgagagggggatagagagagagagagagaacgagtgagagaggaagtggatagagagataaagagagagtgagaacgagtgatagagagaggagcgagagagagagatcgaggagaagagagaagaggggaaaggaaagaaagaaaaagattaagaggagattaaaatcgcaaaaactacttttcttatttttatttgcctgcattataaccgtttgtttaaaaaaaattttgaagtagaacggagcggttgggaaccaagcgctcgtaaataactattgaacaattctgcgcatttagctcaaatatattatttcatacttaaaaaatttttatatttgttggcgattcatctcgaattcgagtttcattggttcaacattttgctgcaatacttttgcgccgctttaattgcctgaatttgtttctccaatttatttctaaaaagttaaataaatctgttcattttgtaaatttgttaggccactaaatggggattattttgacacaaaaaaatgaatttttttaaacatgcattttttaaggattaaatgttcgtaaaaaatttttaaattgcgcaaaaaatcccatcggagaagctaaatagtagcaaaaggcagaataatgttgagattttgatagttctactgatgaatccaatcaacattataaaatatttgcatcattatttaagaaaataataaaaaattaaattaaataaaaaataaatttggtaattctaatgatgatcaatcaacattgtaaaataattgcatcatttagaataaaataataacaaattaaattaaataaaaaagaaatttggtaattctaatgatgatcaatcaacattgtaaaataattgcatcatttagaataaaataataacaaattaaattaaataaaaaagaaatttggtaattctactgatggaataatttcatcatttaataaaataaccaatatttaaaataagaactgatgttgaattccttttttatttttttttatttttttcaatcagtttttaattccatttcaaaatgcaattctatttgggagttaattaattaattaagacataatgatgtttaattcctttattcctttttttatcattattttccatcagtttataattccattttcaaatgcaaattccatttgtgagttaataattcgagaaattattttactaatccgttttaattaatt

SEQ ID NO: 5898 - DNA, 3097 bp, Heterodera glycines
  misc_feature (2927)..(2927): n is a, c, g, or t
  misc_feature (2979)..(2979): n is a, c, g, or t
aacttaatcaattggtcatttttttttacaaattctgcttcaaatcgcattaaaaattacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggtgaccccttcgcaaaattggaaaattggcctgctgaccccttgttttgcaataatctgaattttgaggtctatatctgaattttagtgttctatgtcctgaatttgaaaaaaaaaattggtcaccctcaatatacatatacttctgaacaattctaatgctaaaaaacaggtactcgcgcgaaaactgaataaaaattttgtatttggaaaattttgtccaaaaatttttatgttctaaaattaccggtttttaccggtaccggtaccggttgaaaaagttggtaccggtaccggtttttgcagtaccggtcagtaccggtaccggtttttttgcaattaccgactaccgctcaactctatttcgaaggttaattatgtgtcgttcaaaacgttggaaagtcgggaatttgtgagaaatttgcactgaaaatacgagaaaaaaggaattggacatcaatttcattcaattaaatcggcagattctctcctctctttctttctttatccctgacttttgcatatttattccccctcataaaaacaatcgcacacaatttaaaattttttgtttactttgtgacatacattccaaaaattatatatagaagatttcaccaagatttgtgaaaattttccggcggcgcctatcggcaccgcggaccggccgttaccttattaactctttaaaagttgagtcaaaaagtgcgacatttagtcatttggacaaaaccactagagatcggtattttgaaaaaagcctggacctggattccatgttggacctggacctggatttcctggacaaaaatccaggtccaggaaaaatccaggctcctcgagacctggatccaggcctggacctggattttttgaaatttgttttgaaaagcaaacaaatgaaaaaatcaattatttgtgcttagaaacatctaaaaatatctaattaataataatgaaatgtccatttaaatcagtttatgaaatttggaaataatttattcgattcgaaaaatgatcacttcaaataacaaaagctaatatttataattgatttgtgggagagatttattaaggaagatgagcatttccgcagttttcggtttcaataatgatcgccggtaatcaaaaacatcacgtgccgttttgaaagtccgttcgcttggtacacttgtggcgggagtcgaaagaaatttgttggccagtttagcaagttttgggaattgatttgacaatttccgccgacaatcaatcggggttgagtttgtttcttcgaggccgcactccaaatattcttggaattccagttcaatattctcgtgttgttcagtaggcgtccttggaaattattagggaaactgtaagaattgaagttgtattacctcctgtcaatgttgcttttgacgatgttttttaatcgatcaaaaaaagagtcattccgttttggtgggggagagagagactgatcgggtggcatggtaaaatgttgatcatcgaaatcaaaaatttctggttgtagcggctcagacatcgctttgatccaagcaattacgttcgctctaaacacattgcttgtcatttctgccaaaagaacgcggtccttaaaacgtggatcaaggaatgtcgaaactgcgtacactcttaaaacaaaattaattttcaaaaaaaaattgactatcacttttgattttgaagtccgaaaaaacgtctttttaacgaattgtacataattgttcgaacttggtccactttttttgaaaaaagtttcatttcgtaaagctcgtcatgcataactcctgcgtatggaatcaccaccgaaataggcgactttgataatcctttggtcatcacttcggcaggtttcaaaactaagatgattgttttttacaacatttgctttaaaacaatactcgcaataagttcctccaaaatggaccattcttcgcttgttaaagtgagaccaaagtcacaattttggtaggcatattcattgattgcctttttttgctcgtaaagtcgttcaatcatcatcaggccagaattccaacgggtcgaaacttccttaaaaatactctttaagaattaccaatatctaataacattatacatacctgtaacaagcaatgctcgggaatttcaagaaactcttgaatttcgtgcaattttccgagtgctttgttgctctttttaaaatggccaacgattttacggcatttcacaaacagcttttcaatatcaaggtcggcacttagcccttctttcacaaccaaatttagtaaatgggcggcacaatttgcattcaaaaaagggagaattgcactgccattttcgtcaacttctttaaaggccttaaatatttttatgtaaatataaattttttctaggataatttatacccgacacatattttttgcggaatcagtaacaaaacaatgggtatttgatccttaaattcgccagtgttccaaaatgctgcgaagcttaatcgcaattgctaaccctgtgtgctcaccagggaaatttgtaactgccaaaattctctctttgtaaagccaatttttgtcgatgccatgcgctgtcagactaaataaacaattcttaaaatatatacagaacaaaaatacctaataaaattgtcggaagtgccggcccaacagtcacttgtgaacgacaacactgtgcactgttccacatcactcctaattttggcctgaactcgttcgtaaattttgngcaaaacttctttccttaattaggaaaatattaatttttatatttaattggntcagagacaaacctataatagctttcacatttaacctcctgttgtataagagcatgaaaagtgggatggccaatgattaaatgaaatgttgttgcagatatgtagtgcattatttttt

SEQ ID NO: 5899 - DNA, 4943 bp, Heterodera glycines
tggtcaccataaactctccactcccttttcccattatgttatttccttttcaatccccgacaatgcgttatcggatcacatgtgatatttagtccggcacagatttggttggcggcacggcttatttcgacacccgcagcacacactcctcggggtcgcgcagggtgtctcggaaggagccgtaaaatccgaacaaaaaatcatttctgattttccgattctgagatggtcgtggcttcaactcaattgcattttttcaacttaagtaaaccaacgtcattggatattttagccaaatgggcatcacatcattttttgtttttgggaaaagtcgataatgagaagagcaaagagcggattaaggaagttgtgatttattgcgcatagcgaaagggaagggaagaaacgacggacggaagaagaaggcatttggacgaatcgttcaaagagttaaaagtgagcaaaaaattaatggcggacggagaacggcgaccgaaggacagcagcgaaatgccatttccattcaaatgcccttctcctcctcctccttccttcgtttttgcttactttttttttacatcatttttagttttttttattcttttttttctagtccgattattcctcaaaagttatgaaaattacttgacccaaaatccgctcacagaaatgaattgtttttcgagaattggaaaaattcggtaacaattttttgaaaaaaaaaattaatttaatttttaaatgttctcaatgtgacggtaatgacagaagtgatgaacaaccaaaaacagaaacaatgagtaaaaacctaataaaccaaatgtttgattgacggatcccgccaatttccaagcgatttaaaaaaacaaatcattttactctgctgttcatcacattttattagtttgtgttctgttcattttcaaccatcgcctttcttatttatgattttttcgatggttttttcggtgtgcaaaaaaaaaatgaaaaacaaaatttggtggaagaattaattcgtcgtccgcccaacgaccaccccaaaaactgatcaaaaaaatggttgggaaatgatcatcagcagagtttcgattagctgctctccgacgataacagtcttttttaaagcgttcgcctccaaatatctccaatttttgaacaaattgataatttaaaagataaattctccgtaaaagaaatgaataatttatatgaaataattaatatttacaattccatttaaatgttcataaaattaacattaaattattattttcactggtcattccaagaaaatgaatttgttcacttcgttggacccttctgttaagaaattgttgggctggaaaatgggcgacgaagaagagaaatgggcactgaaagcggtcgaatctttggtgaaaaagatgcaaaaacgaaagcaccatggatacggtaagaggctctaccgtataaaaatgggaggaaccggtgtttttaggtactgtggaggatttggtgcgttactgcaaaatgacattttgttaatcaattgataataatttaattgaaaaaaaaatatttttacggttaaaattaccataaaaaatttaaaaagaaggcaaaaagtaaaaaaacatttattttcgttaaaaatattaaagaaatttttcaatatattttttgatttttaaaatattttacattatgaattttacttaggaatacgcactttcccaccccggctcaagcagcaagtaatcttataaatgtcaattaattaaataattaattgattcatcaatctctcccccctttcattgctttttcctttcttttttcagttgcgtgacaattccccgctctttggacggacgccttcaggtcaaatgaatggctaattacaaaattagcgccggaaaaagccaaaaaatgctaatgggatttttgtaactcctcgtttaatcccttttctgctgaatgagttttgcttatgctattacaaaatccgcttgtccctttgaggtgtcccatcggaagggtcttccccatgtgatttattgccgcgtttggcgttggccgaatttgcagtcccatcagatacgcattttgtcctttgtttacttaacatggatacttcctttacgagttaaggtccaccaccgattgtatgttcccatacgacgggcgaagtgaacaggtggcaaaatcaccaaactaattagggcttaattgattaatttttgttacattatttattatactaaatgataatgttaacattggtcagatatgcatcaatccttatcattaccatcgaattgaaatgctcggacagtcggtatgttcttctttccagcaatattggtcagcaatgtgatttgatcagttgattttccgatttttgcctacaaatgttttcgacattcattaaaatacattttgattttattcaactttttgtctcttttgagaagcctgtgcctcctcctccctcttcttcctccgttgtgccgtcctcctccttttccccctcttccgcttccattggcactttttccactccttccccctctgccgccgcctcttttccgtccgcctccccttccgcttcatccgtctcttccgcttctccctcagtgccatcgttccgccacgtgcacagttatcctcagaccacaaaacaacagttcatgtccaccaatgtcatctccgatcagtccgctctctcctccgcctctcccaccgccgctttgttcacccaatcgccgtcggcactaagcgacgacgacgattttatggcacaacagcagcaacggcacaatgccgcactccaacaacaattgtgccaccatagtcagccatgttgctggtgttcagtttgctattacgaactcaactcgcgggttggcgagccgttcaaggcacgcattttttgttgattgatttgtcattttgagctcaacccataaaaagttagcactgattgataaatgctatgctaagctgatttgatctgattaaatctattagtgtccgatcattaattgtgaaatgttctctctgactgatttgtctgattaactcagatcaattaaatacagtccaattgggagaatattgaattgccaatcaatcgtccgtttttccctttttaggtgctcgaaagtattgtcgtcattgatggtatggcacaaataacaatttgttttgccaatgtaaatgttcccccccccttttttgaaaggttttacgaatccgtccggcgcggggagtgcgtttttaattttccatttaattgcattttaatattttaaggaatttgtcttggcctcctctccaacgtcaacagaaacgtgagaaagcataaaagcgaaaatatcaaagaatttactttttttaaggtgacaattgaaaacactcgcagacacatcggaatgggtgaataatttgtaaaaatattcataattaaagtgcctggtcatggctatcatttttttgcctggttttgaatataaaatgccattaattccctaaaattggtgaccaacaagagtctcgacccaaactcgaataattatttgccattctcaattaaatattttgccctttcccttttcaggcatccgattgatgtgcactgataacaatgttttgcttgtaccgttctttttccatttttggcattatttttggtgctgtccgagagtctcgaaaaaagttcactttttgggttgctaccggcacatatatttttttactctcgagcggcacgtttttattggttttcccgttatgtttattttccatgttccgcagttgaaccaatccgaggctgctgtgttcgttcagtcgagaaatgccaacttcaaatacagccttcagccaacggcggtcaaaaaatgaataattaatgtgccgacaaaatgatcaattaggtagcacaatcttgttgtaaaaaatctgtctgatccattttaaaaaaaaatgtttttatttaatggtttttagaggttcagacattttattgaaagcaattttggggtggtcattttcgcgcgcatattaattgcctaattggctaacattgtcataatgctttcaattttaggtttgtcgtgtccctccgggcgcaacaatggtcagttctttcgttgatctgtttttaatttaatcttcagcagttaatctcggcgtttattaagctaatcttcgatttccatctcttcgccggggtttgtccgtttgtcccccattttgtcatttgtccattttcgttcatttgtccttttttctgcgccagatgcttgaaaaggcgaaggagaatggttaccaacatgtctatgaaattgtgtgagttaatcgcacaaacattggcattttttatacaaatttctcaatccaaattaaacaatttttaaaatgcagcaaaatgtgctttgttcgtctgtcctttgtcaagggatggggagcggactacccgaggtcagtaagtgccaaacagtgcaataatccccggcagggttaagtcgagaccctccgcggcacaaaatcgggaataataatcgacgcatataaaatgccataattcccacgtttattcgcgccatgggttctcaggggaacccattttagttcgaaaattggcgtaatgtttaggtaagttcatttaaggcaggtcagtcactcttccgtttgtttgtgtcgtgctgtttggacgtgcgatgcttcccatcgcttttttaggacgtcacttcgacgccgtgttggctcgaaattcagcttcaccagccaatggcggtacttcccaaagaattgccaatttaattaccccaatattaattgattgattgggttttgctttaatcattttaagtggaccgatgcggcactttcccaattggacccgcccgatcacaacggagttacttcagtgtcataaattggaaaaaacaatgattaaagat

SEQ ID NO: 5900 - DNA, 2588 bp, Heterodera glycines
caattggggaggaggccgccaggagcaatttagccaaagaaactggtcaagcaaccctcgatgccattattgtgcccgtgctggacattttgcgtacaatttccatcaacgccgtggcaatttcagaggaaattccaaccaatcgttccgtcaaggaaaatggtcaaatcagcaacctcgccaatctcagggacaatggcaaaatcggcagaatcctgttaacatgatggatgtgccaaactcttccaacacttcaccaggatttttcgagaacttggcccagtcgttacttgacctcaaaattcaggacaatcgcaattacaaaaatgaggaaccaagatctggggcaatgaatgcgctcacacacatcaaacccaaaacaacagcaatggattgtcaggtcgaaaatgaattagcaaaagaatcctctagtgaatccccagcctgtgggccggaaacaaagacaaacattcccaaaacgtcaaattgggaacggccaagcgtacgatcgaaagtcgcttctttaatgttcattacactaatgcttattggaatgactttgccctttactactgctaatatgccccatctgccaatgcatccccttgtctgtcaaacccaaaacggaggaaaaatttggcaattgccggcagttactggctgttcaaagctgtcaattgatcattcaaaagcacctgttgttcgaactttcgatgtcttttcgccaaatttatttgagcactcggctgatgcttgggcttgccgaaaagtgagaaaatccgtgcgcaagtacacttcaatcactaatgttccgatccaagagactcttgagccacttatgttgcaaattactccgagtgaatgtaagcaaatggccgaaaatggaaagtgcagtttaggcttgctaattaatgactcgggactctcgcatactgacaagaaattggatttgtcaccccgaatgtggctaattggctcatttagctggtcgactgtctcaactgaaaattgttatctttttaagactaaaattatgtcacaacacggtagcacagttatgcaaagtcccctcgggtcagtgaacaattgccaattcaaggcaggccaatgtgagatggaagacaagacattgctcatgtgggacaccaacactacccgtgcctgtgaattttcgaaaattggcacatggaaaggactacaacttgacaatatttggatttcggatgaggtcagttttcgtttgacatttttgaacaacacaaagaaagtcaactcatgtggtctgaatctgataaaatcggaggaaggatttgctgtacaagacttgccttccgacgatagcaacgaatcctcaaagagaagcagaaagacgagatcacttgaaagttgggtcaccgaatcggaaatgaactccaaattgggctatttggatgaacaagtaagagaaatgctgactctttccttttctcagacaattaaatcgatttgtgattatatgttggagacgagaagatgggcagcgacggcacttctctcagatccaacaacttttgccagaaaattattccaatctggtaaactggtggcaaaggtggccgggcccgaattgattaaagtgtggccatgcatcgaattgcaagcacatgactacgaatttgccaaaattgggaactcagcggactccgaattcgaatgctttgacaaaattccaattaaattccgagtgaaggacaacaaaagaatggcatttattgacccaaggacaatgattttgagctccgacgcgagactggcaccatgctctgaataccgcaagcagctcatttttgtgcgtggttctctttatgaagttgatcaaatcgatgctcaggtcaaacaggtgaatgccaatcgcattgacggtttcagccttaatctgtcattggcaccgacttatgctcgccattcctttctccaccttgcccttgtgaatgtgtctgactttattggccaattttacgacgccaatttggcaagagaaagcgaactcacattccaaatcaaaagtgaggacgctatagtcacaaagactttgtctgaacaatgggagcaggtgagtgagtccattcgcaacaaaatgtttgggaattgggaacaaattggaaaaattgtcatgtccatgatgataattattgtttttacagactttttgatccggtttagattaatgattagagacgaatacgttggcagaggaacaacacgacgcatgacttttggtggaaataaaacgcagaaaattgtgaaatctccagcacacctcaacatgatggatctgaatgcatctgtagaatttggtaacgaaattgagctcagtcccgttaagctcattgaacccgcccaaacccaggcacacaaaatcgcaggaaaacgaaagagaccggtaaaaagggctcgcttcagtttttcgggcgccaaaagtactcattgggttttttagtagtttttccttcccaaatgcttttgcaaaaccccgatgtgaataatcaaatcctcattcaattcacttcctccttcaatgatttatctgcttatcattccatttctga

SEQ ID NO: 5901 - DNA, 2604 bp, Heterodera glycines
aagcttaagtcgaatcgaaattctcaaagaaatgcctgtgcctttaaatgttaaggaagtaaaaagagtgctaggacaggcaggcttttacagacggcacattgagaactttgcaatggtcgtagagccattgctgaagcttacgaggcaaggcaataaattcgaatggggcagggaacagcaaaagtctttcgacaagataaaagaactacttactcaagccccgagtctaatttttccagattacgacaaagcatttcacattttcactgacgcctcatcgactggacaaggaggagttttaatgcaaaaggatgacgtgacgggcacattttctgccatttcctattgcagcagaaccctctctgctgctgaaaggaaatggccggcagttcaaattgaaatgagtgccattatttatgctttaagggaattcagaccattcatcttcatgtcggacattgaacttcacacagatcacaaacccctcgcgtttttgctaaaaaaatccgaaaccaatcagcaattggcacgatggcttattgaactacaaaattatcaggtcaaaattgtccacgtggcaggaaaaagcaacactttggctgatgcactttctcgtgccgctgaggacaagcccttgtcggaaatatacaatgtggatgaactcgaggacattatcgaatttccggtctgtctcgctttggcagcacattccagggtggtcgcggacccatttttgcatactttgaccatccgacacgaggatggaaacacttacgaaattaatttgttggaagagcaggcaggagatcctgaagccgcagcctacattgcgtttgtcagggatggggaatttccagctgatttggatgaaaaagaaaaagagttattcgctataggcactgccaattacaaattgatttcgggaattctttattttgaggacaagggactccctccgaggatatatgtcccaatttcgttacgtggactcatttttgaatcatttcactcgtctcttttgggtggtggtcatttgaattacaggaaaacaattgccaagtgcaaaaaatatttttggcccaaaatgtactctgacgttttaacttgggtcaaattgtgtgtcacctgccaattgagacacaatccaacacccgcgtaccgggaagagatgctcatggtgccagccaacacactttttgccaaagttgggctggacttggccggcccctttccagtcactcaaaaagggaataaacacattttaaatatcgtttgttggttcaccaaatacgtgatttctgtcccggtccccgacacaaaagcacaaacaattgcccacgcttttcttaccaattgttacttaaaatacggtggttgcgttgaattaatcaccgataatgcctctgcctttacttccgaatttttcagggaattttgctccatgctttacattgacaaaaagtatgcctgtccacattggagtcaaggcaatgcgtcaactgaacgcacctttcggacatttcacaacatcttggccaaatacatttcgaagactcagcccgacttcgatgaatttttggatgctgccaatttttgctacaacacgtcagtgcatgcttcaacgggtgagactccattttttcttatgtttgggcgtgacccaattttctgtgttgatcagatcattgatccgaaagttcgtgatccgatagccatttcggaccgtaatgaatttaaacagaagctggtcgttgccataagacacgcgtggcacgctgcagctgatgaatatgcaaaagcccagcgaaaaatgaaggaacaatatgacagaaaggcaaggccacagcaaatcacaattggtgaccgagtgctgatcagaaactacgacggacgggtaggaacatccaaaaagtttcaattaccatggcgcggaatttttcgggttatcaaaattgagggcatttatgttactgtgatcagttgcacttcgccaaattcgaacccaaaaagacttcacttaaaccagattaaaaagtgtttcgaaattttgggccctccctgcactatgccaactcaaccagttgaagaggaaaagtgccttgaaaatactgataatgccgataaagcaatttcgaaagggtatgaaattcgaaatgaaatggaccccgaatcccgggaaggcgaaaatttggagcaaatccacgcccgagggccggaaacaagaccagaaattgaagccgatgaggagaaaaatgtcaataaaaaaacggatacggaaccaagaaagtatgaccttaggaagaggacgagaacttggaaagatcttgtgaattattagcacagtaaccattaacatcaaaaatttatttaacaaattcaatgaaattattcgaggtcgatctcgtctaaattgatgaccgaagaggtgcccttctttttcgggatgggcactcgcccctccgccttctgtttctccctctgagcacggcgctgggctgccaacacttcgttgtccgcccgcacgcgctttccgctttgctcatatttcaggcgatatccctgggccctggcctcgctttccttggttttttaaaaatttga

SEQ ID NO: 5902 - DNA, 2753 bp, Heterodera glycines
acttttaaagaatatattaatatattttttaaattttttcctttaactccaatttccatctctaattttcactcagacccccattcttaccagtgcttgttttcccggttcccggttgccctaccgggaccgggacctgagattttcaaaacccgtggcgaggaatttttcgggtcatcaaaattgagggcatttatgttactgtgattagttgcacttcgccaaattcgaacccaaaaagacttcacttaaaccaaattaaaaagtgttacgaaattttgggccctccctgcactatgccaacacaaccagttgaagagaaaaagtgccttgaaaagacacaaaatgtggaagaagtcagttcggaaaggtccggaatccgaaatgaaatggacctcgaatcccgggaaggcgaaaatttagaggaaatccacgcccgagggccggaaacaagaccagaaattgaagccgatgaggagaaaaatgtcaatgaaaaaacggatacggaaccaagaaagtatgaccttaggaagaggacgagaacttggaaagatcttgtgaattattagcacagtaaccattaacatcaaaaatttatttaacaaaatcaatgaaattattcgagatcgatctcgtctaaattgatgaccgaagaggtgcccttctttttcgggatgggcactcgcccctccgccttctgtttctccctctgagcacggcgctgggctgccaacacttcgttgtccgcccgcacgcgctttccgctttgctcatatttcaggcgataatccttggccctggcctcgctttccatggctctttaaaaatttgacttagttgtgaatgagacaattcatctcacttaattccaccaagatactcctcggtttgcttttcggtgaatttataggcttcccgccctttgcagtcacaacgagtgtgttcccccacttctaaatcattaaaattgttgaaaagtcattgtcggagcccattttttactcttaaattgttttgctgccctcgggctacacaactccttcacaaggcaaaccgaagctccgacattgatcccgcaatgcaggccaacggtgagcacgacatcaccgggccgctggatgtggaattcaaagggaattcccgcctgacgcagttgcgcaggggagaaaaagaaactattgtgtccaagcggattcgaacaattgggccaacgatcggtgaacagcacctggcccaattgggaaacctgctgttcgaattccccgccaatgaagagccacaactgaatttttcatggattttcaaaatttttttttatttaactaaaagaaaaaaaaacctttaaacccggtcccaagttgtaattcatatggtggacatgctcgtcctcacggtggagggcgaacaggctggtctcgggcggtgcgcagatcccacgaatgagcgtggcatccttgtcgagtccctaattttttttttctactcaaaataccaaaattttcagcccaaaccatttttccatatgccccattacaggaatagagagctcagttatcagccgatagctttcggtggttttagcgtctggcacaaaccagcgtgtgccatatcgccactcctgcggcaaggggccattcacaatttcgttaaaaaaccttatttttggaccatcttacaataaaaaaaaaaaaaaaaaaaaaaaaaaaacccgctcaatgccggcatcagtctcgtcggtgaatggcagcacctccttgccgtcccgaaagatggttgtgacctttcggtcaactcccttgccatacatgaggtaagagagtgcgccgttggccctcgacgccttcattttatccaccggaatggtggacacagcaatttcggctggcaacgtcgacgcatcggcacctccgctcatgaagcaccggcttccgccaggttggcacccacccaaggtttgcccactctcccgccctgtagtccgtcttgcttcggatgaaataggctgccattgcttatggcgcagctttatggccaaaccacccaccaccgaaacctttttccaattgttatcgttgcgaaggaatgccaataattcattgaaaaagttgagcttataccaaaagtcgaacacttcaatcattttgggttaggacgggacgtaatcacaattttctacaagtcaataattatttttatacttctgagcttatcaggaactctctatatgtaagttgccgactctctacggtttagaaatctcacaaactgtttagcattttcacatatttttattttttctagtgtcaaatcattgcctaaaagaaaccatcaattgcaaattcaatatataatttcaatttatttaattcctcgcctgggggcctaaaaatatttaacaataaaatagtagaaaaaataataatacaaaatgtaaaaattaaaagaaaatttttttttttgatcatttttggctcatctttgtctttggcaacaatttggcacatcaatcggtcatggtccaaaatgtgagcacactccgaacacgctcgaacacttgcgacgtcagccaatagcaatgcgcaacttcagatcgctgcatcaacaaatgtcaaacagcacagtgccttgcctgagggcatgaaacaatcagatttaaaaaaactatagcaatataacaaccattaaaataaaataaaagttcatgtgaatccaaaaataaaaaaagtttttgtttttttaattttctgcggtaa

SEQ ID NO: 5903 - DNA, 3540 bp, Heterodera glycines
ttattttattttattaaattaataaatatgatacattattgaaactgaaatgcaaatgaattattaaaaaatcttttatcacttatacttttattctttatagaaaagaaaaataaaaaaagaataaatttttcttctaaagtatttttattaagggataatctaatgaaagaataaatattaataatttaaaaaataaactcaaacacaaaaaaaaattaaaaaagtttcaaatcacgcctaatttacgctttttacaaaaatgctgcttttactctttgtgacgttaaacaacaaaatgaaaaaattaatgacatttcactggtagggatcggatttatagttttttcactatttttttcctgaactccccatattgaaaaataaaaaattactaataatattattagaaacgagtttaaaattatttttttcaaaaatatctccagtgatgcagaaattattacgttgcaaatgagcttatgaaaattagaaaataaactataattagtaaagaaaaataatattattaacaaaattgcttaattataaatgaacgtttaaagaagatataaatgaaaaaattttcaaaagacgataaatattatatataattgaatttattttaaagttaaggtgataatttcttttgttgtgcttttcaaatggacttgaacggtgcagagaacacaagggaatattaatgaaaaatgaatataaaaacataaacatttgtttaagactaagaaatataatgaataatacaaaaataaaagcttgaatgtgaatgataaacaaatataaacaatttagttattttatcatattattgaaaaataaaatttttatttttactgataaaaaacatttgaatttcgttgcattctctctcaatgtagggaaagaagacaagaaaattttaaaaaataaaattgattttatgtcaagaattacactaatgaaaactccgaagccacaccctagaaaatatacaatttgctctaatttttaaaaccttatttcatcatatttagggaaaataagaaattatcacattttgacaaaaaaatattaaaaaatgtatttctctatacataaaggagcattcgcaatatcaaaacctaaaacgcataatatgaaaatattatttttacataaatgacataaaaggatatgaggtcaaaaagttgaataaatatttaaatattaatttaaatacacaaaaataaataaaaagaatactaactatgaatgtctgatgaatgcatgaacagacaaacaatgtattatttattacaaataatatttttattaatttaattcattttaaatactatatttaatataattttcgaaacaaaagcttgccattgaacatctattatcgaaaaaatactttaattttttatagaatgaaaaaaaagaataaatttttcttttaaagtatttttatgaagggatgaatctagtgaaagaataaatattaataatttataaaataaactcaaacacaaaaaaaaatttaaaaatagtttaaaatcacgcctaatttacgctttttacaaaaatgctgcttttattatttgtgacgttaaacaacaaaatgaaaaaattaatgacatttcactacaaataaaagagaaaataaaaataaacctgatcagaattatataagattaataataaacacttaaagaaatttgaaaatattaatattagcatagaaaataattataagggaaattcatcaaaaaaaaatatttaaacattttattttatttatttcataaaaaaatttccatcttggtttaaattatattattagggtgatgtataagttctatcataatgactaaaaattcatataaaaatccatcacaaatcaaataatacagcaattttaacgaaactttgccattttatgctctttcttagcccggatttttgaccaattgattatgctttttatttgaacttcacaaagttatggtcccgtgaattggccaaggtctttctaaaaccactcacatttccggaagcattgcttagcccaaaattttttatttgactaaacaatattttcctgaaaaagcaaagttagaagaataatttagaataaaaaaaattcataagcaaactctttcattttttattagacaatgttttttggtcaaaacgttctctgtcatttaaatcatttaacgaaaaatttgttgccattaaagcatcaaatttttcaacattttttgttgttggaattttcaattcattaattaattcatttaattgttcattcttcagattttcaaccaaaaagacaaccatttcccaatgcttttgattttctaattcaaccttaagaatttatttttttagtttacaaaattaaattttacatttattttcaagtgctttccagtgccataattgaacaggtcccttttaattgctttgatcagtggcattgctgagctcatttggagttcgccttgcccaaccagcaggaattttggcttcatgcaatggcattccaattgattttcttataattagttttaaatataataagaaatgggcaaaatgttaaacctcagctgggaatcgaacccactcatacaaaaaccctaaattaattttttgtaaatttttcacgtttaagtcattttgggttttcaaaacactttttggccacaaggaactcaaaaacccatttttttaactttttttttgccctttttgtttgcgaataataatttttcagtttttgcaggctaatagagttagttactcaagtgctttcgaatataccaagaatatttaatttaattgagaaagaaaaaaaagttatggccagaaggaacccaaaaacttagtttttcgaactttttgccaaaaacttatggtccaaaaactcgtccggcaataattcgaatgacaaggttttgtcctgctccgaaattaaataaaatggaattagctagaatttttataaaaaattattaatcaatgtgatttttattcacgttttgctatgctttttattctgttctcttctactttctattctactttctataataatacatttttcacaaccatttacctatgtattaaaacatttaatcttaacattatacataatgggggaatctttaaaattgttatttttttctataaattatattttctattttttaaacgaaataaataattgtaaaaggaaactaagaaaataatcctatgatttcgtttttattttgccatcgtaaatatttttataattttaacaatatattaatatattttctcttttacttctataataatcaatttttcactctatttaccaacgtattaaaggatttggtaaatattcatcataggtcccagattcgaaattgcgtaaaaacacttttataggtttttttaggtgctgaaaacgcctaaaccgtcaaaaaaactgcgcgacaaagcgtttagaccgatttaaatcacgaaaatttgcctcaaaaactagccaaaaacactttaaataaaaaa

SEQ ID NO: 5904 - DNA, 3582 bp, Heterodera glycines
  misc_feature (13)..(13): n is a, c, g, or t
  misc_feature (2754)..(2754): n is a, c, g, or t
  misc_feature (2770)..(2770): n is a, c, g, or t
  misc_feature (2812)..(2812): n is a, c, g, or t
  misc_feature (2821)..(2821): n is a, c, g, or t
  misc_feature (2843)..(2843): n is a, c, g, or t
atattttattttngggactcaaaatttaccccatttttcgtatgttctttgtgaagcagttttttatttttattctaatttacttcctccaacactcaaattgggaaaaagataggtccttttatgttcaagtgataaaatgaaaaatgaagatgaaaaattccgacttgtaacaccgaaaacccaaaaaaaaataaggggaacataaaaattccgcggtggttccaaagtgatgcttctgaaaaaataaaatataatatccgtaaaaaatttctaatcaatttttcttagaaaatatattaaaatcaaaaaataaattttcggccgcgcctatcggcaccacttttctttttgaaatttaaacccaaaaatggcaaaaattagtcctattttttggcgaaaggcggctaaaatttccttttttttttgctcaccgctgctcaaattgcttttcggttgcaaattcaaattgttctcgctttgttttttaaaaattttcaaaagacaccacatcggaacgagcgcttacaattcccataaaaattgcgttcaaaatgcccttatcggttgtttccttcttatccataaatgtgcatccgtttctttcctctgtctctaattccacaaatcccaccacacaactgcgcacgagtcaaaatatgtcagttcagggcgtccgtagctgtacccgcggctgctgctgctgctggtgccgaagcagcaacaacagtcactactgctgctatttctgctactgcttcctccggagttgaaaatgaaaatgtctcctccaccccgtcgcccgccgttgtcagctgtagccaaaatgcacgagcaaatggcgattagtgcggcaatgatcagccaaatgagaatgatgatcaacagaatcaggctgatgcattggagccatgcgctccaattcacacggcttctggaacagccggaagtttctgatcctcctccgaatccgcgcttacgccgacgccgtcccttttttgcatctgatgggttaaaaagcaaaaaatttaagcaatgttttaagaatacagcatatgccattaaaagaaaaatgaatgaatttcctctactaattaccaccaaaactgctaattaaaatttatttttatgcactatcacagtgggtgtaagtccctcgccttagtcattttaaaacaaataactaggactatgcttaggttttgtaagaatcgatttttcaaaaatcaaaaatcctggtcatgattttgcggacaatcgaaaactttttactcctgaaaatcttgaaatttgtttgaatacaattttgcaatcgaatttagcatctattagggttacaacctatttttcggttttagcacctaaaatcctagccctgtaaattaccgtcatcattttgaggaaacaatcgtgcgtagactgtcttgtataattttgcattttcttcaagccatttttgatatttttccttgtcattgttgctttcttggtgctgctcctgctgatccccgttcttcttccgttttggggtaagaagctcaacgattttcttggcatttgacacaatgccaattttatgaaaactaatcagtgcccaatagccgtgcattgcgagacgccaattggacatctcttcttgggtgtaaatgccaatctttttccaatccaacttcaaatgcttttccatggctttgctcgcttcttcagaagtgcttcttagctctttgctcaattcttccgaattgcttttcgccgcttcttcgggtggcttttccccctttatgattttgctcaaacttttttcgagtttgtcgattctcatccaatcattttcgtttaatttttctttcaatttgtccatcttttcttttaaacttttgagaaacatttccaccaattttttgccccactcatttttttccatttctccaaattttgcgcattctttcgctaagttttcgtattgtcgggtcattagcaaattgctttccttcatcacatccatcaactcaagtttcactttcatttcaataatttctgtttggctttgatttttgcatccttttccatttttcttccagaattttttggcttcttcaattttgtcatccaatttctttttcaaaatttgcaattcttttctggcattatactcctcttggatttcgggaattgtaaattttttctcaaaaaacattaaatttgcataatcttgtgctgtcatatttatggcaaaggtactcagcgtttcaatgaaaattttggcattggcaatgtcttccaactttttgatcactttgtcatccatcgtttcttttccttcattttcctaaaaattattttttaaattaaaaaaaatattttttcaaaattaccctcccaattgtttcagttattttatgcttaattttatcaatttgtgtgttcaaatctttcaattcctttgttgataatcccatacaaagcaacactaaataaaaaagaattataattgtttattttttacttttaacaatattaatagaatatgataataatgaatgaatttaccagtatatgagataaaaaaataatataaaattatcatcgcgtattttctaaaatgaatgcttttcatttatgttatctatctgtattattaagggggttttaaggaaatttttagaaatggccaaaaatccaaacttcgcaattttttgtacacatttcattttttaaatcttttgacaacaaaccccctttaaatgcaattanaacgttattaagcctntcgtattttctccttaatggaactcgggtaaatttcttttgnagattgggncacagaaattaatttaaaaatntggtgaattaaatgggtgcaccccaaaactttttttggaccataatggacataaaaataatttgaaaattgcataaattaaatgggtgcatcccaaaatgtctccggccgaaacgtcgccagaatactttttggaccataattatgtccgtgttagtcaaattaagtattcttgatgttgctcggtacctctaggcgtttttttattattttgccaaatcacaaaaatatctttaagtgtttttgtacaatactaagaatgtttattttggttgagaaaaaaaaattatggccaaaaggaacccaaaaacatagatttcgaactttttgctaaagaattatatccaaaaattcgttcggcaatgtttcgaggggcgacgttttgtcatactcccaaataaaataaaatagatatttcattatttcttaacattatacataatggggaaattccttattttgaaataattaaaattataattttttataaattatattttgtattttttaaacgaaaaaattattgtaaaggaaattaagaaaataattctaatgatttcgttttttgattttgccctcgaaagctatttgtatacttttaacaatatatgatttgtatagcatatcaattcgcacaataatacgaacattcattggcgttgaaaaaaagcttacttctctggagttttatattaagcggggatctctggaaatcttagaatttttcgagtttttcttat

SEQ ID NO: 5905 - DNA, 1020 bp, Heterodera glycines
  misc_feature (145)..(145): n is a, c, g, or t
aaaatagatttggataatcctactgatgatcaatcatcattttaaatatctgcgtcatattaaaatataatatgcaaattatatgaagtgaaaaatagatttggataatcctactgatgatcatcaattatcatttaaataatgncatcataattaataataatattcaaattaaatgaggtaaaaaatagatttgataatcctactgatgatcaatcatcattttaaatatctgcgtcattatttaatataatatgcaaattatgtgaagtgaaaaatagatttggataatcctactgatgatcaatcatcattttaaatatctgcgtcattatttaatataatatgcaaattatatgaagtgaaaaatagatttggataatcctactgatgatcatcaattatcattttaaataattgcatcataatttaataataatattcaaattaaatgaggtaagaaatagatttggataatcctactgatgatcaatcatcattttaaatatctgcgtcattatttaaaataatatgcaaattatatgaagtgaaaaatatatttggataatcctactgatgatcaattacaattttaaataattgcatcatatttaaaataatatgcaaattatgtgaagtaaaaaatagatttggataatcctactgatgatcaatcatcattttaaatatctgcatcattatttaatataatatgcaaattatatgaagtgaaaaatagatttggataatcctactgatgatcaatcatcattttaaatatctgcatcattatttaatataatatgcaaattatatgaagtgaaaaattgatttggataatcctactgatgatcaattacaattttaaataattgcatcatatttaaaataatatgcaaattatgtgaagtaaaaaatagatttggataatcctactgatgatcaatcatcattttaaatatctgcgtcattatttaatataatatgcaaattatgtgaagtgaaaaatagattggataa

SEQ ID NO: 5906 - DNA, 2034 bp, Heterodera glycines
gaccgaactttaaaaaaaccggaattgggaatccggtcaggattggattgccgagattccaatcccgcttttatcggacttctgatctcgattttttcaaagagggtcgggatgctgccaccagtttaggtgcaaccatcccatggtgccctttttttgctcaaccaattaatcaagtcgaaaatttcctgcgctatttttcaaactttaaatagagataaatcgatgatccgactgtggttttctcaaagattaacttgttaagctaaatgacaaaaattaaaaataaacaaaccgtttttaggtgtatctctgcgatggctatgcatttgggcgaaaccgtgccaaaagcccggttctcaacagagacacgggtaattccctttttctttttcttgcttttgtttacaattatattcgatttgttcattcagtgaccgttttgaactatcccttcgagccggtcactattccgccgggcatcgattcggacgaatttcgacgagcattcagcgcagcgcaattgtatttggttggaacggcacatttcaggtttcttgccatatcttttcgccgaaattactttttttttgattatacaaaccctcattagatggtcaggatgaattatgggttgacgggcatttctaaaacatttcttggtatcgtccgacaatcttaacaaaataagtcccgactatccatggagtttcgggattgaatcgtagtggccaatagccatcacgcgcttttcgatgccattttcaaccactttttcagcaaggaaagctgccgtgatgtgatgcaaacggtgctggagacccagcccgactttgtgatggtcgaactgtgctcttcgcgcattcaaattctgtccatggacgagcaaacactgctgagagaggcgcaggcactcacacgccagaaaatactgacaatcatcagagaggtggaagaagtttcagaaactaacaatcacagttaaagtcgaatttagcattttttttagtttaatcgacgaattaacagtaaatactaatgacaattggcatgcatattcacgacttttgttagacaagcttcgcattgaattcagttttaacaaccaaattttagtcaaaaaatagtctggccgtacaaaaatattttagttgtgcacattggacgtgacttactacccattcgtactgcacagctaactaattgctttccccgtccgctttcagaatggactggcccagggtctgctgcaagtgcttctgttgtccctgtccgcccacatcacccaacagttgggcatggcgcctggcggcgaattccgcgccgcgcacgccgcctccaaattggtgcccggttgcggtgtcattctcggcgaccgaccgctcaatgtgacgctgcaacgcgcgctcagcgctttgaacatcttccaacgcatgaaatttttcttccacttgaccgtctcgctgggcatggaaattgagtgagtgaacggtggggaaatgatggaacaaattaactgatagaatgcaatattgtggagttttggaattcattgaatcaaaaatagctttaattatttaaaaaaggcctcccaattccctttcattgacagtgaggccgaagttgaacgctgcaagaacatggacatgctggaagagatgctccaacagatggccggcgaatttccgcaagtgtcgcgcattttggtggacgaaagagaccagtgagttcacagaatactaatatatataacattgaaattgttatcattattattttttaaatttgtattcaacattggtataactttttaattactcagaatttaaacactaattggggtgataattaagaatttgttgttcatttttgtccccaattaacacaaaagtcttccttaggtatatgacccaagtgttgcactcgctgctccaacggagcaccatggagaaactgtacgcaagcaaaaagtgcaatggtctgtctgttttttgatgcgctttcgctaaatgtttggctttttcaatacttttt

SEQ ID NO: 5907 - DNA, 3079 bp, Heterodera glycines
aaaagattttattcactgattgcagttacaaaatattttcttagcaaatattgaacaagaaaaaaaatttgaaggaagaatttttgtgaaaattttccaattcttagggatgtatttttgaaaatttttaggtcgattcttaggggtgtatttttgaaaattttttaggtcgattcttgggatgtatttttgaaaattttttaggtcgattcttgggatgtatttttcgtttttattgcattttttgggaaattttccaaaaaatgccaaaatagtggcaaaaataatgccgcagaaaaaatagttaaaaactaagaatcccatccctacttataaatttcacgatcgggtttccggtgtagacaaaaacacatcttatttttttcgccatgctcagtttcttaaaccataatttctttcatacgtgaccaaggcccactgtaattattcttcatgtcagcattgaggatagccatgcctaaagtgaaatagaacccgtatccattccatcaatctcggctttttctcgagattcagattaaaatttccaaaaataaaaccatccgaccttactgaccaaacaatgaatatttgccgattttatttaaaaaacattttctttgtattactcaaaacaaaatttttatagttacaaaagaaatgagattataaatgagagaacgagagataaattttgatggatgttacaaaggagaaaatgaagagcaaaattatttatgaatggaggatacctccaaattatggtaaaaggagaaattatgttgcggacagatgaaatcccagagaataaagatacaacaaaaaagtaatatttaaattaatttgtctctgtttctctcatcggaaagactgtctctctcctcctccactggtcatttccctgagtgttcttctctcaccctttgcctcacacaaaagcggtggcccgaggcgtgcaagcgctcttggcggccgcagcctcctttttggtggcacagccgtggctcttgagcatcaaagcgcccaagctgttcgcgtagaagtcgggcatcaggtcgtcacggccttgcatttgactttccatgatgtcgtccaccttaaaacaaatttccaaaattttaaatgccgaggacaaaagaatccaaacaaatgccatttcgagaggggggattttcggggtctgagccttttccaccattttgattcatgcaaaatcgctaaaaattttcgagcagtttcaccccgtgacagccggacaggacgagcatggagcgcagtccgtgatcgttgccaaatttgacatcggtgttcagacggtcgcccaccatcaaagtacggcgcgggtcgatggtccatcggcggcagatgtagtcgaaggcgggcgtgttcggcttgccaaccacttgcgggtcgcgtcctgaaacgaaggcatacacgtacgtacaacaaatgggtgggaaacatgcctgatgccgttttgacggctgccaccagcggtcccgcgtccgggatcaccatgttcgggatcgggccggggcacgtctcgtcctcgttggtggccacgaacatacagtcctcattcttgaaatggactgtttttaatacatataaaattcggtattcttggtaaactgcgtaagtcatccctcccgttcaaaaaacggctatattgcacttttatgagtccaaaggtagttgttataagtctaatcaattgacacgtacaatactttgttcatgttcgaacaaaccctatttgattattttcgtttgtaactttctttaaatgctaaaattctcttgttttctcgtattattacattattcagactttgggctttatggacaaagttattatataaaaaacaggtattgtcaattgattggacccataaagagcaatagagcccaaaaaactccataatagttggcaatgaaagttaaaaaaaactaatcgtaaggttttcgctacccatccccttactttaacactgacaaacgcacccgcaagtagttggaggccttcatcagctttaggtagttgaagtacttctcgtaaccgaccaccaccgcaccgacccgctccaatttctcctccaattccaagtcgtaaaggaaggcagaccctttggaggccggctgctcgtccaccgggtcaaacccgtcgccgaagtagtcaatgcccaattggtccatctcatccttgacgccttggccaccgatcaggtacactttcttgtccgagccttggcccaggccagcacggtgcagcaaatcggcaacaacggcggccgggttgacgatgttatgctgaattttggaggggaaatgccatcaatcgcaatgattttaaatttgggaaaggtatttgattaaattgaattcattttattttccctccattttgctcttcggtaaatacctcgttcacacagcgtccgaagccgagttggccaagctttcgagcgtacaccgcgcgagatttggtcgcgttgttggtcaacacgatgatgcgcttcccgtttttggccaaaaagttgacgaaatccgatgaaccggggatagactgctcgccgagccagagaacacctgaaatttaagattcgtggggaaacaaaataatttttttttatctattccacagaaattggtggccaatccagcaaccaagataacaaattcaaaattagattttgacttgttgctcaaatacaaatacccaaaaaattaccatcagcgtcaaagatgaacgtgtcgatgttgtggagcaacatttgctggaaactgttggcgtcaagatggcgaggcatcggcaaagtgaaagacggcattttgcgaccaaaatttgaataggtttattggtaagaagaggaagagagagcaattgagtcagataagctaaaaaagtggattggttttttgatttactcaatttaggaattttgatttcttaagtgatgattggaaaacagttctttcactattttggtactctgaatgaaaggagaggagaagacgttttgtgtaagcggctgcatgttacagcaagtgttttatttttagaaaacttttaaagtgg

SEQ ID NO: 5908 - DNA, 1370 bp, Heterodera glycines
ttcctcttccagtcttgtacatcatcctgttcctctttttccctttctcttcctcttcccctttgtcgtccgttctctgtcttcctcttacactcctgtccctcatccccttcctggttcctttttatcttccttttccactcttgtccctcatccgccatatcttttcacctttctgttccgcttctgtgccttatcccattccccttttcagctttggtaaaaatcaattttggtgcaaaattaattttcgacttttgttcgaattcgggtccagggttcgaaattagtcgaaatgatgtcagattcgtaatcaacgaccccgaaaaccccctagaaatgtttaaatgtatgatttaaaaacttttttttatggtctgtaaacgacattaataccctcttgtttttctagaacctgcagaattagtcaattacgagaacttccactgacaatgagctctttccaaaaagcacaaaaattgcagcggttttatacacaaaaagaaatgcgcagtgtttctgttaatgtgaaaaactgctgcttctgatctgatcagcgttccccccccccaattttcttctgtgactgacaattgcagggactcaattagccaacgctccgccagcacggaggcgcacatgactacataacatcgtggacttttacccgataaattagcgggaatggggggggtctttcgcggggaaatccctcgtcgcacagccatcgtgcttgacggcggagataagaattgaatggatgaatgatgggatggatgggcaatgtgtgtgctgtttgttggtggtcaatgttttgggcgacggcagaaacaaacagagcgaaagagttcagctgttgtagagggttgcagagagagaaaggaaaatgagagagtacggcacttttgcacagagtttcaacggtagatagagttggtgttttgatgagggtgcatagaatggcaaagaatggttgagatagtgtgacacaatgttgagaagcggaaagagcggtgagccgaggagaatgtgcagacagtgcgagactgggatgagacagtttccaactgtgcgttgagtggcagaggcgaaacacaactacggcggcggcggagccaaaaaaagccccccccccccgcccccctcgcaccgctatgtttttctgagcatttcaccaaatttggctcgctttactgctttaaacactataataaaggcgaaggacgacgagacgaagaaggtggacgaccacaaacgaagaagatgacggatgctcgaagaagagacaaaaaactcccccgcgggggggggggggttgtggcggaggatgaaaaagatggatggatggatcatcgacggacggacggacg

SEQ ID NO: 5909 - DNA, 1707 bp, Heterodera glycines
gcgcccgtctgaggccgcaaagcggccgaatgagcctataaaattttttgattaatctcaaatatcttctggaccaacaattactccacaacccataactgatctaggtagcgaagctcccaaagcgcgaagcgctttttcccagctaaatagccgacggttcacgcacccgctagttactatatatgttatattgacaaggagtttcgttgctaaaaccattttctcccggccgaaggccgggagcgccctgaaagtagtggaagggtcttacaactttttgaggagaatccgggaaaactatagaaaaaaatttagcgcggacgactgagtcccagggacggatttctcattttttcgtgcatttgggggcccgtaactttttttctaaaacccaaatcaaaaaatgtctgctgtgagggggctaagttgaagtgttttctaaaaaacaaaaaaaattccaagcctctatctgcaataggaaaggctgtaggttcgtggacttattcagtaccaactttgtccagttcagtcccggttgaataactcattagggtttgatctgggcggggagttaccagcagacttaatcactattgtacctcttttaatcacttttgtacctcttctcatcactgttgtacctcttctcatcacttttgtacctcttctaatcactgttcttcctcttttaatcactattgtacctcttctaatcactgttgtacctcttctaatcacagttgtacctcttctaatcaatcacagttgtacctcttctaatcactgtttacctcttttaatcactgttgtacctctcctaagcactgttgtacctcttctgatcactgttgtacctcttctaatcacttttgtacctcttctaacaattttgtacatcttttaatcactattgtacctcttttaatcacttttgtacctcttctcacactgttgtacctcttctcatcacttttgtacctcttctaatcactgttcttcctcttttaatcactattgtacctcttctaatcactgttgtacctcttctaatcacagttgtacctcttctaatcaatcacagttgtacctcttctaatcactgtttacctcttttaatcactgttgtacctctcctaagcactgttgtacctctttaatcacttttttaatgttttaattcatttaaatgagtgtttttttctatataaaaaaataaatttttttaatttaaattaaattgtttttttttgtgaaaaatttaattaaaaaattaaaattaattattattttttaaattattatttttggtgaatgttttatttaaaattaattatttattaaaattaaaaaaatttcatgttttaatttaatttaaatttgttaaaaataaattcatttcaatttcaaatattctataattctatatgctttatagtttatttttaataaagaaatggagaatttcttttgttatattaaaaatattattaatattcaatttttctttttttaataaaaccatttccttatttgtttaattttaaactatacttcttttaaccgtaattgtacctcttttaaccgtgtttatacctcttccacccctatggttgtaccctactaatcactgttgtacctcttctaatcactgttacacctcttctatcacttttgtacctcttctaatcacttttttacctcttc

SEQ ID NO: 5910 - DNA, 3920 bp, Heterodera glycines
ttatctaggtagcgaagctcccaaagcgcgaagcgctttttcccagcgaaatagccgacggttcacgcacccgctagttactatatatgttatattgacaaggagtttcgtttcaaaaactaattccggccggccgaaggccggccgggccctgaaagtagtggaagggtcttacaactttttgaggagaattcgggaaaactatagaaaaaaattctcgacgcccaactgagtcccgaggagcgatttctcactttttcttgcagtttagggcccgtaactttttttctaaaacccgaatcaaaaagtgcccgctgtgagggcactccgcagaagtgtcctctataatccggtattttttattttttgatcagaccaaatcccggacctgtacagacacggagactcagttaattttttttccccacttcagtaccaggcgaataactcattaggctttgacctgagcgcagggtggccagcagacttattgtagagctttaaaagcccgatttttccaaattttaaaatttcgaaaattttcaaaatttttcgagctaggcctaaaaaacggttttcgggtttttgaattttaggattttttaacaaattttcccagaaaaacgaagaccacttccaaaacatagtttttcgagctctatcgattagtaatttttttggaaaattttcgatttttttcaagaaatagaaaaaatttttggcctcagcgggacatttgagtcctgggcccataactcgtcaggggttgattttagcgaaaaattgacttaggacatttttgtagagcattttaaatgctatcgaatggtgtactacatgtttggaaaatttcaaaaattttcgagctaggccccctagaaattttcggaatttttttttgggttgaaaatgtgggtgtaaaatttttttctggggtattttggggtgctgagcacgaatatgatgtttgtttttcgtttcatgatttttggaattttttaaaaattcgaaaatatttttatttttttggtccttggaaatttgggttaaaatttgaaaattcatatctggcctagggtttgaccaattttgattaaataaagcattaaaaatggagaaaaatcaggagaattttatgggttttatttggcttttgtaacataaatatgaaaaaagttattctagaaattctgtaaaaattcggattttcagaaaaaaatttataactcgcttctgaaaagatattcaggaaaagtaaaatgctacaaaaatccgcaatttttagctctattttataaattttatttcacatttttatcacttttttgaaaaatgttataaaaataaaagtgattttgggattccagtccaaaggggggtgaccaggatttttgagtggaaaaattttttcaccaaaaatctttcaaaaacatgtcattagggctattttatgacgctgatcacgaatacgtgatcagattttacttttaacatcgataagacctcagaatccctgtgtgattggggattctgagcatcatttgaggggggaggggtggggaagttcgaatccgggcggtgtacattattttcgttatatttatggttatttttaatgtttttaattcatttaaaagagtgtttgttatataataaaaaataaatttttttaatttaaattaaattatttttttatgaaaaattttattaaaattaattatttttttaattaaataatttcatatatttttttttatttgagtttttcagaaactaatttgatttcaatctaaataaatttaaattattataagcttcaaagttttttttaataataaaaagaggcatttattttacaatttttaaaaattattaatgcatttttgtacctcttctgccatttgttgtacctcttctcatcactgatgtacctctttgaatcacttttgtacctcttttaatcactttcgtacgtcttttaagcacagtttgtacctcttttaatcacagttgtacctcttctgatcactgttgcacctcttctaatcacagttgaacctgttctaatcactgttgtacctcttttaattcagttttgtacctcttttaatcactgttgtacttcttttaatcacttttgtacttcttttaatcacttttgtacgtcttttaatcactgttgtacctcttttaatcactgttgcacctcttctaataacagtttacctcttctaatctgatgtacctcttctaatcacagttgaacctgttctaatcactgttgtacctcttttaattcagttttgtacttcttttaatcacttttgtacttcttttaatcacttttgtacgtcttttaatcactgttgtacctcttttaatcactgttgcacctcttctaataacagtttacctcttctaatctgatgtacctcttctaatcacagttgaacctgttctaatcactgttgtacctcttttaattcagttttgtacctcttttaatcactgttgtacttcttttaatcacttttgtacttcttttaatcacttttgtacgtcttttaatcactgttgtttaaaattgataaactaaagaatttatttgttttttttaattagaatttgtcaacaaattaatatacaataaataatcaatcattgtacattttagaatttttaaaaattcgaaaatattttcaaactttttttggccttttggaatttggacgaatatttgaaaaatttcaaggggtattttgaattatttaatttttttatttaaattgttttattaatttattttaaattattttctgatgaataactgttttatttaatttgaattttcgagaaattaattcctttcaatttcaataaatattctatattataaatttcgaactttatcatagttttacttcttttaatcactgttgtgcctcttttaatccttttatatctcttaatccctgtgtgattgcccgtctgagttcaactaaattttaaaaacgggcgcgaagcgcccgtccaaggccaaaaaattgaaaaacgggtgcgaagcgcccgtatgagttcaatggatttaaaaaacgggagcgaagcgcccatctgaaccaacaaaatttaaataacgggcgctaagcgcccgttcaaggccaataaaaattgaaaaacgggcgcgaagcgcccgactaaggccgcgaagcggcataacaagctaaaaaacgggcgcgaagcgcccgtatgagtttaacggatttaaaaacgggcgcgaagcgcccgtccaaggccaacaaaaattgaaaaacgggcgcgaagcgcctaacaagctaaaaaacgggcgctaagcggcagtataagttcaacagatttaaaaaacgggcgcgaagcgcccgtattgagcctcgatgtgtactaataacccataatagttttttagaaattcaaaaaaaagatctccaaccaattcaagtctccacgtcccaaagacgagagcgccctgaaatagatgatagggaattacaaattgtggagaattatatgtgaaccatataaaaataaattcactttggcgaactgatattctagaatcaatgtcccactttatcttgtagatgatttaccgttttattataatcaatgcttgtctttacatgatgacctgtgcaaatttttcccaagtcaaagattcttcttataataagtaccgtacctaattaatagacatttgagattctagcgctttattacacaaaaacaattaatttattttcgttagaaggaattggtgtgtaccaagaatatacatataatacatcgcaaaatatgtgcacaaaatatgcactatgcgtagtatgcacaaatatgcaaatacgcatatggaaatacgtccctagaaacacaaaacaaatttaaaa

SEQ ID NO: 5911 - DNA, 1944 bp, Heterodera glycines
  misc_feature (1902)..(1902): n is a, c, g, or t
tattaaaatttccaattcattttctccttcattttcattcacatttctcacaaaagcgatttgtgattcctgctcttcctcactgctttcaaatccaaattcggtcaatgattttttaaattctactccctttttgtcccttttttctttatttaaattttcaatttcagtatttttttcttcctcatcaaaactttcttcgtcagttttttcctccaattctaaattcgggtcattgacaaatttttcccaatttaagggttcatccgcttccctcaatggaagatcgaccggtccattatacatttttcttttcttggtggacttttcgcaattttccttttttatttagcgattgtaaaattatattatttttttctttttccactcctacacattgaaatggtcctgaccaacgttggtcaaatttatgttttaatacctctttttttaacaaaactaaatcaccaattgttgtgttcttccacttagaacacacaaagaaaaagaaataaataaataattttattgattcggtcggagggcaaattgggaaataaaatataaatgaatgatgaaaggaaagaacaaaaagtgggaggaggtgtccacttttatggacgagggaggaggcggatggacatagaaataacaaataaagtcaataagtcagatcgccataaattcaaattattcactatccaacaccaattttaaattcttttctgtcgcttttcgactgaatcatttacctttttaaatttttcttgtcctttttctatttcttcacgcactattttccaagctttcgatgccttttctgagtgtatttttgtataaatggatatatctgactctaaattttcggagttaggcaactttagcaatcggtctactggtaatttagaatgtcgtaaatatactatataaaatggtgtgtgtttaataactgtatgtatagctgtattataagcaaataatgcatgagtcagtaatttatcccaattgtttcccttttcatttattatttgtgacataatattagctacaattctcattgagccttctgcttggccatttgactgttgatgataagccgttgacattgtatgctcaacaccgtaaatttttgataaattactaaatatttctgaagtaaattgtctgccttggtccgtaacgactatttctggggtggaacatttatgaattactgtctctacaaaagcttcggaaacagtctccgctttttggtcagaaattgcttttgctgttatccatttagaaaaactatcgattgtcagaaaaatgtagaaatttcctcggtcagttttcttaagtggtggacccattaagtcacagtgaaccctttgaaatgggtattccgctgcttttatcggaacacttggtgagaaatttgattgacctggttggactttccttctctgacacccatcacatgcatcaatcaaaagttttacgtcttctttcattccgacccaataaaatctgctttttcaaatccaaaatgtcctttgtcgtgtatttcacaaaaaattctttttcttaatgagtgaggtatgattaattttggattttcagaattctctgtccctttttggttataaatcgcgccgtttatcaggcagtattccaaattacctttttccatttcaaaatttcattgggatattttccagtttttaaaatataaaaaaattttgctaattcctttacttgccgctgttcttcaattatttcttttaaagttattttgttgctattgtcctgattttcttttttgctttcactattctcagtactcagaattttttgcgctttattttcttttttgtttttcttttcacttaaatttatttctatttcgtcttcggttcctgngatattgtaccgtgcgaggaaatctgcggctttattcttttt

SEQ ID NO: 5912 - DNA, 4820 bp, Heterodera glycines
ctttttattaactggtattgaaatttaatgcttttaattttctctcaatagctctaaagcgcttaaaagcggtctacaagaattcgtattgatttttcatagtacctctatacaatattttattcttgcttattaagtcagtattgggtaaataaatcttttatttttctctcgaaaactctaatgcgcataaaagtagtctttaaaagctcataaaaattagtcatgttacctctaggtaaataaagcttttatttttctctcgaaaactctaatgcgcataaaagtagtctttaaaagctcataaaaattagtcatggtacctctatgcaatattttattctcgccttttttaccctctaaatataaactgcatcaggtttcggaagggtcgagttgaaagatcatgaaaattgtaaattggagattactgggacttatcagtagggagtccaattatatgcacatgcatatttttttcctggactgtgggaggcctgaaacgcacgaaaaacatgtttttagcgtgttttgaagcttctaggatgactttccatatgcatgttttgcatatttgtgcatattttggcatttcgtgcatattttatgtgcatatttgggcatttttccaaaaaacctctaatagaatggccccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaaaaagcaaaatttcgctttttgggttggtttttcgcaaaaaatgagtaaatttttgctttatcatgtttttttcttctaaaatgatttttaataccacatttagccattttttgaagattttacttaatatttaacaaatttgaagaaatttagagatattacacccttaatttggaaaatttatatgcatatttttcactttttatgtgcatattttgccatttttggtgcatattttatgcgcatattttgcgattttatgtgcatatttttggactccctaattatcggtcactagaaatcactattttggcatttttactcactattttagttaactatttcgggatttttcttcactaaaattcacgtccctatgtgagttctggtgcattttccgacgttcaatcaatgtccatccatcctgttttttttgactaaaacatttcgaactaagtcaaagtttacattcagaatttgcctaagtatacaaaacttttaggctctaatgcagtttatgagtccaatcgacttttatgagtccaaaagtattttatgagtccaatcaattgacaatccagggtttttatacaataactttgtttatgttcgagctaaacctatctttttggtatcattcgaaagcacaaagtctaaataatgtaataatacgataaaactaaagaattctaacatttcaagaaagttacaagcgaaaataatcagcaattacttaattaatcaaatcttttttagcaattgccttaacgatatggttttatatattttatttacagaatcgaattaattctaatatttgcttcaaaaaataataagtcaaaacagcaatggaacacgacgagcaacaaatgtcgatgctgccgtacgaccatggaatggtgagagggaggggggggggcggagcgggggacccacgcgtttcggcgctcccgtttcggcgccagctcgtttttccacttaagcttttttctttggcatccaaatccaacaatcttggtatcattcgaaagctcttaacatgctctattagccttatcaaaaacgaaaagtttttcaagcctgtaaaaattttattaagaaaaaatttcgacttttcacaattttcatgcataactgttttgataattgtctaatcgcaaagcaatagcttagaaaaagcttctaaatagattaagctttcgaacgacaccaacaatactggatttagtttacaaagaaaaaagttatagccaaaaacatgctggcgccgaaacgcagtggaccccggagcggtgccgttcaattgcatgttaaaatattcatttcttccatgtttagctgttgtctgaggacgcggaggaatttctgctgtttgatggtgattttttggttcgcaaaactgaagaaatttccgacgatggacgaatttttgtgttgtctgtgaatgtcgctggccgagtgagtcacattgttttttgccgacacgaggccatggcggggatgtacaccattgagggcaatcctgagggtttcctaaccatcgaacaatttgtcaacaattatcttgggtccagaacttcgatcatcagcgtaagacaaagcttgaatttttttttgttgcgtgattttctattttttcaggggcaatctttattaagtaaaagcctatccggcggtgggaaaatttcacaaattttgaatgaaatttgcgatgaaaaatgagttaactttaattaaatttattatttaatttatttaaaattttttggcattctgtcttagaaaaattttcaaaaaatcaataaaatcccgcataatcccgcacaaaaaatcaaatttgcggatcccgctgcgggattggaactcaaaattctttgcgggacgggatcccgcgggattaatcccgcaaatcccgcattttccaaaaaatgcgggattgcgtgggggtcccaggttcggttcccagtgcatgctattgatgtatttcgatgattttaatgaataaataaaaggaaaagtgaccaaaataattttaaaattgtttcaaatttttaaaaactttatttgtcacttgtaatgaaaaaaaaaaccatcaatccgcgatcagtcaacgatatcgacttcggcatcttgatcactttcttcattcgttttgtcaccttccgcttgctcccgttgttcctcctcccgcttaattagttggttaaaatttttaaaattcccttctgtcagcccaccagcttcaattcgtcaaatctaccggtgtccagcagccaattcgagacgaaatgatgctccagctgttggcgcattttttcatcgtccggcatcgtcttccaaagggaatgcagtgcctcatctcctgaaaaattatgaaaatttgaacttttcccagatgtgccattgtttggcaaattattttgccccattccatctcgaaaagggcctccatttgatcggcgtggacgaggattttccggatgctgttccccgtcatgtctcgctttcttctccagctgttcgatgcgctctgatcgctcgtcaatagccagcggtggcggggtcgtctctccggtgtccattggcgcagtttgtgttgtcgaaaacggcaccaaatcgccgattggtgtgacagatgtcgacggcagcgaaaagccaaattccaagatttcctcgtccatctcgggcgtcagcactggtcctggagttggtggcggcggctccatcgcttcttcggcaggtgcagcagatgttgacggccctgcgtcttgctgtggcgtttcgggattgggattcggcggtggagcggctgaaatttaaaaaaattatttttgaattaaaaattggtgaaaaaactcactcttcttggccaaacgggctttcgtcgcctttgccattttggttcgtccgctcctcccttttttgttcacgatttgcgttgaatttcttgcgttaattttgctcaataattttcttttaggcatctaaaattataaaaataagttattaatttataattttagattgaagcgtaaaaaaataaaactcgagcgttaaaaatattcataatatttttctctatcgatatgcaaaatttggtgtaaattgtatgagtagaaaaaaagttatatgtggcgaaataaatgtcgtttttcctaataataaaaatattagatagtacgccaaaaggagagaaaagttagagaaaaaagatattgttttttctctgcattctctatttattggtacacttctcgttttttggaatggtgtgttaaatcattttcttttctcaaaaaagcagaaaattagcatctcaaaaaaaaatcatcgttgaacccttgaaaagcagcaataaaatggcggagtttacgaaaggacctagcacccttcaacagttgtgcctcatgcatttttaactctgtttccagactttagcttttatcatgttttttcttctaaaataatattttcatacaatattagcaatttttgaaggttttactttacatttagcgaattttattttgagaaattataccataaatttgtaaaaaattatgtccatatttttaaataataggccccaaactcaaaattgtttaaaaacggtcagaatcgatgtaaaaaggttcgaaatgggttggaaaaatagaattgggggcgcgcttgccatttttcaggctgaaaaagtgccggaattggagtgccaaactcagctgggactcaagtgaccgcactataaaaagcactaaaaagacattttaaataatttttctagggtaatttttggcgctgatcacgaatatgacctttattttgcaaaattccgaaccccgaatccaaattcgacgaaaaactcaaaattattaaattaaacgaaaacatattatagggggttttgaggttgctgaacacggttatgacatccattttgatcaaattcgaaccctgacgcgaacaaaaaaccgaaatttaatttaagagtaaattcaaaattaagcctaggcttaggcttcagctt

SEQ ID NO: 5913 - DNA, 6205 bp, Heterodera glycines
  misc_feature (1483)..(1483): n is a, c, g, or t
atgttttatctattgattttggcctcttgtttgtggtagggaggagaaagctgctgctgtctttcaaaagaagaaaaacagcaattaggtaacacacgacgaacaattgaggccgtatttggagatataattagattaacgaaagaggccaaagatttttctttctcggcaaataccatggttgaagctcaaaaaataaaagataaaaatcctagtgttcccgaggtaaaattttggcatgaaaagcttttaaatggggtaagaaaaatccatacgctatttgataaaataaaaaatgaggagaataacattaaaaatataaaaaaaagtatggaaaaatgccttgatagaaaagatgctgaaatgggccaagaattagcggatgaggcaaaacaatcaatagaaatagcaaaaaactatagaaaggaaattgggcaaacctatcgggccgcttactcaagcccgatttaggcattggagagttggccaataaattaaaagaaacaatgcgagacaagcaaatagatttggaaaggccgagacccaaacagaatttagagacgaatttattgcttataaaatgtcctggtgaaaagaggtgaaaaccaaggaaatatgtgaaatgtccaggaataagtggtgaaaagaggggcaaaatattccataacaggtgtgaaacatatgaaaaaatatgtcataacaggtgaaaatggtaaaaaatgtttcgtaatgtaattggtatggggtgacaggtattgttgtgttattatgtgatttaatggtcagtttttcccaatcatatttcaaaagcggcattttgcgcccgtgccaaccaaaaaaattggtgccagccaaaaaaatacgcagcagtgaaataatgtgacggcttccttttccatttcgtcgccgaccaaattcaaatttgactctagcgtaccgttttccctctcacctgtcaatcaaatttcaatctttcgggactctatgcgcttcgttttcccttctggcggaagtcatgcaccaaaaaacgtcccctctcggggtgccatccccttcccacctgtcaatcaaatttcgtagccagccaaaattcaaattttggttctctcgcgtgccatccttctctgctggcgttcaaattgcttctttcgccggtcttttcccttctttcaccacacacaccactgaaaatcgatcacactcttccgctaattactccgccccttcgcatttgtgccagaattggcgtcctttcattcactcttctactctctcaaaaaatcagctttttcaaccaaccttctcgcccagctaatttcttttttattatcttcaatttcctaatttaattcgtgtcagcgcagcacgtacttgcagtgtttgtgagggagaagaacgggaatgtgaaatttgtgaagggccaagaatggtcacctggtcggcaaaagacggcttggaaccgatgagcgaatttgttaattgngtgaagggcttcagcagatttgaaacggtcgcttttgcacattacgggggacggttcgactcgcatttcgtcttggccgaactatcaaggaaggaaaacgaaactgagctaatgatggcggaccttaagatctatcaaatcaaagcaggaagggtgtgctttcgggatttctggatgcttagtcagaacaagttggcggatctccctaagaccttgggactgagcatcgcggccaagttgtactttcctcacaagtacaacaaaaatgagaactttggcaagagattgcccaatctgccgccacttggagactattgccccgacagtatgaaggaggaggaagcggtaaaattggaatcctggtataagggtaatttcgcaacagatttcgaattaggtaggcagaaaaaatattggcttcttaattaaattggttttaaggggaacagctcagggttttgcagtgaggtattttgaatggttggcgcaacgcaaaggggtgaaagttcgacatgcctgcaacggcggggaggttgaatttggaggtgaaagtggactgtgtgattggtaccgaaaagaaaatcattgaatttcaggttttaaaacatatatatgtatgttcaaatttctattactccagggatgtgcatttcacgggtgcccgaggtgttatctgccgtggacgattggaccaaatgggcgttgcatggaagagaattacagaaggacagagatgcggatggaaaattgagagaaaagtgtatgttaagggcagcgcccttcgggtttcgagtgtggtcaacataacgccacacgcaatgccttttgacccaatcgatattcccttcccctctgttcgtttgttatttaaattcaccctttccctcattcatgttcactcttccctattcagttcactttttgtgcaattgacattattgttcttccccaatttctcttcatttattttcttctaaataaattgtattgtctgcacccaaaataaatatttatatttgttggacactaaacattggcttagcacccattgtgtggaccgaacaaaattggcgacgcccgttcggaagcagaaaaaaagaggaggacaaataaaattgcagcttttagcagcaattcaacaatttgttgactcaaagagaagtcaacaaccaccgcaacttttcaacaaatttgtcatccctgctatacagcttggcgctgttagcagaagaaccggcattccgctagaaagctttcagcttttagtgtgaaagaaatattttgcgctgctatttatttgtctaggcgacaaaaacttagctcaaccacgcgcacccacactgatagcatccaggcgctgttatcaatagtgtggtgaacaaccaaaagaatggcacaaccgacggcacaagagcttttaaagctgattgccgaccagcagacggcgatgacacaacagcagcaacaaattgcacagcttttagctttgcaacaaacgcaaaaggctgatacagtgctcacactgccggatgtggccatcttcgagccgagtgatgacaaatcgcgaataagcgaatggctaaagcgcgcacaattcgcaatcgattgcgtgtctccaaacgcatcggacgctgtcaaggttaaggcgattatgaacaaactctccgaggcggcattcagcgagtacaccaaattctgtctgccagagcccgtgacaagtttcagcttagacacaacagtcaaaaagcttgagaagctgttcgccaagcctcaatcgatcttcatcgaccgatttgagtgcttgatcgcccgcaaaggggagggagaggacttccgatcttttgtcaaccgtctcaagcgtttgatcacggatttcaaattcagcgacttaaaagaacaacagttctatgtcctgatgttgctgacagcgctcaaatcgcacggcgatgcaatgctaaggcaaagaattctgtccaatttgaccgcggatggagacaacatcacgtatgatgcggtggtggaggactgcatgaattttatgactacaattgcggaggccaaagtcatcgagtcttcgtctagtggaagtcaacgaagtcatgccgtaaatgcagtccatccaaaacgagaaaagccgaagtatgagagaccaaaaagccaacaaagcacaaagacggagcaacaaaaatgctggaggtgcggtcaaacgaaccatcaccacgcagcttgcccgcagaaaggctacaaatgccgaaagtgctcacaaaacggacacatcgagtcgcgttgtgaagcagtgcaggaatggcgcaaaaagaacgccaaaagttggctcaagaaaaatgttggcaatgtccacatagtgacagtcaacattggcaccacagcaaaaccgacaacaaagtcaacattgctaagggtcaaggtctcctttcaaggcaaagtcatcgaatttgtcctcgacagcggtgcagaagttaatgtcataaacgaaatgacatacaaattgatcggcagccctaaaataagacctgcaaaagaaaaggcagtgctttacaatggaagcacaagaagcttcatcggaaaagggaccggcacattcgaattcaacggaatgaatgttgaacacgagttttatgtggccggcaaagattccctaaatttgctgtctattcaaacaatggacgcatttgggctgctcgacgaattgaaggaaaagatttcctcaaaaatggtgaacatgtgcaaaggcggtaataaggagaacgctccaagccgaccaaaaggcaccgaggtcaacgaatacctcaccaagctgaaagaaatttttcccaacgtgttcaaagaagaactcggattttgcacaaaggcaaaagcaaatttggtcctaaaaccggacgcacagccaattttcagaaaggctaggccggtaccttacaactcacgagaagttgtcgagaaagagctggaaaggttggagagcctaggaatcatcacgaaagttgagcacacggattgggcggcaccgattataatcgtgaaaaaggccgacggatcagcccgtatgtgcatcgactactcgacgggcctcaacaacgctctattggaccatcagcacccacttccgttgccaaatgacatttttgcgacgctgaatggtggactagtcttctctcaggtggacttaaaagatgcctacctgcaaattgagttgactgctgaagcaaaaaagctatgcacgatcgcaacccaccgtggctattaccaattcaaccgattgccattcggtgtgaagacggcaccaggaatttttcaatccatcatggataaactcctggccggactcgagtttgcgacggcgtaccttgatgacatcataattgtcagcaaaacaaaggacgagcattttcaaaatctggaaaaagtgttcgatcgaatccaaagctggggatttcgggtcaaaatggacaaatgtgcatttttcaaaaaacaaatcaagtatcttggccaaatcatcgacaaggatggaagacgacccgacccaagcaaaatcgcggcaataacaaatatgccagcaccaaaagacgtcccgtcacttcgcacgtttcttggaatggtaaaccattaccaacaatttgtaaaaaacatgcgattcgtccgacaaccattggatgatcttctgaagaaagacaaagactgggactggagcaaagaatgccaagaagcattcataaaaatcaaggaaattttatcctctgatttgctcctaatgcattacgacccaaaactggaaattatcgtggcagctgacgcctcagatcatggaattggcgcagtcatttaccaccgatttccaaacggagcaattaaggccatcgaacatgcctcatcatctttgacacccgctgaaagaaactattcccaaatcgaaaaagagggattggctttgattttcgcagtgcgaaaatttcacaaaatgatctacggaagacaattcattctccaaactgatcacaagccactcaatcgccatttttggcaacaaaaagggaatccgccagatgagcgcgaaccgtcttctacgatggtcactcatgcttttggcgtatgacttcgagattgagtatgtgaacaccaccgaatttggacaagcagatgcactctcgagacttattgcaaaaagcaccggtcccgatgaagatcgagtcatcgcgtccatggaatttgagaaggaagccgaaaatttcttcatcaacactttggaaacagtgtcactctcatcgaaagatataatttcagcaggaaacgaagacgaaaccatcaaaaaggttaagaagtttgtcaaagatggatggcccaatgacaaagcaattgcttcggaaacggaagaaattaaattgttctttcgtcggaaagatgacctctccatcacaaaagaatgtctgatgtacggagaaagagtcgtcatcccgccaaaatttcgagcgaaagtcctccgaatgctccacaaaggccatccaggaataaagcggatgaagcaactggcacggaaccacgtgtattggccaaaactggacgcggaaatcgaggatttcgtcagaaattgtgagccttgccagctcgcggcaaaatcgcccatcaaagcggagctgcattcgtggccgaaggcgagcaaaccatggcaacggaatcgcatggactatgccggaccatttacggaaa

SEQ ID NO: 5914 - DNA, 6385 bp, Heterodera glycines
accaacaaactccgtctttacaattccatcgctttcttcggctccgctcttttcctcgcaatgttggcatttttccccactgaatatccctcaatttgtctcggacttttgggcatttcggccgggcttttgggtaaaaaattctgaatttttctgaattttgggattttcaacattttactaattaggctttaccaccggcggattcttcaaagcgggcccacttgtggccaaacatttcgcattggtcgtaatgggccaaatttcactcggtgagcttacaattaggggggggggagaagctgaaaagggaacaattttgggatggaatgccatggattcaatcaaataaaaacaattatttattggcataatgttttagcgattaccgtaacacttttgctggtgccaattatgcaaaacacttttgcgccgcataacacagcggaggagtggcggtgcgctttccaaattcattttaatactttttaattattttaatttaattttacttattttaattattaaatataattttcgcttttcgttggttttgtccattgtttcgttttccatttcagctccgtctttctgatcactgctgccactttggcactgacaaacgtcgctttttgcttcctttgctccgccgaagcggccgaatgggcaaccgacgaattttcgcgcagcgcctcgcgtaacaaagtgcattgtgtggaggcggcgcaggcgccacaaataaacgtgccgaaaacgttggggtgaagcgaagccgcccaaaatgttacaaagaaaaacaatgtgatttgtacagaaagaaaaatagtctcaatttttgaatgcaattggacaaaaagggcacaaaaattgggggggggggagaaatggcacaaaaagtgaaaacaatcaatcatttggaaattgattgcctttaattacccccccccccctcattagttccaattttcacttttttttctccctttccctccgattgttcccttttttggccttttcttttcttttccctttgcctttggtcccatttttcttttctttctctctctgaccatttttagctttaattcgttgtttttgccttccactgacttttcttcttaaatttgattttgggtattttttcgaatttcgcagaaaatatataaaaaatgccgtggcattgaaaagttacccggaaaaatatttatttaaaaatttgtatttttgttgttgttagcaaatgatgaagtccaattttataaatattttatgtcaaacaaagacacaataaataaatgcaaaatttgaataaaaaaataaagaaaaagaaagaatcaccgtaatttattggaattttgaatggacgaacactctgacagagaaattattattatatggatgtacggtaggaacaaacaaacagacaaacatacggtagtctgtcatttggtattgaaagagaatatgggaaagggggagggcgagagagagaaaggaaatggggaagagatgaggatagagagaggagagagagagagaaagagagagagagggaaagagaaagaaagagaagaaggtaattaatgaataagtgacgaaaattcgcctctcattaatattttgctttggcaattaatttcactaatttatctctgatcagtagtcactggccaatgtttgctaatactcgaaatattattaattaaatgcttattaattaattaaccttaattagcggatagcaattaatgcaaattgccaaaagacagagatcaatcaataaaaatagactaaaatagtctaaaatgcataaatggaaattaataccacctgaaggaagaacatagccaatagcacttactgaaggacggtatactgtaaaagatacggtagaaaaggaaaggaatggcatacagaatgggaccgaagaaagagattgggagagggggagagagagagagaaagagagagagaacgggagagacagagagtgaaggaaagagagagagagagagaaagagagagagaacgggagagacagagagtgaaggaaagagagagagagagagagagaaagagagagagaacgggagagacagagagtgaaggaaagagagagagagagagaaagagagagagaacgggagagacagagagtgaaggaaagagagagagagagagaaagagagagagaacgggagagacagagagtgaaggaaagagagagagagagagaaagagagagagaacgggagagacagagagtgaaggaaagagagagagagagaaagagagagagaacgggagagacagagagtgaaggaaagagagagagagaaacaatagcagcagagtttaacataaaatagtggagaaaacaacaataataaaacaaaaagtgcctaagcgccctttgccggccatcccccggggcgacgcgcgtcggccgtttgtccgcttaaagttcggcatgcatagtgcgtccgctgccaataatgccctcttggcttccgcccgaagagacggacatccgtcgtcccccgcccttttgcttcgcgtgcactttcgtgtgccgtttccgttcgtccgaccgtgcgaattttcgtccgcacacatcgcaacagaagggcttttcgcccgtgtgcgtgcgcatgtgcgtcgtcaaatggtcggagcgggagaaggcgcgcatgcaaaatttgcactgaaattgaaaaaggaaaagcatttggcactttcaaatgcttctgcttcgctgatttgctcacttggaatggcttgtgccccgtgtgaattcgaatgtgccgcgtcagttcgtccgagcgcgagaaacgcttgtcgcaattgtccaccggacattggtgtggtctttcatgcaccggcgtcctcgcgtttcgttggaatggcgaagttgaggcctctggcgtcgttgcattggccacaatgtcaggcacagtgctggctgtggcagcgcccgaaaaagtggagcgccgttcgcgcgaccgttgcggaacgaactcaacggccgaaacggacgcgatgccattagcggaatgttgcggatgggcggcattggacggaaacatcggcgccggttgataagttggccattcatcgaacaacggcggctccagcttgaaattcttaaacaggtcaatgccttaggcaatggaaaagcccgaaaaatgccatttgcgaagtgccaaagtgctgttggagcggagagtggtgcattgcttccagtgaatgagcaccggccgaactcgtcgtcgaggtggaggagttaggccgcgactgctgctgctgcggtgtcaatgcgaccgttccgccggaaagggtcgtgccgacagtgcccggggcgtttccgtcgttggctgaagacgcggcggagactgtgcggctgctgctgtgggtgttgtgactcagctcacaactgcacgaaggggctggcataatgctgcagctgatgctttgatgaatctgcaacttcagagaaatatccgatttcaaccccaactgatcaaatgcttttctatcagatcaatctgattacccccaccactccacctgaaatcgtccggccggcgagcacatttggtggtgttggtgaagtgccgctgatccaccacccgcttgtccctgctgaagcccataggcgctgaattggtgctgctgctgaaggaatcgaaaagatcagtcaggcattcccttggtcaacatatcgcagttcagacttattacttatttggacccgatcaatctttccctgggttcggtctgatcactctctcaccgcttgtccatgcgttgctcctcctccgccccctctgctgccgtactgttggaagtgttgctgttgtatgctgtggttgtgctgcggctgctggtgctgttgatggctctgctgttgcacaatttccattggctctgttccgccgatgactctttgcgctgttgcaaaactgttgttgttgttgctgttattattgttgttgttgccgttgccctccaacgaatgcagcaaatgcttttgttcgcccccgggcgtcgtcgcactgctcgcggccgatgggaccgcctcgggcgtctgtttgccgcacgcgaggggaaaggcaccgccgtcatcgctttctctcattgcctgcggtgggcaaaagggcgcggcatttttgggcattcaatttttgggcaaagtttttacctcatcggagatggacgttttgctgttggtgtccaccgaaaggacgggaaggccctgattacgccagcacgactggaggaagtgctccacgaggggcgagaaggtgaagaagggcgtactcagtcctaaggatttggaaaatcatttaaattacattttaaaattccgtttgtttttgttttttgctttttgtccgaattctttctgcaaaatcatctccgttcgttcgtcactttcacaatttgcgcttctctgccttccccccccccccctctgttaattaatttgtcacatgtttctcccccgggggtgtcttcttctccccccccccctttcccttttttcctatcggacaattcggcgaacaaattattgtattggtaaaagttaattcgcaactgttttggtgaatctcggaatggaatgcctattcgttcttcagaggggggggggggggaggtgcagagagaggaaaatagtgaaaagtgtcgaaattggcaaatgccatcggcattttgggtaattaattaagcggatttcaaatattaataatcagtgggaattcccttctttcttcgcttccgacttcctctcacctggtgagttcaaattttgtgcattcagtggcaaatttgtggagatggaccctttgatttggaaactgagcttctgatcagttcctccggcgttattttttgctgttggcgttgtgccaaaacttccggtggacgcgtggagaagcgaagcggcggaacgatgcgcacactcagcggaagaagaagaagaagaagcgccttttgaggggggggggcaattatggaggaaattaattcatttatttagcaaaataaaatcaaaattggaattttacttggctggtgatggtcggactgaggcggtgagtggtggtgagaagatgctgacacaacggtggaggtgatttcgatgttggctaaatggggggggggaattagacaaaaaaagggggagggcatggccagcaaagcaaaagcattggcaatggcaaatgccatcgattggcattgatcatttacagaaaagttaaaaaacccatcaaaatgacacttttgtaaattgtttgaaatcgtaaaaagagaaagaaaataataaataaatttaaatttaattaaatttttaatttaaaaatcaaaaagttttgtcctcctcagagtatgtgaatgaataataatgggcttcccttttcctaattattcattcttttccatttctccacctgttagcaatggctcgtggtccccgaaaaatgcctgtgaatgttgactttttggtgtcgccgagttcaggcacaacggcgtgttcagttcgtcgatgtgaaccaattgctacgggggggggggcggtgcttagaaagacacgcccctcagctgatctctgatcacatgcgacacgaatgaatcaaccaactgattgcgatgcgctttttcatattatttttaatggattgactgatcaatgacagcgtttatttatggggtgacgaggggtggggagagaaaggtccttttgggctcttaagccgtttttgccattttaaattcgtgtcgcattgcgaaacgatgcgtgccgtcgcgtcaagacgcgtaccgacgattttgggccgctgccgccgcctgcgcaagtgtttgttggcgatgtgagcagtgcggtcggcgtgcgtaaaaggtccggaatcttcggcgtcggcgtttccaaagcgtgtgccaaaagtccgtttgaaagcaatgcgccggcggcaacgttcggcgtcattctctgctgccgattgccgcgtattccagcggagttcgcgtgcaatacgcacgcgctgttgtacgagtcgatcttcagctcaggaacattgggtgtcctccgcgttgggtttccgcttccgccgcctgttcccgcgtgtgcgcttttgtcttcggcggttcggtgcgcggaagcgcaccgcagctgaccaggttcaggctgtggttgttgttgttctgctgttagcgtcgtaattgtctctaacggctccaccggcgatgctccgtcagtcccttggccaatgtcccgaggggaggcacacggcgaatccgacggagacgaaatggggcgcggcggcaccgctgtgatggaaggcgatttgaatggaagagaaaaaacggtagaagcggcaat

SEQ ID NO: 5915 - DNA, 3519 bp, Heterodera glycines
actgattgtccaaagatggccaaattttgcacctgacaccatatcgttggacttcgagcaagcggtggtcgctgctgtccgcacagtctttccactttgtcgtgtgcaattctgcttttttcacttggtgagaagtatgaagaagcgaattgcttcagagggtttaacacaggtattgattgcatttttgtattttccaatagaatttttcattttaagacatacaacaacgatgccgtctttgctgaaaaaagcaaaatgatcacttctatggcgtttcttcctgtccaccatctccctgctgctctcaatgctttgcaggcacaacttcctcaacaacttatgggcgtcttcaattggtgaatacgggcatttgattgtacacatccaactgtcttccgcttcatcaacacaattcgatgtgagcaaaagtctattgatgcagaaatctcacgatgcatcgctggtgaactccctcctcaaaaggcgcccaaatatcgtgccgccgatgcgagaattcttcgactcttgcagagctacaatgccatcaacaataaccaggctcaccaaaatgatcacaattaccatgcccttatcaatgttaacccctataacatcatcaattttctccttggtatttctcggaattatgagatgcgcccgtaatattttcaatgttttgttatttttttgttgttaacacattgataaatctattatggtgttaattttaaagaattttcgagaaacaaatcagaattggatcaatgtaggacaaaaacagcttgccagactaaaacggccagactaaaccgacccccaccgtgcaaaattgggaaattcggaaaatgcgatttgagtttttataaataatgggctggaattaaaattcggaaattcggatcccaacgttttattcaaaatttatacgaatccaggtgatcagggttcgagaaatttttgggacaatttcttgccttaattctcgagagcagacgatccaagaaaaaaaaatgatggacataacacacaatttgctaccaagaaatatttgtttgtggtggataattgcgaatcaattaggggaaggaaggaataattaatcaattaatgatcatgatgatgattaattaggatggttaattaggataatgattaatgaacaaaatgattttcattgttttttttgcagccatttgcgaaaactttgacaaacttttaaaaaatttaattatttgattttttgagaaaaaaaaatctacgttttattgaaaactcttaaaaaaaccttttttgtaaaaaactgcgttgtacgaactgccattgacccaaaaataggcactaaatctttgaaaactggtgccatcgagaaaaaaaaaattgtaaaatttggtgccaaaaaaataaaatttaaatttgattgaattgaagcccattcattttaaatatcattggctctcctttttagccatcaatttatgttgccatgctaattaccaacaaatgttgcggaaacattggcactgcacttttgtccaattttggcatcttttgtcatgttttgggttgatcacgaaaacattttgtgccaaaaagggtgaagtttgttaattgctcaatttactctctttttggcattcattgtaaatacataatcgtttgtttgttttgtttgttttgcgttgtgtcgtccgtcgtttgtcgtcccttttccgcttatttttggccttttgtccaaaagggcgcgcaaattgcaaatgcgtcaaaaaacaaatcgcagaaaattttgcactttaaaaggacaaaattttgtttttgaaagaaaattatggtgaaaatcaaccaatttttgatcatttaatattgaatgaacgattaattaaaaaagaaaatttaaaatatatatttaaaaaataattcatgttttaaaccaattcatcaaagttttaattatattgaaaaatggatgaattcattaaagtcaattcgaaaagcaattaaaaacaattaacgcatgtgacttatccgtgccggtactcaattagactacagcgaagaataaaaaaattttcggcatttttgttaatttcatcatcgtcatagcacagtatggcattccaattttcttgataacaaatgatgacataacacattcgtcgtcatctgtccttccgccgttcttcctttaattaaaccatcaatcaccgccgccggcgctaaaatccgatgttttcggcacggcacagacgcattgtcattttggcgagaaaaatcccgaatttgctctgatgcgtgcactttcagcggatataattcccatggattttgcaacactaatccggcgcaaatttgcgcgcctttttgcgccaaacattctaatttcattggctacaaacatatccaaaaatggcacactttctgtgtgcaaaatgcctgcgggcacagccattagccaaaattaacttttctttttttgtagctgttcaatgtgccgcctgtgatggcggcacaccaaaacaacaacaacaaaaacaacaaacggagcataatccgacaatggcattggcatcggaaatggtgctcatctgacaggcaaccaaagccaaccaattagccaaatggtgttttgttcgtgtgcccggcggcgatgaacacacattcgcgcaaaattataataactttgaacttttgtggcatgctgttgaggaaaatgaatgaatggatgcgatgttgctgccgactggcgttcattggcgaaaattggcttttatgtgattagtgccattttgaaaaaataaccaaatttttggcattccgtagtgcaagaaaaaacatgcaaatatcacatgaattaatattgaagaaaatttaaattgtgataatggggataaaatgattttttaaaacgctctctaatcacagagaagcaacaagaaaaaaaagaaattttgggaaattcggaaaatgcgatttgagtttttataaataatgggctggaattaaaattcggaaattcggatcccaacgttttattcaaaattatttatacgaatccaggtgatcagggttcgatgaccggaatgatcaggcaggaacagagaatgtcccgtctaaaatacctttttgggttcgttcatttgtaaaagcaatgactcagtttcataagcacaatttgagtgttcttgaatgcaatcaaaattaaggtgcatgaaaaatttgaacaaattttcgatgcaaaaggtgaaaatgctgaaatttataacccaaatttttaaattatccaatcaatttatatctctataaaatataattttaaaatgatcaaagtatatccaatcaaatcaaaaagtgatcaaactaaattttcatctaaaaatagtccaagacaacgtccaaaccattcattacgcatttctgctttttgcacatgtgaagttcaaatgtgagcctctcggcaggggaggattaatgtcttagaagaagcccccgaggggcaacagatttcgtgcaaattaattt

SEQ ID NO: 5916 - DNA, 2360 bp, Heterodera glycines
atgcgggggaaatgaaaggattggaacagggtcaaattgggaccgccaacaacgtgatgatggcacaattgatggccatgctcttgagaaaaagcccatggatcactggcacagtggccgaatgccatgggtcaacaggaaaatatgtcgaaaatgtcgggcaatgccatgctattacattgttggacggatcctccaaaaacaaaacaaaagacagaaaaaagctcattataatgtggttggaatgattgtgacttgagtgtgtgctgctcttgagaaccccgactggtttcatgtaaaaagaaatttttgggacaatttcttgccttaattctcgagagcagacgatccaagaaaaaaaaatgatggacataacacacaatttgctaccaagaaatatttgtttgtggtggataattgcgaatcaattaggggaaggaaggaataattaatcaattaatgatcatgatgatgattaattaggatggttaattaggataatgattaatgaacaaaatgattttcattgtttttttgcagccatttgcgcgggtccttaagatatgtgctgctgttactgcttcaattccgacccatttccatgatgcgcttcatcttctcgcaaagctctcggatttgatggcggacaaataggcggagaatgtcggctcactgttgcacaggtcgtagttgcacacgcaccggaacgcgaactccaccgccaggtccggctttatcgtcatgaagcggctgaagtcgtagcgctacaaaaaaaaagcaaaagattatataatattcaattttacagtacaaatgggcgagataagtaatacggtatcccctggcccctacagggtacggtgggtaacggcagcaacccgtgaaaagaaatcaaagtcaatgcaaattgtttcaaaataacccctcaaattgagacccagaaaaaccattaaaaacaatcttgacatataattgatgcccatttttggcacaaattctcgactccaattattgactgtgttatggtgggatgacgtttttttttgtgtgaggtcacagcacgtaatttgataaagaatgtgccgcttttggaacgcgattatgctgaatttttgccaatttgagggatttcaggcaatttctatttatgagagacttaattgaacttcgcgaaaactctgatcagcatgattccccctcccatcacatctttaacccacactcacttcgtaaatgcatacggtcaagatccggtactcgtccaccgacatggcgaacgcggtgttgtacgccgccatcatgtcattgtcggggccaagcccgaactggctgccgttgaccagctcgttgcccacaatggtggccggcaccagggcacagtatgtccacgattcgttttgcacaattgtagttttgccctaaaaaattttaaaaaatatattttttttggcaccaataatagcatttaacgtaaaatggcatcgccatttccccccgtcatgtgaggcatttaattacccgccgctaaagtgccattatacctatattagacatgcatataagccacattaatcccccggtggggggggggggggagacaacacaatgggcaaccaaatcttttacgtgccaaaaattcctcggcatttccccccattttcaggaaggccaaatggccacacttccgcaattaaataccccgccgataatgaccccccccccgcggcgtttgtgccgtggccgatcgaccgccgactcacgtcatgccaaaacgggaacaaaattggaaaagagaaattaaaaaaaggcagagagtgtcgtgtcttggctttttgttcccctccctcatcatccaattttctgtgtcaccacattttggcggggaatgtgaacatattattcgcaaattcccccgggggtcgctgaagggagtgatggcatataccaaaagaatgtttaattagtcagcaccagtccccgaaaattcttgaaactctcgaggattaaaatatgttaactgtgccttaatgccatcggcaacaaggtcactatgccaatgttggcacggcatgcaaccccacggaacgcacccgtcaacacaacaacttacattcactgtctcgtagcaggtcaggccggcaaccagcgcgttgttgctcagctgggtgcagaggatcaccaacacgagtgcgcaacgtcgggccattgtcatcgtcaacgacggcattcggcgatggcacaagtgccgccgttggagtttgccacaaccgtactccaccaccactttttcgtcgccaccattgcgagcagccggtcgaacgttaattatgccgttggcctctctattgccgctaccgtag

SEQ ID NO: 5917 - DNA, 1170 bp, Heterodera glycines
gtcgaggatgagctctttatctatatatttgttacaaagagtaatgtaattgccaattcaggccaccaaaattttaagtcattgacatttgaattaagccattccagaatcatcaatgcctttccattcatcacctaattgctgcagatgacaaaaatgaatgaatggtgccaatgccattcattttgccaaccctcggcccctcaattcacagcttaaatgttgcatttagcaatgtgtatgtacaaaacaaaatccgatttgtgtaaaagcaattcgtttgagggcgaaatccgattcttatccgtttttaggtcttggcaaagttgggaaggcctaaaagtctgtggattgagatcggaattgttgatttgggactgtagtgaccggaagtcgagaaaaacccatttagaaagtccgggagataccgggggaaaactgaacttttattaccaatgtttgggtcccgacctctgtttatagtagggctgcacgggcccgggtacccgaccgggtcgggtacccgcacgcccggttttttaatatccgagcccggtacccgggcccggttttttgaaaatccaatacccggtacccgacccggtaggtccggatacccgagtaccaaaaaatacactggtaagaatgggggtctgagtgaaaattactgaaaaaaattgttgttaaaagcaaaaattttttaaaaaataattattaatattttatataaaagtgacactgccaattgggcaaatggcctagtggctttactttcccttcttctttacaatgttcaatccctctacagaaattaaagtatttttagttttctttttgtatactcatgggtttcctatcgacaaaagatgattaatttacacatttttatcatttttaaatgaaatccgtacaaattgagcctactaatcccaaaaaccaacctttttgttgaaaatctgttaacaaattacactcaaattttcaaaattttccccggcggcgcctatcggcaccgccggaccgcccctgccccgaaaagtttttagaaaaagcacaccgcaaaaaagcggtttaaatagcaataaaaaaatttggcaaataataaagcgtttatttgtaaaaccattatatttttcatgcttttttaaaagtataagcttttattttcat

SEQ ID NO: 5918 - DNA, 4813 bp, Heterodera glycines
gaagcgtcaaaaattatggcattttcttttgttttgtgtttttgtttgctttgttccttccgttggagtgagtcaccgcccccataaataagcaagcgttgttctgctggacagagtcgggctgcttctgctgctttccactatggccccaatgtttatgctaataccccaccgccttagtgcttcatttttcccactgacttctttgcccattcttctttcgggtggctttacccttcccgtccctactccgtccccccgggggcaattccatcgattttcaagctgtccactgtccactcccaacttcgccacccccagcctgcttcattgtcctccaatgctttttgaggctttagccgtccctcgagataaaatggcatcgatttggtggtgtccacccctaatttgccatgcttctcccctcccccaacaatgcttcatctccccaaatgtttataccatgaaatccctatcgattttcgtggtgtccaggccatcccccaattagtgccaccacaatgccctcacttttattgcttcggcgccagtctttgccaccacttcccgtccattgctctcatggtcacttcctccgaatttcagtagaatttatgggtcaattacaaatttgtcgcttattttgttaatgcgaatttaatttgccaaaattaagcatttaaaaattaagttattattttataaatttaaattgacgcactaaaaattctttttaattcgcttccttttattgtttttgtttaaatattttaaaattcatcaatcccattaattaaatattttaataatttagattaaaataaattttattattttaatttaacatagattaaaaattaacttttactagttttaattgcaaatttatttcctcatttttcatttgattcaatttttaaaattaaattaaattaaattatttagctttattagtctttcttcatcacattttctctcaatatgatctttgggctgtcttcttgtaccttttgtcaacttccgcatctgattcttgccatctcactgtacaataatttaattttaacaaataataaaatatatttcagatttttatttgtttttattaatattgcataaattaacaatatttactgaatcgctttatcatttatatatttaaatattgtttatgttttttatttttgttatttcaaaaaattaatttattaaaaattaattaaaataaaattttgtccttcccaaattataatttgaattttagcattttttctgtcataaaagcgttccgtttccatgcctatgccaaagtgttgttccacgctctgttcggccttttgcttttgctctttccccagctgatccatgggccaatggtccattaaaaataaatttaaatgaaatagtaatttcaattattatttttttgacagatttcgggcggcaaatttgacgctgtccatctgattttgcaacgctttacagctgcttttcatgtaaaaattctcgaaatacttaaaaaaattgacagaatttggcatttcttgaaaattttattgaattctttcttcaatcagtaaactaatcggttgatcatttggatctctgttaaactgccgtttcagcttggatttgcccttttccattatttgtcggcattccatggcaatgcaaacggagtgaatgccgtaattttggtaaattaaattgaaaaatatttttatgaaaattaattttaattttacatttttttagttttccaaggccataactgctgcatttgtgttgttgaataaactgatcagtgcttatttgctgtatgaacaacgttcgcgtgggcattacgtttcacaaaatgtgaaaaaaatatttaaaaattaaaataattacaaatatttaaatttaatttttcagtttcttcgctgctcactgattttggatggaatttggctgctcgtcgaactttatgcactgattttttcctcaaaattatcattaagcggtgaaattgaggtgttaataaacattattattgttttttattatgttattttattaaattaataaaattgaagaaaaactactaaaatttctaataataaaaataaatgtaatcaaatagataatttatttattcattaaaataatttttcaacaattttttttattattattaaagtaaaattatttttcataaaaatatattttatttttgaaactcaaattcattataatttttcaaagttatcaggtctttttttcaaaattttttcgaaaaaagtaaataaattatgaaattaataaatccacaatttaaactattttttaatcattcctttcaattaaaattcctatttggcaccaacaaattgcagctgatgtgcgcgaggacgcgccgttggattggcacgggccatgccaatgtcaactcgcaacgcgcccttttctggacggactgcacaatttgtctgttcagtgccatgtgccaattcgcatttgctgaacatattcttaaaatcatggtcaacaagttcaaaaatgaaatgtcaattgcaactaattaattaattaattacttagccaatcaattaattaattacttagccatggcaaaattttgacaaaaatggaaaactatttgaaaataacaaatgttttggctccaaaattcacacagatccatcgcgagtggcccatcaccgaagtgcatgaaatgtacgcgcgcgaattcgcctgccaatgtttggcaccggccattgtgtcattggtcggctccttccaattcaccattgaacagcagaaacattacatttggcaacgcattttggtgccatttttttacatcttttggcatttttttttctcattttcttttaatgctctcggaattttcggcacttttttgttctcaagtgccgcgattgccagtctcgggcttagaaaaaacagaaacagaacctggagacctgttaaaacaaggacttcatagttctgaatgctgtccggttccatctcgtaatccgtgttccgatcaccgatcctggtccaggtttttcaaaattccgggctcttgttcccagtctcgactctcgaggtccgttaattggttcttgagttttgcgaaatttgccgcatctttgtgtatcggtctcagttccgccgatgggtctcaatttagcggccttttcccacatattgaaaatttcgactttcgaccactgatcgatggtcggttaatttttcacgagagtctttggactcgcggattcctaaaaatgctaaaatttgttcaatatcgagcgtaatttggctgactaattgcttcacgcctttcagtgccaagtggtcatttgtgcgctgaacagttgggcccattttggcatcggattgttctcctcaaatcacaccgtcccttttgtgctttcatttttccactgtgcccttttggtgccactttttttaattaaaataagttaaaaaataaggaaatttttggcgattctggactaattaggcatcaaaaaatgatttttatataccggatactgtaaatgattttatcggatactttagttggggacaactttctggacgactgcctgcctggtttttgttgaattgaaggaatttggttatcattttagagtcctacaggactttctgtccgaaatactgtccatgtccgactcgaaaatccgggtcatggtccgagtttttcgaaattccgggccctaggggccatggtccagttgtcgctttctgctaaccccaaccccatttttaaatttgcaaattttaattctccccatttccgttcgtcatttggcaacgcgtgcgcgaggaggccattgaagcgcgggacgaagcgggcgccgacattttgagtcccctgcagcagcaaacgaacgcccgccacccctccaccacttatgtgttccgcaccaccaccgtggagaaggccaaatgagcgcggtcaccaaaaaacaataccgtatagtaaagccgaaatgaatggcggcactaccgtattccaccaaaaacgcaccctaccattgccatgccaaagcataccttacaaatcacccagtcctctgccccatccctacgcctcggggcaatttcgtaaatttttaatttaatccttcaaaaatgagattttttaattttagtgtcccctaattaaaatttcccgattttccgtttcgggagggggggggggggttactgtactttcgctgttttactgtccccatgtcattcaacattcattcattccaatactatatatttgttcatttaattgtgtaacacaactcaggatatatgatgtatgcatgttttaaatgataattatgccgacatttcttcaatgatattgtaaattttgtgtgtcaaataataaaaaaagatggaaaacatttttcacccaatatgtttaataaaataaattaataaaaataatgtttaaaaaacaactgcaaaatcacaaaaagcaaaaaagagagagagaataacagcaacagaaacaatacaaagaaacaattcacaaaacggaaaaaaggattagacttttcatttggcagaatttttcaggtccatacccggaagtttttttaaaaattttttgctctgtccgtaaaaaatgtgcccaactttgagtcaaaaaaataattacacagaaatttataatggcattggcgaggaaacacaagtgccataaaaaagggcgaagcaaaatgtcgaaaagaaatggaaaatatatcccccgccccccagcagggggtacgacggttatgccgtgggcatttttgga

SEQ ID NO: 5919 - DNA, 4063 bp, Heterodera glycines
  misc_feature (3937)..(3937): n is a, c, g, or t
  misc_feature (3948)..(3948): n is a, c, g, or t
  misc_feature (3954)..(3954): n is a, c, g, or t
  misc_feature (3958)..(3959): n is a, c, g, or t
  misc_feature (3996)..(3996): n is a, c, g, or t
  misc_feature (4007)..(4007): n is a, c, g, or t
  misc_feature (4014)..(4014): n is a, c, g, or t
cgctttaatttatggatcaatctcctctaaaacacagtctgataatcgtccataatcatcaatcatggccttccccccgaccgtccgccgccccctctgatcagtcgaccaaatttggagttctcctcgaacagactgcggatggtccacacttggatgccgccaacaatcagcatcacaacggtgttcacctgacaatgagcatcatttttcaaaaaaaaaattttccgatttaaaattttaattttcggggagtgctaatctccaatttttgggcacttgtttaatcccttggttatggtaaataaaatgtcaaaaaaaactgttaaattaccctttaatttttggttggcctgggccagaaaggcctggattttttctggattcccgggccaaggacaggtctttttcaaatgtctgaaaatttttcatgggtctttgtccagaaaacacaggatttcaggtggacatggaatccgggacctgttttttctaaatgttgaaatttaatacaaattttttttttttaattttgtcatccctaaacggtttttcaccatttttttttgtttcctcccaattttatgcccaattaaaatggcacaaattagttaggtaattaaatgcacagaaaaacgtaccaacgaccagaactggacacggtcattgttggcaccgacaacggcacggtcacgtgcttcgctggcccggaattggccttggtaatactcgacacggtccaaacgcgatttgatcgtcgtgaaagactcctgttttggatagaggagggggggggggggtggcaaattttttgaaaaatatcgactgacctggaactgttgcacggtcatgccgacctgcttcaacatctcttgcattgccgcgtcggagcctttgatggcaaatttggtcacgtcctcctcctccaaagtgccgttggcgtcgtacaaataaatttctgtgttgcaaaaaagaaatgtgagaagaggaccttttgttttcgttgcaatttcaacatttttgcataaataaattgccaatattttgaatgcattttttatagggggatgaggtgatagaataattccaagcattttttggtatgacagtgccaaacactaagaaaagcgtaagaaatttttcaatttttgaggagcggcgccgttgggaaatcaaagaaaaatagcgaaaaaatggaaaacgaaccgaagaacaccactttacgggtttggtatgagaatgagttgtcaaaacagagctggtagtcggcaggggcgggaatgtcaattctaaaattcaaaataataattagatttacttggcgaatctttcaaaatttttggtttaaaattggcaggcattaggtcttagaaataatggaaaaatgtattgtcaaccttacactcgaacattttgtgtgcaaacattcgagtgacctgatcgacaaatgaacggtcgcttttgagcaacaaatttggcacttccaaccacacaaaatgtgcgcaaacggaaataccaactcaagttgctcagtttgttcaacatcaccaacaaggtcattaaccacttgaccaccgaacccaatggaaagtttaatttaccagtgtcaaatttaagaaaaaacaaatttttttgccaatgcacaaatacgcattgttcatttgtcagccaaattccatttcaaaaacaggacgggatcccgccgagattttctcggaatcctggccttatccagaattttttaaagttcaggagtttattaaaaattatataatttacaactttttttcgggaatcctatttccttattttgagccgacctcacattttgaaaaattctacatccagctggattcgggaaacgatcccggaccgggttttcatttttaaaaatgggaattttaaattataaaatcatttttacaaaactactcacttatggtcaccgtccgtcctcatctggtcctgcttcagcacatttgcgtccaaaatgagcataaaatttatgttcaagtcgccgccgtcgataacctaaaaaagtccacaaaagaaacaattaactgctaaacccttcagttacctggtaataaacttccatggatttgtgcttctccaacacgggttgaaaaaaacattggatttttcctgaaaatttgcaaaaattactaaatttttgtggaaattggatcagcttttggaattgaaaatttaaaaaatcggaaaatcctggcaggctttcgttaggtttctgtttacactgtatttcctttttataaaaatttgtctagttatcttgaaaatgtagaaatcgttaaccaaacgaaaaacagacctggaggaacctcggcagtcaaatcgtactcgcctccggtcacaaagcttgaaaacaatagcaaaacaagaaaaagggtcaagaaaactgccaaggaaccaaacattgtctctaaaaaaaatgatagcttgtttattcaattattggcttatttagcacaccatatcacacgtaaattatgttatagataaagcagcatgattggatttatcagtcaacactaaaaaattaaatttgcaattttgaaatttgcaaaacataacgccaaacatgtcaataacaaaaaaacaattgtcttaggcttaggcttggcttaggcttctttaaaacgtagctgtaccggacctatacttttgctttcctttctctatttttttctctttagctttatctgtttcatattttgttttgcttttcctacttaattaaaaattttatttccaaataagtttttattttccatttattttctctgtcaattttgcggccacaaagtctctgtcactcactaatttttttcaatttttaatacttttaaattgtcaaattcatttttagcttgtctttcactgtcgggtattaattgattgtttccttctgtgttgccattttcatttttgctctgcttttctctctgtctctgtgtgaatggacttcaaagagttggtcaaccaagcggaacgaaatgcgaagcggcaagagcgcaaagtgcacgaggcggaacgcgagatgaaggcgcgtcagcagagccaaatggaacgcctcgcttatgaaaaggcacgcgaaaagttggtgttgaaacgacgcgctgtcgccacaatgcaacagcaaaaggaacagcaacaacagcagcaggtatttgggaaaaaaggacggaatttttcaaaacgaaaatgggtctctaaaacttggacttccagggtaaaaaacataattctgtccggtcaatccgggagaactatacattcattcgtcttatttttgtccgagttccttggttaccgcgtctgaaattgccgttttatcggccggcccaacctcggcgaagttgctgggccacagtcaacggcacggcataattattgactacaaagcaattttttgggaggcctctaaagcatgaattttcgaatccaaggttcagaattgacaaggaatttggttacagactttctgtccttgaggaaatatcgttttcagaatacacacaattttctatttagctacaacagtcacaaaagcagtcgacgacgcatgaacgaacggatgggacgacgaaagcgatgacaaagcgagaacggttgggcagcgacgcggtggccactgacaataaacatcgaaagggagccgggccgggagacgcagcacagctgtgcaacggcagcaacgaggtttgtgcaggacggtttcggattaatgccgaaaaattggattgtgcaatcctggccgttcggcattaaaaactacttttttaaatttataatgggaaaaccaatgtttttcgtcatttttggagcactgccggccttcaaaattttcaaaaattgacgtaaaatagccaattttggtggaaatttgttaaaaatggtcacaaatttccaattntttccccctgntgtctngtgnngcaccatcagtccctaaaaaatctttgttttttctanaaaactgactncactcgncaaaaatttttttcattttctgaatatatccaccctgataaacactgat

SEQ ID NO: 5920 - DNA, 3230 bp, Heterodera glycines
ttttctctatcaaatatgcaaaatttggtgtggatttaaccagtaaaaaaagttaaacaggatgaagtaaattcggtttttctctaataacagagacaaagaaatagcacgtaaaagactttcacgttctgttttaagtcagatacggacacattgaaatttgaaatttatcattgaaaaaatggtgcgttgtatgcgcgcaagcagaggttcttcaaagggtaaaggcataaagcacatgagcagcaggacgcagcatgcgcagtctgcttcaaaaagacaaaagttgcacaacaacgaggacgactgtcaatgggagggatgttcaaacggcacggacagcagacggaagatggtcggaatcaacgaccttcctcatccggtgttggtcagtcgcaacgcaaaacaatcatgaattgtctttttgactaaaaattataggggcttatcctggcaaatcttaacccggccgaacgtctgcgagccgaatctgtgtgccatcgatggaaatttgttggaacacactttagttggaccaatcagcgagagttaactgtcaaggaaattgtgcacccttcaaccgcagtgcactcgctgttcagcatgtcaaagccgttgaccaacaaacatgtacatgctagttcataaaacaattccgttcttccaaaagttttcagcgaatattcatacaaaaagaattttcctaaatccgtcaatatccaattcaattccaaatcttaataacattaaatacagattgaaatacttttgaaacggtgtgggtcaagtcttcgtctgctgaacatcggctcactgagctccgtcaacagagacagcatcacttacgcggtctgttccttgttcgtacatgtgccaatgctgcacactttggatttgtccggcatccaactgacaaactccgctctttcatcgcttggctttcggttgccgaatttgaagagagtggcgtttagaaattcattcaaggttttgaacattcctcattattttttttaatatataaatttcaccatctggtttcattaattttgttttactgaaaaaatatacgatcattgttaaagaaagcccataatttgttaaaatcaaatttggcagaacacccgtatggagcgtggcctttcttcgtttctcgcgagttgcaggcggttgacgcatttggatttgagcgggaacgaaaacctcatcggctctgctttttccgaccttcctccgtcggtgagtggaaattttttttagcttatttcgttttttctcgggaccatttttctttctaaaaacaattacttttccattcatttacagctggaagagctcaacatttcctactgttatcacattggcatccacggcattagacaaattcgtgcaacttgcgccaatttgcgacgcctttacatggaccaaattggcgattcggtgtctattagggaattggacgaaatgctgcgagaactcaaaaggtattttccgttgctttattacattttttacagtagagttttgtttatccttctgacaaataattggtcttttcattcagcttggtctacctcaaattttgtgaatgctatggctcttccgacttcaacgacttgcaactgaatcatgaccaacatttgacgggcattggcgagctgacaaatctgacggaattgcacgccaacgaaaatagactgttctttttttaatttaattttttcttccatttttttttactgtttattgccatttcgcagtgttgatgacgaggtgctgagggcgatctcttttggttgcacttctcttcagtttttggacatttcgcaatcgcaacggggcatcactgacgcgggtattaattttgcttaattcattcaaacaatttgctgaataaattttgaacgtttctttgattaagggcttcgtcatctctcccaattgcctaatttgacgacactgaaaatgaacggacagcggatggtagggtttttacactgtttaacaaatccatatatccaggatacaaaaataatacaacaacataatttttaaaccatttagtgcgtttattgtgataagtggtcaactcggaattaattccaattttaggtctcggatgagtctttgattttaattgctcgtcgaggcattttaaaagtttgcatttagttttttctttaccctttatgctcaaagcaatgctttttttgccacttaaggagctaactattagtcgctgcacacaaattaccagcgaatcggtgctacaaacaatcaaacactgcaaggttgttttgttttgttttttgcttgcatacatcgttttgaaatgatgaacattttttctgaactcaatttttaatactctaaaacaatccttctcttattgttggttcaaatcaattcaattgaaatgacttaaaagtttagaattaaaaaccaacttttttggcgcacaaaactattatttgagaactattttgatggctcatacttgggttgatttaagggttttattagcaaatgcttgtccaaatcatcaataaacattttttaaatttacattttcttgtcagaatctcagttctttggatgtctcttattgtgtgggcgtcacacaaatcatttttgctgaactcaacaaggcaatggagcgtcgacatggcaaaaatgcgccgtcgcgtcagacacggcaagaagacaaatttcgccttactatttgccgttccggcatccaaggcatggcacaaataaataaataaatttattcgagtattctctcatcatctgatatcgcaataatttaaattttattggtctcttatccgttttttcttattaattcatttttaggaaatgtcccgtcccattcgccatggattcacttggtcgactacccgcccaactcggaaaactcgctgacatcgaacgctgttttcatcactgctcagtgagttcatcttccgtttggagtgctttactaatgaaaaatgagttcaaaagattttagtcttctgaacattccgatgatcgccatttaaatgatagggaaggaagagaaggtgagtagtgtttggtgtggacatgtccacgggtaatccgttttcgtttcctcatttaaatgtttttaaggcacgcattggtgcacatctgtcatcaaagttgggctcataaaccttcgtgtccacctccattttctccctcatttacaattttctttctgttgt

SEQ ID NO: 5921 - DNA, 1102 bp, Heterodera glycines
aacagttgatactttcctttgattgatatattctacaatttgtctgttgtctgtctctccaccattaaatattgtactgtcggattcggtgaccaaaattgtatagtcatatgagtcatcgtctgattgtgagcaaatttacggtttaagagtgccacaccggaatgtgtatgtgtgttttgctggttgtctttttgtcttcccattttgtcactcatttctttgtctgactgtctccgcctccggcatctctttttctcggcattcgtttgtttgattgaggcgatcattgaccactcttctttaacattgctctttgctctccaccacatcatctccatttagaccaggaattcatcatttgacaacaaaaatttttggtgataacatagaataaatatcgcagtgacacgtcaaaatgttacacattattttttccaaacatttcgtttctaatcgtgcttaaatatttgctttaccatagcgcattttgtgttcttctcaatcggttctatgaactgttcattttttgtttttaattttattgttcgtgcattaataatggcatagtttgttttttagcttttttctaatttgttctgatctcgactttctccttttttcccgtcaaatggatttggttcgggacaatcaaaatctccataagtttggcttgcaagtgcagcagttgctcgccgctgagctgttcggatttgacaacatcaacaacctgaagtgggagctgaagttggtggttgtttttgacgttgctctacctggttaatttccatttttattcattttttcaggcgtgagtttgggtattccgttgacgaaaaggccgaggaatttgggtacccatccttcaaaggtgattttccgcgtcaattgttcatgaaaaaatggtttcgatttgaaatgatagcaaaattctagaaaaagttcatttaaaaaaaagtgaacaagaaattttgtactaaaatccattgtatggattgccatcacccagaattgtaacttcttgttttctgacaagggaaggggcgaaatgtaactcggaaaacctatttatgtttggtatcgttgatagaataggccaact

SEQ ID NO: 5922 - DNA, 1425 bp, Heterodera glycines
tcatgttcacagcacctattaatggaagtatatgcgatgatatcatataaaaatatgcaaatcagggcaatcgcttgaccaaatggttaggtaatgggtcctcgcccccctttcatccttggccatactttctcattttcaattccttttccacagcccaatggatgcaattcttgctgttttttaatttacttttgataggcacagttttggtcccaaaatggtcacataataccagttcttaaagaccttgtaaatttaattccttttttgagttacagttcgcgcccttatgaacaattaatccttttccattgcaaaagaaatttcgtaaaaaaagctatgaccaatactgattttctcattacagtccatttcattattaaattatctaaaaacaaagtccttctctgctttagacatgctcgactcaaaagttttggacaattacgtggaaattgagaagggccgcttcagcgaaggggggcaaatggtgcagacgcggtacaaggcgaagcacgacagacacacaactgcagtgcgccaacagcagatcattttccagagggaaaaggaacgaaagtgagtaaattcgcatttcttttcgttttgctcaaaacctccccaaattgggaatttaacaaaattagcaagcgaatattcttggagaattgttgggattcattttgttttgttaagagaggagcgaagacaacggcaaatggagcgtaattttgatgcacaaatgtggagaccgtcggaaaaatttggtcaaccatccgccagtggaaagaggttagtcccggaaaaataaacataaacgaagaattgcatttagaacattgaatgctttctgattacgaaatagtttactactttttagaaaaatgaaacgcataaaactaaactcatttaacttttttttagtttttccaattactacgagtcgcaacagcagcagaaccatcgattctatgctcagcaaagggagcattcgccagcgatggaaatgaacggcgcattggacagcaattggtacacaaatgaagacgacgacaacaacagaaacaacaacagcgacggcatcgacaacgtcgacgaccgcgaggaggtcagtgacagcgacggtgcaagtgccaaattggcggcggattacagcaacttcttcggggccagtaaatggccaagtaatttgtacaacaacacccattgtcaggcaaaacctacagcaaaggagcagcaaaaacagcacaaatcaccgccaaaaaaggttggcggggtgtcggagtggagttcgggttcgggagacgaacagcaacagccgagcgaggaggaagagaagccaaagccagcacaggagcagaaattgacaaagcaccaattcgtcgggatcaggtgggtataaagtgttgatcaggcccctat

SEQ ID NO: 5923 - DNA, 1151 bp, Heterodera glycines
cccccccccccccccgcctcgtgcgttcgacaccctccgaccccttgccggagcttcgtttattcaataattccccatttaaattaaaaagcaatgttcattcatttcacaaccttttcaggaagtggacggtgcctgccttttgctctttacgcactttcattaccaaaagttgggcctgaagttggggccacaggtgggtgaattgataattgatttgtttttagccgagagtattaacttttttaggtaaaacttcagcaaatggcggaggtaaataaaacaaaatcgtttaaaattgaattaaatgactaataaaaattcaattaattttgtttcagtatttgcgacagttcacttttgctgatggccattaagaataatattgtaagaatgtggaggaaaacaataatctgacaattgcttctttttgggctcttatttttgtttatgtctttctttttactctgtcttaaataaaatggtaattgacctttaaaaaccgatttttgcatttgttgcggtaccaatggtgaggccatgccatgttaactttcattttcactttattattttttcatttttatttcttagtgccactttttcgtttcgtcccccattttgcaaattgtttatgagagtgtgcgctcgactctccgccgtgcaacaagcaaagcagcagaaggcggcgaccgccgccgccgccgaagggccgcagaatggcgaacagaagcggccacagacagcccggaagcggggcaggccgaacagctcgttgacgacggacggcggcgccggtttttggcaagcggcggtcgccacgcggccgagacgtaacgcgagaccgatggctgtcgaatggcaacaacggcagcggcacggcgtcgttcaggtgtggctttgtacgaccaaccaatgttttggtgacgcttttccggaaatgggaaaaattcatgtcattaactaatgcaacttccagcctcttactccagccgaagttgaaaattgagtgatatttgactaatttgatcgccattttccttttttgtccccacctgacctaaatgtcatttttgaatttgtattgaacttcatttttcaatcacgtacaggcgtccaacttcgattgggagcagtacttggctgtccgt

SEQ ID NO: 5924 - DNA, 4365 bp, Heterodera glycines
  misc_feature (4237)..(4237): n is a, c, g, or t
  misc_feature (4296)..(4296): n is a, c, g, or t
  misc_feature (4319)..(4319): n is a, c, g, or t
accatcgcataatttttcaacaccaaaaattattcgattttctttttttttgacagtattttttataaaatgattgctttacccaaattaaacaacgtagcacttccagtaacaacatgttgggcttggtttgatcattcctccgcccgtctctctcttatcgttcgtttctccagtatcttcttattcttcttctttcttcttttattgatcatattcattttattcttttgttagcattcgcaaaaatcgctttaatttctgttgaataagcacttttttcatttccattaaataattattaaaaaaatcatttgccttttaaattttatttttgctttacattaaatgaaataatattttattcaaatgtttttattgagggtgtcatcaatcaatcaattcagtcttattaggaaaagaaaatgaccacgttagtaattaaaatagcaaatttaaactattaatttttggtattacaatgatttatagtattattagtgatgggagagaatgtttcagaatgattaattattttgattgactaattaaaacacatttgatcgatgcgagtccaaaggcaaacatcagcaggtagaaatgtcatcctcattacgattattacaataatcatcatcataattacacgaccagaaactaattatgaaataaaacgatagagtgaataatttgaatttatagaaacattttcggctaacattcaaatattttgatcatttttaaatgagtacatcttactaatttggataattagaatatatgaacgagatggggaagcttttcaatttgctcaaccatataggattcattttcgcctcaattgatccattaaattcctctcggggaagcttcttcttctctatctcagttataatcgtcccatttacataaggaaaatttaacgatacgaattaaaaaattttaaatttggccgaaatgaataactcattttttatgattaaaagcaaaaaatattttaagaaattcctctcaaacaatggcattattgtccattttttgtctgttgttggcactttgccccgttttgtccattaattccaccggccatttccttcacatcaccgacgtgcacatcgacccgaattatgacctcagcggagacccccaaaaatggtgccatgggagcggcgacagcacaaacaaatcgccaaagttgggagtgttcggcgaccacaactgcgactcgccaatggtcggaaaaataatcattaattattatacaaattaatttttaaggcattgttagaatttatgttgaaagaagcaaaggccaaagtaccaaatccaaacttgatcatttggacaggcgactcactgccacacgacaaatacgacgaaaagggtgctaattaattaatagcccagttattaaataattcgataaatacgacgaaaaaagtgctaattaattaatagcccaattattaaataattatttaatcatgttttcttaattcgtccattgtttagtgttatttgacatattgcaaaaggtgaccaatgcgataagtgcccaattccccgacgccgttcttctgcccgtgctgggcaaccacgactcggcacctggcaattcgttcactgaccatccggcaaaacagcaaatttacgagaaaatgttcataatatggaagcaatggattggccaagagggaaaggtgggaaaaatttgtagaacataaaaggtaactcgcccggtgggcctcgaacccacgaccccagcgatccgtgccgtgctctaaccaactgagctacgggcattccttttagaggttcttttaggtcttttatcccactttctctcacactccttttccttctgacatcatgaattttttctggagtaattcgaaaaccaaaccatttaggagagttttacgcgtggcggatattaccgcgtcgaaacatccgccggactgtttttggtgctgaacacaaacatttactacgaatcgaatccgctgaggaaggagcttgtggagccggaagacccaactggccaattcgactttctgcaatttgagctggaaaaggcccgccaaaagggggtgccggtgcacatccttggccacgtgccgccgggcggtgccgccaattaaaaacaaatttaaaaagcaaattttattttcattttagcatttgaagaatattcggtgaacaaactcgaaatggagcaaatcccgcaaaaatacaatcaaaaattggtcgatttgcttgttgaatacgcgccacaaattggatggatatttttcggccattaccataccgacacttttcgagtgattaaggtgaaaatggcaaaacaacaacaaataaaaaaaatccattgtaattaaggatggcatttttagattttagcctatttttcctgagctcccagtgacatgaaacacacgaaaaacaagtttttgggaggttgttaagctacttttcgagttatttgagcctattttctttcttgataagaatttttgattttaaaaattatttatataatgatttggattaattttttaaacttttttgaatagtttttgttattttacacaccataaatttgagggtttttagtgcctatttttggtgttttttagagcctaaagcctacttattttggctgtttttagagcctaagatatcattcatatttataagaaataattggtggaaaagctttatagcgaaaggtttttttctgtcggaaaagtaaaattttaaattcagagcaatagcgcttaaaagagaaaagaattaaactatttaaaaagattattaattaagaattccgacggaaaagcggtgcagcgatttttcacagcgccggcacttacgccggcatttcagaagaataacccggcatttcgtgtggccgactacaacactgacacatgggaattggaagacatgaagtgggaaatgaaagagggggggggggggtaattagtgaaattaatgagttgtaaatttaaaccatttaaatgcacttttaattgttcattatttatttgaagaacgtattacgtcgagttggacgaactgaacaaaaatggggcggacggaacgcgcgcgaaattggaatattcgatgcgcgacgcattcggcggattggacgcgcaaacattggacgcgcacattcaaaaggcgaaacggaacggcacagtgttcgacgcattgatacggcacaaccacgtgatgtacgaggcgaacaacaattggcgactgaacgccacgcaacggtaaaataatggaaaatatatatattaaagaaaagctggaaactatttactcatcgacaaccccacaggcacaataagcgaaaaagaaaccaataattgggagaaaagggagcaaattaggggggggggggggggagggggagcgctaataggggtaagtaatgttttatttgagggtatttataccattaataatattattaatttttgggggctttctgagccatttttttaattttcagatcagatatattctaatcgcttctttcaaaaattaccgtttcttgcaatgttttttcaaagaataagattttaaaaattatgggattacgcatattttgggcacccgaataccgtatttccataattgaaacaatctccgtaattatggatacttaaacgaattttcatgtaactgcttaaagccttcaaatctcaataattaaattttgagaaaatatttttcgattgaatgattattcagtgctgttcacctttgtgccttggaatttgttgactacaaaatgtttgagcagtgtttggccaacgacgccaacaccaatgaccaagtataatttcgactatttaatgcccatttgagggcttgtgaactttttattgctgtgaatttctttaaatttatgccaaaaatttcagattcccgcggcaattccgttggccatcggcggtttcgctgtcccatttttggtcacattgtcttcaattctaaccttacttttgccattttgacttggtttctgatcggctattcctttttaaatattattgtttaatgagattaatttcactaattgctcaaataagaaattaggacaaaaataaataagaattatttaacccataaaagttatttataaatgctaatattaataattcgggttgtttgttatcaaagttaattttaatattcatttcttctgatttttcaaagaaagcanagcctatttcttccttttttacaaatatttctgttgctaaatattttattctgatttgntcccgtttacccatttgtcttanatatgaaatttaaattttccatcaaatttccatctgattggcgttt

SEQ ID NO: 5925 - DNA, 1279 bp, Heterodera glycines
  misc_feature (135)..(135): n is a, c, g, or t
aatttttatattcatttcttctgatttttcaaagaagccaaaagcctatttctcctttttacccaaatatttctgttgctaaaatatttattctgattgtttccgtttacccatttgtcttaaatatgaaattanaatttccattcaaattttccatctgattggcgttttgtttgttgtctttgttcccaaattgttccgcttcggccattagcgcctccttcagctgttccgcctccaatcgttcgattgcttccgcatcaaatccaatcgctttcgtcccgcacggctcattttccgggtcgtggtacctaaggaaagtggaaaaatgccatagaataatcaatcatttgcatgtgtaagcaatgtaacaaaataaatcaaggaaaaatgagttaatctctaaacaaggttcgtaattgagtatttactcttgattccaatttatgtgccaaaggaccgcaaaaaacggcccatttgatgaatttgcttaaaattagggttaagccccgacccctcggggaagaaatctcaggacgtttgagaggccagattcggggatcggggagaggcaaaatagggcggagagcctggagcccgagctcaaccctaattgaaattgtggcatttatgtctccaagataataaatagcaccattgaactgctttttaaaaaaattttaatagccctaatcccaacaaaattacaggtccaaatattggtgcccaagggcttcttcagccgaacaccgccgccacggagcgatttgcatcatctgagaacaacaatttaaaccaaccaattataaaaagggaatataatggagatataattgatgaaccattgcaattaattccatcgcttttggcgttgcctttggcaaaatcgtagcccacggcaacggcactctgtcgccgcatttttcaatccaagcgcggaccgaaaataaaacaaaaagcatttttaaaatggaacagaaatttcaaccaattcggagttgattttttcaaggacctgaaatctagcgaaatttcattccaaatttggcattttaaatcaaaaaatattacctctggcttaggggtgcccaaatagcaacaaatcatctgataaattggaaaacattaataaaattggcatggaaaatgaattttggcttttgccatgaaacgaatttaatcacttttatttgcatggccgcgtctcgtccagggaaaagttgccgtcgcataattagctcggcgaaaattgtgccgaccgaccaaatgtccaatcttt

SEQ ID NO: 5926 - DNA, 1087 bp, Heterodera glycines
tgtttttaccggattactgtacataccatcagatccatgaccaaatatacgtcttttccctgcagaaaaacgattgaattcattcatccccgatcattttcaaacagaagatgaatgagttttttctacttgagcgccgtcgcccaccgtgaacatgtccaacactccgacaatgttttcgtggcgaatgtcccggagaatgcgcacttcccctttttgggagagaagagaaacaattagtctcttaatccataaataattagcaaaaatattttcgattttaaaatataataaggatgatatttttaggctctaaaaatggaaaataggcactaaaattcaataaaaaaaacctcatttcaggggttaaaattacaaaatttattcacaaaagtcaaatcggtattaaataaaaaattttaaaaattcttgtctagaaaataaattaattattttggagatgaatttttgagaaatttttcaattctttggggtgttttttgaaaattttcgggtcccttcttaggggaatatatttttcgtggttttcaggccatagggagcccatgaaaaaaataggaaaaattaaaaattgagccctaataataagcagtcgaatataattaattttatttgtttactcagtgtccgtttgaccaaagcaatcgcggaaaaggcgcgcgcaatctttttgatggcaacattttgttgtgttctctaatcaaaatgtaaaggcaattagttatgcatttataaagaatgaattttattataataaataatcactcatttgtattatcattatttatcaccttatcaattgcctttcccacggagccataagcgcccgaaccgaccattttttccagcgaataatttgtgccgttcaattggaagctcatttaattaaatgattaaattctatttaaaaaaatgaggataatagtataataaaaagtttatgatttactgaaatttgtcgtccctttaaatttcgaataatttttaaaatattttttgatttaaaattgtaatttgcccacaattaatcagcagagtaaaaccagtcagtctcagcactctcaca

SEQ ID NO: 5927 - DNA, 4298 bp, Heterodera glycines
cgaagaacagcagttttatctttttcatccgctttatccctatccctaattcagttcagatttccctctccgtcgtatatcccacccgctttatcactttccctaatcagtcgcatatcctcatcccctttgtctcccatctttgctttgtccctatcccaaatcagtcgtatgtcctgatcacccagttcagaaccacccatccccaccccttcttcagttcagaaatatatccgtcgtatatcccctccctgcgctttatcccgattccaattcagtcccatcatccccattcccgctttatcccgattcctcccatcattactctcacccactttcgcttaccgttaattctcccccattcagctgttgcttctcctttggattcacctccgctgctaatctgtgcccattttgtgctgccaatgccatagtgctccatcgccctggcacattaagcttcttcaccggcttctcctcatttattattgctttttgtgccactttatcctgccgtcgcagctgctgcttcgtcttcatccccggcttttcctcgcccgccgtcaccacactcgccgatggtgccctcgccgccgtcactgtcgccaccgcctcgcccagtcgctgctccgtcgtctgctgctgaggttgatcatcaacagttcgaaccctcaacactcgcttcttcttcttcaccactttgatcactttctgctgctgttgttgcttctccccatgatcactcgccctctcctccgcctttttaagcgtcgccgtctttggtgcgatcgctgtcactgccagtgacaacggcgacgctgacgccgaaaccgctgaccaccttgaactcgtcggtgtcgtcgtcgccgaactcgccgccgccgctgcaccggcacctttctgctccaacttcttcaacaatgcgctcactttgcttgacgacgacagcgatttcttctttgtcattgtcgccgcttccgctgacagtcgcttgtcggcaccgccgccattggtgctcgccgaagtacttggcgagcactcgccgccgccagcattttgttcggccagtcgcgcagctatcctcagcaccttgctgtctccgccgctcactcgcttcataatcggcgaccccgttgcgctcgtcgtcgccgctttcggcgccgccgcggtcgttgtcgccatcgtcggcacctcctcaaacttgaccgatcgccgtgccatcagcggtgacttgctgctgctgctgctgttatcactggtgccaccgccagtcgctgctgcagtctctcgctggcccagtcgccgtgccatcaacggcgacttcacgctgcaatcgctgtccaccgccgctcgctgattctgctggcactgctcgccaccaccagcgccaccgctctcctggcgttgctttttgtttgcagtttgctccgtggaggagcgcgtccgttgctgatccgctgctcgccgcgcctccgacttggaccgcttctcgccccgtggcactcgcttcaccaccaccactttcttcttggcactcgctgcggtagtctcccccgcttttttggcatcgccgccgtcaccgctgtcgccaggcggcgtgacagcgatcactacctttttctgctggcggtggtggtgatcattgtcgttgttgctggtgtccatcgccatttcctccattttttggccctcttgtcgccgttgttgttttggcactttccctttagcagtttcgttggcactaccgccgccgctaattgtcgtgccaatcctatcactatcactatcatcaatgctatttccatgtccattttcgattgttgttgttgttgttgttgtgccgttgttgttgttgttggcattcgtttggtgctgttccgccgccaccagcaaattctgtaagcaaaatgccaaaatcacattaattagtgaaattgtaagacttaattagcccccacagtctctcagcttcatcggtgtcatttgtgataatttgttcagagttttatttgttttttcttttttttcttttaaattttggtttaaattttttttaaatgtataattttttatccattttttcagtcgattaacaggggttttttggtaaaaccccggcaaaacggtcagtgttcggcactatcttttccgaatttccaatcgaacaacccacccgatcaaatgaaattttcgttttcccctcactgattttcaattttcccaggttttttggtgaaatcaaaattgatttttcggggttttaatcagaaagaaatcgatcaaacccattcattggcccccaggcatggtctctctgctgatcactaccggtgtgtgttaccgtatcttaggtgttaccgtatcctagcgattgattgcggtgagtggtgcccgtgccctttggtgaccaccgttcctatacattttgcgtacccgcacatactccgcgccgtgcacacttttgttccgctgcattgtccgcatcatgcgcatcacctgtaaaacaaaatgccaaaatgtatttaaaatttttgaaaaatttaaggcatttttttgtttttgcatttaaaaaattccaatacagcgaaaacgagaaaacactcggaattttctcggttagatttttcccgtcttaatttattttaatttttttgtttaaattataattttattaccgatttttaaatttattttttttttaattggaggaatttctaacaaaaaaaaattaaatttgtcgatataaaatcagtttttgagcccagctaaaatttgaatttatctatactttgtaattttttttttgaaaaatgttcaaaaataaatttagaaaatttaattaaatgaaaaatttaaatttaaaaaagggcctcagattcttttatttttctcataagtgtatcaaccaaatcagagtttttattcatcattgaccaacatttatcccactgagccacggattgcgcgatacattccatccttattttttattagtagggataaaaatttcatgcatatttttttcttggattctccatgttttaaatagtaagaaaaatttttgaattgtgcacaaagttgagacttttatttacacaatttttacatatttaatggatttttctacatattacggtatagttcgcactttttgatatatgaaaaatatgaaagttcctatcaaaattcaaaaaaaaaaaaaatttttattgaaatgtgctcctaatatcaatttttaaaaagataaaaaaccttttctatgcctaattagatatttatgtggcattttatgttcttttcacgttttaattatgaaataatttacaaaaacaaaacctaaaatttttttaattgatataaaccaaataaattgaaaataaaaaaactccaaaaatttcttttaatcaacagttaacattatagtatccttttcctttaccgtatcattttcccactaccgtatcgccaagtttcccccgctactgtcttacatttcccattactgtatcacacgcacacactttcccactaccgtatcccctccttttccatcattaccgtagtatatgccaaaccacaacacccacctggttgatgaacagtacgccgaacacaaggcgacggaaccgtttgttcttcacgtatttgcggaatttgtccaccgccagcgggtggcaaactgccggactcgcggtgcgactcgccgccagtgctcgctcgcgattcttgcgaatccacgcgtgtcgcaggcactcgtcgggcagcattcgacgcctaagggggaaggggtgaaaatttggaaattctcgcgaaaatttcctgaaaatcccccctcgcaaaaaaaactaactcttttttgagaatgagcagttttgagatgaagtccttggcgtccgacgaaattccgttctcagcaaactcttggaaaagaaagaaaaatatattttttaaaattgaaaacttaaatttacaaaaaaagaaagaaagtttttgctgttttttttttggttttcgaaacaaatatctttccattataaaatttttgaacttcccaaaattataaaacaaaattttaaaataaaggacaaatcttagaaatcaaaggacattttaaatttataagattcggcctctcgaaattgggacacacgtgtttcggcgccgcgcgtttcggcgccagcccagtttttggactataacttttttctttgtcaacgaaatcaaacattgttggtatcattcgaaagctgtaaatgtcctatattagcctacaaaatttgaaaaaattaaaggttcaa

SEQ ID NO: 5928 - DNA, 1010 bp, Heterodera glycines
  misc_feature (33)..(33): n is a, c, g, or t
cgatttaaatacaaaaatgccaaaaaagtattngatttatttatttttttaacgattttaatataaaaataccaaaattttgattaaatttttctaatttaaactttttaacagttttaaatacaactgccgaaaagcagatcaaaggactaattaaagcgatgctaatcatcaggccaaaagcgatcattcgggattcagttatacagcccaaatctttttatcaagcttttggtgatattctgatcatagggcagagacacgctggtcagaggaaaataaataaactcatttatcggtttaaatcacctaaaagtgaaactgatcaaccttctcaatttaatcaaatactgacaaaaaaaaaaaccaaaattttcgtcgtaaaacaaaaagtgccacaattacccacctcaggagtgccggccatgaacatcaaatccttggacccgtcgtaccactgggccaacccgaagtcgatcagcttgatctggttggacgtttgcgacacgcacattatgttctcaggcttaaccgatggagagtattggcaattggcacaaccgacaaaaagcccccttttttgaatttggcaccaccttcaaatccaagtggatgatgttttggctgtggatgtagcggatggcctaaaaaagatgatcgttgagcacatacataagaggcttcgatttgaaaaggcctaattaggtctaattaccctaattacccctcgtcattcaaaatttaacatttgtctgtgctgtataattaagtgaaataaaattatgaaaaatagtgctattgaaaatttttttttgacaatattttttttgacaccttaggcattgagaaaattttattttttatcggcgggagatacaaaaaactcacttcacatatttggaacatgatcaatgcgaccgccatttcggtgagtctttaaaaaagtaatattattgcatattaccgtatttattgagtttctactaacggcatattccaatcggtttacg

SEQ ID NO: 5929 - DNA, 903 bp, Heterodera glycines
tcattatttacccaattcattttcagttggcgtgccgtgcttcttctgttggttgattgtgccaccattctttggttctttttgtatcatttcaaaaaacaacgacgccctcgcaaaaaaatgtaaaaaatgttaaaaaaattgagaattccataaagctatttttcagctttatctgcgccgattgttggctggcggtgttcgatttacttgcgccttctcaacttggcctcgaaattggactgattagccgtcgatttgacctccgggtggacgaacatttcaaaacgcgcaaatggagaatggacaaacaattgctaatccaatgggaaattgaaaaaaatggcacgaagaaaatgcaaattgtccaatccgatgggaaacctttgccaatcccgcgaaatccgttgccgaacaaagtgatcggattcagaggcattcagatcatgtaacgaactgattagattggaactgatttgttgccatcacattttctgcgcttttcagctacatcgatcaaaatgtcgtcgcatttctccgccattttcaccgtcttttgggcgtttgtggaatctttttggacattttcacgggcactgatcgcatttgggactactttttgctcaacatttggccaatgctccgcaattccatgcatctgatgcttttgaacagcaacttttttcgccgtttgcgtcaattggacccatcaatgctcagcaattgtccatcacttcgctatgtctctttgaatgtcgactttgtgcccgcttttccgcccgatgacagtgccatggcgtcggatggccaagcagtggccaaatggctgttcacgcctcgtccggacggtgtgccgaagtgggtcgcttgccgtattaattcttcagtggtggaccaatggtc

SEQ ID NO: 5930 - DNA, 3564 bp, Heterodera glycines
gattaaaagtgtttatattatattagtggcatttcctttctttagtgaatgtttttacattttttagaacaaataaagtgtgtgaaatggcagttaacgcaccttttttgagccaaaagttacaaccgatcaaaattggcattttataagagttgggctagggaagttttgccagaaattttccgtttatttttaattaaaaatatttttttatttaaattattcccatcgcatctttgttctttctttacaccattcatctgctgaatgaaagccacgattttctgctgacattaaaaatattgattctgtctgtcactccgcagcatttcaatcagggctgtgcgaaaatcacaaaaaaactttttcgtatacgaaaacgaaacgaaaaagtgcattcgatacgaaaacgaaacacgaaacgaaaaaaaatattttgaaaaccgaaaacgaaacacgaaacgaaaaaattttgacggacgaaaacgaaacacgaaaacgaaaaaataaccattttcgtacgaaacgaaacgaaaaaaccgaaaattttttgaacttatttcaatcataattaagaaacataaaactttaaaattgtatcctctaactgaaggaatgaagatcctagtaggtggaaaagctaatgtggctctaggacaggggtgtgaccaaacaatttttaaaataaagaacatcaatgacaaaaaataaggtttagggtcaaaaaagacaatcttgcaaaattggttcgaatcagttaatatataattttttcgataaaaaatgtattaaaatgttatgtttttcacatcctattatggattttaacaatttttggggaagaaattagcaactgctgaaaaaaaaagattttcaaacgttttttttgcagtgtatttttttttacaagttgatgaatgggaagtgggtccggcggcgccgataggcgacgccgggaaaatttttgaaaatttgagtgctattttatagcagattttcaattaaaatcggtaaaaacatgattaaaaaatcggtaaaataaagtgcggtcatgcgggatcgaacattaatgcacagcacaaagcaaacctgctgttttcaccactaaactaaaatacttaaataataaaacttattatttctttccaaaaaagtcattcttaagggtgtaaatattttcgtctttttcgtaaaatattgctctgacgaaaacgaaacgaaaatcctaaattttaaaaaccgaaaacgaaacacgaaacgaaaaataaaattttgaaaaccgaaaacgaaacgaaaaaactttagcggacgaaaacgaaacacgaaaacgaaactcaaaaagtgccgaaactgtaggacgaaacgaaaacgacacgaaatttcgtccagccctgatccccgcccccgcgaaaaggccacccccgcccacggggtccgaaccctacttcaaacaaagtgtggaacactttttaaatcattttaaggtcatttaaagtcagcaacaaaaaaaaaattcatttggcttaaattcccatccctagatatgactgagtttttcctgaaaagtctgtaaaagttggcactttacgaaacgaccaagcaatgcttttatttgtccttgttttattttttttgcaccattttgttttaatttcagaaacaaccggtcctcaatagcaaagctgttgctgctgctgctgttccttttgtgccgccttcgaaccaaaaatcattgccaaatacaccaattgcatcatcaactcagaaatccacaccaatccccacacaagtgtacaaacaaacgaccgctatgcgcttacgaaactcggtgtttattatatattttttattttgtaacgttttaggtttattgttaacatttattccagggctttcgggatcgttgttgttcaattttttttctattcattccgatacgtttttaatagtttaaactagtgcagcgggaccgggacctaaacacggacaactgagtgcctaagtcccggttttgaccgggaccagtcccgtttttccagccaaaaattcccgggtttcaacccgaaaaggtcccccggctttgcccaaaaatttatgaatttgggaaataaaaattttctaacttttttgcatttgaaagcatgtttctgggtggtttttaaggcactgatcatgaatatgacaccagactggttacaaagaaaaaaaattgttttaaaaccggaaaatttttttccgaaagttctacatttcgaaaaatgtgctaaccaacttgaaaaatatattcttaatttaaaataagtcaaaaaatatttgaaaattcataagttccgcctcgattttcgagtttgaagttataaaaaggtgtcgcccaaactgttgagaacatttgtgatttggctcataaagctattgagaagacttgacttctagagatttcttgtacgaaatccaggttcgagtttaaaatttacacgaaaatgaatgtcttttcgtgaaattaaagaaaaatcgtcaaaaaatttttttttgttttttaagcttccaaaaaaatagtttaaaaatttttttcaaaatcttttctcgggacggagagctgatccaggaggaagggaactgatatgggggagaaaacgagatgttcccatggggaatttagcatagttattttttatcgctttatttcttgctcttccagcaggcacctctcaacatcaaagcaattccgttcgtgccgtcaaagaaatatttggtaaatacagcaatcgcgtcgtctacgcaaaagccatcacaacaaaactcgcagccaacaccaacaaacaaacagcagccatcaacaacgacccctcacaagaagaaatcggtgtgcttaattggtttttcaaaaagttgagaccggacgagaacgcgggattccaacgtgaaaagccgcgttttttttgttgccgggacgagatttttacgagaacaggaaaaaagcgggactttcttgtcccacttttttccgatttcccgtaaattttcctaaaacttttagactaagaaaatgaccataaaaaatttgtttaccggactctaccaaaaagcaaatctttggaataatcttcactaatttaactcgaatatcgaattttttttttttagagagagcaaccagcaacaaacaagaaagatgttaaaaaagataccacgaaaaatttggagcaagcgcagaaaacgaccaatgaaatgacaattaccccgaattacaaaaacgggaaggcggaggagaaggcggcggtttgcacaaatttggaggaagtgcaggaaaagacgaatgaattaagcctcaaggataaaagggaaaagacagtacgttttaatatgaacagctcccccccccccccccccccccgccgagaaattaaaaaaatcaagcgtagaaagtttcaagaaattttataagaaaatttctgagagtttttgcaaaattttatgatgaattgttagttatttttttgaaatttttccaaaaaaaatatatatattagcttttaaatcgtctgttttaaaaaaagtatgacc

SEQ ID NO: 5931 - DNA, 1598 bp, Heterodera glycines
  misc_feature (1580)..(1580): n is a, c, g, or t
aggggtttcagaataaaatgcaaagcagtttcattataatttcaattaaaataattttttccaaataacattgaaaattttagaaacgggcgtcctatgtccgttccttttattgacatgtccggcaaaatgatgaaggatattagagttgtcaggtgggcttttttagattctaatgcactttatgagcacaaacaaattttatgagtccaatcaattaaccataattagtttttatacaacaactttgttcatgttcgaacaacctaaaatatttttggtatattcgaaagcagaaaagactgaattaagtgtaataataataccgcgaaaacaagagaatagttaacatttaagaaagttacaaacgaaaataatcaacaattacttaattaagcatgcctaaacgcgctgacaaagggaggtggccaagtgtccgtgggatttccaaatgaaacttggttggatggatagagcacccatgggttcttaagaaaaatggttttattttctgccaaatgagcacgagtgccgagttatgacgtgccaaagtttttagttttttataattaaagaaaataattaattatttacatatcttcaatgtgttgtttggtgtagaggtaatgtgttagtcaaaatttttattggtcacaagttcgaatcccctttgtgtaaatccattttttaattttaatttttcctttttatgagcacttcaattagcaaattttatttctttatcaaaatctttattttaattttattccattaaaaattgcattaaacataaagatgtaataaaaaacctgtcgaattaaaaaatatatttttgtctaatatttttattgagtattttatgcactaaataatttcaaaaaaattaaaaataaagttttttttaataaaaaatattttgataattgacttggcataatagacaaaaatttaaaaaattaatttacatgtaggtgatccgaaccctaggttaactgatgctgactattgcactaccgctacaccactggacactgtgcggagacacaaataagtatttcttttatttcatcattaaaaagtttggcattttttatctcggcacaggggtccatttggcagaaattgaaaacatttttcttaagaacccaggtgtgctctatctacccaaaaaatctcattccgaaatcccacggacacttggccacctccctttgtaagtgatatcgcaacaataatattcctgattatctattaagatctgtgctaacgtggcctttcatcctcataactttgtgggcgattacttctaccaacaatcccgtaaagagtcggttgacgtgggtcagttggcggaacgcaccacatggattctgcgcatgttggagaccaaccgcgtggtgcacgcacgaccaaaatatatcattgtgttgcgcgacggactgtcagaggcgcaattttccatggtgagtgatgaaatattggtatattatatagttaattttgtcgttttaggccattgatgaggagatgagtgctcttaaaatgggctgcatggaatagacgagagttacaagccaaangtttatgtttgttgtggg

SEQ ID NO: 5932 - DNA, 3351 bp, Heterodera glycines
tttttttcggaaaaattttcgatttttttccggaaatagaaaaaatttttggcctgtgcgggacatttgagtcccgggtccataactcgttaggggttggttttatcgaaaaaactccttagggcaaattgtagactttttaagctctatcgaatggtgtgccatatggccggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatgaaggactgctcaatttaagtgaattaaagctttaaaaatagcaaaaaatcgggagaattttatgaggtttatttggttttataatgttcaaaagaaaaaaagttattccagaatttctggaaattttcgatttttcagaaaaaaattcataactcggttctgaaaggtcatactgtaaaagtaaaatactacaaaaatcagcaattttttcctctataatataaattttattttacatttttatctcttttttgcgaattgttataaaaataaaagtgatttttggtttcgggaccaaaggggggtgaccaggatttttgagtgaaaaaattttttcgacaaaaatcttccaaaaacatgtctttaggggtattttatgacgctgatcacgaatacgtgatcagattttacttttgacatcgttcagacatcagaatccctgtgtgattggggattctgaggcatcattttgaggggggggggcaagttcgaatccgggcggtgtacattatttttgctatgcatttttggttatttttaatgtttttaattcatttaaaagagtgtttgttttttaattaattttttaatttaaattaaattatttttttgtgaaaaattttttaaaattaattttttgtttgattaaagaatttcatataggcgaagttcggacccgggcggtgtacattatttttctttgtatttttgggttatttttaatgttttaattaatttcaagatttttataaattatttaatttatttatttaatttcattatttattttttgaatttataaaaaatgaatttcatttcaaaataaatattcaattattaattttcaaaattatatttaatgaataaaaagtgtattttattataaaaaaattttaaattaaaatgcaatcgatttttataaaaacttttcattatttatttaattttaaaccattttgtacctcttctaatcacttttgtacctcttctaatcacttttgtacctcttctaatcacttttgtatcttttatcacttttgtacctctttaaatcacttttgtacctcttctaatcacttgtatcttttatcacttttgtacctctttaaatcacatttgtacctcttctaatcctttttatacctcttctcacactgttgtacctcttctcatcactgttgtacctcttctcatcacttttgtacctcttttaattacagttgtacctcttctaatcactgttcttcctcttttaatcactattgtacctcttttaatcacttttgtacctcttctcatcactgttgtgcctcttctaatcaatcacagttgtacctcttctaatcacagttgtacctcttctgatcactgttcttcctcttttaatcactgttgtacctctcctaatcactgttgtatgttctgatcactgttgtacctcttccatttacttttgtacctcttttaatcaccgttgtacctcttctaatcaccgttgtacctcttctgaccaatgttgtacctcttctaatcacttttgtatctgttctaaaatttaataacggccgcgaagcggccgtcaaagcccaacaaagtttaaaaacgggcgcgaagcgcccgtccaaggccaacaaaatttgaaaaacgggcgcgaagcgcccgtccaaggccaacaaaatttgaaaaacgggcgcgaagcgcccgtccaaggccagctaaaaaacgggcgctaagcgcccgtataagttcaacagatttaaaaaacgggcgcgaagcgcccgtccaaggccaacaaaaattgaaaaacgggcgcgaagcgcctaacaagctaaaaaacgggcgcgaaacgcccgtatgagttcaacaaatttaaaaaacgggcgcgaagcgcccgtcttgagcctcaatgtggactaaaaacctctaataatttttttaaaaattcaaaaaatctctccaaccaattcgatcaatttgaatcgcttcacagtctaggtagcgaagctcccaaagcgcgaagcgcttttccccagctaaatagccgacggttcacgcacccgctagttactatatatgttatattgacaaggagtttcgttgctaaaaccattttctcccggccgaaggccgggagcgccctgaaagtggtggaagggtcttacaactttttgaggcgcatctgggaaaactatagaaaaaaattcagcgcggacgactgagtcccagggacggatttctcattttttcgtgcatttgggggcccgtaactttttttctaaaacccaaatcaaaaaatgtctgctgtgagggggctaagttgaagtgttttctaaaaaacaaaaaaaattccaagcctctatctgcaataggaaaggctgtaggttcgtggactttttcagtaccaactttgtccaattcagtcccggttgaataactcattagggtttgatctgggcggggagttaccagcagacttattgtagagttcaatgagctggatttttccagtttttaaaatttcgaaaattttcaaaatttttcgagctaggcctaaaaaacggttttcgggtttttgaattttaggaatttttaacgaattttcccagagaaacggagaccacttccaaaacatagtttttcgagctctatcgactggtaatttttttggaaaaatttcgatttttttccggaaatagaaaaaaattttggcctaagcgggacatttgagtcccgggcccataactcgtcaggggtcggttttagccaaaaaatgccttagggcaaaattgtagaactttttaagctctatctaatggtatactatatgaagggaaattttcaaaaattttcgagctaggccccctagaaattttcaaaaattttttttgggttgaaaaagagggtgaaaaatatttttctggggtaaattatggtgctaagccacgaat

SEQ ID NO: 5933 - DNA, 2382 bp, Heterodera glycines
gaattcataaatgtatttaggttctcaattctgcaaatgcaaatgattacttcattttaacataaaaataaataaattgcctctcattttatcaatttcgcccgcacaattcaatttgtcaagaaaatgaaaataaataaattatggagacgaatttttgggaaaatttttcatttcttatgggttattttctgaaattttggtcaattttcaggggtatattttcttaaatttttgggaccgattcttattggtgtatttcgtttttattgcactgtttttttgtgaaatttatattttatttaaacattttttctttcgaaaaaatcttctttcaacatccttctccattttaaaacataatggaatataagtttttaaattcttattatttttattcttctttatgttcataattcttcaattgcaaaaggttgtattattttgattccaaaaaataattataaattatatttttataaattacctgaaaaagcatcagtggaaaattcacatgaatcttttaccaccataattattttcaccgtttaaaaaccgctaattggccaagaccaaattaacgtaatcgtccaactgctcttataattattaaaataaatattattatttctatattttctttatgcgttatgtgcaggcattttttttggcaacctagatctttccttgagctgggtttccttgagttttttaccccgaactcaatccaggccaaatattcaaaaaatacgggtccaggcacaggctcggcacgaattttctggatttttttagggtttatttcaagtgaccaatgttttatttgaagttatcaaaaaaagattaaatagatttacataagattcaatttgtacttttatatgttcctaatcaattaattgttatccaagtccaggtccaggattttccaaaatgtcgtacactaattaacaccaaacgcagttttttaaacctaaaacccaaaaagacatttttataacgagaattatgtcaagaatactgtgcaacagcacaatttgtgctggtgacaacggttaagcattcgtcgtagcattggttggttcaacaactgtgtgtgaatatgaagaagcataaaaattgggaagtgtgatacatggaagagaagcggagacaatttgtggcaattgaagaggaaaaaatgcggcaagaaatgccattgcgagcggaaattatgggtcaagcggagcaggtcggtgccgcactgctgtacacgctgatccacatgaaaatgcgacggatgttcatggataacaaccaaaccccaagcggaagcaacaggtggacttgtgaattttctggctctatttcctttggctttaacttttttctttacctaaattatttatatcaacaaaaaacttaaagcctatagaatatttcgtcgacctaaattctgaactaaatgtaacagacaaaaaaaaaaaattattcttgaatatactcgaaaaaaacgccttttgtgttttctcgttgtaattattttttttattgtcagtatttgctcttttcttacattcgtgagttccagggaatttaagctttcgtttaataccaagaaagtagttattgaccaagtaagaaaaaagttatggccaaagaaactaaactttggacgcctaaaatgcactagagcattttttccccggtccccaaattgatggtcatttttaagactaattaacatttttgtaaaagacgtcaaaatttttaaaataaacttaggaattctatttattaaagggaaatctgtgtatgaactcaaatggtaatagtttagttttcaatttcctatttattgcccaatttccgggaatttttggggccggtgatcaatgatcacgaataaaacactcattcagggctaattctgaaaccgaaattatacaaaacaaaaagcttaaatttctgatttaatctttagtcgttctaaataaaaattctcaattaagccaagctcgtgatgacgacaacaacaacaacaacgaaaagaacaaccagcagcagggcttagctgaccctgcatattttccattttggttgaaaagggtggaagaagcattccgatcacatttcgagaaaggaaaggaacaatttggcatattttgactgaattccctaccgagaatttggagacgtcaaagaatgtgttgccaaatgggaaaacatgatcaaagttgcagcagcagcagaaggaagtgacaatgaaagtgatcagcactcattttctatttgttgaaatgggtgctatgtcgaagcacgaaaagtgcaaagtgatcactgatcaaattaaagcaagcaaaataattattaaaaaattaaaattaaaataattatttaaaa

SEQ ID NO: 5934 - DNA, 1266 bp, Heterodera glycines
cgaagcacgaaaagtgcaaagtgatcactgatcaaattaaagcaagcaaaataattattaaaaaattaaaattaaaataattatttaaaaaattaagagcaaaataattattttaaataaatttaatatagctatatattatttcaaaaataaacaacataatatttataatataaaccaaaattattaacccttacaataaaataatcatagtaaattttttctataaaaatatttttgttgcactatttatctatttgccttaataaatgtccgttttattgagatttaaaaatattataaaataaacgaattaattatgcaagtagattattattatttaaaataattattttaattttaattttttaataattattttacttgctttaatttgatcagtgatcactttgcactttttcatgcttcgcccaaccttgcacttttcgtgcttcgactcagcacggttgaaatgcctttttattattttttttattcatcaaagaaaaaccaaatctagcgattttatttctgaaagcccaaaaataggaccaaaaagtaaaaatcatggcttttaattgcggcacgcggttaattcgttcctgcatcgattcgttcactttgccgtgcattaatttcaccaagtttccttaagtatattgtattttcattacagggccccagaatccctgaaaaacaaaaaaaaacaactcttgaacaaaggataaagctaaggtcgtgatactatcatcacaatgttcaaaataaagtaccctgaattttgcagtaaaatgcgtcagcctaaccagcctgaaaaattcttagaatttttacattaaaagttttacaaaaatccgtccgttactaaaattaaacacaattcaaatacaatgcttgtcttgtatatatattatattagctataatactaatgactatgagatatatgtataaaatttgtttgtctaacactaaatgaatataaaaataaatgtaaaataaataaaatatttggttttctattgttttaaatcaaattatcttctgtcttgaagtctgatgagctggcacacctatttatttttattcattaaaataaatttaattttccattttgttttcaattatttatgataattgggtgcccttaatggtggcgcaaaaagcgcttcaatcttcccatttccatgaaatttttcattaaaattacaattgtcgataaggaaattaatggtgaatggctaagcgacgacaaattcgttaatga

SEQ ID NO: 5935 - DNA, 4528 bp, Heterodera glycines
  misc_feature (4458)..(4458): n is a, c, g, or t
  misc_feature (4492)..(4492): n is a, c, g, or t
tcaaatttaatttcttaatttagagaatttccgatgactttgcatttatgtcaataatttatcgagttaaattctcatggaaaacgacctcactaacagcaatgatgaatgaatcgaataagtggccaaattctgttattttaaaggtcgcattttaattaaaattacatttaaaaaattaaatttttaaggtgccgaaaacaaatgatgaattcaaagcaaaagacggtgaaccgaaaatggacgacacttttcaggaatatttcctcgattatttggcgaaggcccacaaagtaaaacaaaatatgctttcgttttttatttaaaattataatttataaaatacatttttatgtaaaatgaatttagcgtgaaattgccttttacaacggttaccatcgcttggacccatcaaatcgttttttgccaaaattgttttacggtgctgactacagttcccagcatcatgaaggtgaattaaaaaacgcgaaatttgaatcgttattggcaaaatttattgccaattttaccgtaatttccaatctaaaaaatattttgacggtgccttcgcagcgccggactaccaattgcaatagtatttcgattttcaaatccagctaaaaaacctgatttcacttgtcccaaaatatagaaatttttatttatctccaaaattggcaattgatagtataaatattgtgatagtgatgcgattttttaaattaaaaaataagcattaaaaatgtttttttaaataatttttgttttttcttatatttgattcccaaatttttttggggatgaattttcttaatgtgaacagtttgaggtcggtttctctgcgctaaacagtgtttttttaaagggataaattctgatcaacagttgtccgcttttagggctgatcatcatggaggacctaagcgaccgcgcgtgctgcgtgccgatgctgccggggctaagcgacgcgcaggtgcgcgcggtgatcacggcacttgcgcgcatgcactccaccgcatggacacaccggacggaactgatgagcgaactgtggaaggacggcacagcaagcgaatgttgggcattggagccgctttttgtggactcaatggttgaggcgggcaacgatttggccaaagtaatcaaaatgccctgcggggctgcaaaggaatttttttatgaaatcgaagaaaaaaaaacgaatttcaaaaaaatgacgggaaaaattttacaatgcagggaaaattttcctaattttatcattttaaaaaaaataatacataattttgtggctttttggcacggaattgtgaaaaatccataagaattgcaattttcgataccaatcaaattttttatttctgaaaaattcaataatttctcttcaaaatcgaaagaaaatggtgaaattatcgaaattgaaagattccgactcacgcctgatccaacggccaaatttgatgctgaacagactaatgattgtacggcacaaacgcactaaaattacttttttataaataaatgccattgagaatgggtgccaattatgagatggaccaatcaatataataggtttgatcagcaaatgagcttaaattctgaagaaataagcagataatatattaaaactattctttaacaaaattaaacgaatttatgaatcttgttttcacattaacaaacaaattcaaaaaaatgaatgacaaagttattaattattctttttgtttactcatcgttttccttaattgttgacaaaaattaaatttattgtacaacttcaaattagtcaatgtttcattattcataattttcgatgtcccaatttacagattgaaccaaatgccatcggtcctttgctgtgtcgaattttgccaaagtttcgagtggaaaacctcgcagagagtttttatgatgaagacaaatatggtggctaaaaatcgtaaaatatttaatgaattttccttgttttgagtggcattccctaaatgttaattatttttttgttaatttattttggaaattcattttttcgtcggggggcgtccgtcataagacatcttttttattcaagtatttgaagatgaattcaccaacagaagaaataaaatataataaaaataaataaatttattgaaatttttctttttaaataaatttaatttagaaattataattcaagggtttcctgcttgcattgttcatgccgatttgtgggccccaaacatattgtggaccaaaaatgcggaaggacaagcaaggtggaaaatagtagaaacatttttgcaattcctaaatgttgaaaatattaaagcaaaagaatgattatttcagcgttttttcctatcgaaaaatgattattattaatttttatcaaattcattattaaatttagcgatcaattatgcgcaattatcgattggcaaacggtccattcgggcaacccttgcgaagacattggccgtctgctcgcgctgaacacgacaagtgcataccgtcgtgccaacatcaaccaattgttggcattttatgctaaaaaagtggccgaatttatgggcggaaatgccccatttacattggcacagctgaaaaaggcattcgtcggcgcaatgccatacgtaatgatgtgagattttctctaattgggcgatgtaatatgcaattttcgagactcaaacccgagacagaagagactctcgaacatatcattatttaatttagcatttttggttcttgtcaaattttgtactaattgccgcataattacttatttacctttgttatttctaaacaatttaaatttaaaataggtttttctgttttggaacgacaaattattgcaccatggaatcggtggtgggcaaagaaggcacggcaaagcgagaagaaaaccgtgccgaactgttcgatcgcgtccgttcattcatcgaagacacagaaaatgaattttacgatcaaattcaatgaaaactattaaaaattaattgaataaatagtcctgtgccataatttttatatttttatttttgcaattttatcaacaaatttgtgaaaaatctattattaaatcttaaataaaccaagttataatctatgttcccctatttgggctaatttttgtccggcaatgtctgtcgagcacctcaggatctttaaaattagatccctcagatcaaagtgtcatacatattaatcactcatttgtattgatcatccaaactcatttctgcagtcattacgattcctttttcctttttatcgattccgattaacatttccttcccatttcccttatctcgtgacctcattagtcctttagaaaataattaatgaatttttcaagaaaaaattctcttaatgacaacatcagcactcagtgggattcgaattttggatttctcacgagttgtggccgcaccgtttgcctcaatgattttgagcgacttgggcgccgaagtttggaaaatcgaacgacctggtgaaaaaatgactgacattaataagtctggcgtaattttttccaaatcttcctgtgagatttttccctcctaaatcgaagaaatgcaaaacaacataaattaatattgaaatcaatttatgtttgaaaaacaaaaaaatttgcttataaatctttattaaccaggccagattgatgtttatcctatggcactgaaaattctattattttagacaaaactaaatattcaatttataatttgaaatggattcaaattattcatccggattttcaacaattgctttggtcacattattcccaattctcaataaatactgacaatcaaaaaccttacaaaaaaaattaaaaaataaataatattttcttttatgttcaattattcgcaggtgttggcgatgattctcgcctctttacaccgcccgaaatcaatggccaaagttgttatacgcttggccttaaccggaacaaaaaaagcattgcgatgaatttggctcatccggaggcacaaaatttggtacaaaaatttttcataagacttcaactattaattttttattttaggcgcaaaaattggcaaccaaagcagatattgtgattgaaaatttcaagacgggttacatgaaaaatttttgccttgattaccctcaattagcgcagctgaaccccggcttaatatattgctcaattactggtatttttgtgtatatactaaaaaatgtaaatctgaatgaatgaaaatcatctggatttctgttcgaaaagctcaatagaccgattttttttttttaaattttggataggataagcaaattattgcttctcgactctcgaggaaataaaaagtcgggcatcggggaggaaattccccgacaaaaattgtcgtgattggctggggaaatttaaaaactttcaggaacatacctttatctgggagtgaattttcataaaaagttgagaaaactggttacagaaatttttanaaattataaattcataaaaccccgctcatatggngagaaacttttaacaattaataagacattgtttcca

SEQ ID NO: 5936 - DNA, 1031 bp, Heterodera glycines
  misc_feature (40)..(40): n is a, c, g, or t
tttaaaatttttttgaatttttaaaatttcccggttggtncccggttcccggtttttcttgcggtcccggtcccgaaaaaaaaatcgaggtcccggtcccggcttctcaggtcccggcaagtcccggtcccggttttggcaaaaattcccggtcccgtggcactctaataaagaaataaaaaaaaaaatagtaaccattttaagaatgccttttgcaaatgagaaaataaaacaaataaaatcaaatatttctttttttaactcatttttacgcaaaaactccagccatccaaatccaattataaattgcttaaattcaaacattcacttttaataaggatttttgcttcctatgtatctttttttaaatattaaataattatgcatttatattttttaccttttaatttatattaattatgacgatatttttttcctttagctttgtgagaaaatggatttgccagaattgtgcaattcatctgactacaaaacaaatgccgaccgtgttcggaatcgtgaaaaacttattggaatattttcaaaaaagtaatgttttataaatttatttcgcattattttatttttcatttctttcaattttaatgctaaattttaatttaattcccccccaccccacagatttcttgaacatgaccttgagcactggaacgtgttgctaaaacattcaaaatttcctgccggcccagtgaacacaattcgtgaggcttttcgtcatgagcaaacgcaacacattggcattgtgaagccgatcactcaccaacagtacggcactgtgaaggtggtcggtaagcgaattgaattgttttatttttagtaaattaatttaaatgctcttgtaaatggttttacagaaaaaccattcccaagagtttattttaagattttggttcggtgatttgtcacggagaaaaattaaaaaatatattggtttaatatagaaaaattgtttaatattttcagaagagggacaattgaaatcatcagaaatttattaaaggattctaaaa

SEQ ID NO: 5937 - DNA, 2034 bp, Heterodera glycines
acgacgactcgtatgaccaaaaaatgccacgacgacgacttgtatgaccaaaaaatgcaacgacgacgactcgtatgaccaaaaaatgcaacgacgacgactcgcacaaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgccacgacgacgactcgtatgaacaaaaaatgcaacgacgactcgtatgaataaaaaacaataactatttcgagattcttcgtcattaaaaaatcgcaaccctacttattactagggcttccaattatgtatatggaaatccattttttttcatggactgtgggaggcctgaaacgcacgaaaaccatctttttagcttggtttgaagcttctagtatgaatttctatatccattttttccatatttcgcgatttatgtccatatttttggaagccctatttattactagggatgcgatttttaggtgctaaaaactgccaaaataggtaggttttaagttataaaaaaaccccaaaataggtgctaaaaatgggaaaataggtgccaaaaagtttcgaatttaggggtgtaaaatcgaaaattttcttcaaaaggcaaaaatattacgccaaatcattaatgagatacataattttcaaaatcaacaattctcgtcaaaaaattaaacaaataaattttgtagatgaatttttgagaaattttcatttctcagggtatatttttgaaaattttcaattcgattcttcggggtatattttttgaaaaaaaattgggtcgattcttcggggtatattttttgaaaaaaaattgggtcgattcttcggggtatattttttgaaaaaaaattgggtcgattcttaggggtctatttttccttttattgtatttttgttaacaaattttgggcaaaatgccaaaataggtgaaaataagtttttaaaattttttttaggttttttaggtgctaaaaataaaaacctagaaaataggtgctaataactcgaaaagtagcttaacaacagcccaaaaaaacatgtttttcgtgcgtttcaggccacggggatctcaggaaaaaaatatgtaaacatctaaaaatcgcatccctagttattattttttttgtgaaaatttataaatttaacagtcctatttcaaattactagcgaggaggaaggaaacaaaaactactgtcagcgccttcggcgcatcccccgctaggcagtacgattgtgttatagaattaagaatgataaaatcgactggctcgtcgttcattttttaatactaaatttcgtctcgctgtcctctatcaatattttaattaaaaaatattaagcatgaaaaagcattaaatcaatgtcaactcaaccatctagctttttcaacgtcgccatgccgccccttggacatgtcgaacaacttgttcaacccatgtttatcaatgcggcacatcagcaaatgccggtatttttttatttttttttttcataaaacaaattctgttttaggcaccatttttgtgctgatggcacgcacaccattcaatttttgaatgggagcgtctctattgggggccgcccgttgccgtctgttatttaaacaggtttttctattcaattgattattcaggccgatttggctcaccggaaaagaagtggatccccgcccgca

SEQ ID NO: 5938 - DNA, 2288 bp, Heterodera glycines
  misc_feature (76)..(76): n is a, c, g, or t
ttgtatcaaacaaagctaaaagtccctagaatcatagacaaagaaatagcaataatgacattagaaaaatcgacancgagaaaacacgaaacgcatcctttttgagtatattcaagattttttttttgtctattacttttagcccagtgtttgggactacaaaagattctatagactatgcttttatttgataccaagaatgtaggtattgaccaattaagaagaaatttatagccaaagaaactgatgattagacgcctacctaaaagtccagtggacgtctgtctatatagcctatttttactatttttcatatatatttgtttagaaattgcaatattttctattaggggcatctctctggtaatttttgtcgttgaaacacagcaccagtgacgcattgaccatggactacggcgtggaacgcaaacgccgcagactctccaactacggagcgacgtcgccgacaaagagtgtccaggaggtgaaacccgtggcattgtcttggcacggtctcaccgctgtccatgccaaatcgggacggaaaattcttggtaaaccccagtcggagttgcgttccctacgtcaaagactgtttcgatttttttagacgacgcgtccggcatggccgacgcgggccaactcgtggcactgacgggcgacggcggagtggacaaaacagcgcttttgaacacgttgctggaccacaacctgaagactttgagcgtggagggtcaagtgctgatcaacgcgcactccttgggccggttcatcacttacgtcatcggggtgagtcggaaaactgctaatcttctgttaaatgtcaaattttgaattctaaaacaaataaatggtaaacagaattacaaaaatgtacaatttttcctttgaaaacttgggtttcaagcgtactttaccaattaagttttgcaattctgcgcgccgttagttttaaattcaaaacttgaccgcataatgtaaagtgccggaatggcaaatccaaacatcgacgatatgtcggttgagaccgttaattgaaacgggattagtggttattaaactatagtgtgttttcccgttctcaatttcagtacgtgcagcaggacgacttgttcatgggcacgccaacggtgaaggagcatctgatggcgcaggcacagctttggatggtcggacacacccaacggacgatgcgtagacgcgtcaatgaggtgggattttggatgagtacaaaatggaaatcactaattttctaatggattaatttggctgctaaagtgtcgtcgtgcggtcattggaattagcaaacgagttttttaagaatgaatttctcattttcagttggaagaagccatttcggatggtgaggcgcgtcgtttgccgttcgccttcgaaccgcggcacaacccgcaaatcatttttgccctcaaaccgactaaggttccaatttttttttgaattatccaaaattcctgattaggacctcgactcgtcagtggtggacagtgtggtctcgcacattctgcgtaccctgaatttgttcggccggcgaatcgtcgtcacaattcaccgtccgtcagaaggaatgtgccagaaatttgagcgggtaaaatttgaccgattttccataaattcagttgggatgagtgccacccccaccctaaatcaccaaaatttacgcatttgtttttatttgtctgttgataaattatatttactattaaacgttactttttgaagttgccatctgaatgtaccttttaataaaattgaacatgtcaaaatttatggtcgttttctcttcccattggcagccaaaaaagcagaaatggaggtagggaaaataattttaaaaattttctaagtttttttgaaaacattctgttagaaattttggtaatactaccgacggtatcacaaaaaaaggttttctcaaaggggaaacaagcttctcacagtgctgacttcttacaaagaagcagcaattgtttttagatttagcgcaaaaataaattctctttggcgttttgaccaatttgtctaacactgaaacgaacaataattttcttagtcttagtttttcttaacaatcctttttttcaatattatttagaaaaagtaatccttttttaaaaaagaaaatgcacattccaaaaattgaattccccgaagaaattgttccgagattggccaatttgtcgctaactcgtcgacccatttatgcggttttcttttgactatctttttaaataaatatttctagtcctaggaaagggtaaaataatttg

SEQ ID NO: 5939 - DNA, 2232 bp, Heterodera glycines
  misc_feature (1360)..(1360): n is a, c, g, or t
  misc_feature (1386)..(1386): n is a, c, g, or t
cagcagcaatccatcaaccgtcttacgataacgaatcaggaacaacagcaaaccattgccgagcagcagcaaaccattgccgagcagcagcaaaacatccaacaactccaaaaccttttgggtttgtgcaaaattttagttgaatttcttttatccaacaattgattgtaatgcctaatttttcaagccggtcacccgcagcatgcgccagcgatgggcctgggatttcctggtgaccagcagcagcactatgcgctcggcggccagcagcaacaacatgcgccagcgatgggcctgggatttcctggtgaccagcagcagcactatgcgctcggcggccagcagcaacaacatgcgccagcgatgggcctgggatttcctggcgaccagcccgaaaatattggtcagtgccttggttaagtcaggcactctctccatttcctttcgtttaggtgtccagcagcaaatgcagggacagcatggtccccctcctccgccgccgccgcagtaaaaccgttgcaagtggaagtcgaatgatgcgttgacgtttgaccgtttaacctcttatgttttaacgttattttgtttgatgagaataaaatctaatgcctcgtttcagtgtaatagtttttttgttcagaattaccagttagaaaagcaaaaacaataataaaattgtggtatgtcaccatagcttaataaatttcgagatttcaaaaacccatcaattctgacttgattacgcaaacattaatcccttcccgcaaaaaagtttgagccaaatcccacagcgggatcagcaaatttctcagggttatattttatccgtcgtaatgccatcaatttttgttgtcaaaattttcattcgttaaagaaagcgagattgaaaaagcaaaaacagcagtggtctgatccaaacaataataaagcgcagagttcaacaaagaaaaagccattaacattttgtgatttattggtgttgctccttcatttccgttccgttcattttcactgtccccccttcaagtcgcgcatgccggcacgcatcacctcgtccacctccagcagattggaggcgatgttctgacaggcgttcagactcgcctgcttcacgcacacattgtcccaaacgctctaaacgggggaagggaatcaatgaaagtgttcactttttatggcccgacccatttgtccccgtccatttctggggacacacctgagaaacacacggctctccgctctccaagtccaatccgaccagctcaccagcagcactgaacgtctccaccagcttgacaatggcctggcaattgaaaagagttatacatacatttttgactgcttttcactcacctcctgngcgtcgaatccggcattgaccgccanagttttcggaatgactagcaaagcctcagcaaaagcctgggaatgagaatgatgacaataattgaaagggattaagaaagaaagaaagaattacggcaccaaaacaccgagtttggcacgccctttcacattgtcggcaagctaaaatagatatattcgtgaagtctggaaggactctgcttgctacctttttcagtgcacaatatcccgcaatttcaaatgcaccggcgccgggcaaaacggcacctaaagaaaccatgaaaattaaatatgtgacgaccaaatgacagtcataagtaaagcccaaaactgggaaaagaggtgcaaaatcaaataacccaaagtgccaaggcattaattgcctaggtaattagtcattttcatccaaattgtcccatcccctcgtcgcaaaacccaccgtctttcaacgcattggcaaccgcccgctgtccgtcgtaaatggcgtccttcagctgcgtgatgctgtgcctgttgggccctttgagcagcaaagtgaccgacttgggacttttgcactcctccacaaaagtgtatttgtcctcgccctgaagcggacggtaaccatgtgttacatacagtacaccaatggaaaactgtccccgcccaagaaataacggcactgctcccccttaactgaccagcacatgctcataaacactgcccgcccatccgagcacatcgggcgtcaggtcgtccaccgaattgaccgcctcgccgccgcaggccaactgcagccgttccatgttccggcgcttggcacgtcgcagggccaaaatgccgtgctgtgccaacaaatccaacgacggcggatcaatgcccttaggg

SEQ ID NO: 5940 - DNA, 1770 bp, Heterodera glycines
ttttaccttataatagagactggaaattgcaaatttgtgggattttctgtgggatttgaattcaaaaatttaaaaaatgacttaaattataataaagaccaaaagctgttcaaataaacaattcgtcattgagttaaaaaaggttcaggtcatattaacgcaatttttggtggtgaaaaacaatgaaattgaaccaaatggttaaaccgattaaaaaataattatattttcatattgttggataatttacaaattattcatataatcgactaattaaggctgcattgtttccatgcgaactttgttcaactgttttgaaggaaaacattgccaaattggcgaaggtaaaaaatgtaaatttattaaacattgatgaatttaaatatggtttttgttcttttctcagatggcatccgatgccgcggctgtcgcctcgacaaatgccttttggccggcatggatccgacaatgatcaaagctaatgcgaaggacggagaagcgttggcccaatatttggccaggttggagctgcggaagagaaatgctttagcgaggaacaattgcgcggaacgaaacaattgaatttcgattgaattttgtattaaattccttagaattgaatttcaaattgaattttaagttgaaaaattcacggttttcgtgaccttgaattgattccgtgaatcgtgaccgtaaccactatctaaaaacccgtgaaattcacggttttcgtgaccgtgaccgtgaattaactccgtgaatcgtgactatctaaaatttgtgaaattcacggttttcgtgaacgtgaccgtgatcttgaattgactccgtgaatcgtgaccgtaaccactatctaaaaacccgtgaaattcacggttttcgtgaccgtgaccgtgaattaactccgtgaatcgtgactatctaaaatttgtgaaattcacggttttcgtgaccgtgaccgtgaattaactccgtgaatcgtgactatctaaaatttgtgaaattcacggttttcgtgaccatgaatcgtgatctgaattgactccgtgaatcgtgaccgtaaccactatctaaaaacccgtgaaattcacggttttcgtgaccttgaccgtgaatttactccgtgagccttgatcggtgctttttgcgccttttggcatttttcacactgacggacaatccgttcaatttccgaatccatgccgggccaatatacgtgttggcgggcgagtgctttcatgcgcacaattccggggtgtgccatgtgcagggacttcagcattcggttgcgaagcgattgcgggacgacaacgcgattttggtagagcaaacagccctcgatttccaaaatgtccctttttggaaaatacggtgcgatgtccgggtcgctgcatttctttggccaattcgattgggtgaatgccaaaatttttgccaaaatctcatcttttggtgtcgcctctgcgatttcgtctgcagtgacgggaagttgttccgttttggtttgcagaatggtgctgttgtagcactcggtttcggtgcagatgttggcaatcaaaatatcctcctctggtcggggataatttgcgatgaggcgtgagagaacatcagcctggccaaacgatgcggtgttgatgtaccgtatctcaaaatcgtaattggccatgattagggcccatctttggagtcggctggcggcataaatggggatgcctttcttggagacgaagatggtcagcaatgggttatggtccgtgagcagtgtaaatt

SEQ ID NO: 5941 - DNA, 5656 bp, Heterodera glycines
  misc_feature (5625)..(5625): n is a, c, g, or t
tcgaacgcggactgctgttcgcctccccaactcaggattcatcctttcgaagaagttggtccaatggcgccctgatttctcgcattggtttaacaaaacgtccgtaatgagcgctcccaagaatgaacggagggtcgttttgtcgtgcggcgctgacatttctgaattgcctctgagcgcgctgggtcggggcgtatgccgttggaggagacgacttggccgagaaaaagcaattctttctggaggaatttgcatttttcgagctgaatgcgtaggccaaagtcattaatgcgtttgaaaagcgtttgaagcgcattgacgtggtcttccagggtctttgaggcgattaggcaatcatccaaataagaaaagacccctggaattcctgcgcagatttggtccatcaggtgctgaaaaatggacggtgcagatttaacgccaaatgggagacgttggcactgaaataggccgcggtaagtgttgattgtgcatagtggtttcgatttttcgtccaattccatttggaggtaggcgtctctcaggtcgagatttgagaaaaatgcggctccatttaaagctgcataaatgacgtcgggtctcggaagaggatggcgattcagttcgatcgaatcgttcaatccggtcgaaaagtcgatgcacacccgggtctttccatttttctttttgacggccaaaatcggggcggcccaatggctgaattctaccggtttgattgcgccaatctgcaagaggcggtccagttcggtgtcgacagcttcgattgcaccatgggggactggtcgtgctttacagaagatgggtcgggcctccggttttagaatcaggtgcgctttgattgcgcaatggccaagtccgttcttaaaaacttcctcaaaatctttttgcaacacagcggtgagcgaggattcatccgtgatgccaatcgccgggtttggtgccttgacgacattggcgttgattgacgcgttgggctttcctttggtgctctttgggaacaaaatttctcttgggatgagctcgaattcctcaatccacggaaggccaaacaaatcatgctttaagtcactgcttacgtaagcgatcagtgttttggatggccgatcgaagcaactgacggtgcaatggaattttccttcgggtgaaaatgcggtgtcattgcagttgcgggtttcgatgtccgttggagagagtttgggttgacccaatttgatccacgttttgaagctgatgactgttgcttgggctccactgtctccattcatcttcaaatttataccattgattatgaccgggatcttccaccatcggccttgggttgtgccaatcaccatacaatgtgacttgaccacgaccgtgtgaaatgatcggttctgagatttgtgtgccgtgttggacgagcactgacggcagacaatcgcaatgtggccttgccggttgcatttgttgcaaaatgcgttggcaaatttgcagtccgatcgccagtgatcggtgcttccacaggatgcacatgggtgcggtggatggcctcggtttgctttattgtctgatttttgcttaggcgaaggcacatgatgcggcgatttgggtgccggttcatgttgtggccatttgggtgccggttttgccttgtgtttgcctttgctggtctctcgccattgctgaggtcgcaattggatggcgctggttgagactggttgagtaagcagagaaagggcactttccttgacgatttgaatcgccttcaattcctcttacaccttttggagagtgatgtctgtgccggtcttttttgcgtcctccagcattttgagacacttttgcctcaggtcgtgatgctcgtcgttgagtgcaatgaccaggattatgcacttgttctttggtcggactcaaattggcgttttcgcaggacgcattgatatgagcgaccagcgatgatatgtcctggctcggttgctgacgaattttgaaacattcgtagcgccggacaaatagtgaacgcgtttcggcatataatcctttcagcttggtgatcgagtccacccaagtgactttgtcgggctgggtcggactgatgctgtcgcggtatttgccgtactcctcgtcgccgagtttgccgaggagtagtctgacttttgtcgactcggggaggtccttaccatcttcctcaatcaaaactccaaaccgtttgaaccactgttcgaaagtgtttccggtttcggcgtcgtaattgaattttgaaattcggccgtcgatggaacttgccaaatttgcatggttcagactcgctgacgcggcgttttgcggtgcttggcccattagttgttggatggcatccgattgcactcgcatggcctcaaggagttgcttaatttggtccgcgctcatgccgaattgtttgccggtgccgaatttgagagtccaaagttgaaaaaccgcttattgcggaaccgcaacctttcttaggtctgttggtttttcggtgaattaactgcaatatatgcagacctcacccgcctagggactattggttttgttgatggcgaaaaactgcagtatttgcagacctcacccgtctagggactattggttttgttggtgtgcattccgggtgtcttcttgttggttgaagacgactgctgactgcgccaaatttgttgtgtctttgtccgagtgaataagaccaacaaatatttatttacgaagagacaataataataaataataaaaatggcgaatggtcggtgggagagaataatgaataaaaataataaattgaaggcaggagaagaagtgaacatgggggaagagtccagcctttaaatagacaatgtgagggggaaggaacggacgagagaatggacaaatgtaaagatcaataatcgataattgaacatgagcaaagtacatttgctttttctccaacacattggaagaatttcgtagaaacaaacaaattaaagaattgaaaaatttgccggaaaattttcaaaatggccaatgctttggcattttaattgagccagatgataatgccgaaatggggcatatttcactcacatttgcaatttatgtgaaaccaatggaaaatgagtaccaaccgtcggcggatgaaaataatgaaaatccaccggatgatgaagacattcgaacaatggtccgaagaatccttttcaggttgttcgagccaaacttggcaaaggtgtacaccgtcaatttaggcaaaattgacccacccgaattgtattttaatcgcacaattttggtggacaagaaaaatgatttggccaattaccatgccttattgtatgccaaaatgcatataaatcgacaaaatatctctggttataatcttttgggctatgctcaattaattaaaatcaacgacgaagaagcatcctccagcagctcagaaaataaggtaaaagcaaaaaacggtaataatatataaaaaattatttatattaatttttgattatttttatgtaatttttagtccaataaataccaattgaaaattccaattaatttatgtgcgcttttcaaacacttcattcatagctttggattgcaaatttattcttttgaaaaggtagatttattaatattacaaataaacaatacaaaaaacacttaaaaaataatgggcagtaattagattaattatagaataaaaatcacaaagaaaaaatggagaacagagaagaaaatccgcaaagaatgtgcaatttgtcttgaatcatttgaagatgacaaattaacaatgaaattgcatgaggattataaggttaattaattaattaatgatattaatttagttaaataaataaattaagtaattataattgatataattaataattaacataattattaattaatataattaatccaatgtaatgctttagcatgtgtttcacaaggaatgcatcactaaatggtaataaaaaaagattgaaatattcaaataaacaattgttttttagggttttatcccaagaacaaatacgatgcccaatttgcaatagaaacgcatttcaagtcacaacggtacaattttaatcgctgtaaaatatcttattagcttatcattaggctcgctggtcggggttaagggatttcgtaataaaatattttttaaataagcaaaaatttaacttatcattttattcattcgaaaattaaaattttctaaatattttgagtttttgacttatttagccagatcttcaaccatatttgatagacctgaccagccttcaacttcatttttttatttgaaccctttggcatttttattccaattagcgaatggaaaaacggaaaatgatgaatttaaaaagaaaacaaacaaaattagcaattaaaaagactgaagaatttgtaaaatcacgtgaagccgaactaaagcaaattgctttggaagcagaatttttgaatttgaatctttcagctgagcaaaaattgttcgaaattgggccggacggagtgaaaagtcatccaattgtcgaggaattgaagaatcaaatttcagacattctttcaaacggtcgtcaaaattcggaggaaatcatagcaaaagccgaacaaatgaattttttgatcaatcgaattacaatttgaattatggtgttcgtttggctttattcattgaaaatatgcaattgatcagtgaaaattgatttccaccctcccttcgtcccatccttttgtgtttatctgacaaatgagcttgtctttgactgattattgcctttctttgcaatctgttatccaattcagcatttgttgacatttttctttaaattttcctctcgaaatgaattataattcgttaacctgttctctattagcctgcaaaatttcattgaatttcgttagggttcaataaagttacatcaagaaaatcccaaatgtttgagctttttggaacacagattttttttttgaaattgacggggccttaaaatcttgcaagctaatagagaaaatttcgagctttgaatgataatagaatttaaaatttggttgctttaagaaaacaatttttatcggaacaatggttgaatttgtaaattattagactactgctaaattgttttcccccttaattttcaatgtcgaaataaaatttggactaaattattgaattttggaactcttttccaattgttctggcaacacggattctaacgaatactaaaaaatgaaccaacaataaagcaaaagtgcataggtcggccaaggctggcctgggattaccagaggcggcctgtatctgttatattttttgaaaaacctagcaataatttatatattttttcttcaatttaggagacaaaatacaggtacaggaaaaattaacacacatgtacagaaaaaatgccgctttctgaaaagtcgctgcacaaaaatgccgtagggaaagcccgtagcgttcattttcgttgatcagttattctctttttggcaaagtcctttcgctcatcaatcgctccgcttgtcctttctcgatcatttccattttgtcactgtttagccgatcagtgctgtttttggcactgtcttttcgctcatcaatcgggttcgcttttgcctttgcctcgncctccaccaatttctcgaaaatcaagtgttc

SEQ ID NO: 5942 - DNA, 3365 bp, Heterodera glycines
gattttatcattcataatcctataatacaatcgtactacctagcgggggatgcgccgaaggcgctgaccccgctagtgtaaacaaaaaagtaaacagttgcaggaaattttttctcaatcggtatgccaaattagtgtgtatttaaatccgaaagtgttaacaattttttcctaacaatgataatatggaaaaatggattgcagtttaaaaacttcaacttttgtttatttttttcatttttgtattaactttttctaagtgtcaaactcgcatttgccaatctctggcccattacaggttttactttgagatggctgtccttatttcaattccaaacgcctacaaagttgtattattcattattgcttgcggttatttgatttgtttgtacgtaaattcacaaatctttacgttcgtcgtcttctttctgcttggctgtgttagttttctttaaatatattattataatttgtttttttgttgttgcaatttcaatagtgaattattttttgataattttattacttgtttttgttattcactttagaccgttggatactttggagacggtcggtttatccttccgctcaaggctttacatggaaatggcaaagagttattcatgctgttttggaccaaataccttgatgtgctccgtatggttttgccaaaaaaaaagaaaattttgcacccgcctacacattggaatagacggtaatgatggagtttgtaaaatttttaaaaaatccacctaaattttgaatttatataaaaaagttttgaatatatgaaatcttttgaaattttacagacaacccttataccaacatattttggttctattgaattttttagtccaatcaagtgacaatacctgtttttttatacaataaatttgttcatgtcaacaaccattatttttggtatcattcgaaagcacaaagtctaaggagctaaaatatataaaaaacagcatttaggccattgctaaaaaatttgattatgccaattatgaaattacgattagtaataacataagcaacatttgcaacaaaaaaaattttcgctaaatgtttgaatttaagtccggcgttcgaaaaatggccgtccaaaagccgattaaaatttcgtgaatttgaaagtgccatttcgatggttttgttttttacgtgctcatctcttcacccccccccccccccctccacttgcaatttctctcctcaattttactttagctgcccattgctcctctcctctctttcctccttcgccacttgcacagcgactcggcaattcccgtcgcgggcggaagcaattaggccaacccatcgccgctttcattagcatcgcaccgcttaagtcagtcagtcacaaaccgacaaagaaacggcaaaattctctcgcacattattcagaaaagtcgaggtgagttgttgaatttcgttgtttattttattcaatttattcgggaaaggctctgccaaacctccgaacagcgaaaaattcaatcggaaagtgagtctcgaggaaagggagtcgagaggggacgagcaaaaggctttgcgatgaacatgggcatgcccgcgggcgcgacggaagtgcccgagggggtcgtgcagctgaatgtcggcgggacttgttttctgaccacaattgacacgctgaaaagggatagcggagcactgctgtcccaattgttgacgttggaagggttggagaagaacagcaaagtcagtcagtccaggggcacagcgacgcctttggtcactgattaatttggaggtggccaagcgaatgagcaacggcaccattttcatcgacagagacggcgaacagtgcgtacagcactctgctcttcaggtcgccggtccggtgctgagtcgttatataaaagccatcaaaaagggcttatataaaaaaccatcaaatgaaaatttccaacagaaaactgtccataacttttgtctaagtaaaccaaattaaacattcttggtattattcgatagccctaacatttctctattagctcacctaaatttcaaaaaatttgaccaagtttgagcaaagttatggccaaaagtagtcaaggaaccagtttttcagacatttttggttataacttttttgaaacttgacgaaattttttgaaacttaggtaagctaatagagaacaattaggactataaaatgaaatcaagaaaccaaaaaatataaacaatttataacgtaaatttttttatttagcataaaataattttgatgatcaaaaaaatttcatttgatggttttgccgtcagcatcaaatttgggccttcctaagtcaaaaaatcactattttagacgtaaaaattaaattaaggcccgcgttcaaacccaaggccattttcagcgactccgatcaggcatcatgtgcgtgtccgtccaaaaactatcgaccaaacaacacacatggatttcacatttgctgacaaagcaacacgcatggttttgacaacgacggacaagacaatggacgtggatttggcttaaggacgtcgcgacacaaaacgagcagttggacaaacagcttgaggagcaggaacaagcgatcagctttctttgacagcaggtccgcaccagagacgcaatgatcactgatctgctccgtcaattggaacagcaggcgcagaagaatttgcagaattttggaaccattatcgtccaaattatttttagcatccacacggccgcaaaaagaatgcggctacattggagcagacctcacggcaaaatttggcagagaaaatcgctgatgtgatcgatcgagatcggtgtaaaaatgaaagcccttttgcgattgatcaacccaaaattcgacgtatttccaccattgaaaaaagtagaaatatttcttttaatgaaaaattctaatttttgggtgatccaaataaaaagaaacacctgccttgtactacattatgaggcaaattctacgccggcgggtcccgctttttattgtctggatatagctggagccttgagcttcagattgtccgcagccacgggcaatctgattagcttcagatcagacgaattgattttaaaattaagcgaagacaatggccaaggcttcacaaaaataaccatttctttggcccatgcttccttcacatgcgaattctccggccaacaatttcatcgtggcagcatttcccgcaaaggacaaaagggaaaatttgatcaaattctgcggcaacatttggcaacaaatcggccaattgaatgaaattgcggggaaaaaatcaaattgtaaattaacaaattttttctgaaatcaactcactttttcaggtttctcggcggtgatctgagcttcttgtgggca

SEQ ID NO: 5943 - DNA, 1630 bp, Heterodera glycines
  misc_feature (1627)..(1627): n is a, c, g, or t
ggccaattgaaggaaaattggggggaaaaaaatcaaattggtaaattaaccaattttttcagaaaatcaacctcactttttcaggtttctcgggcggtgatctgagcttcttgtgggcaattattggacactgtggctctgccgttacgacatttccctcgcctgtttgcgattgtcaccgcgaccaattgttggacgtggaaaagtgcaaaatttgaacgacggaggaaacggtgaaacaagcttagcagtttggatgactcgtggaaaatggtgagaagccgactgccgctgctcgagcgctgaccatgggaatcgttgaagagccacttttgcgatcaatcatttgaccgaatattctggcgccttttcatgtcttccagggcattggaaatgctctgatcaaagagctcgaagcatcgacggaaaacgcggaaattgcgaacgaattttttcggagcatcagggccaggatgtaatcgttcaggaaaaaggacatgacggggaactcaatcagaaaagttctgattcatgcggaccaattggagaggtgttactcagctgaatggccgtaaatcatttgtcaaaccttggggcatttggcaaaaatataaacttttacaaaagtgcttttttatttgatatttttgaaaattaaatataaatttaaggcccagccactgtcgccacgggatttggacgaattggaaacatcaattgatcattttcggacatttctcaacgatcagtcgcggatgtgcactttgatcgccctaaaaccaaaggtccacctgctgttgaaccattttgtgccttcgccaaacagcaccaatttttggcacttttggacgagcagggtcaaaaagaattttgaaattaaagtcctgaattttttaggtgatgaagcattattgcattcggtatggaagcgtttggaacagttgtggaaaacaatgcctgacgaagaacaaatgcgtcaattgttggagcaccattttgtctcaaattggcttctcgatacgggaaaactcgacgaaaatgtcggattcctgttcagcaaccccaaaaacctctgtaaacttgtttttagtgcaagatttttgaaaattttttttccaaaaaggtgggggacaaactacagaattacccaaaaatgtttactggtgtacgaagaaaacgaaattgactgttgattgcctttccacagccttcagtactaatggcacactcacattgtttgatttttagggtaattacaaaaaatcatcaattatttgcctattttccttttttcttgatacgacacaatcggcccctacggcgacggcattttattatcttttagtgtaatttactgtcggattgtccactgtccgattgtccgggagccatatgaaaggtcaatgtattggggtaaaggtaaaaatattcagctaaatagtcgaaactttaaccaccttgagtcaggactttttccaacactgtacacgcgatacaattttgggctccaagtacaattaagttggtttcttcgtcttagtggtctgtgagttaatcaaaaaatggggggtcacaggttcgaatccagtgcatgttgtagctgtattttgacgtttttaaagcaaantaa

SEQ ID NO: 5944 - DNA, 2012 bp, Heterodera glycines
  misc_feature (1937)..(1939): n is a, c, g, or t
  misc_feature (1941)..(1941): n is a, c, g, or t
  misc_feature (1949)..(1949): n is a, c, g, or t
aaaatttaatttttaatgcgatttgttaacagaatttgtcaaaaaatgacccaatctttggttactttttcaatttctaggctgtttaaaatgaaagaaaaaaatttttaaaagaaattttatttaaaataatgactggtaaagtaaatatgaaaaatattttatcccagtggggaattgaacccaagcgagaaataatgaaaatcagaaggtttaaccacttgactacttatgtatatgaacaaatgctttaaattagagtagagcgggaccgtgaattttgggcaaaaccgggaccgggtcttgccgggacctgagaagccgggaccgggacctcgatttttgtgcgggaccgggaacagggaccaaccgggaatttttaaaaaatcggctaaaattgatttgtaaacggaaaaacgttgcacgtcgcacgatgtcagaagagcaaaataaatttgatggttgaattataagaaaaattttcatttctaacacttctaacttttttaaacgatcgaatcctgaaaaatttggtatcatccgaaagctcttgacgagctaagtctaaaaagaagtgaataaattttcttctgtgttttaatctcaatgtttatcaatattcaacacttttggtatggaaatggcccaaataccttagtagggaaacggcggtaggtaaacagctagtagggaaacggtcggtagggaaacggcggtagggaaatggcggtagggaactgacccaaccgacaccaacacataacactctgaggattgagcgtgatcgactccattttcaacgaaaccccgcctgttcgtccgcccggcactgaccaaagaacaactcaataaggaatacgaagagagaatccagctccattcagttctcacaaacgaccaaactcccgttgttgcaaaaggaccaaaccagaaggaggccagtaaagacatttccaaaccgccggaagtttttgaccaaacaatcctcgtatattattaagcattgaattcattgccaccacaaaattgttcactaaattcaatcactcgaaaaacaataccctcgtcttttcaataaatagttctaccagacctcgaacaatttcttaaaacaatacatttattctactacaaatttttcttacaaattttcctcaaaccaaatttttctcttcaactctcaaaacaatttccttttcgctggaggtctgactttctgtttctccaaatacaattgattctttaactacaataagaaatgggcaaaatgttaaacctcgggtgggaatcgaacccactcatgcaccctttccgtgggcagctctaccattaagctaccgaggcacatccgccctttcttttatggatcttatcaacccccgctttccgcgttttaaccgcccagccagcttcttccttacagctccatcctcatcgggaccggtccctcggtccattagttaattgctgctggcgcggtggggcaaccatccggtgctaccaataagaaatgggcaaaatgttaaacctcgggtgggaatcgaacccactcatgcaccctttccgtgggcagctctaccattaagctaccgaggcacatccgccctttcttttatggatcttatttgggtcaggggtacggaatgttgtattcgtgatcagcgacctcgaaaacctcttgcaattgctgaccaacaaaatgacaaagcctcgaaaagcctggacctcaactgccaaatcatcgcagaggacactcgccgacccactacagttggcgcaaaaagaaccagaatcgtacacgaacaccgtcatcaaaattattttttgaacttttattcggtttagaaggatggtgcaatccaaaatggtctcgcactgctgaagtaaaggcgcaaagaagacgcggtcatcaaaggagttgaagaaatctaagtgannnantgtgaaancgatggaccggttgatactcagttggaaaaaaatgttattttttgtaccacataataataaat

SEQ ID NO: 5945 - DNA, 7001 bp, Heterodera glycines
aaattatagtccgatgaggaacagggaatcacacagttcatgggcaaatgaaagtaaagcttttaactagagtagagcggggacaaatgagtacctaggtcccggtattgcccaaaattcccggttcgctctactctacttttaactgagaatttatccaaaaaaagaaaattctaaaatttatttttgcagtgcgccttttcaaaaaaacattggaaaattttctctcacaaccctgtgtttgtcccactgactaagcttttcactgatttaatgacctttatccaaaaaatgtgcaaatggtttctttaacaatagtcaacaaaaaacatttaacgtcagagtctttcaaatcattgactgaagagtttcaatcttagccctaagaacgtcactctcagccctaaggcttacattctcatcacgaaggccggcattctcagcccgaacggcgacgttttggttctgactgtcggtcctatcaatcgccaactgattaaaggtagcaaaggtttcatagagtgcgaacagaacttaatgaagattcaaattattagtataattaatagacagtgtttacgactaacactgcgaagccttgttaatttgggtggcatttacgttttctagcaggttgagaattcttccaaactgaatctcgaaatgtcctgcatttggagcttgactgtcttcgtggtgaggaaatccatagttgtatgccacctgaatatatattacacgattggttatatttagggtttccatattataaaaacaaatatgcgtaccgccgtacttttggtgctggtcaccgtcgaaatgttgcgcatgtgcacagagaaggagttgaagcaggtggaggagcactgcgcaaacacagcacagcaacagaagcagaagaggggcgaaaagtgccaccaaatgatggccaacgcattggcacagtgcggcacgcggaattgtgtggcggagttggcacggaagatcaaaaacggagtaaggagggtttaaagtaagggcaaagccggctgagaagcagagatggcacaatttagcataagcgaggggggggagaggctaataccccctttttggagaaaatgccgccaattcagcctccaagaatgccaaatttctgttccttggccatccatttcgcgcactttcagcaagtggtccaatccatcgccgtccagtcactgctcgcgctcaaccaattgccgtccccgtcggataccatccttgacgaggtgcagcagttgtgccaatcgcaaacagtggcgggcagtcaagcgctgaagcagagctgctggttggcattcggagcgctggtcaacgaagtgtgccagcacacgacggcacaaaatgcgaaggaatgtgccggggagggcggcgccggcgccacggcaaaatgcgcacagtcgggattcgtggacaaggacaagtgcccggcggacaagaagcagaagtacaaagaggtgaagcgggtggatgtcatcccaaaagtttaaaaataattaatgactaattggggtcatttccaacaaatcgacgcttcggttgcccacgttcagacgcttttcgctatgtacaagcagcagcagaacgagcagcagcagacgcagtgcatctacgacaaggcggtggcgctgggcgcgctcggcaacgccggcctggacattgcgcttgcggacctggagcggatcatcaaggacacgcgcgaggcacgcgtggtccgcatgatggccattgacgcaacgcggcgcatgcgcacgcaaatgccgcacagcgtgcgcgccatgttgctgccggtgttcctgaacacgggcgagcagccgcaggtgcgcatcaccgcttttgccaacattttgggcgcacaaccaacggccgaagtggtggaccagctggtgtacgcgattggcaaggagccgaaccgggaagtgcaggcgtactgctacagaacgatgaagaccatggccaactcgcagaagccggacgagacgcaaatgtgagcaaattcaaaatttggcaccgaaaaattggccgaatttagtgccaaacacgtcaaatcgtcactgaaacagttggcaaatgccgtggacgagcagcagttgcgtaccagcggaaagtggcagttcgagcagttgtacaacaatgcgcaacgcgagggcgtgttcatgtcttttgtgaacgcggtttcgtcccgctccgcgctgcccgcctacgcgcacgtgcagttggactcgcacttcaacgaccattatacgtacaacaagctcaacatttacatggtgcagcaggaagccgagcaatggtacgagcgggcaatgaacagcttcggcaacagcaagcggaagcagaagcagcagcagcacggcagcaagcagttgagctccatttacgagcagttgggcatcaaaagccatcggtccgactttggcacagtgccaacggcggcggacaacgacaacgaggcgtaccagcaacaccagcagcagcagcagcagaacaacatgcgtccgttcgccatgcttggcctccgctccaataacgtggacaaggcgttcattgcgctggacgagcacacgattggggagcagacgcgacggatgctcaacggggaggagatgaagccgaactgggccgccattctgtttggccacggggcacagcagcagcatctggacatggcaattgtgcagaacatgggcgagaaggaggccaaaattgcgacgtcggctggcgtgccgttgcgcattctgagcacaacgccaatgatggcaaacgttgagggacgcgtgggggcaaaggcggcgccaaaaatgggaccatctgctgctggtcatgggctgagtgcccagttcgagttcagcgccatgtcggcacggatggcacaaattcagaaaatggtttgccataaaaaataacgcccattttttaccgggacccactcgtcatgttggcattttctcaggaactgatcactccgtttgctgccagcggcgtcgaaagtattcgctcgctgcacatcaatttgccgctgcaaggcgagctgagtttggtcaactctgagcagcagcagggcatcagcatcaaagttaagttgccccagcgcgggactcagttggccagcgcccactcgctgccgttcactttcatcgccaaggcggagcccagcgctcagtttgtgcgcgagccgcgccaaatcatcgccgtccacgaccccaagctggaccagcaacagcgcgaagtgaattccgtgctgggccaaaaggcgttggcactgccgctgcagattcgcggtaaattggcgggttcgatcagagatagagagtggcatatgatcagaggaagtgataaataatgacagaaaagtgaaattgatcagaggggaccatggatgcactgatcactcaaaatatgatcatcggtccgaaaacagggcgactgatcagtaataggaaaaatgggtgggaaatcatgtgactgatcacgaattctgatcagagattaagcctgagatagacagattggcagaccaaaacctcaaaatttggaagttttcgccgtgccccacccattagccgctccctgaaacttttcctgtattaaagtcaggatcggacaattagttacagattgttggtcattagcgcaattgattccgcttaattggctagctgctgtaagtttccgttgttcaggccactaccatgtgccagccgagccgtccaacctgctgcagtttgcgcagctgctgatggccaccgagaacgcagtgcacgtacagtaccaacccaatgaggagagcccgcgcgagttgaccatccgcgcaagcggcgaacacttccgcaaagcggcacagatgcaactgccggacacgccgcagctgcacaatttctacgcacaacagttccacagcagcagcagctgcgacagtgacgactccgtcaatgcagcgaactgtgaggagaacgacgcgacggagcagcaacagggtgaaaacggcggcgagcagtacattagtaacgacaaccagcagcagcagctgaacagcttcatcagcgcgtacaagccgcgtcagcaatacgcacacgcgctgcgactgagcgcgcaaacgagcggtggggcacgggacgcgacggcgcacgccaacatccaagcgcaatgtgacgagcggatgcgctactgcacggtgcaggcggatgccaacaagaaccaacagtggacactgagcgcacaagcacaagtggtgatgccggacactgtgccgtcggtggaacagttgcagcagcccaccatgttgaagcagttcatcgcgctggccaaagcgcagtggggcgaccagcaggacaaacagcacatgaacgtgcgcattcgcggcacgcaagcgcacacggagcagacacgcgcggtgatggcgcaaatccagcagcagcacgagggcaagcgacacgggttcagcgctcaacagcaacgcaaaatgctgcagcgcagcgccttcctgaaccaattccatgtggaggctacgtacgcactaaaggcgtacgcacagaacatgatgaaccgcggaatagaactgctaaagtcggtctacttctggaacaccaaatcgcaactgttgggcggaccgaacgcaccgaaaaacggaaaggtaagcggaaacggacattttgatcatcacccaacaatgatcagaatcactgatgacttactgatcaaaaggatttgatcagaaaacggggcattaaaattgccgaaacccgctgctgatcagttgagcatcaaaaaatggggggaatagccatgatcagacattggtcaatcagtagttatcaaaacagaccgatagcgaagggtctctctaattgatcagcggaactacctcccctccaaaatttgatcactgattagagaatgcgatggcattgatctcgccccccttttgtgccacagatcgccgccacaatttccattgatccgctgcagccaagcaatgccaacgtgaccatccgtacgcctgcgcagcagttgcacatgcagcaaatccaaatgccggccgcggtggggcgccccttcccactgatccgtcaacagagcgcgcagcagacgcattcgctggcacagctgttctacaagcagttcagcctcaaaagccgtgcccaatgcattgttgacggacgaaatgtggacacttttggtaagggggggggggacggcacattagacaaagtcgggaatcaatttgggaaattctcgacggactattcattatccctaatcatttgtctgatgttttaagacggctttgccttcaccgccccgctctcctccaattgcttttctgtgctggccaaacactgcagcagcccaatggaagaacagcatcagcagcagccccaatttgttgtgatgctgaagaaagtgccgggcaaacagaacgccaacaaatcggcacaaaaagcggacaaagtgaataattgaaattgaaggagcgagaagaatttaaaaatgatgacaattttcaaaaaaaggtgctgaaagtgatcactgctgagcaacagatcgaatgtcagcccaaaacagcgcagggcaaaaagggacaaatgatttgcaaagtgaacggacagccgatcagcggggacgagcagtgtcaggacgagctgcagcaccagcagtgcgtgcagttcaacgacccacgccagacggacgtgaccattcgcacggggccaatcgcagtgcgattcaacggacgcaaggcgtggctgaaggtgtcccaggcgtacaagaacgcccagtgcggactgtgcggacactacgacgacgcggacgagcaggagcaggagttgaggatggcaaatggccaaattggtgggtttggagggcttaatttggccaaattggtggatgaggtggaccagtggaccaagcagaaggcggcataatggccatttaattgggtggccataaatgagcctaattggccataatgactgaattgtccgacgatgtgacaccaaacaggacatgtgtctcgtgtttggaatttcaaattgcattcaatatcacaattactgaaaactcatcattataatcatgacactttgggagatttcagcttccaatttggtggaattccatcgctcgtacgccttgaaagacgcggaacagtgcacgcagcaggcgctgaacagcttctacaacgaagagcagcaacagcagcagaacgttgcttacggtgatgaacaacagacggacaatttctacggccaatacaatcagtggaaaataaccaatgaaaatggtgaggagacgaggagatggagcagtacagcgacagggaggagaacaacaacgacagttctggagaagcggaagaggaggaggaggggcaaaaagaacaatttgatggccaaattgaggacattagcgacgaaaattgggccggggaagaagaagacattgagatgagcggagaagagcagccggagaaatgttgctgttgctgtgccaaggagaaggacgaggcacgtaagcaaaagtgtcgaagaaagtgccaacagagcgacgaatgccgaagaaaatgccaacagaaacagtgccaacagcagcagcagaggaagatggggaagaagcagaaacagggacaatcttcggcattggagggacaatgggaaggtgagagagaaagaaatagagagagagagcggatagggagcatggaatggggagagagtgacagagagagaaaggtggagagaaattaagatgagaaaaggggcagaagggagagagaactctgattaatcgatttgctggagggagattgattgaacgttatcaatgggatcaaccgataatggtgtggtatcaatcaattaagcacaattaggtggaggaagtgataaaggtccaattgagaaatgtgaccactgatcagatatacttttgtccgattggaattgcttttgatgcattttgggttaccccccccccccccc

SEQ ID NO: 5946 - DNA, 1288 bp, Heterodera glycines
cccccctccccttcaagcggttatgccgacaatgaacaccaaggtgtacgagcagaaccacgcgctgtgctttccaccgagccggtcaagcaatgcccgcgcggcaccacaacgaacggcggcgaagaagccgatcagcagcttagcggggaaaagccgaagcgtgtccactttgtgtgcatggaccgcgcggagtcggaggcgcgccgtctgatgcgccaactgcggcgcggacaacgctcggtcaaagtcagcagcgcccagggcgagtccttctcggaaatgatggacgagccgcagcagtgctggcggcgccggaactgaacgcggacgaatgggacgcggagagtgcgcggagaagagtagaaattgatcattagtcagtcaacatacctaacactctccgataacttcccccccccccgtctaatcagtgatcagtgtgatcaatgaccgtaataaaagtgccaattttattttgtttaaatgcaccgataaaataattgtagtaaaaaagaggcgtttctggtgaagaataaacaacattgagaatacaaatttgaatgtaggcataaaacaacgagaaaaaatgggaaatgataaaattagaaacaaaaaatgccgcaaactttaaaaaaactttaaaatatgtgaattatgaatttaattgattccccccccccgctctcctcgacgcaaaaaaatgagttttgaaaaaaaattccgaagcattgggtaatattgaccagtgatcagaaaatacaaaagctgccgaagattaatgaccataacaaatgatagaaaatcacaacagaaatccaatccataaaattgctttttgaattattttaaacaaaatgaacaaattgagagataggaagaaaaaagccaaagtttaaaacaataaaatgatatgattacatcgtttgttgttaataagaaatagaaagcgttttaccaattccgtcatattttgttgccctttattaccgtaattatctccattttgtggcattccgtcaactttttttcttgcgcatttgacaccaaacgatggtgtaaaattgtgcagagggacaacgaaaagacaatgcacacgataatggccgaccaaattggcacggggccgtgccattcataaattgcactgaaaatgccaatttgtacataaatgcatgaattgtgccatcgcatttgttaattacccaagtacaattgggaaaaccacggttaacccgtcactgcatacaacgaacagtccctgcattgtgccctgagggaagaatta

SEQ ID NO: 5947 - DNA, 1005 bp, Heterodera glycines
gctccctttgttcgtccgtacgcgaatacgttttgtatgcgtctgggatgattaagtctgtgagtgtgttcggaactggtggcggtgcatcaatttcacgtcgtacacgcctgattatctaaatatacaaatatttgaggaaacataaaaaactatcacttgttttgtcgcctgtttggttgggagttgcgcaaggactggcgtggccacattctgcagtgccaaagagcgaattgtcgctggtggttccatggtttgttccgccctgcgtttgattccagtgatcactcgaaagtgcttccattcgagctgcacttggttcacactggtggttcccaacttcacgtaaaatgcggttgtcgaggtcagtgtgaaggcgtcctttacaactgatgtcttttgcgtgatgatgttcacacgcccaaaagcgagcttcaccgtcagcactcggcttgtgaaaagtgtatgaatagccattgtgctgaagcttggtacggttcctttttgttagaattgcttccattttattatctgtaacattaaacataaaatcaactgacttctaattcatgataagcatccaaccattgaaaatctctcttctattgtcgaaattcttaccaaagatttttcgaaaattttttggtaaggaaatgaaccaaataccttggtaaggaaacggtggtaaggaaacggttggtaaggaaacggtggtaaggaaacggttggtaaagaaacggttggtaaggaaacgattgggaaggacggtaggggtcaactccgtctggccaactccgtctcagcaatgttcaaaaagctataacttttttctttgttggccaaacttcacaatcatggtatcattcgaaagccctaaatgtttagaagatatttataagctatttctcagtgattaatcagctctcaaaaaagttgtcagttgaaaaccgcaaaaattttctgtaatttttagtaggctaatagagactgtgaagagctttcgaa

SEQ ID NO: 5948 - DNA, 2013 bp, Heterodera glycines
atgaaccaaataccttggtaaggaaacggtggtaaggaaacggtggtaaggaaacggtggtaaggaaatgagtcgatccccccaaattcaccacaccctcagttgtcgccacgcaataaaatttttttttacctaccaatttcccattgtttatgaatggcttcaaaattctatagcttagatttttatttgcttaaaattaatccattcgtcgggtattattttttaacttacatacctacctaacaaataagttagaaaattatgctaaatgaaagaaagttgaaaagaaacgtatgttttacatacgctgtcatttctcatttgtataattttctcgcgttccgctgaatagacccatagtgaatctctcacaagtcactgtttatagtttattccgtcaattgtataattcttttttctttccgtcgttattggagcggatttctcgtttccattcacagtagtgaaaattaattgatctgttctctcgtaatgagtcattttcaaaataatacattgaatacaattgttttcattttactttgaaccaactttaattgaacttcacgtccaattaattgaccaactctcggtttttagaccttttttttcttgattgaaaaatttatttggacccgtaaagcgctggaaacatccaacaatgcaccgcttttttgcttgaagcgctcaaaagtgacgacgagtcccaagggcatttgcagactcgtctgctggaaatgaatctgatgtcaaatcctcaagtggccgatgctattctgggcaaccgaatgtttaatcactacgacagagcctcgattggtcaattatgtgaaaaagctggtcttccgcaaagggcgttggaacatttcaccgatttgtatgacatcaagcggaccgttgtgcacacacaacatttcaattcagaggttattaacctattcgttatttttaaacgacaattttttcagtggcttgtcagttattttggccgtttgaatgtgcaagattcgttggaatgtctcaaagccatgttacaagcaaatctgcgtcagaacctccagattgtcgttcaaattgcgtccaaatactgtgaacagcttggcacgcaatcactcattgacatttttgagtcgttcaaaagctacgagggacttttctattttcttggttccattgtcaacttcagtcaagactcggaagttcatttcaaatacattcaggttccttgagtcgtccattttaatttccatgtaaattttcttaaggctgccaccagaacaggacaaatcaaggaagtcgagcgcatttgtcgcgaatcgaattgttatgatccggagcgtgtcaaaaactatttgaaggaggcgaaattggctgaccaagtgcttttttaatctcttctatttgtaaatgtcaaattttgtttagttaccactcatcatcgtttgcgaccgccatgacatggtccaagatttggtgctctatctctaccgcagcaatctcatgaagtcaattgaagtttttgtcagcaaagtgaatcccaaacgactgccaattgttgtgggtgcattgctcaacgttgactgcagcgaagaccaaatcaagcagttgattcaaatcacacgtggcaaatttgacatcgatgaactcgttgaggaagtcgagaagcggaaccggtcgggcttttggattacatcctaccggtttaccttttatttttagtctgaaacttctgaactcgtggttggagagtcgtgtccatgaagggaatcaggaccaggcaacccataacgcactggcgaagatctacattgattccaacaacaatccggaacgctttttgcgtgaaaatcaattctacgactcgcgcgttattggcaaatattgcgagaagcgcgacccgcattacgctcttttggcatacgagcgcggtcggtgcgattctgaactcattgcggtaaagaaacaattacaatttggttgattggtttcctttttaaaggttgcaacgag

SEQ ID NO: 5949 - DNA, 2443 bp, Heterodera glycines
ttcaaaatgtttaaaacgtatttgcggccgaaatagagtggtaataataaaattgtggcttttaaacaattattttagtgctcctaactttactatttgttattttgttagctgttggtggtaaaacggagataattaatgttgatttattagggtcgtacgacccaaatgcaactattggaggagctacggactgtaatagttaattttttttgttcgcaacaataaacaattttggccttcggcttggtagggtgagcaagaagaaattggggattttgtttattgcacagaaaaataatttacaattaatttggtgaagggaactttttgtattgggggaaaaactgttgctgaacggggggaattcgacgagaaatgagaagaatgaattaatgcccgaggaaggtatgatttttgggtgggatttctcgggagttccttaattgctaattagtgtaagggtgggcgccttttttgtttggttaatggaaaggcggtaagcggaaactgcccataactttcgtctaagtaaccaaattaaacattcttgatatcattcgatagccctaagggttctctctattacttcacctaattttcaaaaatttgatcatgtttggacaaagtttggccaacagtactcaggaaaccaggttatcagaatatattgatcataattttttgaaacttagccaaatttttgaaattttgcaggccagaagaaaacacttagagctatcaaatgatatcaagaaaataaaaatttaaacaataaattttttcattagacataaaataatttttttcttcaaaaaataatttgttagaaccacaaaaattttttgaaattgaagtaagctaatagagaatccttaggatttcgagtgatatcaggaatgtttaattttattgcgtcatttttaagaaattgcttaaaatgaccatttttcttgtattttttttcttgatttcggggcggggggggggggggggaggggttagcccccacctccgccgccttggctacgcccttggtacccttttcaagcaaaatcctgggaccatccctgcaccctcccttccgttcctcactcggtacaacccgaaacatttagggaattctatacctttgctaaagaagaggtcgacattgaatctacaactgcaagcgaccaaaatcaaaatcatcctaatccaatattttttataatatttattagtaccatcattttattatgctggttatgctgctggtacattcaatacaaaaaagggggccaaatttggggccagataatgtgcctaacactactcatcgggttccatcaatttcaaaatgtttaaaacgtatttgcggccgaaattgagtggtaattaataaaattgtggctttttaaacaattattttagtgctcctaactttactatttgttattttgttagctgttggtggtaaaacggagataattaatgttgatttattagggtcgtacgacccaaatgcaactattggaggagctacggactggtaatagttaattttttttgttcgcaacaataaacaattttggccttcggcttggtagggtgagcaagaagaaattggggattttgtttattgcacagaaaaataatttacaattaatttggtgaagggaactttttgtattgggtgaaaaactgttgctgaacgggggaaattcgacgagaaatgagaagaatgaattattgcccgaggaaggtatgatttttgggtgggatttctcgggagttccttaattgctaattagtgtaagggtgggcgccttttttgtttggttaatggaaaggcggtaagcggaaactgcccataactttcgtctaagtaaccaaattaaacattcttgatatcattcgatagccctaagggttctctctattacttcacctaattttcaaaaatttgatcatgtttggacaaagtttggccaacagtactcaggaaaccaggttatcagaatatattgatcataattttttgaaacttagccaaatttttgaaattttgcaggccagaagaaaacacttagagctatcaaatgatatcaagaaaataaaaatttaaacaataaattttttcattagacataaaataatttttttcttcaaaaaataatttgttagaaccacaaaaattttttgaaatttaagtaagctaatagagaatccttaggatttcgaatgatatcaagaatgtttaattttattacgtaatttttaagaaattgcttaaaatgaccatttttcttgtatttttttttcttgatttcggggcggggggggggggaggggttagccccacctccgccgccttggctacgcccttggtacccttttcaagcaaaatcctgggaccatccctacaccctcccttccgttcctcactcggtacaacccgaaa

SEQ ID NO: 5950 - DNA, 6156 bp, Heterodera glycines
gaaatttttttaaaaaatggaaaattttttattaagggattaacagtttgggggcaattttcgatgggaaatacctttcaaatacgaaattgggggcagcatggaacgttggatggaatggggagagataatcaatcgagttgggcgtccagtaaaataccgaagaaatatcacgggtaggttccggaaaaaggaggagttcatcagggagcataaagtttcaaatatggttttgtcatggtggcccactagcgcagcaaaggataaaactgtacgagtacaaggagcaggtctacagggaggaagggtctaagctgctgtattgcgatacaggtgggcaggaataaaaagaaaataaaaaccaaaaatttagattctctagcttttgctcatcggaaggggcggtgtccgttgaaggaggggaaatttttggggtagaacattatttttgaaaattttctataaacatttgtttagtgagatgactcgagagtatgctgacagcgaaattttggagtttgtgtccgcgggcccgaaacagtacgccttgaaacatagaagaaagaaggatggtgtgatttggcataaaaccaaaatcagagggatgacattggatagacgaaacgaatttaaatatgaattgttcaaagagatggtgctggactacaaagaaggggtaaagaaagtttttcactacccggagaagatcgggccaacaaacgacttccgggttctctcaaaaaatgtgcaaaaagaatatacgccggtgcagaaaaaaggaattattgacgatcattttaatgttttaccctttggatattattgataatttttttggataattttgtctcatgtttataacatttaatattttaaattaatcaaatttgtttcattttttagaatgtcaaagaaaaatttccaagaaacttcaaaagaaatccgccgctcgaaaaatacaaaaaattatttcaaaaacagtcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagctgagccgggctggaaaattgagaaaatttcagtggacctttattgcagtgccctgtcagacccagtgatcatccctgcccgccccttccaacaatcgaacccagacattgttttcaacgagttcatgcacaggcagcaatcatttggggaagtgaatttgttagaccagagaatttcaataattatgccacttattctttccctgttaaataaaattttttcatttttccctttcattattttttgttcattccattattatttattcgagttttttttctttattaatttttcagttaaaatgtactcgtttcaaaaatattttgaggaggctctcgaaaaagaagattttttctggcagaaaaacagagcagaagtggaggcattgttaattgaggcttcaaattataaaattataatacacagggactacgaaagccgctattctgattatattgccacctatcgccgcaccccactcttctgtttctgcatgattgagagaaatttaagatttttttacgacacaggaaccgggacgcccataggaagggttacaaccgtgctacatgttaccgttgaggcgagctatacaggagagggcttcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgtatagataggttggaacatagaaaaaacaatttaaaaaaatattttagagatttggtcggatcgtggtcattgttctatagactcccaccctcactttttgacacttcacgccgggtggttgcggagaataaactggaagaatttttaaaattaccatcattttttcgcatgcttttttataataaatattaaatgttcatgttgtttttaaagtgaaggttttgacccaaatatttaatcaattttaatttattatttttggtagaattccagaaaatgcaaacaatcgctgaaattaaaaatttcgagattattgaaggcggaagagtttttattgtgagagcgagaattgagaacgtagtacatgcggagtacagggtttgtattaaaaatgaaaaaaatatatcagttttttaaggcttgcgttttatgccgtaagggggcgtgttcatgtggcgttgagaaggcactgacaccttatttgaaggtgtctgtggcagatgatactgggattttggaaaatgtggcaattttttggtgtatgtgggaagaaaaacggaatggtaatgttttaaagaaaaaataccattctaatttaaattcaggaggagttgagaggattgtctggggccgtgtgcactatgaaaatcggcgcgagggtgaaagaattcggagggaagaaggggatctattactctttgattgatattgtcagcctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggcgtatttagagacataattaggttagataccgaagcaaaagaattttctttttctgcacataataccatggttgaagcccaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatgtgtcaagaattagcagaagaggccaaacaatcaatcgaaatagccaaaaattatcggcaagaaattgggcatatttatcggaccgcttactcgcagcccgatttaagcattggagatttggcaaataaactaaaagaaacaatgcgcgaaaaccaaatacggtttgaaaggcaaagacctcttgaagaatttagggatgaatttattgcttataaaatttaagaaaaaaataaaaattcgagaaaaggaaactgcatgagaatcaaaggttgtgggacataaaccaaaaacaggtgaaaagggaaacaggtgaaaatagatgaaaaggaaacaggtaaaaacaggtgaaaataggtgaaatttcacctaaaaatatataggggcgtgtatttaatggggcatattagagaatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatccagacactatattgattgaaatcgaagaggaaataaaatatcataatttttctgcgggggcaaaatgttttttgggtgacaacaagaaatagttgatgatgctaagaaaaatccgagactccaaactgaatttagagatgaatttattgtttgtaaattataaaagaaaacaaaaaaattaaaataaaaaaagatgaattttgaaaaatcagaaaaactaattccatattattggaagctgcaaaaaaagagacagaaagagcatggcgggatgtagctacgctaacggatgaagtaagcgattttgccaaatcttctcgcgaaacacttaatcgtgcaataaaatctagagaaaaggctccttacgctaatggtattcgagaattatatcttagaatgtccgattcaatttgggaaatcttcacaatcctggacaaaatcaatttggagtcagaaaaagccgaatctacgtggcgtgatttcgagagatgcaaaacatttgaccaggcaacaaagctcgaggaacaatcgcaaaattcattaatggaagcccggagattacatttcgagtcccgaagggtgcagagccaaatgttaaattatgaaaataggctccaaacaattgtttgggaacatatgggtatataagaataaaaaaacgaaaagggaaacactcaaaatggaagaatgtacaattatcgagtctttatgtcatgttaatccaaaatttggctttaaaaaatataaaaataaattttattttaaaaatcctttcctaattaatacggaggaaaattttaaaaatatactcgcatcaataatcgaagaaatttataaaaaggaacaaggaaaattcagaagtattttgaagctttcttttggttttgagtcgttttattgccctcttagatgccctagcgaaaacacagctgaggctttgttccaacatatcttattaaaagaagaaaaatattcgcttttctatactttggatgatgtcataacgctagaagtaaccataatcccagatgtcaacaatagaccaaaaaattaattttataaaaaacaaaattacaggaaattggaaaattgccggaaagattgttaaacgttcacatttgttagcaatttttgcaaataaactttttaaacgggtgaaaattttctacatagcggcatttagcgcgccagacattgaaaatttatatttttcattcttagaaatgctcgataaaattcaaaaattaccaaattttattatgtatgaatatagaaaacagtctttagctatgcaaaaattagaaattggcatcaaagaacgaaatatatttaaatgtcaagaagcagagaatttattggacctttcttattcaaagataaatgaattccgagaacaagtgcaaaattattaatttgacatgaaaatgttatacaataaaatacgattgacagctattaaacatttatttaaacccgaaaagaaattttttagtccgtttcaaatagaaaaaaatagagaaattttttattcattatttcggcatatctaataaaatcgcaactttctttgcaaaaaaaatgaaatattttcgtaacataatataatcgaatgatttttagtgtaatatttgagccttacttgtgcaaaagaccaaaaagtttttgcaagtttgaaggccattcactaatttcgtttgttgaatctgaactaaattagggttacgtcatgtattacaaaccaaaaatttgagtatttaagaagaaaaatacacataactcatctgccgtttttcaacttttcaacgggtatgggttccccatggggggggacttggattaatatcccccgctaacttatatttaatattattttagatgtacgcccaacaaaacgacatgcaaatttcggcgcaaggagatgatgtgttgccactgacagcagcagattttgcggctatggatgaagcgcataggcaatgggagactgaacggcggcaacgagaagaacaacggcaaagagagcaaaaaagcgcccgaaatggaagtggtctgatgaatggatggtgcgccaaagagagtgggaaaaagaaaaagaagaagaagaaaaagaccccaaaaatggaaaatggaaaaggaccagcaatttgaaaaatggaggcggcgaaacgatgaactttggacgaaatcggcaggtgcgggtggcagcagcagcagcaacaacaaaaaatcggacgctgcccaatacgtttgggattaaatttttttgacttgtttgtgtttattgagttttggcgatttctgatttttttggctattttttttggatttttatgatttttttgcgatttctgattttttttggttattttaggaatttttacgaattttctatttttggcattttttttatcaatttatcgtgaattttttgtgataagcaaagtatgtatattctccctactttaatgatactgtggtggaattactaagt

SEQ ID NO: 5951 - DNA, 2893 bp, Heterodera glycines
aggtgccatacactattatcattagatatttggccataattggatattgaacaaacaaaaaaccgcgcaaatagttttccaaaaaaaaagtttttgtccaattatccatggcatttttggatagctaatatttaatatgagcactatttatccaatatgcgtgcttaatcttaattaaactgatttgtttacgtgggagaaacatgaattaaaaaaatgagcttaaaaattttgttaaattaataaataataattatttattgcgtgtctaattgctcaattatataaattaattagaagtcacaagaagagtgcattaaggaaccataaaatatttataatttattgttatcttttcaaatggtggaaaaaatgctaattgttctgtataggtcgcttcataaattatgacaccatgcaatttctaaaaacattaagagaatgttagtagtgtaagaccacgattccctgtacggttcagtaccggacatttcagtcccagattttctgacacgtttcagtaccagagtcctggcactgaaacggcctttctggtactcaaacggccatttgtccccatggttgacctattgtccctttgtcgaccatttgtccgttttggatcatttatcccaggttgaccttttgtcccttttcgaccatttgtccttaaatttaatctgctaactccgcgcggaactgaacccaggttgtgccgaaaaaagcccaacacactatccattatgccactgatatgtatttgtgctgagcattttatttctgattaaataattcatttcaaaatccaatcacatggtgtcgggatcgaactttttaccccctctccgaaagaaccaaacacactaaccattaggccacagatagaccaaattacttcgtgataaatgatgtataaacatcattataaaattcgttcgccatttcttagaagagctatttcaatgatcaatgatcatatttaaattttaaataggtattctaaattggctcaattttttcaatgatcaaacaccaaaagttttaattttaaaattgtgcagacatttggcttttcaatgatcaaacaccaaaaataaatatggatttgctctccgctcacatttcgtaaaatcaaatgcgacacattttccacccgccccaaatctgttcgcccgcccgcctaatttaagtgatcaaagatcaaattctctaaataaggattttccccccctcccttcacagtttgaaaaatcaaatgcgaacattttccacccgccccaaatctgttcgcccgcccgcctaatttaagtgatcaaagatcaaattctctaaataaggattttccccccccccctcccttcacagtttgaaaaatcaaatgcgaacattttccgcccgcccaaatgttcgtccgcccaccaaatttaagcgatcaaagagcaaatttcgcacatttcatttccatttctaaataaggaaagggcaaacgaacgtgctcacccaaatttcggcgtatttaaacgcatgggcacgcaagaaaaaatattcattgtctctttaaaaaatattttttatttaaataaatactccttaatttaataatttatatttaaataatttttaaatttatttgtatctttgatcatcaatattgtgcattatttttaatctcatatttattaaattaaaaatttattaattattcagtatttatcatttatttttattgttcattttattattaaaattaatttaataatttattatcatttaaatttttaattgttgataggatatttttgtgttcattttttattattaaatttaatttataaattttagtatttattatttgattttttattattcattttataatattaaaattaattttataaatatatttatttggcattttatttttattgttctttttattattaataaatttaatttatgtatattatttttatttttattcttccttttattattataaaaatttaccattttattttcaatgttcattatttaattagatatttaattaaatttataatttaattatttagcatttcctattttccaatttatttgtacctatttagacaaaacggcggcagatattccgccaattcatcagcaattgaaaatctgaggtgaaggacaatccaccagtaaatccatcagtatggacaatccatcagtaaaatttttctgtacaaaaaattaaaaaaataattagattttacattttatggaatgatattttccgaactgcttattcaaaatttttaagttaagccctaaatattttttgaaaatatgggtaaattaatgcaagttaattaaaaaatcgccataaaatgtgccaatttgtggatgcagcaccatactgtttaaatttagcaattgaaagccttcatcattataattatttttaaatataaattacactgatggagtgtcaaccggtggattgacgactattactgacagattgtccttcacaacggattatccattgaatgactggggagccatagggccagtctcgataaaaacaacattcctgtttgattaataaatagctcattcctttacaatattttacatttgaatgattttacattctaataataaattttgaaattattaaattaaataatttatattaaatgtctttttaattagccttgcttcggctttctcgtgccctttggtaacttaaagtctatgatgaaattagtggtataaatattttatgtaattttcttcatcaacatgtttgtttggttttatcactacctgatacggattgaaccaatttgcaagcaaaatagctgttgcgtgaaggaattaaactggaatgaattttgtaattttgaaaatt

SEQ ID NO: 5952 - DNA, 4634 bp, Heterodera glycines
  misc_feature (83)..(84): n is a, c, g, or t
aatcccaaataggcaattacaaattagtacgagattggcaaaaaagacatatttcattttcaaattggttggttgggttggcnncgtttttcctccatttccattcgctttctgctgtttattacatgcacacctcagcaaaccaacaacaacggcagttttcggtctcctctgaaagtgcaacagaatttttcggaatttcccagcgttaagagaaacaagagaaattcaaagtccaaatttttgaatttttactgattgaaagagctataaaaattcttagcaaccgccgtttttcaatttgatgtcaccaattgtcatttgcacaattttgagccataaatttgatttttcacggggtctgattattgaatttaccgcgatgatatttgtacggttttagggggatccgtgtcaggttttagctttatttttagggcttttgcttgcttaaacaaggaataccaaatgcaggccctaaaacatggttttcagtctcaattacctattaaatgacatttgttggacgcgtaaaatggcacgggacggttgaaatgtcgtggtgattgaacgcctagctagaaacccaaaaaacaacagtatcacataaattttattgtccgaatacattcatacaacatatttatgtacacataatgattggttgttgcattggagcacatacaaatacaatacaatatataggacatacatacatatatcattacaacaattacaatggtttgatcactgatatggacagcgcatatagcttatcacggacaacagatcagagggtgataaagcacctacaaatgatataatttggggggaggggaacagcgtcatattgtggggatcagcagcagttagaaggggagaagcgtttgttgctcgaagtccatcgttcgttcgttcatccacgggggccatcctcgagtcgatcattgttcaccgctggggctcacgctttctgcttcttgtccttcttggagccgccgcccgccgatgccttggcccctttggcgttgtaaatcatgccacagtactgaaaaggaaatgggaaacaaattagacacaaaacgaacacgaacggaggcaaaagcgggccaactaaaccaaattcatctctgaaaggcttctaaactcaattttcggtttctaaaatttgattccgtctgacatgaattaaaaaacacgctgaaggtaagccaaattcattttccgtgcttttatgagtctcgtattcatcctttttgaaagctcaatcccgagctgattaaaacaacaaattttgaaatggatacaaatttgattgggactcaaaaaatgcagcaacaaaacaaattcccccaccctcaaacccaccgctccaccgccgaacgcaaccgcagccacgaacatgtacaagaggaagcccattgtgttgttggagagcagcagcagcagaagtgatcggattcgacgtgtgcacgggcgatggatgtgctgtgttgaagcgttgcgcaattgtcgtcgttgctgattgtttgttgttgttgttgttgtcgctgtgaagggaatgagtgaccaaccgacattttcgctccttttatacacattttttcagtcgaagttttgcctttaaaatttttagttctttgcgccaatgtctatttaaaggacgcttttctcacccgattgctccattttaatttggtcttacatacttttttggcatttatttgaatgcaaaaccatcctttctgttgagctcttctaatctttgttcggcgtttcgaagtacgtttttcgccaaaatgtgactaggtgtggatttttagttacgaaaatcccaaataggcaattaacaaattagttacgaagattggcaaaaaaagacatttcaattttcaaattggttggttgggttggccccgtttttcctccatttccattcgctttctgctgtttattacatgcacacctcatcgattcaaatgctattttctgttgaaaagtcccaaatttgcactgattttcctcgtggtttcgagaaagagtacgccattcttggccaaataaagatggtattaattaattctaaaataaaaaatcttccattttcattcattttttgaatgctctcaacgccgattccgaaaaaaaaacttttgacagaaatggacaattgctgaaattggctgccaacttaaccccccattgattaatatgaatattgctttttagttaatttagtcatcaactttatttttaaaaataaacgaaaagtgcgtcgcctgaaagttttatgaattttttcgaatagctgtaacggctaaacaaacataaatttgtttagacaatttaattctgatgaaatattcgtgtttaatgaaattacatatttatccatgcttcaagaaattcaatgcatttagctacttaaattttaaaaatatgcatttaattttgtttccaattacttctttttcctttcatttcacttttatgtgcaacaattaaccttagcagctgacacctgcaattaaattatgtcttaattacccaaattagcaacaaaaaaaacttgccgttgctttgctccttgtagtaagcttggatcagttttcctgaggttgtccagtaggaagaggaaccgacctaaataaaattacaaaaatttggaatgtttccatttcgagaaatgcaattggtcgaatacagtctcggccattggtggccatcatttcctttccgttttttggcttcacatttcatttttcctcacattgctcgccgatgcgctggtggtcaatgccgaacacgactcgcccttgttacagacggaccagttacagtaggagattttgtagccgtccaaaaaagaccaccattcgttcatggagctggtcgcaattgtgccgtctcagaaaaatgggcagacctggcaattagtgcaaatattgttttttaaaatattatgaccccaagaaccactttttgtgtaggccgtcttgagttttgccccgaggccagaaactgtgtgagtgccggcgtaaaagtggaaagtgtacctttggggaagtttgtgtcaaacagattagctaaaatgatatcccaaaatatatgacatcatataaattcacattaaatttgagtagccagtaattggatttgcagcggcaacgtccacgtcctttcaaatgttcgttttaacaattaaatttaatggaaattattagggtcgctacttttagtgatttaactaattttttttgctcaattgtttcgaagaaagaagctcaaaaatacatttctgcgttgaaaattttcgattcggatctcactatcgcatattcgtaatcagcgacctcgaaaaccccccataaacatgtttccaagacttttcagaacaaaaaaaaatgtttcttcaaaaaggggggggggggggggtaccatctatagtattacccatacaagtgtcacaattaccatcaaaactacaatttattgttcacattttacatacaatatgaaacggagttacattggaccatacataaatacatgtgtacacatatataacacatcaatacaattagaacaatatgatcgctggtatggaaagcgcaaaatttgcttacagagtgataaaacacaaatgatgggggtaacaacatatattttggggatagcatcggtttgggaggggaactgttgtcggccattccatcgttcgtccgtcctcatctgcggcggcatcattggctcttctcactgctggagctcttcgatcccttgtgtttcgccattttttttacctggcgccatagtgattccgttgtagtacgacgcattctcctccggtggccaacggacttcagcgatgcgaatgctcagtgccgaggctcctccagcaggcgctgctgatttcgattttctgaattggcatggattgttgtttttacggatcagaaataaaatttgtggccattttgcattttctaagggatttaaataatttgtggcacataaccgaacaactttaatttaattaattatccaaaaaatttcaaatttgttagagtttgaatgcgagcagattttggaaatgtttttccttattaacaatttccaaaaattgacaccttcggagaattactcacaatgatatttttgggacaaagagaaaaggaagaaaaaaaatttgttgattaaaaatacaaaatttccaaaaacactgagcctaacaatttttaacaattttcattttagtcgaacaaagaaatagagagaaattaatgatgggatgaaaatggaggaagagaagagggagcaaacagtgcactttccctctcacttctcctctttctttgccgacgaaatactattttcttccttttcattccttctgcttgtgaattggacaaatggttcgcctctctctcatccccctccctctcttctgtctctctctctttcattttttcgcctttatcgctgcatttctgccgctgctgtcaaaataagtcaatctttgcttatgatttcgtatttgaacgaaaatcgattataaaatgtctaaatgaagattcatagttaagaatattttagttatgaatttctgacataattggaaaactttaataaat

SEQ ID NO: 5953 - DNA, 6198 bp, Heterodera glycines
atcaaatgcattcaaaatcaatgtttttaaatgctttttaatttgggttttattttatgcttttaatttttaattttgccggcttataaagaccattccgcccgctttccaaaatttgatttttaaaaatttccacattatttctcaatgaattttgacaggaattaaattggctttgctgaacaaatacaatttcatggaaataataataaaatacgggtggccatctcttttaacaaaaaaccattctcaccttgtgatcaaatttcaaattcgaaattgaataaatgtttaaacaaataaaattcatggccttccaaattgtcaaaagctgctgaatatttattcgataaaaatgatattattagtagaggtgcgccgtgactgaaaaaacccgtgaaccgtgaccgtgaattgagaccgtgaccgtaatccaaaaacccgtgaaattcacggttttcgtgaattttttgagtttaatttttccctgtcggcgaattttttgtttttcactgtctttttttgtggtataattttccaaaaaaaattttttgggaaacgggggtccatagcagggctgcacgaaattgcggattgcggattacggaaattgcggggtttttggaacccgtaattgcggattgcggatttccgtaattgtaaatccacttgcgtgcagccctggtccataggcgccgatagaggccgccgcaaaaattttaattcaatttgtgcacagattttgtcaaaaatggcaaaattttgcgaatctgaaccaattttttatgaaaaatacgcttttggaagcctggcggtgccgataggcgccgccaggagaaaatataaaatttgagttcaatttgtgcacaaatatgtccggtaaaatgagcgaattttgcaacattaatcaatttacaaagacaaaaaacaacgaattttctcatcattttgcgtccaaatcgattccgacctttttaaatgattttataagacatattacccaattttaaaaaaatagggattttagtggaaaatttttgaaaatttgttgggatttgttaactgattttgcccaaaatagctttatttcgtgcgagttttttttaatttaatgagtttttatttaaagggtcatccttgaaactttgctttttatttgtttttcgcacaatataggtagtttggaggggagggggccggcggtgccgataggcgcgccggggaaatttttgaaaattttgctctgtttcttagcaaactttgcccaaaaaagacaaaattcctctatgaaaacaatatttatttcataaatattcaattttatccagtgtaaatttttcacggaataaccgtgaattggtaccgtgaatcgtgaccgtgaccgtgagtgaaaaaactcatgaaattcacggtaaccgtgaccgtggttcagggcgcacctctaattattagggcttctttgttatgtaagaaaaatcgacaaatatgtaaaataataactcaaactaggtttagattcatcttttgcactttaaaaattcatttttgaatatctctttttttgaaaaataccgatttttaagggtacatttccagaaatttttttttaattttttacaagaaatttttataaattctcaaaaatcctcaaaatatgtacgaaaaatttcgaaattttgggttttaaggtgcgtttaataaaaatttcgcgaaaaatcctcaaaaattgcaaattaattatactaacattaagctgaagtgtaatatgttaaaatgaattgagaagcattttcttgtctccaactctctttcgccctgaattaagaaaattaacacaggaattgtaaaaacactttttaaaccaatcagagttcattattattattttttttaattcactgtgatttccgtcttcagtgagtttcttttgtgtacaattcgatgtccggctcaattcgccctaaaaagtttgtttttaaatttaatttttaaaagtcaaatattcctacccaaatttgtatgaatttccatccatttttgcaataccatcggtttgagaagaatctcttaattgcaaaaatatttattgaattagattatatgtattattatgtaccagttgtgtttggccgtcggttttcatcaatttccataacattttcaatgagttcgcgcattcccgacgtaactgtggacgaaattgggccgtgttgaccctggcaattagcaaattaaactgtaatttaaaaataaaaacatattatactcttgcaatcctgagcaaaagaagttggatggagtcgccgtcaaaggctttgtgcaacttaaaggatgaattaattcatttatttttataatgcttgtcatttacctccactaactcgtaaagcacacaaccaacggcccacacatccgattttggcccataagcgcggcctattccatgaaatgataataccattaattaggtgatcagaatttttgcaaattcaccaattacataattgtgcgtgtaattaatgctttttgttttctaaattgaccttcgcatatttccggcgacacataattcattgtgcccacaaatgtcgacgcttgagcacatttcgaattcaattcctaacaaaaacataagccagtgaagttctcaattacttattattatttttttttcttttattttattttaccttactgatgccaaaatcgccaacctgaatcattaggggacaaattaccctttttggcaatctaaaagttaaacatgccttgacaattgtcatttttctgttcaaaaatatgttcgctgttttgatatcgcggtgaagaattttcagcgcgtgcatatggtccaatgccaaaacgatcttaaaataaaagtccaattagtgttggctttaattaaagtaggtcatttatggtataaataggctatcacaaaaatcaattaattaattaattacctgggtaaaataataaagcaccaaatcttggcccattttaatgccttttctctcctggatcatcctcaataagcattttattttaatatacataaataatttttattatttaattattgtttatcacggtgttacgacaattgcggaccgtacaaccgcctttatcacctttccattgtgccaccatccaaatattccattaaaatgcacaactgttccaattcaacaaatgaatcgtagaaacggatgacattcggatgggacaatttcttcaacaaactggcttcatcttaataactcataaataataattatttatttataatttgttacggtaggttataattttatttcaaaaattgataatttattttagcttatttcaattgaataaaagcgtcctacatgaaattgcccgcttgtcattttcgctttggcattcaagtgacactcgtttgatcaccactttcttgtttagccgacttgtttcatccttttttcgaagggaattaaaaatacaaaaatcgccaatattttaattttaatataaattgaaaataatttttaaaaatattcgctttaccttataaagtgcacaaatgccgaatgctccgcgccccaaatcctttaattttttgaaatttttcagcctcttctgtgggctgttgtcctctgctgaggggggcaattccgtcgttttcgccgtctcacggcatttgttaaaattgctaatgtcaaaatccatcaaaaagcagaatctcaaaaacaatattttcaacacttttattagcccacaattatgtattagtaaatttgtttattttgttttgtttcgtaattatttcttcgggcgaatttgggttggttggtccgtcagcagtgcattattagttaatgcgacgattatcattgttttatgtattagggaagggataataatacataatgacaattatctgacgggaagacatttcaatggtggaaatctttttgtcgatcgatcagtccccccccccccccccccgacaaaacctaaccccaatcggcggaggttatcaacgccaaagagtgactgactgactgatgatcacatcaccaaactcaatcaacttagaagaagtcactctgattattatgatgatttcatttaattgtttttatctccactataattaatttttcgaattttctcttttttcaaaaccttttgttgcttcatttaaaactcatactaaaaaaacattatttacacgtttaaaaaaaccagtacaaaagcggcaccaaagaaatgatgaagcaaaaaatataattattaattaattatataattaattgagtactcccttcccaaattgccgaaatgtcccctttcttctttttcttcttcttttgcccgttttgtcacttttgccatctttgctctgccggtctttgacatatttgaaacgcaaatagaagccacttatttgttatcccgttgctgttcgcactcgacgtgttttaaccgtgatgagacacttacacttgcgccgcggatatttgcgccgcccagcaaaaatggacttttgcgccgcgctgtcaaaaatattatattcataaaaattccactattatcaatcgacaaaaataactaattgaaaattcgaaaaaattactagtcacaaagattgacattcaattttttaaccattaaatcttaacattgaataggttcatcaaagatatgaaaaaatgattaagaatacaaactaacaaaaaccgaaaaaaaggaattttctgtagaaaccccaattatttttttgcttcgaaaaaagaatgaaattcaattcctttgtaattaatttgctcaataagttattttcatcgattttaatttaatttcattgaaaaaacgcactgattttcaaattttcgcttctattttaccatttttcgcaatttttatgcccttatttatttacctattttgattttttttcgcttaaaatccgccgcttaatgataaggcaatacgaaggcttgttatcgcatatggtcccaatgaaaaccaaaatgatcaagatttgatcaatcattacgtgcacttcaatatggaattgacatgaaaggcttcgaaaaaggaattaataatgaatatctatcaattcttattctataaagcacataaatttattttaatcagagcgcaaatgtcttttttcgctgtacggcgcaaatgtcgttttttttaggcggcgcaagtgtcgcgcgcaaatggcacggcgcaaatgtccgcggcgcaagagtcttttttgctgagcggcgcaagagtcgcgcgcaaatggcgcggcgcaaaagtcggctaaccgttttaacgtgatggaaaaaacgaaatggcgaccgaatatgaacaaattaataattgttatgacgcattacgcaaactatagaaatgcaagtgataattaattaaattaatcaatttgaagtgagattcttacacttgcattttatgaaaatttttttcgaaaaacattattttgaataaacaaataaacttaaaaaacgaaatttaaaaaaatccggacaagaatagatttttatttaagatttctaaaactcttttttgtgatcttttatgagacttttggcattttaagcatctcatcaaatttaatttaatattaaatgcttaattagaatttggactcagcaaaatcccgcgcgggaaccctccaacgaattatgggaaaattgaagattgatcagtggtgatcactttactcttatttccttactattcttctatttgggttggtttcatttttttttactttttgctattttgatctcaacttttctcatccaaaccgaattggtgacagagccaatgctgtatgagtttgaagtgagactcttttgatcaaatgtttatccttgctttttggcgatgatttttatttaaatttttgatcgcgtctttttttatcattaatcttagttccaatagtttttttcatttttaggttctattcctatcctattttgcagtttaggtcctaaaatgccaaccctacttaaatgccctgctggggaagggttacatgataataaatacacacagaaaggggctaacattttaagccaatctctcacttaattaagcttaggttcacaaattattcaaatgtgactgcttaatggatactgagacgcgtggaacgtcaacaactcattttgtacaccaaagataata

SEQ ID NO: 5954 - DNA, 2511 bp, Heterodera glycines
  misc_feature (904)..(904): n is a, c, g, or t
  misc_feature (1104)..(1104): n is a, c, g, or t
  misc_feature (2484)..(2484): n is a, c, g, or t
aggcatcattaaacattatcatttttaacaagcatatgcttaatcacttgtttgtttttaagtgctgctcgttgcccaccgttttccggtttgaagctggtgaagtgtcaatgccgaaactgacagaataagcatttttttgggggaaataaacaaaataattttaatatgtattccttcgattttcctttatttgacgctctctttcaggggtgcgcacgggtgagaagttttttttgctacttttctattaatatttacaaaaaaaaaattcttaaggaattttatctccgtatggtgataatcgttccccggtttgactgaactttttgagaaaaagtttaattgccgaatttttttggattttcagtatccgccttttgttgggcttgattctccaagttctgccaactcagaaccttgctcacccccctgttctttattttaattctgaaattaagcagaaattaatatttttttttattttacttaatttaaaaaattttcctgcccttaattatgttaatgtattgcaattaaagcgtcaaatgaataaatcttaagcattacggtttcatttaattacttttgtcaattttaaaaacatctgtaagatggaacaaaatgttgcataaagcgaagtaaatgttgtttcccaatcaagttttccttcttccatgtaatttatgaattcaattatataattatttccaattctttaattatactctgataattgaggtctaattaaaatataaaaatagatttggaagtcaaaatggcgaatttgtcatctgaattgtgggatgaaatttaggtttttccgttttaataaattctagggttacacgggtacgaaacccgggtcccgggtattgccaggtatagaaaagccggtacaaanccgggtccgggcatccggtaaaaccgggtattaataaaatccaaaaaataattactaatggaggtaattttttctttaaaataaaagctcatacttacaaaggagaggtacccaagtgacggtggaacttccgaatgaaactttgaaggtagaagatagattactccccttttgtcttaatttttttttttttttgctanatgaagcttctggccgagatatgaagcttttcctttttgccatatcaatatcatttaaaaagaatgaaaagccaatatgtctgtcactgtttttaggtttatttttcaatttttctatcttcctaaatttttctcaaaaatgctaacaataaacattggagagggaacagatgagaggaggaccaacgaaaagaattttttaattaggaacagaatccaagagattaaccactaagccaaaggagcaattgatgaagcggcttttaaaattaatattaattaaatttaataaaaaattctttcctccaactttgctcaacgatttgaccaagacccccattcttaccagtgtactcttttggacccggacctaccgggtcgggtaccgggtattggattttcaaaaatctgggtccgtgcccgggtagtaaaaaaccgggtatccgggtctgggacccggttgggtacccggaccgtgcaaccctaataatacgcattaactgcgaacagttcattggaaattttatcatagcaaattatttggcaaaaaattgcagtagggatgcttgagcaacaatatccagatcaatcttggaatccgggtggtccaggaatgaaaactgaatttattcttttcagtttctatggcgaaaaattgacctttttgattgaaaatctgtaaagagtgagtttaatttattttaatttttttgtctgcggcgcagattgaaagaattcaattatattgaaattgttcaagaataattggttaattattaaattatttactataattaaactaaaatgataattttttttcattccgttggccgcaattgtcctgaccgcaaatgtcttaacaattttttatgttattttcaaaattcgacaaattaaaaaaacgcccagaatcgttttccggttcgacaaaaatttaaattctcggatgtatttaaactccaaaattggttaaaaaaattcgtataaagtgttaaatttggcttttgttcactttagagcagaaattttttataaaaaatttcaaaaattaaatttttgaaaaatttttcagctttttgtaaattctttgctttttaaaaccaatttaaaaaatccaggtcaagcctggattcaggccttgaggagcctgggtttttctggacctggattttcggtccaggtctaacatggaacccagtccaggtccatgcttttttcaaaataccaatctctactaataattctttatctgctctttggtttattatacaactttttgttataatttctttcattccataacgcgtccaattggcgaaaataatattaatttaaaaataaaaaactaaatacattttaaattaggaaggtcaatttganttaaattttactatgcttttacttaga

SEQ ID NO: 5955 - DNA, 3591 bp, Heterodera glycines
taactgaattaatttctcaccgtttgttgtccaatggccgttaaatgagttggcttcacagaaggattggctatgacttttcactggaaatgataatttatgatgaattagctatttgtagagagagagaaatccaattcaaatggaatgttttgctgaatcataatgggaaatgaaaagaaaacggacaaaaaagcactgatcacttctctgttaaatcagtaaagcagcagataacttcagcacaacattaataattttgggctgctttttccaaaaaataaatatacaaaaataaatttatttatttatttatttttttgtttgttaggtaatttcaatgccaattcgtttcctctccatgctctgccctcttctcgtgctgctcaccaatgttccttcaacgctgccatggatgttggaacgggatggtgtccttttagcttacgacccaaacaattacaatgcggaaacatgggctgactggggcaagaaagttggcgcgagtgcggtcgcaggaggagtcgctggatccgctgttcctggcattggaacggtggccggcgccatccttggctttttcggaggagccgccgttgctgctggcgaattcgcaattaataaagtgtattgtcaggtaaaagaacgtacctttcgacctttcgcatgttaatttgttttatgctgaagtaatgaaatgaattcagtttttaaagttcaaaaatgtgaccaaactttaggaatttggcatttttaattttgtggcaattttttttttaatttcgactttttgttttttcgttgctttgaaaaatgtcaaaatggctttaacctcttttgtaaaatttaaaaagtatatacaaaaactttaaattatttaaaacaaattatgaatgttgtcaacttataatttaaaatgatttttcatagaaaaattctcgttggtcttcggtaacacttaattttagtgaacgtttaagggccatttccgtccttaacgaaaatttttaaaaattttcaatgcattttttagagatttaaatttttaacaaataacaaaaaatttccaaacttacaaaaacaagaaaatgcttgaaaatattccgctgagaatacaaacttattaataaattaactttttttattttgatgattaattttggattaaatttaaattttattctgtatgtaaggtagatccaagctcaatatcttttattatttataaattaaatttcttatttgtaactgatttgttttattggtttgtaaagactgcgtgtggctcgcagtacgttgtttgcacccaatcgaaaggggcaagcatggcatgctgcgacagcaactttgcacgcaaatgtgttaatgattttaatgaggttaatgaataagatttgtatacatttacaagaaaagctaaaaagctatttaaaatttggttaatttgcatgcgaatatttgaatcacttttatttttgacattttttaatattgataatggtaatttatatcctttattaataaaatttaaacataggtcgaggcaatgtttcccaccacaacgacgacaacaacgactccaacgccggctccaattcacccaacggtcgtagactaaagaaataacatatcattttaatagggtttagatttaggttatattttataacaataccttgctatgttttgtgcatgttttaacatgaaattttgaaaatcttgcgttaatcatgggacggttcagtttcaaattaagcctctgctgatgattagcatttttgccaaaaaaaacacgccgggaaggggggggggactcactcgataagaacgcatatgttatgacaaatcaacagataaatcacaaaatatattctaaattgaaaatgccgtgatgcaagggcaaatccgaatttatttattatttaaaaaatgaatctaatcattattatataaattgaagcaagtataaaaaatattaattaatttataatttattaaataaattataacttttaagcaaaaattaaaatatatttaaaatattctcttcacctgaaaattttaaaatctaatttttggcaaaatttaaaatatcctaaaaatttccaagaaaattttgcagcgacattcaaaaaaccatacacaaaaaatttatttaattttcagcaatttaaaaatctaactgattgtcatacatatatgagttagatttcctctaagaaacctttaaacatatttatttttagcatatggcaaattggcaagagacagcggtcaaggaagcagcaaatttcaccgtaaccctcaaaattaaaaataattttatttaccttaattccttcattttttaaagttaatatttttagaagttttcctcattaaagtgtaaacgaggacgcaaaacgacaaaagattataatattgggggaaatggttgcccctatgagtcattatactgctatttcatgttctgttatgacggtaatgaaaattattaatttaggaaagtgaatgatttaatattactcctcttcgaaatttagtgcgatttgagaagggacattttgctgaatggggctgccacccagcagatgaacgtgtagatcattccaaaaattatcctcaaggcgattgggcatgcgaacagtcctatcgactacacccggattatgataagcagaccctcggctacgacatgtccaacgaacaagatacttttgaggaagcatatgaagatttgcgcaagaagtacagcaagaaaactgggtgataatagtcttataggagatgtgatacttgaggaattatcctcattttctgggttttgtgtcagttttttttgaaattaggatttacgtagaaattttactaatttgtggttttgaccaaaatggcttttttgtcagaccctgaaattaactcataattttttctctggaaattctaagacgaaaacaccaattttttgtttgactcttaaattgggtttggatataaatatgtttaaaaagaaagattgtaccgagagatgatgttttactgatggttttataaaatttgaatcacatctctgtttaaacctattaatgggatatccaaatatgccgacaagcaccctcttaatctattagattgtttgtcatgatgtatttaaccatcctattagttaatatgtaattttttaaatttattattattaatattaatattaattattatttattttattttattctaatattctgtgttaccggtaataattatggacgatatctatagacgcttcaaaaatctagaaaactcacattttcagctagacacgttaataagacaaaaaattagattgagcttgtttaataaatcttattaagtcgtccatagttaattacgatgggtcctgcccatgatgaatttatacatccattttatttttaaaattaatatttattttcatacaatttttctcacattgtactttttatatttcgggataaaatatcttaatcattgagtaacacataatattatataaatattaataagaaaataataaaataaaatttgtttcggcgccggggcagttcagaaaaa

SEQ ID NO: 5956 - DNA, 6373 bp, Heterodera glycines
  misc_feature (9)..(9): n is a, c, g, or t
  misc_feature (32)..(32): n is a, c, g, or t
  misc_feature (147)..(147): n is a, c, g, or t
  misc_feature (161)..(161): n is a, c, g, or t
tctctcttnactatctctcactgctcgctttnttctctctctctctcttcctctccctcttcttcttcttctcttcttcttcttctctctctcttcgctctgtctcctctctctctatatctttctctctctccctctctctttctntctttctccctctntctctctctctctccatgctctctctctctctctcacttcgctctgcggctctttcttcctctctctccctctttctctctctctctctttctccctctccctctctctttctccctctttctctctccatttgctctctctctctctttctctctatccatctttctctctttatttctttctccctctttctctctctctctttactctctctctcactgctcgctttttttctctctctctctctctctcgatctcttcctctccctcttttcttcttcttcttctctctctttctctatcctttggctctctctctctctctcgatctcttcctctccctcttttcttcttcttcttctctctctttctctatcctttggctctctctctgctctctctctgcgctctctctctctccacttttctctctccctctctctttcttgctttctccctctttctctctctctctctctttgctctctctctcactgctcgattttctttctctttctctcactatttctctctccccttagctctctctctctctctcttctctctatatttcattttctctctctcccttagcccgctttctttctctctctctatcccgtcgctctctctttctctctctctctatttctttctctcccttctctctttctctgctctctcttccaccctctcactttttctctctctctctcttcgctctacctctcactgcttctctcttctctttctttctttctttttttttctttatcttttccttctctctttttctctctcttctctcctctcacctctctcttagctctttctcttctctatctctctctttgctttctcattctctctcccttctctctttttctctctccctgctctctctctgtctctctcccatcctctcatctctctctctttctctctctctctctgtcatctctcagtcttcccactctttttctatcgttaccatttccccattctcaatcgctatttatcttccgctttctctttaattgtcctcttgctttttctcttttatcttctctttatccctatctcttcttctctttctctctcagtcctctctctctccccttcctttagaatctcttcattctgtacactctctcgcttcctttttcatctctctctattgttttcctcttcttctctacctccttattcccaagcactcctacacactcatcacacacataaacaaactcgcacgcattcaatcctgcgtgacaaccgcacgcgttacccactctacccctcccatccgcgccgacagagaaacatacactgcactctctcttctacccatcctttctctattaatctccaattatattttttaattttctgtttctttttcctattacaacaaaacagcatttaaccgccaattcaaaaataggggcggggcttcggctgacttagtatatagttaagggatgaaattttttagcctataactttgtcaatactagatcaaataaaaccattttatgctcattttgaagggaaaattctagagaatattgttagttttatttgatttggccttaaatagcgcacttggctaaaaaagaattaaagtattgaaatgtttgccatgggaaaaaattttttcctgtgggtaactttttttgaaattttgtataggcccatattttgtcccccactaaataaataataataaacctatttgcactgagagcccaaaattgggccgctgtgtttataaatagggaacggatttctaagtttttgcttattttttctgcggctttaactcgacgagaaatgcacgaaaaacacattttttgttcgaaaattttgtgttttaacgcacttattcgaacttagaaatgcttattttggcgtttcgtgcttaaaaatgcttattttagaggttcgcccttaaaataagtttttgtacttattttagcgttttatgcttattttcgttcttatttcgcgatttttgggaaatttattaacaaaaatgcaataaaaatgataaatacacccctaagaatcggccaaaaaaatttcggaaatatacacccctgagaattgacctaaaaattttcaaaaaatacactcctaagaatcgacccaaaaaatttcggaaaaatacgcccctgagaatcgacccttaaatcctgaaaatttctaaatgtacttcatttctaactgcaatcagtaaataaaattgtttgacttaattttaactaatttgcatagagaaaacagcaattttaacaaatttcacctctacatttggaattttttcatgcttattttcgcacttatttcgcgcttttttcgcccttatttaagcacttattttggactttttcgcgcttaaaaatccgttccctatttataaatcacaccgatcactgcctttttgtattacctatttaggtatttgatcagccatagccatggctctctttcataaactgtatgtacaagttttatattattcgaagattttaaatgagatagtaatcttttttttaggcaaaagctctgcaatttgaaatagaataaaaattgagttttacaaaattataaataataataaaaagtatttcttttcctctccttttggcgtactattttcatgtctctaacacattaaaaatcatgaaattcgcaaatgctaacaattttctctaaaacggtataaaatcactttcttcttttagaatcaatagagaaaataatggttttagcatttggttgaaatcagcagtttaggacttgagttataacgtaatgaaaatttgaaactcccacaacttttttctgatatgtcaaattgctggtactagttaagtttgggtcccccttttgggtcaaatttttcaaaagcgtagacagacagtcagacagtgcgctatttccttctttatttttctcacttcttcccttttcccacacacagtgctgctgcacagcgagctacttatcttagatatcaaatttgttcggtttggttgggaatgaagcgagttgtctgattaaaataataaacaatacaaaaaagacatttaccagtgtaaattttgaattaacgcgcaaaaatttacgccaaatacgctatttggcgttatgagtaattttgtctaacactgggcttgacccatagtgcatttattgtcttttcgtgtttaatactccaaacaagaaattcacaaattcttcgctagacaaatttttagtgtgactttatattagagtagagcgggaccgggaccaaaacacggacaactgagtacaactgagtaccgaggtcccggtcttgaccgggaccgggaccagtcccgggttttttcccggttttcccagccaaaaattcccggtttttcaacccgaaaaggtcccggtcccggttaagcccaaaattcccggtctcgctctactctactttatattaaaaaataacttttttactggttgtgttaactacatataaagttgtagttgatgtaatttttttcttgtctttttagagaaaatttgatatggactctttccttcaaacaaataatgatctcattatttcaattcacaaggccttagttgaatctactcaggaaatcaccaggaaaatagtaagatgctgatgtatatgggatacacaaatttggctaaatatcatctagaatttatggcacttttccagttgatggcccctaaatttgaagtcgtgaaaacttattcaagaggttttcgtgatcactaaattttgccaaacctccaaggaacaaaccaaaagtgcaaattttcgaatttatagttttacaacaaatgttcacgaccttttatgacaaaaaaatttttagcaaaccaaaaggggtccctccccctttggttttttcagggaccatcaactggaaaaagccgaatttgttaataaaaataaaaatctaggagaatttgcgggatgatgttcgtgacgtgaagttgtcgctggctaagaacgatcgtatcatgcaggaagaggctacaaattggcgtcgtcatacggaggctattgttaaggagttgggggaccgacatcagagtgacatttctggactccacaaattgctattggaactgtgcattcgctcttcacaattaccacaagctcaactcgctgttgtagaaacgaaacagtcgaaagaggacgaagttattttttttgtttaaaaattttaaaaccctaattttaaggatcacacgaagaaggatgttgaagttgtgcagattgctaagaaggatgttgaagttgcgcagattgctaagaccgttgagcctgctgagtttaaaccgactgttgagcctgatgcagaagttctgaagactcttaagaccgttgagcctgttgggtttaagccgactactgagcctgtcggatcacaatttttgcatcattattttgtaattttttctacagactcctgctgttaccaccgctgtttctgttgctccgttgagtggcactttaaccttcaccgcttcgtccatccctattagcggcagtctttttggtggtgcttgtcgacccggaacaaacacgttatcgaacttggcggccaaggtcactgctaagaccactgaacctgttggatttaaaccgacttttgagcctctggtaatccaattttttttcctttaaaaaaacttactttagcttcctgctgttactactactgctgtttcggttgctctatttaatggtgcttcaaccttcaccactccgtctgtccccattggcagcagtctttttggtggtgcttctcgtccgggaacaaacacttttgcgaacttggcagcgaaagtcaaattttgttttttttttactagttttgcttattttttgttatgtaggcagctgagtcgggtggtggttttttgggcggtggaggcgtcactgcaaaaccgatccaatttggtcaatctgcatttggaaccaatgcaaaggatttcaaggtttgctaattgaaaacaacaactgaatctgtacgatattgtgataatacgacttttttatagcttttccaacaaccgccttctcagccttcattcagttcaaatattcataccgttgataaaactaccgatgaatcgtacagaggtgatgaggggtcggacaaagaagacgctgcagaggaattcgttccagacgtggtaatgttaattttggctttcgtcacttgctgattgtgctcaccaatgcttgctgttttggagtcccctaaaaattatgtgaattattaatagccataggggtcacccttttggtttgtaaaattaaattggtcttattgttaaattagtgatcaacaaccccaaaaaactaacgaacattttttataccttattatgataaaaaaaaaacaatagaatccccatttggttcagtgataccccagcaagcattgggtattaccatcagaaagagtcactgattgtctaatccacttttccagcattatgagcctgttgttcctcttccgcccgaagttgaagtttctactggggaagaggaggaagaggtctgtcgcatttttattaagcattttattaaaactgtgaaaaaaaattctaaaggtcattttctctgctcgttgcaaattgtaccgttttgataaggatgctcgggaaaacaaggagcgtggtttgggtgatatcaaagtaatttatccaaatttaactcctttttaattccttttttcagttgctttacaatcctcggagcagtcggtatcgttgtgtgatgcgtcgtgagcaagttttcaaactgtgcgcgaacttcccaatttatccggacctgaaaattcatccgcgtgagcatatgccaaccgtttacacctgggcttgcagggtgagaaatataaatgttcagtctatttctgtttaaaagccacttagtgattttatgcatgctttttgtatttccatctttaggacttcagcgatgaaccgtcccaaggagatgacgtgacgttcagtgcgcgcttcaaggataaggtttgacattgggtgaaaaaggctttaaatggtttttgggttttaggcaatcgccagggaattttatgagaagatgacggaagcggtgaacatatgaaaggttgagtgaactttggttgtttacagactggtggaggtggactctttagag

SEQ ID NO: 5957 - DNA, 201 bp, Heterodera glycines
ggacatctacatttttgaattgaaaaaaaattggtaattactctttctttttctccatattgaccatcatactcatactcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 5958 - DNA, 3174 bp, Heterodera glycines
aaaaagaaaaagaaaaggagaaaatgcatttaccgtatttgctcttcttatcccacatatccattaatcccccaatctccaattatcccccagtctacgaagcgtttgaaaaataatccctctatcttaatcccccagtctcgaattatcccccagtctcttaggaggttgaaaaataatccccccccggggggataaaaagagcaaatactgtatttgtctttatttttagtgaaaaacctgctgaacttgcaataacattttcattaattctcggctgattattctgcattttgatgtgtataaaaaaccataaaaatattcaggcaaaattcagtccattctatttaaaattttttatataatttggtaaatttcttttaaatttttttattacagtgcaaaaagaaaaaataaatttttatttaaaaaaataaataaagatttccaattttataagaagacttgattggaatttaatttcgaaaatttaataaaaattcattgaatgtgtaaataatcgtcccaatattcacgcaacatgccaccctctcaagccaatgaatcgttttattgtgcaatttgccacagtacatacagtaatgggcggaccaagacggtgtcatatggaaaattggaatttaaaataataaaataagtaattgctgtaaaatttaattgcattaaataatcgataaatatttaatttcttttaatttaattttttttcgagaaaaaccctgaacttggcgatacatctgcttttgatctgtatagggctgaaaaaacgaaatattgataatgaaatgaccaatgaaaactcaaaaatcctcaatttttttaattagaattttgtaaaataaatatttcttcaaataatagattaaaaaggttattggatctaataagaaataaaaattattttgtgacacttaagttttattgaccattttatagatatttttaaaatattccgtaaaaaactatattatacctatattgtaaaaagttggcttagagaactaaaaaataaataaaattgctaagaaaatgtttgtttataatccatttaaaaatactttttctaaccattaaaattattatatatagaataaataaattaataaatcattacatataacaaagaaatgcaattatatatgccaaagtgtcttcataggatttacgcgaaaaattgaatttgacaataataagagctatttggcaatatgccaacggacattccgccatcaacaaattaatatgctgagcaaaatgccaacaaaatccactaaattcaaaaaaaacttatagtgaaaaccttaaaaatttctcaccattccaatgtaaattgtgtcaaaaatggttcaattgaaaacaataaataataaattaaaaaatggaataataaaatacttcattggaaagtataaaaattaaagattttaaaatatattatttatacattcaattaattaaaaagaaaattccaaatttttttatatattttaaaatttttaaactttgagtgaatacattttcactgtttcccacaaatagttgaaacattgggaccaaattcgaatcatttgaaaatataaattcactagagaccggcgggatcgggactcccgcgggattttacgggagtcccgctcccgactcccgcttttttcggtgaacgggatttttaacgggagcgggatttttacgggattcccgttcgggactcccgtcccggtaaattttgaactcccaatcccgctcccgctcccggaaattttacccaaaaaataggagtaaaaatgcactggtaagaattgagttttttggtaaaattaataatttttgattgaaaatctgttaaatatatagccaaaatctcaaaaaaaattttcccggcggcgcctatcggcaccgccggaatcttaaaatccttaattttcttaaaaatgcctcaaattttcaaaaattggctatttttggacataatctgacactgtattgtattcaaatatcaatttttttcccggcggcgcctatcggcaccgccggactccctcttcctccctggtcaccaaaaagttttttcaaaaaataagccgcaaaaaattgttaaaattaataaagggagtcaacaaataaattattaaaaaattttatttgaagcaatttgaaaaaatactgattttcgacccataaatatgattttttaatttcaaattctgcttactaaatttttctatctattttttctttaataaaaggattttccttcaaatttgtgcattaaaaatatttttgttagtttttaattaaattttcgaattactcccgctcccgcccgggactctcgtaaaatttctgcgggattttaacgggagcgggattttcacgggattcccgatcccgctcccgctcccggaaaattttgaactcccgatcccgctcccggaaatttttttttaccggactctaattggtacacatctcgttttttgggatggtgtgtacagtaaataatggagaattgagaattatggtagtcgacaaatgagctagcttttttcaaaagtaagtacctacttagaaaatacgccaaaaaaaaattcctttaaaaacatttacccaaaaatttttttcttcctcttccctccctccctcccctcttccgcaattgccttttttgaacactcagagactgacgacacagacggacggacgtacagcgccgtacccattaataaattgtcctgcttttattctcctacgccttcgtctgttctcttacatcccaatccatcattcctttccgttccttttcttttttgtttctctacttattcttatttttcctccttttcatgtgattttacgtttacgacgtgtacgccccaaagcacacacattattcattcattgttcttctcctgctggtccatgaacccatttaaatgtagctattatgcaataattgaaaaataacttagagtttaattaattgttaagccaatcttacataccctttttcttttaaacatagccccacccccctaaaatagagccccctttggaggggggggttgaaaaaacaggtataaactaaaattgcttttgcataaaaattctctcaggaagtgctaatccaatccagccaggctttttctattttcc

SEQ ID NO: 5959 - DNA, 8260 bp, Heterodera glycines
  misc_feature (166)..(166): n is a, c, g, or t
  misc_feature (2942)..(2942): n is a, c, g, or t
  misc_feature (2949)..(2949): n is a, c, g, or t
cgtttcgatccatcgcttttggtcctttcgttcagcccatccaagccaaggaccgtccatcaaatccgtttggcatgctcgcgaatgtttggccaattttggcactgaccaattccgcttttttgtccatgacgttgttttgggcggcgaattccgacggcacttngagagggaaaatgcgcaaaaattggagcaaattttacgcattgccgaaatgaaaatcagtgccttttatttgcatggaatcgaactcgatggacaaaaaagctatggacagaatggcacagagcagaacaaagtggcggagaagaacagccaaccgacgctgaagcagtacagccgggtaaaggaaggacgacacttcggtgtcttcaatctctctcacttttcagctcgtctccgatttgctgttcaatgtgccgttgtttcggatggcccgactccgtcgccgctgtgccgtgcccacctttctgtactttaacgactatttcaataagtgccaattcgagccgtggactccgttccgaggcgcaactcatggtgatgccacccggcacacttcccttttcacaatgtcgcctctttgtcaggcaatgagtacccctacctcaacggtctcttccccgtgggcgaattccaattcaccgaggcggaccgacaacaccgtgccactttggtccaaatgttgtcctctttcattcgcaatgggtgcgtcaaaaggggaaacgtttttcatcaatggcaatctttgggggtttttatttaaccgaaactgctaagcatatcaaatcctttatatccattgccattcaacagaatgccgagcctatcactccctggcgactactttttgtggccatcaaacgaacgaagcgatgaaggaaaagagaaagcgctgcaatttgtgcggattggaaatggaacggcggaaattgcctttgcggatgccgtggaacaaagcggcacattttgggaggaattcagtcgcgaatttggtttcgatttaatactgggaattacgtacgaatgtgacgaggaaacaaaggaataacgaaatgaaaagatttccactttgatgcttaaattgtttaaaaagctttaaaattgtaggcaaaagaggtagtgatacaaattcgttctttcaataaaatttaaacatatgatttttatcaaaaattttagttgcgcaaaaagagtagggaatccataatgatgtctggatgcattgcataagacagaattaacgccacaaaatttatttcataataaatcatcatcaaacaatatgtcggattaaaagaagaaaagcgatcaattgaccaatcaaaaggaagcaattataatttatttctgataaaagcaggacaaatattcggaaaacaacgaacattaatagtttacggggaaatgtttgatgatgatcagagtcgacgatggtttgtatttgcagacgacaaactgaaaaagacgggcattcccaacccaaactcaccactcatgttcaaatccttggaaaaaccgaccaacaaaagggcagccagaacaaaccaaaaactgtgaaagtacaatttcaattgggcagttcagcaacggtcacaccttagtccggcccttctgagtctgctcggccattttgttgctgttcggcctgttcctcgccctctttgggccccgtctcttcttccccctcctctccatctttgggctctgcttcatcctccccctctccgtctttctgtcccgtttcttcttcgccctcctcctcgtcccttttctcctcttccgcttcagcaactgtttcgccagtcattccttccattttcaccacaatcgccgacttcagtccgccgcgaacatttgtctcctcctcgtcttggtcgtccgactcatccgccacattattcttagcctgaccaattgtcccgccaaagctggcggtggtgtacgtgtcgagccgacgcaattcgcgagtcatttcatcacgtcgtaactcaatgagtgctaaacagagacagagacaagacaatggaataacagaagaaagtgttcagccaatacaataaatattcaaatccctaaaactcactttcaattttctttgatgactctttgaggagttccaaagttcggagtgtgtgtttggaggggaggaagaacagcgggggcttagtctgagtttggatgaagcactgaaggcgacggaaatgtttcgttttctcttcggccttagagaggcaaaatttggttaattcctcactcaaaaacgatctttccaacccaccgattgctcaatggccttttgacgccggagggattgaatttccatttccttctcgcgcttcttcgccatcagtgcctctctctcccgcatcattcggtttctgttttccttctccgtctcctctaaacgacgctcaacttcgcgttgcttgtcaatctgtgcgttattttctttttgatgcaaatacaactcttcccattaaacctgcacttgtcctttgctcccaaccgtcttttcctcgttttgaaatttacgcaacgtggcaaccaaaagattaccgaaaagacgtcggtttctaaacaataagggcgtttgcgaacacttttaaagcattgtgtcaaaaaatctttggcacatttccagcaactcaccgcacttggtcttctttgttctcgttcttcttcatctcgttgattaccgccgtacgcgatttggtctcaatggtgggcatcacgacactagattgcaaagtgcggtgagtacgcgctgaagagggcggggaataatcaccaggcggaccctcgtccgcggcgtaacgcccacgcttcgcattgcgatcgctgaaagtcgatattatgcacataaaagcatgatttcttaagaaaattgccacttcgctacaccgtaattgttttcgcttaactagtcatccaaaaatttntactgtntaattaaacctgcttccggccgataaaatatttttcggcccaccctcctgcacacgcctgaaaatatcaatactaggtaagtgtcttttgatgtcccttcttaccgatcaaagggagtagagaaagaatcatttgttggtgcgcttcttttccggttaaatcttaaaagccataatatgaaaaaaactagcgaagtgttttttacctttctgaaactccggaaagcattgatatgttcatgtcaatgctccttaactcgtcgtaagccttggtcagagccgaatttacgtcaacagccatttctctttggaagtgttatcgatgcggaaaaagacagacaaacagctacaaaatttcacaaatgtgagcaatttttttgaaattgaaaggacagaagactaaaatacaaaattaaaatggtgtttgcttcaattgcattaggtaaataggtttttttgtaaaacgaacagcacaaaaatgaagaaagataaaaaaaattttggtttttcaataaacataatgccaaattactgtgcttttatctttgacaaatttaaaaacacaaaacaagtgaaggaaagtggggaacattatcatcaaatttagattatgttctgttgcgtaaaaccgagttttaataaaataaatatttttttaagcttttatctttgcttttttgaatttctttcactcaaaaatgtccagcgatattgtcgagaaaaaggagacaaaccccaatgagacggatgacaaaaccaaagaaataaaatgtgttttttgtgcttaacccaagtaaaacccatcatatttggtgtttctttctgtttcagcgcttgacgaggatgaaattgccgcacttagtaattacaacatgggaccgtacgcggatcagttgaagcaggcggagaaggacattgatgaaattcagaagcgcataaacactctttgcggagtgaaagagagcgacacggggctggcgccgcccattctttgggacattgcggccgacaaaatggccatgtcccatgagcagccgctgcaggtgaattttattttgattttggtcaataagacttgtttaaaatcttaaagatgagtgaaaatgaaaatagtttaaggaaaaactgaaaatgctaaattttaatgttagggattaggaaatggtcaaattcttggtgggtcaaaaatatcgaaaatttacaataataattcgcgacgctccaccttaggcaaatgttgcattcaatacaaattaaaatatctttttaaaaaggtggctcgctgcacaaaaatcatcaaagaagagggcaaagaaacgcgttacatgatcaatgtgaagcagttcgccaagttcgtcgtggacctgcacgaaaatgtggcgcccactgacattgaggagggaatgcgagtgggggtggaccgcaacaaataccaggcaatgtgcacattaatttatttcagaatttgcgtttcacagttacttaaacttttctgtgggttggaccatttttaagggatttgacaaaatacgccatgaattgattttaaaaattaaaaaagtgggcatttgactaattgtaagtaaaggcacaacaaaatcttcctttaaataagagagcagcatcttgatctcccctcccccgaaaattttccacaaaattttctgatgtattctaagtttttcaaaaaacgatttctcaccatccatcggcttacaaaacatttcatttttaagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcaggtcggcaattcaatctctgtttttgtttttgttccattttgcctctttatttttagcctgagcgtttcacgagtttgggcattgagcctccggtgcgttttgccacaccttgggattgtctaacgttttccatttcagaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggtgggtggggggatgtgtcttccattttggcttgaaggggaaggcaaagggggaggtcaaccgaaatttttgcgaacgggtccggtcttttaaatcgacgacttttagctttttttgcggcgccctttttgtcaaaaaaacttagggaacgggcaggggacccggcggtaccaataggcgcagccgtggaataattattgaatttttgatgaattgttaagaaaatttgttcaggatttctaatttcaggttttgatggccaccaacagaccggacacactcgacccggcgctcattcgtcccggtcgcattgaccgacgcattgaattttccttggtaaccaatgaaaataaatgccgatctgacaatgagtacacacactgctcattatgaatcttttcagcctgacctcaaggcacgaggaaacattctccaaattcacaccaaacggatgagcgtcgaccggaacattcggtcggtcattgtttttgacatacatttaaaatggagtacaacatgttcggtgtttcaggtacgaattgattgctcgactctgtccaaacacgacgggtgaacgaacgcccattaaaatgaaccctcttacaaatagcgattgcttaattaaccagaaaaagtacgttttgctttttgaggtgccgacttgcgcagcgtttgcactgaggcgggaatgttcgctttgcgtgcacgtcgaaaggtcataacggagcaagactttctcaaggctgttcagaaagtggtacgttttccttttgattgtgccaagtggattcttttatttggcttatccaaagtccttcgtttgttcgttctctttcgccctttgtattttacgttttaatttaaggtgaaaagctacgccaagttcagttcaacgccggcgtatatgacgcacaactgacaatacagttcttacaaaacggacttttttatatttgtgcacttttgtttcattacaatataaatgaggaaaccaattccgcagaatgtcttgttaacaaggactacttttacggcttttggaaattcaagcgtaaaaattgagtggcggtttcgtaaatgccgtgttaataatgcagtcccccccccatgtgtatgcggaaaaaagtggtttgtgcccagggatggcacggaattccgtcttcctaaattttattaagtagtaaagctaaagcaccacccaaaacaattgaccgataagtgtttaaaatttaccaataaataaataatattcaaagggaagtaactgtcgtctttggtgccgtttcttcatctttcgctccgtcttcgaacatttgacccattgcgttcagccgagcgtagcattccgcaacgccgaagaattcaatcagttctttgattggaggaccccgcacattgtcaatcattgacagacggaatatttttgccagcagctgataagggatagccaaatctgtggccaacaatttgaaattgtcaaaagtgtgcgcagtgtccgacgaaaggaaccattggcaaagtgccgtaatctaaataatcacgcaaaaaacaaaatgaaaactaatttggtaaatagtgaaaatcatatactcctccaatataaatacgaaccaatctgacgcattgttcacgatccgcctcccctttcacgacgacttcgagcagtttttgagcacttcgaggccgataaaagaagaaacgaaaatcgccggttgataattcgcccaaatgacaaaatgcttcttctttcaacttgagaaaggtgagaacacgacaaagataagactcggaaagcaaagaatggtcgatggagcaacgaagttcctggtaaatgtttaataataaaaataatggtcaaaaatcaagttgaatacacacatttggcaaattgtcgaataccgacttgatcaccggcaaaaggtccttgtcattggtctgttaaacgctgaaaacattttccatttctctcgtttggtttcttttactataaaaacatgcccagctttccgtaattgttcagttcgtttgtgtccatctgaaaaaccgaataaattacgacaaataaatacaattctcaaaccgtgaaactccctcgagtgatcaatcgctcatcgaatcgttcgatcaattcttccactgtaataaattaatttcaattccaaaaattaaaatgctatcttcacacatgagtaaactgtttgtggctgatggtctctgattccgcttccgttgcgcaagagaaagttcaaaacagcaatgggtaaatgcccatttttcaggtaaaaatcctgagaccgaaactgtttgaactattttctttaaaggaccaaccgcgtaaccagcttcaaagcgtttggacaatttgcgtttgccgtccaaagtgatcagaggcaaatgggcaaagtgtggcggagaccaaccgaaggcactaaaggaaaatggaaagattttattttttcaaattatactaaaatataaaattaattttctgatttttttcttaaatttttgaatttttattaaagttacccagcagagtgtgcgtaaaaattatggggttaatcgaacgggaaaaggtgagacccccgtccaaccttttttgttttctcgttccgaaaattttttaaccgtgttcattgtcaagatacttcatgaaaatttatggtttatttccgagcacctgtaaatttgcaagtgttttgttgttgaacatatccattccgctcctcttattacatctgtgaaaatgcgatttctcaaagggattataaattcattccccttaacattcattgacaaaacgattattccccagtcaaattacggctgattttcatccgtcggtcgtccacgacattggcaaagtgataagtgggaaatccatcccttttgaggatcacaaaatcgccctcctccgaataatgttcataatcgccgaatacgatgtccttcaaaaatataagcgaaagg

SEQ ID NO: 5960 - DNA, 2491 bp, Heterodera glycines
aattcatttcaaaatccgattaaaattctctcaagtacatcgaaaacccatttaatctgtactaacttctttaaagtcgaacctgcggatatattctgataaaattatgatggttaacaaaatctcaatttaaacccaagcgtattcacttactgacatcatccggtgtataatagctgctcattttctaatatttatagaaacctcatcatttatttctgaaaatgccatatattcgtgcatttttaaaaatgaatccccatcaaaaccaaataaaatttcactcaagtacccccaaaacgaatataatcttaatcgagagctttgaactgtaaccgtggttattatcctctgtcatataaaatctcataaaagttttctcaacagtactgtaaggaaaaatataataaactcaccggatctgatatcgaaaataatcaaaatgaaattgtttctccattttgagaaagcatattgttctgctgatgtgtttatcgtagattatgatgacacactaaacactttcttcaaacccgagcatgacttaccaacaataatcggcgaattattagctattcattttgtgaatttttttagaaatctccagttccattcaagaaaaagcctactatattcgtgcattgttcaaactgaattcatttcaaaatccgaataaaattctctcaagtacatcgaaaacccatttaatctgtactaacttctttaaagtcgaacctgcggatatattctgataaaattatgatggttaacaaaacctcaatttaaacccaagcgtattcacttactgacatcatccggtgtataatagctgctcattttctaatatttatagaaacctcatcatttatttctgaaaatgccatatattcgtgcatttttaaaaatgaatccccatcaaaacccaataaaatttcactcaagtacccccaaaacgaatttaatcttaatcgagagctttgaactgtaaccgtggttattatcctctgtcatataaaatctcataaaagttttctcaacagtactgtaaggaaaaatataataaactcaccggatctgatatcgaaaataatcaaaatgaaattgtttctccattttgagaaagcatattgttctgctgatgtgtttatcgtagattatgatgacacactctttaagtcgaacctgcggatatattctgataaaatccttttggttaacaaaacctcaatttaaacccaagcgtattcacttactgacatcatccggtgtattttgttaggtgctgattattattacgagttagaacccacccccgttcaaagaatttcaagcggctatcacctcgtacaaactcttttgggtccaattgtggccggcaaaccccatcctaatactcaattaccccaaaatcatctgatcaatttttgtacccagtctgaaataattccctctgatttctttacactcgaaagtattggaattaaagaaaatcctgaacctttaaaatgtgatgaccttattcttactcaatttgaagaaaaaatagagttttttaatgaccgttaccaagttcagttgccgttcaggtcggatcccaaaacaattgccctcccatcgaatttcggcctatgtatgggccggcttcgttctgtttttaataccctttcaaaaaatccaacacttcttaaaaaatataatgacattattcaagaacaaaagacattgggaatcattgaacccgtccctatttcttcaaaattttcacctcctcttcattatctagcccaccatcctgtaattaatgaaataaaaggaaaagtcagaattgtatatgacggttcggcccatgttggtaaagagccttcactcaatgactgtctgtacccaggccccattcttattcccgacctcgtgggcctcttattgcgttttcgaattcctaaatttgtaattacatgcgacatagaaaaagcttttcttcaagttttagtacaccctaatcatcgtgattgtacccgttttctatggctcaaaaatatccaattacctccctcttcaattaatcttcaaatgttccgatttactcgtgtgtcctttggccttacttgctcaccctttcttttggctgcaactattcggttccatttgcacattaacccatcaccattatccgacgaaatcatttctaatatttatgtcgataatattcttctttcctccgaaaccgaaaccgaaggtgtagacaaagccgtagcggcaatttctctttttgaaaaggcaggaatgccactgcgtgaatttgtttcaaattctaatgaaataatttccaaaatccccgaaaattttgtccttcacggccccgatcaaaagtttttaggcattaattggaaccccctttccgatcgtttagtttttaagctggcaaatctcccaaattcgccactttcaaagcgatcaattctttcctttgttgcctcaaattatgacccat

SEQ ID NO: 5961 - DNA, 2090 bp, Heterodera glycines
  misc_feature (2042)..(2042): n is a, c, g, or t
ctaatttcacaaccatttttaattttttctaaaacaaaggtttaagcccttatataaaggaaatcgattaacaattccgaaattagaacttatagcggtagaaatcggtaccaaattattaaaatttaccaaatcccatctcacaaatatagaattagactcaattgttcatttatggagtgattctgcaattgtaatctcttggttaaataatccatcctcaattcgcgaaatttttgtaactaaccgtcttaaaacaataaattctctccccaatttaattgtacaccatgtaccgggacaacaaaatcccgccgacattggttcccgaggttgcccatccatatcctgtttaaaaaattccaaaatttggtggtctggtccggaatggctatctaaaacacaggaagaatgggcaacaaatccagaaattaatccgtttatttctaataaaatccttaacgaaaacccatcgcttccaaatggtacggtaatgttcacgtttcacgtaaatgaaatgcaaccctcaactctattatttgatttaaatcgtttctctcgtttacccaaagccattcgctcaatttcatattttttacgatttatttcactaattaatcccaaatcagaccataacaaattacggtatccctcacttaccataaaaatttcagaaatgcgttccgcgtttaaattcataattaaacaggaacaaaaggcatttccccccgctcaacccgaaaacgaggccttaggcatatttcaagataaaaatcaattactccgttctaatggccgaattaataatagtcaaatcagtcctttgtcaacaaatccaatttatttacccccaaaatctccgctcgctcgcttaattgtctatgaaatacatcgaacaaatttgcattctagtccactttcaactttgtcctttttaaggacacaattttggcttcctaaaggacgtcgtactgtagaacaaataatttccaagacttgtaccgtatgcagacgtttttcagccaaaccctttgacctccctccagttccacaactcccaaaagagcgtgtaattttaaatcgtccattcttttccactggcctcgacttttgcgggccattacacgtaaaaagcatttcacccatttcatcaaggaaaaatgcccgggtcgaaagtgaaaaatattggattgtattatgggtttgcctttgtacccgaaatatttcccttgatattgtccccgatcaatcagccccaactttttcccttgcatttcgtcgattcattgccaaatttggcaccccacaaacaattcattgtgacaatgctcccacctttttggcgattcataaatttactcagccaatgtaccaaacaaattgggtatttaggactccatatgccgcatggaaaggcgaacattatgaacgatttgttgcccatgttaaataccatctccgtcgcgtattgtcaggacccaaacccaaaatcttcccaagggatcacattcaaacattcctaacagaaatagaaaatattgtcaattcccgaccaatcactttcgattcaaccaacccattagacccacgacctttacgtccaattgattttgttcaccccttaggccataaccacccgtctatgttatctgttttggaaaacccacaagacatacttaataccgaaataccgaccagtacccattttaatctcaatgaattatggttgaccatttcaaaatatttatcaaattttaaagaaaaatggcacaaagactatttaacttcgctcagagaacgctatcaaaaaatcacccagtcccaaaaccgttggccaaaaattggcgaatttgttcttgtataccaggaaaatgcgccccgttcaatttggctaacagccactattttaaacgtattttataatgaactcaatttccccaattccgccaaagtaaaaactattaatggccatacaacaattcgctccgttcatcatttgtatccacttgaaactcaagaagaattagcttcaaaaaccccanaaaatttcatgggccccttatcctccccaattaccaacctcccgttat

SEQ ID NO: 5962 - DNA, 1638 bp, Heterodera glycines
aaaaaatataaaatttcaataacctcgcggccaatttgtggcttatacctcattttttaataataattttttttagaaaatcacacatcccaaaggagaatgttttattatgactaaacccaatgctctttgttacaacctttggaaatagatgactacacatagcttaagaccaaagaggcaaacaaatttaaaaatgaacaagcaaatatttttttaaaaaaaaacttcatattttataaatcaataaaccaaatcaataaataaaatcaaatttaaataaaatcaataatgtaaatcaatcaataataatatggtactacttataaaatattctgtatattagagacacagacagtaacctgccaaaatcttttggttcaaattaatcgataaaaatatgttaagtgcaaaaaaaattaataatgtactattgtaagcgcacaaaaaaaaatcaataatatcaaaaaaaatgtgttccaataccttttggctagagacagagaaattactgccaataccttttggttaaaatcaatcgataaaaaatgtgtgtattcaatgtagtccaaaaccgttggccaaaaattggcgaatttgttcttgtataccaggaaaatgcgccccgttcaatttggctaacagccactattttaaacgtattttataatgaactcaatttccccaattccgccaaagtaaaaactattaatggccatacaacaattcgctccgttcatcatttgtatccacttgaaactcaagaagaattagcttcaaaaaccccaaaaatttcatgggccccttatcctcccaattaccaacctcccgttattgaaaggaattttcccagtaaggtacacattaagcagaaccgtagatggaattgggccgataaaccaccaacaaacacagccctttcccagctctaactacaagacaaatcccacataacattacagtaataattttttcccgtcgcgcccggaggtgctgcgctattcggttttcccatccccatcgtactctcccctcctgtgcattgcgctgtttcgttgtgctgcgctattcggttttcccatccccatcgtactctcccctcctgtgcattgcgctgtttcgttttcccatccccactagccatcgtagccttccttcctgtgcattgttttaaacggatatcagccaatttaatctaacatttatattaaagcgtctccgcaaaattcaatttttgctagagagccccgcccttacccaactgcttatatatccaggcatcattgtatttttcactcaattatctgctcatttacttaagaaataaatgggaaatattgtttcattcgattttgcctttaaccataatcccactccaaaaccagagcccagcaacctcaaactctccatttttctgtccttaattctgattgttttaattctgattctgattatctactttggacacatccgtcgttggtgggcaaaaatcttcaaacagcaatccatctcggtcactccacccaccctgccttccatttctgatcgtccaacccaatcacaaagtggcccaattgaagaacgccctctttccccctcaaaatcccaacggtggttttgttctattctggtaattat

SEQ ID NO: 5963 - DNA, 2542 bp, Heterodera glycines
cttgatgcgttggaaaagcgtgtgaagcgcattgacgtggtcttccagggtctttgaggcgattaggcaatcatccaaataagagaagacccctggaattcctgcgcagatttggtccatcaggtgctgaaaaatggacggtgccgatttaacgccaaatgggagacgttggcactgaaataggccgcggtgggtgttgattgtgcagagcggtttcgatttttcgtccaattccatttggaggtacgcatctctcaggtcgagattcgagaaaaattctgctccattcaaagctgcataaatgacgtcgggcctcggaagaggatggcgattcaattcgatcgaatcgtttaatccggtcgaaaagtcgatgcacacccgggtctttccatttttctttttgacggccaaaatcggggcggcccaatggctgaattctaccggtttgatggcgccgatctgcaagaggcggtccagttcggtgtcgactgcttcgatagcaccatgggggactggtcgagctttacagaaaatgggtcgggcgtccggtttcagaatcagatgcgccttgattgcgcagtggccaagtccgctcttaaaaacttcctcaaaatcgttttgcaacacagcggtgagcgaggattcgtccgtgatgccaatcgccgggtttggtgcctttacgacattggcgttgattgacgcgttggtctttcctttggtgctctgtggatacaaaatttcttttgagatgagctcaaattcctcaatccacggaaggccgaacaaatcatgctttaagtcactgctgacataagcgatcagtgtcttggatggccgatcgaaacaactgacggtgcaatgaaattttccttcggttgaaaatgcggtgtcattgcagttgcgggtctcgatgtccgttggagagagttcgggttggcccaatttgatccacgttttgaagctgatgactgttgcttgggctccactgtctccattcatcttcaaatttatgccattgatcatgaccgggatcttccaccatcggccttgggttgtgccaatcaccatacaatgtgacttgaccacgaccgtgtgaaatgatcggttctgagatttgtgtgccgtgttcgacgagcgctgacggcagacaatcgcaatgtggccttgccggttgcatttgttgcaaaatgcgttggcaaatttgcagtccgatcgccagtgatcgttgcttccgcatgatgcgcatggatgcgatggatggcctcggtttgctttgtcgtccgatttttgcttaggcgaaggcgcatgatgtggcgatttgggtgccggttcatgatgtggccatttgggtgccggttttgccttgtgtttgcctttgctggtctctcgccattgctgaggtcgcaattggatggcgctggttgagaccggttgagtaagcagagaaagggcactttccttgacgatttgaatcgccttcaattcctcttccaccttttggagagtgatgtctgtgccggtcttttctgcgtcctccagcattttgagacacttttgcctcaggtcgtgatgctcgtcgttaagtgcaatcaccaaaattatgcacttaagctgttccttggtcgggctcaaattggcgttttcacaggacgcgttgatgtgtgcgaccagcgatgagatgtcctggcttggctgctgacgaattttgaaacattcgtagcgccggacgaataatgatcgcgtttcggcatataatcctttgagcttggtgatcgagtccacccaattgactttgtcgggctgggtcggactgatgctgtcgcggtatttgccgtactcctcgtcgccgagtttgccaaggaggagtctgactttggtcgactcggggaggtccttaccatcctcttcaatcagaactccaaaccttttgaaccactgttcgaaagtgttcccggtttcggcgtcataattgaattttgaaattcggccgtcgatggaactcgccaaatttgcgtggttaagactcgtggcgttttgtggtgcttggcccattagctgttgaattgcatccgattgcacacgcatggcctcgaggagttgcttaatttggtccgcgctcatgccgaagtgtttgccggtgccgaatttgagtgtccaaaatcgaaaaaccgcgtattgcggaaccgcaacctttctcaggtcttttggtttttcggcgaattaactgcaatatgtgcagacctcacccgcctagggactattggttttgttgatgacgaaaaactgcagaatttgcagacctcacccgcctagggtctattggttttgttgctgtgcagtccggggtcttctgtttggttgaagacgactgctgactgcgccaaatttgttgtgtcttttgtccgagtgagaaagaccaacaaataaaataatttatttacgaagagtcaaataacaataaaataataaaaaatggcgaatggttggtggagagaataatgaataaaaataataaattgaagacaggagaagaagtgaacat

SEQ ID NO: 5964 - DNA, 2110 bp, Heterodera glycines
cgatgagatgtcctggcttggctgctgaggatttttgaaacattcgtagccccggacgaataatgattcgcgtttcggcatataaatcctttgagcttgttgatcgagtccaccccaattgactttgtcgggctgggtcggactgatgctgtcgcggtatttgccgtactcctcgtcgccgagtttgccaagggaggagtctgactttggtcgactcggggaggtccttaccatcctcttcaatcagaactccaaaccttttgaaccactgttcgaaagtgttcccggtttcggcgtcataattgaattttgaaattcggccgtcgatggaactcgccaaatttgcatggttcagactcgctgacgcggcgttttgcggtgcttggcccattagttgttggatggcatccgattgcactcgcatggcctcaaggagttgcttaatttggtccgcgctcatgccgaattgtttgccggtgccgaatttgagagtccaaagttgaaaaaccgcttattgcggaaccgcaacctttcttaggtctgttggtttttcggcgaattaactgcaatatatgcagacctcacccgcctagggactattggttttgttgatggcgaaaaactgcagtatttgcagacctcacccgtctagggactattggttttgttggtgtgcagtccgggtgtcttcttgttggttgaagacgactgctgactgcgccaaatttgttgtgtcttttgtccgagtgagaaagaccaacaaataaaataatttatttacgaagagtcaaataacaataaaataataaaatggcgaatggatggatggagaatgaataaaataataaaagtgaagacaggagaagaagtgaacgaggggggaagagtccacgcctttaaataacaaatgtgatgtgggaggaacggaggagggaatggacaaatgtcaatcgataagtgaccatgagaaaatgtactttgctcttctccaacacaattcttacgcaatatttcttaaacatattgccgaatgaatatttcttttagaatgtggcaacatttcctttagaatgtggccacaatttttctatgcaaattcagatgggcataactcttcagcaaattgagataaaaaataattaaatactccaatcgaatgctgctcttgtgctctacatgatgcaataaaaaaatcgctcagattccttctaggaacaatttctagcattctaaactttttctaaaatatttatacaattcttacgcaatatttcttaaacatattgccgaatgaatatttcttttagaatgtggccacaatttttctatggaaattcagatgggcataactcttcagcaaattgagataaaaaatatttaaatactccaatcgaatgctgctcttgtgctctacatgatgtaataaaaaaatcgctcagattccttctaggaacaatttctagcattctaaactttttctaaaatatttatacaattcttacgcaatatttcttaaacatattgccgaatgaatatttcttttagaatgtggcaacatttcctttagtggccacaatttttctatgcaaattcagtgggcataactcttcagcaaattgagataaaaaataattaaatactccaatcgaaattgtgaatatttcttttaatgtggccacaatttttctatgcaaattcagatgggcataactcttcagcaaattgagataaaaaataattaaatactccaatcgaatgctgctcttgtgctctacatgatgtaataaaaaaatcgctcggattccttctaggaacaatttctagcattctaaactttttctaaaatatttatacaattcttacgcaatatttcttaaacatattgccgaatgaatatttcttttacatttcctttagaatgtggccacaatttttatatgcaaattcagatgggcataactcttcagcaaattgagataaaaaatatttaaatactccaatcgaatgctgctcttgtgctctacatgatgtaataaaaaaatcgctcagattccttataggaaacatttctagcattctaaactttttctaaaatatttatacaattctt

SEQ ID NO: 5965 - DNA, 1509 bp, Heterodera glycines
  misc_feature (95)..(95): n is a, c, g, or t
  misc_feature (161)..(161): n is a, c, g, or t
tattttttataatgcaaaaatatctattttgattcgaatagagaccggacaggattcgggatcccgcgggattaatttcagatcctcccgaacgnattttttaaattcaccggcattgatcgggatttcatcgggatcccaaatcagggatccctcccganccatttacccaatcccgcggggatcccgcggggattgaagtcacgagaatttttcgaaaaatctcgattttttaaataaagatcttgatttttaaattataaattatttgcctttgtttatttttctttaaaaatcacttaaaattcatgggtctccaaaattttacaaaaattttcaaaatttgacgcaaaacttggccattttgtgatttttatttatctcaataaacaattatcaaaaattatttttttttaattcctaaaacattattctaaatcttattaggtaaatttatggcacaacgattttaaaaattttgtcaaaaaaatcttgtctacgtatttttccttcggtgccaatcggcaccgccagacccaaaaccccacttttttcttataaattagttcataatcataaaatatggacagttttaggataaattctgttatcaaattaccttacaaattttcaaaattttcccggcggcgcctattggcacagccggcttcttctccataaagtttttgaaaaaatttgctgcaaaaaaaaatcctaaaaatctgattttttgattccgattctcaaaattattaaaaataatcatctgaggcgaaaataaaaaaaaattgatattaattaattaaattgtaaaaagttatttaaagctatgttgttaaatgtactaatttttgatcctaaaatatgatttatgggcatgatattttaattttgaaaaattttctataaaaacctgatataatttccatccctatttttctcgatcgaattgatcaattatatgtaaatattagataagcatttaaacaaaacctagcacaaaacgtaaaaaaaaatttgaattttttgcaaatcccgataatcccgcgggatcacgaaaaattcttcgggattgatctggaccgggattcggtcgtgatcccgactcgggatccgtccgatcgtttttccaaaaagttcgggttgatcgggatcgggattcagtcgggatccatccgaccccagttgttcggtctctaatttagaatgaagataaaatagtatgaaatttttgctgttatttgaaattatggttattaatagggcaccgatttccagtgaaaaaacttttttttgctcaattgatttgaagaaaagagctcaaaaaacgcatttttgcgttaaaattttttcatttggacgccatttttcatcactagaaatcactattttggcgttttgtcacttaaaatagtgaaaattcacttttttggctttttgtcactatttttcattattttgagattttttgtaaaatttattaataaaaatgtcaaaaaaccaaaaaat

SEQ ID NO: 5966 - DNA, 2435 bp, Heterodera glycines
tttcaagagttccaccattgtaaaccgttacagcaccgttttttccgggactttccgaaatccaattcacggcacttttctcgttcccgaccaaaatctctatttatttttttctcatcactggaacatcactgtaagaaactgaaacttggaattttctgacaattactctggccaagaaaagtgaacatttttgatcctgaaccaaatacttgcccccatatacaaatcattattatgatcaaaaagttttaaaactttcaatttcgacaaactaaccatcccattttgtattggccaaccccgccgggcgatgttctggccaaattcgggtcggccaaaagtgcaattggcttcggacaatgggcagcttccccaatgttgccagttggtccagtgactatgaacagtttggaaccggttgaccatccttcgatcaatgtcggatcagtgccgatcattgtaggtcgaatgtacagcgatgcttcgtccgaacttggcacccaatcctgatcagtccgcaccaattcgtcaatgattttcagcaattcatttccgtcaaaatcctgcaattttttatattatgttgaagaaaattaattaatcacttaaagcaaaaatttatactatataccacactgacaaagggccgacggacagaggactcacaaagacaaacgactaaaatttctttaaaatcagcgttgcttataatttttttaaaagttttttttttataaattgaagcattttatcttttaatttttttttgtgggtcatttgtccgtggtattttgtctttgtgtgtacgtttccgtgggccttttgtcactacaccctttagagggcaccgaaattgtgtgttcttttttaaatggcacgaaatgaaattttttttgggataattcggtggtcaaagtaagttttaaactatttttactttgtaccaactaattttttcgacttggatgatacacaaaaacagcggacaatggtttttcccattaataatgtcccagttttcaaaaaaaaaaaaaattatgttcccgatgttgcactgatttgcgagatttctagcagtacaacattaccaattcagattaacggcaattttaccggtagcattaggcgtgccgctgttcgtctcatccgtgcaatattcttttcgggacgaaatagtcgaatatggttgtcctgaccgcggtaagccttcatgccttcaaacagttcgatggcataatgtaaagcctaattaaaatttaaaaattatttttaaaatttatttgccccacctttgccccggggtgcaattggagcggatgtaatggagaaattaacggttttccccatcctttggcatcggaccagtccacctccatcatatggtccgaaaaattttggccaaatttcaattggccattgacaaacggttttggctttaattcttggcctgtcgcttgaacaatgctcaattcgtcgtgctaattaaagcgtttttaaaaaataataataaaccgaccaaaaatgtatttctaatatttgaaactgtggagaatttagcaagcacaaatgaatttaattgttttgcagaagagaatacattttttgtagtgtttttaatgatcattttttattaaatatatttaatcttaaacgtattaggtcaaaaaatttaattataattttaatttggaaaaataaatattattttcgaaagagatcattttggtaggtgcaatcacttcactttacatgtagtggcaaggtttttttccttttttgtaatatttattaatcaatttgtagttttgtgattaatgtgaattaattatttgaattggttggatgaatgagaaaatgtgcaagaaattgcgttttgtaatttgttgcgttaatttttttaaatgatttggacaaattaattttggcctttaattttaatgctgttaaataatataaattcgaataataataataataataataagcaatcgccagttatccgattgtaaatttcttcttatttcccccctaaaaatcgaatttttgattttaaattcgaattccaagagattttaagaaattttgagaaattttccttttttatggaaatttacgatatgtccatatttttgcgatgtagatctatattttatggccatatttcgcgatttttttatatcaatcaatatatttgcgtcctaattaaagaaaaattttgaaaaatggaaaaaaaagtatttttatttttttcgaaggtctttaaaaatatcaaattttattatatattaatcttatttttttaattaaaatcttattaaaattgttttcactatacaattttactaatgacaaagatttattaaagagcggaaatacaaataataaaatgaaaatgaatattaaaaaggcaataaaacactaaaacaaattca

SEQ ID NO: 5967 - DNA, 2180 bp, Heterodera glycines
  misc_feature (1851)..(1851): n is a, c, g, or t
ttattcatgtcctttgcattgtccctttttctgtttttgaactaatttaaagattaaaaatttattaagccaaatttagttcaaatttttcatttatttataagtttttgtgaacagaaaaacgcgaattctcatattttacgaataaaaattacccattttgagcaaaaatgcgtttaaaatttcaaccgaaatgcagcaataaaaatattttttgctctctcccgatgatcattacttcagatattgcacaaacacaataaaaaaaaacaaggaaaaaatgaaataactaattaaataattatattgctatttgtatagggccgtgagtgtctcacactcatttggatgccaagctggtgataattgaattaatcgcgactggatgcaaaaaacatggatggatttagtaatctttcaaacagaaattagccaataggaattggtggatttgaaagatctcaggcataattattcttgctgatcaatgttctagattttagtaaaataagcacagtaattcccgattttcactttcttgacgctgaaattcgggttcagatttcaattataatcttcgccctatattaatttttatttaatttaataaattattaaacattaaatcaaaggaaaattgatagaagacttctcggaatgtgttggcatcaccacactaacatcgtttggtgaagaaaaattgctcggcactttttaggattacacttgcgctagtttaagcacaactgtacttcgccaaatgcttgttggttcaaatgccgcgctgtggaccacggggcacgccatggctgttctgtttgctgtgcaggtcgagcgcggaacggacggcacttggcgtggccatgaatggcattgaaacgagcgaggaatattagcatttatgcgttaattttttattgattgaaaatttaccagattttcccctgccctgtttcgggtcctgtatttttaaactgcaataggacccgcagacctattaaaacaggaattttcatccgtaatcctgttcgggttcaacttggaaaaccagttcctggtccggggtttttcaaaattcgagggctctaatattttgccatttcaaagattcgtatgcacttttaggggcacttttgcaagaataaatttattaattcacggttgctccctggggtttcatttttgagagtttctggttttgaaaaattttcaaacatttttttttattttatccccgttgatttgttttgtctcttattttcaaaagaaaaaaataggtaaacaattcgacatagacaaattagaaaatcctcaaaaaaagaaataaaaatcagttaaaataattttgttttttaattgcatcttaagaaaatatgttttttccacttcagcttcaaccaatgtttgacgcaacatatggtatttcaataaaatttagcggcaactaagcaaatttttccacagtcttcgaaattttattaaatacattatttccgaacaaaaaatattcttttttataattttaaaagtgaaataaatattatacaaattcatttaaaaaaaaaaaaacttttggtttcccaaatatctttagccgattaacaccctcaaatccaatggtcaaaattgaggaaatttctttttccactttttcaaggttgtttttccaattcccaatttctttgcaatttttctgtcgttaattttcggatttctttctttaattttgaaatattgcttcatcttttgtaatttgtcctcattggaatatttactttgttcttaaaaaaataatttaaatatcaaaataaatttttattttacttttattatattttggcaacaattcgnttttccatcttcggaatgtctctttaaaaatgcccaattccttcacaaattctttttgtttgccttggccatataaacttttaaattcatcaattttttctataaattctttctttttctgctcataaaaactatttttcattattttatttgctttatattaaaattaattcttttttcctttatatattttggccgcggtttgccccaaaaaattttccaattttaagcccaattttgaaacttttttttcccttggaattttccctttttggtttccgtttttttttttaattgcttccaaatttttgggatattttccctttttt

SEQ ID NO: 5968 - DNA, 2648 bp, Heterodera glycines
ttttccactttttcaggttgtttttccaattcccaatttctttgcaatttttctgtcgttaattttcggatttctttctttaattttgaaatattgcttcatcttttgtaatttgtcctcattggaatatttactttgttcttaaaaaaataatttaaatatcaaaataaatttttattttacttttattatattttggcaacaattcgtttttccatcttcggaatgtctctttagaaatgcccaattccttcacaaattctttctgtttgccttggccatataaacttttaaattcatcaattttttctataaattctttctttttctgctcataaaaactatttttcattattttaatttgctttatatttaaatttaattcttttttccatttatatattttgtcgcggtttgcgcctaataattttccaattttagcctcaattttgacactttttttcccttgatattttcctttttgcttcagtttttctttaattgcttcaaatttttggataatttcgcttttttgttggtcatttggttccattttgctattttgatcacttttgataacattttgattggaatattcactcattttatcaattgattcggttcccatttcttctctgttttcttcattttcatttttgtcccattctttgccgaatatttcatcaaaatttggtcgaattttgcaggactcaattttataaataaagcaaaatattaaaaatattatatgccataaattcatcttttcttttgagaaatcgaatttattgcattaaatgaatttatttaattttttattcagctttttaatattattatttcacttggtatttatattctcttttttaacaaatctttgtcaataataaaattgccacgttattctaagcagtgaatttaatttttcacttacaaattagataaataaataataattttcctattccattcattaatttcgaaatatttttttatctttattaggtaatttgttctcattggaaatttttctgatcgaaatcggatattctttactaatctttattaagcttgtttcaatttcgataatccaccagaaacctaaaatttattttattttaatttaatttatttttcttatttatttatttaccttaaaattgcaaccagttgccttcttaatgtcttcaatgctgtaattctcgtgtatttcaattaatgttaagccttcttttcggcacacatcgaaaactgcctaaaaattaaaaaataattctaattaaaagttaattaatcttttattaggttgggtcattcataattaactgtacagtttttacattaatattttttgaccaaaaaaaaatataatagtttgaagaaaaatttatgaggcactgaatttttattcattttaatgccaaatttatgcatttcatttatttaaatattttttatgattttaaaatgattaataatgacccgacctaattaataattgatataccatttcagtgattattcttgacaccacttctttcccggtcaacggtaatgtgcaattttccaaaattttgtgtttaccatctttggcgctgtgctaaaataatggattatattaatccaatcccagactataaatccttgacatttaggccccattcaataattcttactctgtttactaaccccctaaaaagaattttcttatgcgataaattgataaattgttggcattttttaaaatttatacctccatcaaaacgacaactcttgagcctggtgcactcactaaatccattgctcctcccattcctttcaacatttttcccttaaaaattatatattttacattctttttatttttaatttatttaaaaaaaattcgaagatgactttgatgaaaataaataaaatttatgaaacaaatttcttgaaacaaattttttttttagaatttattttttaattgcttagtttttgattaattattaaattttcatcaaaatcgaaaatgtaactttttcaacaattttcaaaaggccgaactatttacaatataattttgtcattctgtgtttatttgtctttcccaccggaatcatccaatttgccaggtcccctctcattgacacctgcagcccaccaagcattgtcaaatcgatatggccgctaaatttacaaacgttttttatggaaatttttgtttttttgaccccctaatcatggcaaaagattcatccgagctaaacacagaagcaccaggattatatctgaactattaattaatttacataaaaaattaatataaatcatccgaacgtgatggactcttttccagcattcacataatctgggtcctgctcgcccgcaatcggatattgaccctgaaacaaatttgaaaattgcatttaaatttttacatttttatttaaataaatgattttcatcttttttttcgtgttttttaccacgccaagcatcccattttctgcgtgtatgcacacttttattgacttgtcactgatatacgaagggcaaagggttggaatgccaatgccgagattaactgttcaaaaaaaaattttttaaatcataaaaacctctcaacgagctgcagcccccctccccccccccccactaagtaa

SEQ ID NO: 5969 - DNA, 2203 bp, Heterodera glycines
ggggggggtttattaagggggagggcgggaattttttatgggttataggggggggatgcgagaattttgggggtgtataggggagaatgcgaggagtggctaaatagaagaggtgggagggggagttcttattttttatcttttgtggggagagggggggggggattattaatatgttttaaagggggggggggggggaatatggtcagtggcggatggtgttgtgctccgtggacagaagatgagagagatagtgtggaatggagagaggagattgagaagagagagagagaaagagggcaaagaaactgagagagaacacttaatttagtaagtgcccgtggggggataaaaaaatggtcagcggtgggggggggggtggtgtgctgagtagacagaagatgagatagtgtggaatggagagagagagagaaaagaacgcgaaataaaataaattttgcaaactcaaaaaggggattttcttttgtttaacacatacacatacaatttttgagaaatctaataatttcaatttccattcatttttttacaactattttgaaaattaaacaaaaaaaacaatggcaaaaattaaaattttaaaaatattaataatttttcaaataaaagaataatcatttttatttttattccacaacttttgacagatgttttgacgtggcttggtggtttgatcagcaacaggcaacaaccgaaacaggtgttacgcaacaaacaattgaaatgataaaataaaatttaaattttaaaaagggatataaattgaaaggtctgttgcttctttcaatgaaaataaattataagcgatgtaaataacatattctgcatttataattagtagttaccctaccactctcatcgtggggtgtgaaaatgattaatgggttttcgggggagggggtccctttgatcttgccgccctaattaatcatggggggcagctggtaattaataggtttcggggaaggggtggtaattaattatagggggggggttaattaagagggagtgcgcgaatttttcatgggtattagggggtgagtgcgcgaatttagggggtgattagggacgaatgcgcgaagtgactgaatcgagaaggtgtgagagggagtgatcattattgatctctgttgggatgagcgggagggggataattagaatgtgtcaaaggggcgaggggggggggaatatggtcagtggcggatggtgttgtgctccgtggacagaagatgagagagatagtgtggaatggagagaggagattgagaagagagagagagaaagagggcaaagaaactgagagagaacacttaatttagtaagtgcccgtggggggataaaaaaatggtcagcggtggggggggggtggtgtgctgagtagacagaagatgagatagtgtggaatggagagagagagagaaaagaacgcgaaataaaataaattttgcaaactcaaaaaggggattttcttttgtttaacacatacacatacaatttttgagaaatctaataatttcaatttccattcatttttttacaactattttgaaaattaaacaaaaaaaacaatggcaaaaattaaaattttaaaaatattaataatttttcaaataaaaaaataatcatttttatttttattccacaacttttgacagatgttttgacgtggcttggtggtttgatcagcaacaggcaacaaccgaaacaggtgttacgcaacaaacaattgaaatgataaaataaaatttaaattttaaaaagggatataaattgaaaggtctgttgcttctttcaatgaaaataaattataagcgatgtaaataacatattctgcatttataattagtagttaccctaccactctcatcgtggggtgtgaaaatgattaatgggttttcgggggagggggtccctttgatcttgccgccctaattaatcatggggggcagctggtaattaataggtttcggggaaggggtggtaattaattataggggggggggttaattaagagggagtgcgcgaatttttcatgggtattagggggtgagtgcgcgaatttagggggtgattagggacgaatgcgcgaagtgactgaatcgagaaggtgtgagagggagtgatcattattgatctctgttgggatgagcgggagggggataattagaatgtgtcaaagggg

SEQ ID NO: 5970 - DNA, 3179 bp, Heterodera glycines
gaagaggtccgtcggtggagctgcccgcgcgctcggcggtgggagtccgcagctgcgtttggaggggtccgtcgaaggtttttgtttggagggaagaggtccgtcggtggagctgcccgcgcgctcggcggtgggagtccgcagctgcgtttggagggagtcgtcgaaggttttcgctcaacgggaggggtccatcgaagagggcggtactcacctggccgcattacattaagatggcgtacgcatcggtcatttgggtggtcgattgggatggcgtacgcatgtaatacggtacccttgaggtggtgtgcgtgtggtgatacggtaccattgggtggcgtgcgttctgcgtacgatgcatctgccgtaggcattgtacgcatgtatgataccgtaatgggattctgcgtaagattcatctgccgtaggcattgtacgcatgtatgataccgtaatgggattctgcgtacaatacatctgccgtaggaattgtaggcatgtatgataccataatgggattctgcgtaagattcatctgccgtagtcatcgtacgcatgtatgataccgtaatgggattctgcgtacgatgcatctgccgtacgcatgtatgataccgtaatgggtttctgcgtaggatgcatctgccgtaggcatcgtactcatgtatgataccgtaatgggattctgcgtaagattcatctgccgtaggcattgtaggcatgtatgataccgtagtgggattctgcgtaagattcatctgccgtaggcatcgtacgcatgtatgataccgtaatgggattctgcgtaggatgcatctgccgtaggcatcgtactcatgtatgataccgtaatgggattctgcgtacgatgcatctgccgtaggcatcgtacgcatgtacgatttctggaccgttgaatatcgtgagtaagttgatgcgtacgcacgcatctaccgtaaaaccttaatctaccatagtcatgtagacaacgtaggcatcaagaataaatatgtgttgatggacgtacgcatttctggagcattgaatatcgtgagtatgtggatgcgtacgcacgcatctaccgtaaaaccttaatctaccatagtcatgtagacaacgtaggcatcaagaataaatatgtgttgatggacgtacgcatttctggagcattgaatatcgtgagtatgtggatgcgtacgcacgcatctaccgtataaaattaatctaccatagtcatgtagacaacgtacgcatcaagaatactacgtgttgatggacgtcgccatttctggagcgctgcgtacgcatacatctaccgtgcgtatcgtacgcatgtagattcttttaaacaccatacgtatatagaaatgtttgatagtcgtagcatctggagtgctgcgtgcacatgtatctaccgtataatacgtactatttttctaccgtacgcattcctggagtgtacgaattcttctaccgtacataacgtacttatctttctaccgtagactattattgtgcgtacacatgagtctactgtacgtaatcacgtttgcatttattgggatgttacgcatatagattaatcaattagtctctctctttctttgttgcgcaagaatgtttacaaggcattgtcgactgacagattgtttataagaaggtgggagttcacatttcttctcattcgttcattttttaatacaaaaatttcgtctccttgtcctcaatcaatattttaatttaaaaaattaagcattaaaaatcattaaatcaatgtcaactcaacccactagctttttcaacgtcgccatgccgccccttggacaggtagaacaacttgttcaacccatgttcatcaattcggcacatcagcaaatgccggtattttgatttgtttttaatcggaaacccattctgttttagtcaccattttgtgccgatggcactcacaccattcaatttttgaatgggagtgtctccattgtgggccgcccgctgccgtctgttattcattgcaacgtttcttcaattcaattgattttttcaggccgctttgtctcaccgttgtagcattggaccaccgtccgcaccaacaaacgccagctggctcactcccggtgaccaatgttgtgctgcgcaatggcgacggtcagcgtgtagaagcctcgggttggaagcaacaggccagtgttctggcgtctttgaacatcgggagcacctactggttcaccaactgcactgcgcgggcccgataccagcaactggactgttggtaccgattggcgtcgatggcaaaaatgccattgtcgtccctcacactgccgctccacaggtaagtttttttatacgtttcttataatagaattttgtgttaagccgacggctccgcaaagtggtggactccgccattcaattgcctccattttgggagaacaggtgattttcattgattcaaaaaaaaaaaattaaatatggaaatatttaaggcgccacatgttcagacgggtggaggccgcacggtcaatgatgcgcgtgcccctcccgcagccgacccaattgaggaggacgagaataacaatgtgagaaaatgatttttttttttgtattgtgtttttttttttttttttttgaataaaatttgctcagacaattgatcatcgttttgggatcccggtgcgtcatcagagacgggcagctcaagtggttggttattatgatttgctttttcttgaataatttaaccatgaataaataatttaaaggtgactcgaccaattgaggactgtttcgtcattgagaggacgacgccaatgcgcaacacactccgaaacacgaggggcgaactctgcgaaatccgctttctgcctctggaggatgccgagcgacctgatctccttctggagacgctcatccagcatctgctcgaccgtgtcctggaaggtcaccccccaccgatgctcgttggacttcagcttcacccgccaggcttcgaccgaccgtatgtcatccgactccgcccaccggagcaaaacaacgcagcagcattggcggcggccattgaacgactgaacgaacagtcggcagctggaatcgatcttctcgccggaactactgttgcgaaagtgcttgctgtgtggcccctggagccaattcgtgcggatgcgcagcgcggaggttgt

SEQ ID NO: 5971 - DNA, 2115 bp, Heterodera glycines
ataattcactataaaaatttcttaaaaaaatttatttttataattttcttataagaaaaaactatctaagattaggttaaagcccccggtggctctcttttctaaaaaccggtaatttatttatttaaagttagacatttttgtgaaggtagaaccatttgctaaattcaaaaattatacttatttctaagaaaacgtacttgaatttgccagcttttctctgacgcatttcctattttttaaagaatatcaccgatgagacggtggccgatgttgcaaaaaattgtcatcaattggaattcatatcactctccaattgtaaggagatcactgatctggcaattgtttcaatttctcaaggatgcccaaaaatacggtaaaaggaacgggaaattactgtagaatggctactgtaataaatatatacaaaattattcattcattgagattacggtaccataaaacttcgcgtatttttgaatcgtgaaaatttcaatatattttaaaatcatatggttaattaggtatgtagctcaaaaattttctaggaatcactgtaccattgcaattacggtacccataagtcatctgttttttaacaataattagccaatcaattaactaattaatcgtgtttttcagctatttttaatttaaaaaaacgccctaaaattttttgacgatattttacaatattttaacattttttctgttgtattcaagtgcatacatataattgttatttttctcagaccctcctataataattgcgacttttttaaaatttttattaattttaatactattttattatttaaattacattattttaattttaatttttatgcttagtgatcttgaattggctggctgtacaaacttaacagatgcgggctttgttcaattgtcaaaaagttgtcatgagcttgaaagaattgatcttgaagaatgtcttctaatcaccggtcaatttttttttttataaatttaattaaatttaattatttttttatatttatttgtttttttcagattcaactctgacaaatttcaacgggtgcccaaatttgtacagtctttccctatcacactgtgagaatttgacggacaccggtttagccgaattgtgtggtaaatttaaacattttttaattattttaaataaattttcaaatatatataattttttttattaatttgtaagttaagaataaaatttttttttattttctcataaatttaaaggaaatgataaatttaatttgcagatttaactcgacgactcgagaaattttttaaaaaattgttttcagatgagaatttaaaaagcttgaaaatttctgcaaccgaatttcgtacacagctttatgtatttatagaaatagaattttagaaaacattttcaatagaaagttttgggaaaaaacctaaaaataattttcagcactttttttttagaattttttttttgaaaaacttaataatttatcgaaaaattttgaaaaaatagctagaaatttaaaaaaaaaaaaatttttctttacttttttttttaaatttcgggtggcgggggaggacagcggggaggaagaacaatgtgcatccttatttaaattgatttaaatttataataaaaataataatttaaatttaaatttcagtggcccatcgagaaagattgcaggtgctcgagttggacaactgcccaaacatcactgatcatacgttggaatccatgaagcatttgaaggtgttggagcgcgttgatctgtacgattgtcaattggtcaccaaagatggcatcaaaaaatttaaagtaattttttgtaggtaaaaataacatatttttacatactattaaaattatattctacaaaaaaaaatatataattatttattaatagagttcgacattttgtaaaaagcctggtcctggacctgaattccatgtttggatatggcctggatttctggaaaaaattccaggaaaattcaggcccaggaaaaatccaggcttgtttgcctggatccagccaggcctggacatggatttttttttataaatttgttttgaaaatcaattaattgcttaggaatatctaaaagtatctaatt

SEQ ID NO: 5972 - DNA, 1521 bp, Heterodera glycines
tttatgaatatatacagtagcttgccgagattccaacattcaccccatgcccactggatttctcaattactatttgtctcaaaatccaaattatcattagggacagggcttttaagcataaaatggctaatttaatttagcaatttaattacgcgtcaaaaaattcatcaattaaacacgaaataagcatatgcatattagcacaaaaaatcgaaaaataatgataaaattttaaatttcactgtccgaatcacagagaaagttgaatttttctttaaataaataccaaaaatgcattttttcgaaactgtaagaaatattaatttaaataaaattaaaaaaaatcaaattcttaggggggtacccatttttgatatgaatttttatgtgctacattttttttgtttcgaaccccttggcgcaatttaggaaatgcccttccactcctaaacactacactggcacactgtacagcccagttcggtattttttttttaaattataagcacctcaacctgtcatactgtacctgccaatgcggtattggctcatggtagtaaatcatttcatcaaagtggttctcatctaatgtctccattaatatttcacggtcccacctgtcaatagttgtcgtggcaatgccaatgtcttcaatcatggcattggcatttaccatgggcttcaaaggcatcttaaaaaggtgtgcatggagtcagaattaaccttttttaaaggggtgtcgaccgccccgtgacatgggaaatgcgtcagtggaaaatgcgtcagtaaaaaatgcgtcagtgatacaaatattttaaaataaagttctgtagcattaagtattataaaaaaaatataagtaaaatcatataagattgtcgtacttaattccaaacccctgacccaaattcgaacaaaaagtcgaaagtccaaattttcgaaattgcgtaaaaatttagggccaaaatgaaatgaaatgaaaaacaaaaacaaattgtcattaaacgggaaaaatggaagaatactaaaatataaattcaatctttttttattgggataattattaaaagagagttttaattgcttaaattttttaaaatataattattttaataattttcgagtttctttatatgtaaatgtttaaaaaacctcaattaaattgataaagaattgttttttaatttcaaaatttgccacgtaaactattcttttggcaaattgtcttccatttttgagcaatttgctgaatttattcaattggttttcgttttcttcaatgtgcaagaacagtttattaccacgttgtctgtaattattaaaaaaattgtgttaggccgtcggttcttaaaaagtgccaattttacagatttttcgagaaaaattcggtcataaatttgctaaacgcaacacaaattagcataaaaaattccagaaaatttcattcttcaaaaatttgttaccaaaaatattgaaaaaggcaatactatgccaaatttttctcgcaaaaatttgtaaaat

SEQ ID NO: 5973 - DNA, 1968 bp, Heterodera glycines
gcataaaaattccagaaaattcattcttcaaaaattgttaccaaaaatattgaaaaaggcaatactatgccaaatttttctcgaaaaatttgtaaaatgcacttttacgaacacccataatgacacttttttgcgaaacgacccagcacaattaaaaataatattatattacaaactattttcataaaaagcataattatggatttacattgggtttattttgaaattaaaaaaattgctaatatcattttacatcaaattataattaatttcataaaaagcataattatagtatttacattgggtttatttttaaatttataaacatttaaattcaatttatatcaataatattataatacaattaatttaattaaaaaatatgcttataaatttacataagagtttattttgacattaaataaaaattaaatatcattttacagttttcgaagggtcattaatagggtcgcgacttttagtgacgaaaaatctcgaaatagttaactaaaatagtggcgaaaaagtgccgaaatagttacaaaatagtgacgaatagtgacataattctcagccaaaaattgagcaaaaataatttttattcactagttgcaggtgcaaatgagtaggactgggatttttaagaccaaaaaacccaaaatagttacctatttttgccaagaaagtaaatttttgagaaaattttttttcatttcatatgtaggagtatattttgaaaaattttagctcgattcttaggggtgtatttttttgaaaaattttagctcgattcttaggggtgtatttttttgaaatttttttaggtcgattcttaggggtgtattttttggttttattgcatttttgttaaggaattttccaaaaaatgtcgaaatagtgacaaaacgccaaaaaagtgaattttcactattttaagtgaccaaatgcaaaaatagtgatttctagttccaaaaaatgacgtccaaatgaaaaaattttaatgcaggaatgcgttttttgagctcctttcttcaaatcaatcgagtaaaaaaaaaagtgttttcactagaaatcgtgtccctagtcattaaactaattgtttaataagaaatgacaaaaatttctcaaaaaaaaaaaactcaaaaatctccaatttggcattgcttttttttacctagcatgttggaccaaaccgtgcacacatttttgcaatatttgatactttttgttatagttgatctgtccgaccttctctttattaaaaaattttatggctaaaagtgccgctttgttgggcgatgaaaatggcaattgttggctgttgttgaacgggttaacatgacgtgcaatggcctggtcttgtgcgtcctgttgtaataagggtaataagcagggttgccatggtgaaaatttttcaaaaatcatcattttgccaacaaaaatcagcagtttgaaaaattttatcccaaatgaaaaaaagcaataaaaatgttgtttttttgcggcgctttttccaaaaaacttttggaaatatgttggtgggttggcggaaaaattttcaaactttgagtgcaatttttgttaatagatttttttaccaaaaaaaatgaccaaatttttgcaattttgagccgattttttaaggaaaacataagtttttgggatcccgacagtgccgaaagacccctccgggtaaaaaaatcagaaattttgaccaatttttaacagattttcactaaaattggcaatttttaggtcattttagcgttatgaaaatcatcattgacccccttgaaatcagcaaaatgatgataaatcatcacatctggtagacctagctgataactaaggaacaaatttctagcgggtgaaaaaatgtaccaaaatattggcgaaaaaatggcggaatgtggacacaatgccaacaaacgccaaaatgtttttcttacttttctcaccgaaacaaag

SEQ ID NO: 5974 - DNA, 1335 bp, Heterodera glycines
aaataaatttgaaatttaggcagctttttttagaacttttagaaaatgaaattttaaaaattacgcattccggcaattttttttggcttgcgaaaaactatggtatttgctccctaacgctttcgaagactttgatttcgaaatccatcatcgagtttttttttccaattttttttataaaaaaattttctccccgacgagattattactttttcacatttaaaaaaaaatttctacaatcatctggacaaattttgtcgggaattctctcccagaccaccgacatttctctccccaaaggtcagggagcatttcaaacgaaaaaccattctaggtttggtatattgtattaccatattgctttaaaaatttgtacaaatcgatgaagaattaggcaaaaattgaaatggagtggagggagtccgataaaatccctaatttcaaatttaaatttaaaactgtgcctcaatcgctgtgccaagtgtaatgacagccaaattttccagtatcccttccggtgccaagcgttccgttatgaattcgcacgtttcgatcatggtcttgagttctcgatcatcaccagcggcagcccaattcgggtgctgttgttgtaaaattaattgcaccaagaaaattgtggcacaaagcattgccaatgccatatctcttcaaatttttttctagaaaaaaagccacaaatttcgtcatttttaaaattaaattagtattttcagaaaaaaattcaacaactccctaattcataaatttaatatgaaaagaattttccagcatattataaccagggataagattttttggtgcaaaaaaatgccaaaataatagttactttttaggttctaaaaaaaaacccaaattaggtgctaaaaataggttttaaaaactcgtaaatagcttaacaaccataaaaaacatgtttttcatgcttttctggctacggggagcagggctgggcgaagctcggcttagcactcgaagccgaattaatttttttcgaagcacgaaattcgaagttcgaagcccaaaaaccgcgaaaatatttgacgaaaaatggcaaaatatgcaaaagaatctgaaaatatgcacaaaaaatggcaaaatatgcatgaaatatgcagaaaaagccaaaatatgcataaatatgcaaataaaagtcccgatttttatacgcaaacacaaaaaagaaagtgtttttcctgctatttagagcattgagaagccaggaaaaaaaatatgcatttacatgttttttgcatccctgataattaatgttttaacgaataaatttttccttttttgattttgaaccagtgcaac

SEQ ID NO: 5975 - DNA, 2903 bp, Heterodera glycines
  misc_feature (2848)..(2848): n is a, c, g, or t
atattctcactattttcaatatttttacttgttttaattgtttatttttctgagattctattaatattttatttttatttatctttttaatttaatcataccgtaattttaactttaatttggttttaattttttaaattatttttaatttaattttaatcctactttatttttaattttttttatgtttattttaactctattataataatataacaattttaattttactcttaccttattttaattttatttattttaaccataattaattttaattttattttgaattatttgaattttatttcaactttaattataataattcatttaactaaaattttaaaattatcacaagcgagctctcatatatcccctgcgtgcactcatttggcatacgcgagagctcaggtggcctggtgttccttcccctccccaaaggacacgaagtctgacgtcctttcccttctctaataggatttggctttggattttcttaattagtttatatttaatatttaattaatattttaatttagttttcatttatttaatttacctaattttaatttattttattttatttttaattaatttaatttaattttaaatttaattttcatttatttaatttacctaattttaatttattttatttttaatttatttaattataatttatttaattttatttaattttaatttatttaattaattttatttaaatttgactctcctgataaagatttcggttatgttgattaaagatgaataatgtactataatttgagaaagtgatcaattttcatttttcctgagtaatcaaatgtaagtaataatggtaaatgcaaaaactgcagccaatgaggatccttttttggataattattattttcatttccaatctgatcattcatcattgttctccatacaatcagttctttttgaataatttcaatgttgtgcagccaattccctggagttcgcatccattgggtccattcattgcactgaagttggactgttcaagcgggaaggtgtaggagcccacgtcgttgtcggagaagttcggaatggtcattgtcccagtgacaaagtccaattcagcacaaccgaatcgatttacctttttttttttttttattcattattttttatttattatattttcattatgtttttatctatctcatctctctaaacctcatttgcatttctcaatatttctctctcagaatttgcctctctttctctctctctctctttctctctctctttctctctctctctctttctctctttgtctccttattcccttttacctctctatacacattttttctctctctctctctctctctgattctctctctctctctttctctctttgtctccttattcccttttacctctctatacacattttctctctctctctctctctctctgattctctctctctctctctctatctctcttcacaaccacacaaacacaattaatttgatcactccatttgtggtccatgctgtttggcctgcaaacaaatactgcggctcattgctggttgcagtttggcgtttgaccataaattttccaggtacagtttcatatttgaaaaatgtacccaatttgagatggagtacggtctaaaacggataaaaaatttagttttttaaaatttattccaatatataattttaaatttatttaatttttatttatttaaattttatcatttaattattaatttcattatgtttattagaccttttttctagcatgttcaaaatcggctaacatttgaacagcatcttgtccaataaaattttggcatggctcccaagttgtttgattataaccgctccagcaaacgtgccactcatcgttgccatacgcattgattcggtggtcaattattcgttccagctaaaaaattatgaaaaagcacataattactaaatatataattacatttttatttgaaatttgaaaggatattaattttaattttttaatttataattaaaacttatattattgacctcataaatatcatctgcagaacactcttgatgaagctgagcatgaaattcttgctcatgaggaaaaatgagttgttgttgttgttgttgcgtaggaggaaaagcgttcagttgcggtaaaacataagcctccatgtgttccgcgggatttgtttccatttgttgcggcacgggtggtggcaaaggagggtgaattagtgattgaatttgttcaatttggttttggcaattgtgcaattgctgttcgatcaaatgaatgcggtcattgtttggacattctccctaatttttcatctcatttaaattaatttacattttttatgattttaaaatctcacatcattttccatttcatccacaaaattgtctacaaaattgtctaaataatataatataattcatttaactaaattaaattcagtacttaaatccataaagtcaagaagcggggaaactgacatttgaagtaatatttgaacggctaaatttagaatgagaatgaaaccgagcatttcggggcttaaatatcatcgagaattaattttcttaattgtttatctattaaaaatgtaggaaaatgcaaaaatattgttgaaattgctattgttgaaattgctattgggaaaacaagcatcaatggcaatattgtgaagccaaatgttattgtcattgacctgtcatatctctattgttacttactgcgcggcatttggggagagcgaatcctaatattaatgttccagtgatttggtttggggaataggtgaatttttgttggtgaattaataattatttacctccanatgatttattacatttgatatatttgcaaattaataaattttattttatttattt

SEQ ID NO: 5976 - DNA, 1896 bp, Heterodera glycines
aaattaatttccattttttatgaattttaaattttcccattgttttccatttcatccacaaaattttcttaccaaattgtttaaattaatataatataattcatttaataaaattaaattcagtacttaaatccataaagtcaagaagcggggaaactgacatttgaagtaatatttgaacggctaaatttagaatgagaatgaaaccgagcatttcggggcttaaatatcatcaagaattaattttcttaattgtttatctattaaaaatgtaggaaaatgcaaaaatattgctgaaattgctattgggaaaacaaacatcaatggcaatattgtgaagccaaatgttattgtcattgacctgtcatatctctattgttacttactgcgcggcatttggggagagcgaagtctaatattaatggtccagtgatttggtttggggaataggtgaatttttgttggtgaattaataattatttacctccaatgatttattacatttgatatatttgcaaattaataaattttattttatttattttattttttaattttttacctcctcagggattttttacctcatggattttttcactttttattggatttttttttcacctcctcaggtattttttcacccttcagtgatttatataaattattattaggtgttttttaaagtttaaatttggtactgaaaagtccctttccattgggactgaaatggcggggctgaaaattaacccccaaaatctgcatgggtaactactgttttgatcgtctaaataattttatttattaaagaatcaagaagtgatttaatcttctgaattttatattaatgttttactatgtttgaaataagtgaaggcagtttgatttatttttatgtgaattcacagaaatttcagaacacttgccgttggagcactcaaaaatatcttttttgatcattttttctttaaagttttctaatgaaattggaataatatttttgcatgtattttttaatatattattttaattttattttatagtaatgataatttatttgtttcatggtttaaaaataaataaattatttatttgtattaatttcttatattggtatagatgtttgacccattagttaagttgggaactaatcgtgtttaatattttttatttgttttttgtatattgaagttgtcttaaaatttataatgggacagataaattattcatgtccccctattatttttattttgaatttttttatttttatatatttttaacaatgaataaatgaatctttcaaaatagagtttttataaaataatgatttagccttgccaaatgaaaatattgttatcctcaaaatgctaggtttattcttcttttataaatttaaaatcgagctatattaattattttaatttgttttttatcaaagatgtttctagttaggcatcgtccattaatttatttttcaagttgaaaattgtctttctttgaaaaatctttctttttaccaaagttccttaagaatggtttaccaccaattaatattcaataatttctttactaaatttttaattaatttttttctatttctaacttttttaaaaattttaatgctttcatttttactcattaaattatcattaacttgctagcaatcaattcattaaaatttgtggtaaagatgaggggaaagtttcttaaataaaattttaaaaattattcagtggaaaaatatctatggccatatgctttttacattaaaaaaataaataaaatttatattgaaataatgttatataatctatttgagaataaatagaaaactggatttttgcgaatgcgaaaaatgcaaaagattgtgaaaatggcaaagcaggataggacggaatg

SEQ ID NO: 5977 - DNA, 2884 bp, Heterodera glycines
agaaatggggagaaccagcgcgaaaaacgacaatacgacccataccaaaaatggaccgaatccccgatcaaaatcgcattcaacaaaacagctcgtaataatcttgccacatcatacagtatttgaacaaatgttttaagtgcctgaaaattatgacctctggggcaatgccatcagagctggagcaaaattaattatgtatgaaatgatgggttgaattttttgtatttgagaatgatctttttaagtttggttgatttcggagcgtttgtcggggtttcagcagagttttttatacaaaaaatggggggggggaatggaaagccgggagttatgaggaccagtgatgccgcgggttgagaaaaatttcaggttcgggtttcgggtcgggcactcgaaaaatttcgagttcgggtttcgggttgagaaaaacttcgggtctcgggtttcgggttcgggttggcatcactgatgaggacgcaaacccgaaagctcaattaagcaaaagcgacaaaaagtgccagaataaagtggacagacagtgaatgctgcgaatttttaaaattttcattttccaaaaaagcaaaaaatgcatatttttaaaattcatttctctttctataaacagggaagtcacctgtgttcggtttgaaattgttgatgaaatggtgaagggacagaatggcattgcgattgcagatgatgagcttggcggtattatcgtattattcatatatttttcacttgtcccaattttcattcataaaatttggcacattttattttttcaaatttttattaattttacccatttttgtagcctgcggcgtgtccccagtgggccgtggcggaggatggcaattccttcacctggcaatgactaaccgacggtgcacggatgtaattttggcagcacttaaaatatttgcattcattttttgcctctgttctcccattttgtcaatgtttattttcaatttcactcccatcgggattgaaaagccgggatttaatttgaatttaatttgaaactgcttaaggtattcaatatgtccgtcgttgctggccatgaattgatgcacgcgcttggctttgtgcatgagcaaagccgaagtgatgcccggaattacgtcattttacggaaaaatgatggagtaattaacaaacatttcaatataatttttcatttgctcattataaagtattccaaaattgaccaatacacgcaaaactttggcttcgcttacgatttcgggtcggtgatgcattatgaatctgggggcaatcataaaaagtatgaacggttggattttaattacctaaaattggaattaaagaggcttatacgacctgatcactttgccacgcttttaccaacaaacgattggccaacgcgaacaaatctctttcaaagacgcggccataattaaccaaatttattgcaaaggcaaaccaattaaacataattaagtaaattttccatttgttcagactcatgcaaaggccatgaggacaagtgccaaaacgggggctatttgaatccgaatgattgcacaaaatgccattgcccggacggaaacggtggccaatactgtgccgcactcgaagagagtgagcaattaatcaattcaacaattaaagcaattataaataaatttgaagatttgaattgcgaggatttgagtggaattccgagagaattggtggccaatcagtcagcagtgttattgaaaacgaaggccaaatatgtggggaataagccgtgccgatgccattggcgaattaaggcaataaataatatttttgaaaattttaattattttgagtgttattaatgcaaattttaattgcttttagcctgaagcagggaaaaaggtgcgaattcagttcaaaagtttgagcaatttgtttgaatgcacacacaactgctcatcggcgtatgtcgaggtcaaataccgagccgacaaaagagcccaaggcaaaaagacaaacaattaactaattaatcattaattagcaaaatgatggctcattaaggtgccaaactttgttgtgccgcatcactcactgatctgaacgcaaatgaatacaaaaattggattgaggcggaaaacccggacatggacattgtcatttccgcgcacctttcaacaaaatggaccgtatcatctaccagggatcacacggaattacgacgatttccgatcgccattcttggggttggaattccgatttccgaattttttgataaaaattcagaaatttttggaatttttttttaattagcaatttttatacaatttctgtatataaaatgcactgaaattttgaaaaaattttcccggcggcgcctttcggccttgaaataaccttttatttggttaagaacgtattcaaactgacgtatgaatcaggcaaggaaaattgaaaaataaatatttattataccttttaaattttttaaaaattaacttattttaacttgctttcgttttaaatgctttactaatcagaaccattacaaaatggaaaattaattgttcaaaaatctgttaaggcaacgccaaactcataaattcgagcaaatgcatgaaagccgataatttgtttgccgagaaaaggaaccccggccacagaggtttcacgtgttatgacgaggtcaaacaccaattttatgactgctcctgtcacggtgataagaaatgcctcgctgaagaaaaatgggcacacgacgcatttctttgccaaataataaaggcaattaattaattaattattaattaatgccaaaagacaccgccacataaacatttcatttgatacataggcaatttaatattttggcattaaaaattaccattttttgtataaaaaaagcggaaat

SEQ ID NO: 5978 - DNA, 6979 bp, Heterodera glycines
aaataaaaaataataaagaaaggtaaaggatcccattttttaacccttggttgtaaaattggactaacaaatttggcaacgggcgggttgtacaaatttttgcaaatcgttttcagaataaattgaaataatttttaaaaaataaaattaataaaataatacatttaaatatttaattaattgccttttatgcttgacaaaaatgccaaaagtgtgttctcgccactgatcactccgccatgttgggccgcaaattctcgacgtgttcttgtccggaagccattctcgccaccaatttcacactcaataatgtgccaattgtgaagccttaattaatcaatttattattaaaatttaaaacaataaatcttaattatggcaatacattggatcgacaatcagtttgacccgtgtgttatcaaagcccaaattatgcgctgcaattgcggcgcatgccatcgcattgctaaacaaataaataaaattctaaaatgatcaaagtccaataaatacaaacttttccaaaaataagtgaaaaaataacaaaataattattttattggaaatttttttgtgtggcaaataaactgaaaaagccgtaataaatgttgtgtctccggatttaaggcaaaataggaaattttaattccactgatatacaaaagtaaaataaatattttggtaaatcatacacattatcaggcgccaattgacagatttgacgaactggtcctgttaagaattaattacatataattaaaatattaatttttcgggaaaatacatgggaccagagcgtttgggcccccgtttttgggccccggggtcgtttgggcccccgtttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtgcattctgatttggacatttttcagaaatggctaacccaattgcaaccaaaaaacaaaaagtaaaattgtcttacgaaggccgcctttacaccttcgctaaaatgagttctgatgggatgacaaaattttggagatgcgagttcaaaaaatcaatttcacattattttggagtttctccggggaatttctcgcaactatcgaatgaacccgtgaatttctgttaatttttacattttttattgttaaaattattgttgaatttatttttaaactgtttattttacatttttatgctgaaatttaaaaagttgtttttactgtgatttttcatttttctgtacttggggcccaaacgaccctggggcccaaaaacgagggcccaaaaacgggggcccaaacgaccctggggcccaaaaacgagggcccaaaaacgggggcccaaacgcgggggcccaaaaacgggggcccaaacgcgggggcccaaaaacgggggcccaaacgcgggggcccaaaaacgggggcccaaacgcccccgactcatatatcggaacctctcgtgcggttccgagtgtcgagacaaaaaatcataagttattaatgagtaaaaaatcaaatcccctatagcatatttttacattttgcttttcctcgttaccagtaccgccaaatcctcctattaaatttttgaaaataatggtgaaaataggttgggctagatcatcgttcaaaaaatttttcctgctcaaaatgtataaaatatttctgaaatgccgatgcccgaattcttgcaaaagttcaaaactcttacgccgaccttcctaacaacgatgatcacaattattaaccgacatccccgtaacattgagtatatgaaaggtatttcccgaaattatcagatgaacccttgatcattctttgtattttttattttaatattgatattatttgaaaaatttgttactttcaataaagtttttttgaaatttgaaaaattatttgatttatttggggccgaaccgtgggggccgaatcgtaagggccgaactgagttagaccggtatatataattattaaaataattttttgtttatgtaaaagcaagagatttatgggaaattggcttctttttctcaaaatccttcaaaattccaatttttccccgttgcacgatgaccaaaaaactttaatttctttaaaaaaattgttcgaaatcacaaaatttcgttttttagaattcttctagcaaattgcacttaaattttcaaaaattttcccggcggaagcgcctaacggcaccgcccgctaggaccccccccccctccccctctcccccttgtttcccatttttagaatgagagcgccaaaaaaaacgtttgaaaaagcgcgtcacaaaaagatgttaaagcagggttacccttaaaaatttcccgaaataagaacatcgttggtcacaaataagattttagggtcaaaaataaggacattttttaaaacacgctgcgaaaactttgaatcgcatttttattcaacaaaatcaagcattactcagctaaggatagggtagcggctgcctagccacagctaaaattccttatcctcatcgaggtgaggatagttgagtatagttcacaaaaaaaataataattattaatataaaaaaaaaataattattaatataaaaacaatttataaattttctataaattttttaatgattttttccttcttataataaggattaaaaaactatgaaaaatagttttgtgtaacactagctcgggctgcaaaaccatcaccggcattttcttctaacataatttctgtttctggttgttcatcaaccagatcttcctcatcaaattcaggaacaccccgcatgattgcaatattatgaagaacagcggctgccacaataaacatgccaatattttcaaatttaattcttattggagtttgaagagcatggaatcttttcttccatcgcccaaatgtctgttctataaggactcgtgttttagtatgagcattgttataatgttgctgcacattagtactggggtttgcaaatggcgttaaaagccatttacgacatggataaccgctgtctcctggaaatatttccttaaaattttactcacccaataaaacacctcgtattcgcctgttttcaaaatcttcccatacagatgaatgacgcaatataaaactgtcatgagtcgacccaggccatttacaattaatgtttaggaagcggcctttttggtcaacaattgcttaaattattatttaattttttttatttattttgcgtgccttgcacatttatgctggcccagccttttcggttatagtaatctcttccatgttgggcctcggatggcattaaaataggaatgtgagtgcaatcaattaggccaacaacaatttgaaatggaaaattcaaggcgatgtcttaaggttcaattattccatgatagacggacataattactttttgtctttttgtgcgtcctctttaccagtttggcggatatttttccaacgagtttgcacctgctgaacctttaggcccccggaggggacatcgagagggaattcggagtttaaaatctgagtaaccgccgaccatgcttccttttgcattcggcctgcgtcagcatggcgtgagcccgggaaaagttggtcttttcgagcttggataagctcaagcaaacgggcattcatttcggaagaaaacaccatttgggaatatatttaatggatcgaaaaattatgatgaatagctatcacaatttaaggttgttttgatcaacaattacttttttatttttccggaaaacagccaacggccaacatgttctatcttattcatctttgatgtctctttatttcaaaattctctttaattacataaatagtggaaaatgtgtgcgaagggcagctacggataggtgtatctgctagtgctgttcgagaccaaaaatttcccgagactcgagaccgagactcgaccccgagaccgagactcgaccccgagaccgagaccgaaaaccccgagacccaaaaaacccgagactcgagacttttttcaaaaaattttcctattcgcttaaaaatcgttaaaaacattttttgactctattcttaactaatttttggtttttttttaaattttgattcagttggtacaatatttatcattccaaaaacgcacaaaacaaaaattcattaaaatttaagtgcaatttgttaactgatttagtccaaaaaatgaaaatattttacgaatttaattgttaaaattatgattgaattcccaccgaaaaatgaataattttgaaaaattagaagaaaaacaactacttggaggggaattactttttttaaaaattttcttatttcttaaaaattatgaaaaattactactacgtttgaaataattgcatttattcaactgaaaaattatgaatcaaaattaaaatgcaaaaaaaacagggctcccagattaaaagtttcaaaagcctcatttggtatgcaaaaaaagcctcattttgagtcaaaaagcctcatttttacaactttattcaaaacacgcttattccaaaaaacttttggggaacaaggggggccggcggtgccgataggcgccgccggggaaaaaattaagaattttgaccatatttttagcagattttcattgaaaaaattcttaattttgtgaactttggaaaaaattggttattttctggtttttatgaaaaattaaacaaatttttttggaaaatttgggtgagattttcgttttttccccaaaagcctcaaaaatcctcaaaatttctcaaaaaaccacaaaaagcctcaaagcctcatttttaaaatttagcctcattgacctatcaaaaaacaacaaaatgaggctaaagcctcagatctgggagccctgcaataaacacactaattaatgcttaattactgccacctcaaggggacggacacaaggcattgtcggattgggaactgtttgagcttctcccgacggcgccatggctccgaaaaacggacaaaggcccctgggggaaaaaaccgccggaattgggcacaaaaaggaatagagcggccgcacttttgatctgctaatatactataattacagttggaaaagccaccaaacttattatttgactcactttggccatatcattttacaattaaatttcaaaaattaaaaaaggaatttactaattggcacttccatttataaacaaaaagcacatttcatcaaagtttaaagcaattaatatgtctttttgtcatttcattggccgtgcctttcgagtttcactttgtttctctttcttttcggcttttcatccttccgccgtggcttatggcgttgtctgttcgtggacaaatttggtcgcttcatccgtcaattcttttgcgcccggaaggacacgctaaattaaaatgctttgaaaaaataaaattgatatttcctttctgtttctacccctctctctctctcccctcccctcactctcattcccacacgctctctctctctctctctctttctatccactcctctctcctccccctcccatctccctcttctcctcactctctcaccatacctcttcaacaaatttgccagcgccggtgtcttcgttgatttggctggctttggcaccaacatcgttcgcaacttcctttacagcttcaaccctctctttgatggagtcgatgattacgccgccgtttgagttgcgcatggcgcagaaaaagaaaaaacaaaatgccaagaaaaacggacgcattgtcattttggcaaatttaaaattcgtttgggtctgaactcaaaaagttcggcattttatgtacaaaaataaataattaagcaatggcataacaaatcagagaaagacattgctaaaaagagagaaggaagggaaaagatgagaatgaaacattaatagacactgcacacgacagacagtgagagaaaagagagaaataaaataaaaaataaaataatatttaattattaagcattgctttatataaaataacataaatgcttcttctacagccttaaataaaagaaaatgaacaaaggtaacaaaataaatgtatgaatgattcatacaaaaaacaatgaatttgccattttttgtaaatgtttcttcacatttttataataaaaatgcattctccgaggaaaagccatcggaatttgaatgagtgagatgaaaaagcatcgcagaagaagcgtttttagcgaaacattattcactcattcattcattggtgagtcaatgggcaaaaagcgaaggaatcggaaaacgaagaaaaacgatgaagaaataaatctgtgaattttaaataaatatttaatttaaatttcaaattaattctcttcgtaagcttttcatttacaaagggagcagtgaaacaaaagccaaaaaagtgccaaaggtaaagagaaaaggcaaaagcagcagcacacgctttagcccgacttcgccgtcggcattaatccgtgaaaatatttttttgctgaatttcaattttatttttaaataatttccaattttccctctcttctgtccctaagttttgagcatttattccaaatggataataataatcgcgatttttcgattgttttcctatttttcgtccaattcgatcactttgtacttctctttctcctgcggtccctcaacagaaactgtcgtcgttttctcatggacccattccttcacttcttcaaatttctgtttgatcgttgggagcactgactgaaaaaaacaaaacaaaaatttaattaaaaaaataaacaaatttaagccctaaataattaattttaaagtttcttcactaagaatgccgaacttttataccggcagcagagcctatcttttccaaaaagcagtcat

SEQ ID NO: 5979 - DNA, 2038 bp, Heterodera glycines
gcattgacttgagcccctcactaaatttgtcgcttattccctccagcaaatcctcaaacattccgccggcatttgaacggtcgacagcgcaaaggaaaaaaaggcaaaacgccaaaatgacaaagggacgaaacatttagcgcaattgaaatgatttaaaatataaaagattcaaatataaactaaaatatacaaaaaattgccaaaaatggataaacccacaaaaaatgaaaaaacatatacgaaatacaaaaacaaaaccaacaaatggctaagtaattttcggaaatgtaaaattgtcggggagtaattctatttgaatttttttacgtgattttaaattgttaggacacttaacgcaattaaaataatttagggaaatgataattaatgctaattagagaattggacacttttgcattgtttcttttctttgtttgttgtgagttattattctccactgttgtgttctttgcttattcttttttttgctaatgagtgtttttgcattcttattttgctaatgacggagtgctcaaacaaaacaacacattactgcgccggaagggcacttaatgatcggctaattgcaacagaaaaacgggacagacatttttacaatgtccaacagaagagaagaaagaagaagggcaattagaatttgtaatgaaaggtcggcaatcacttatttgtataataaaagtgaaggactttgaactggcaaaagtgaagcattttggacccattagccggcgggaaatggccatcattagagggaaaaggccggcggattatggccgagatcgattggatcgacgaatatttggggaagaaagtaagcgggggggggggaagttagaggacgcgaatttgtggccaagagggaatgatttggcaagtctttcggaaccaaacaatttcaaaacaattgacctttgatgtgggccgccatatttgctgtgccatttaattggccgtccgttcagccgcgatggcccgccggtccatccttcgtccaattagaggcctaattgatcaatcgcttggctttcctccttcacaatgttttctgatcgcccatatttcaattaaaaaagtgataaatttattcgaagaatgttcaccattttatacgaacaaatctgctcaaaatgggctgtttctcggcaatttctaccatatgatttggattattttattatgataaaggggagaaaaacaaagacaaaattttgtcctaaggaatttcttatcattttgccctattcttcttttgtctgatcgccattgaagaatgaatatccgcgccaaaattggcaatttttctggccaataatctgatcaaaaaaacggattaaaaatgaaaacggaaaaaagaaatcacaaaatgataatgaaaatgatgataggagaaaagaaagcttcttagaagtgtttaatttattgtaattttcaaataaacataaaaatgcacagagaaatggcctaaaaatttcattgaaataaatttaaaatattttaatttcattttgttacattattttattaattgatctcacggcacatttactcgcattttcagctttctattcgaaatgccctctcttaatttgaattacacatcttaattattcacatcctaacaaaaatagaaacgacgaatttgtgtttgttggtcaaggacagctcaattgaattcaattttcagcttttcggatcacggcatgcagcagcagctacggcacgagacttaactaaatgtgcagcattggcattgttgtgtagcatccacaagcagtacaaaaagcaatccaacagcaacggctaatggaacaagcagtggcacccgtgcaaaatgccatagcaacacgcgtggcacccacagaaattggtcagttgcatatggaataagttgaaattttacaggaaaatactttgacataagagctatcagaagagtgcaaaatttcataaaatctcatgcattaagaattttaggttcaaaaaaaactagaaaataggtgctaataacacgaaa

SEQ ID NO: 5980 - DNA, 2434 bp, Heterodera glycines
  misc_feature (36)..(36): n is a, c, g, or t
  misc_feature (98)..(98): n is a, c, g, or t
taaaatcatacaaaaataaaaatgaatccaaatttnaattaaattaaaaaacaccttcaaatccctgtgcacatgttcaattgtgcagatatccacgnccgaaataattgccaaaacttttgctttgccatttcctcgctgagttttttttgttttgaaattaaatctgaaaagaaaatgcaaatgcttttttaaatttaaatctctgaccataaatttcgccgtttggtgcgtattcagtgaccaaataaagcatgttgttcgtctccatcaccttcaattgaattacaaaattaagcaattaattaattatcaatcaattagtaataattgtcctcaatttgtcacctgataaagtcgaacaatgttcggatgtctgaatttcttcagcacatcaatttcgcgataaatttttgaattacctaatttggcatttcgtttgaactgcttgaatttgaatattgtgcacaacaaatggcattgaaagtgttaatcgaactcctcgctgacaaaattttcactaaaaatttttacgcattcccaaaaattcaatcaattaaaaaaaacaataatttaattaaagtagcctggtgtaaacagacatatcacttatttcttttctgtcttcatctctgcaggcttttctcccaccaatatatcgattttttatggtgacaattttagttgtgagcagatagaaagaaaatggagaaatagtgtgggctagagaaatcaaaaatatttggaaaaaaggaaggaatcaactgaaatatgaaataaatactaattttcgcttctcttaaaaggaggccaactgcctttttgttctacggttaaagtggccttaaatggctttaatctggcagaatttttcgtgttaagaagagcaagggaattaaaatcgcccaattttatcagattccctcagccaaaattgaaatccctgaatttcaagaatccggaaaaaactttgcaattgttgagaagaatccgagaattgaaacaatcgcctaactttgtcggatctttcaggcaaaaatgctgctttaaaatttcccccatttcatttcccattttaaatcatttttctatgacaaatttggaaatttaccttttagaaattgttacaaaattaatttttttataaattgattgacgtacgattgaattttgcattttgtgacttttttgtgaattaggtaaattcccagccctacttataaaatgtattaaagtcaattaatttaagatattgccgactaattcattttccattattaaattcatcattttttcataaaatccggcataagtatgtgttaatgtgaagtgtacaccacataataaatattaaataatctttatagagcatctcatcaaaaaaccatcgactttgaaaagtgctaattaagtggtctaaattttctcacttttgatgattttcaaagtttgaagaaagtaattgagttagttttgagcaaaacattttcaattggcaaggtaatttaaaaagaaaataggtcgagtggtttgatgaaaagcggcaattctttccaacgccaatttcgaatttgtttttacaagtttatgaatttaatacataaaaataatgatgcaataaatttatgacaagtaaatgatttttacatggaatttggaagaaatggactagggaaatgaagataaatgtgaaatgaaaagtgaccaattagcagaatgatggaaggaggggagaataaaattatatcaaatttattagtatcaaaatgccaaatggcatcaaattgtcgtttattggcaagattccgtgttcctccgctcattttccccattttcatttgctgtccgtcgtcgtcggtccttgcggggcgggcgagccgttcaaacgcaatgaatcgtccgacactttggcgcttcgttccaacaaatcgtcgccgctttccatgcccgagtcgtcttcctccttcttctttgcttctctttgctcctgctcgttttccttttcctcctttttctcttcctcctcctcctcctccgcttcgttccatcgcatttccgttctccaccaattctctgccactgtgccggccaacttttgtctgaacgcgcggcccatccgatcactttgctccttgctcatgtaattcttccagtctctgctggtgcccttccgaacgaatgactcgccgtttctgaaccaatggatgtggtaagaattttaaaacccccaatttaattcaaaaagagtcattagtgatgggcatgactcttacaattagcattagcaccagccaaaagtccccaattttattttattttatgttttagcccctaaatgatgatttctcattcccataaatttctgattcccctcccccccccccctttttttcagttggacttttttctaccagggccctgccgggaaaccatc

SEQ ID NO: 5981 - DNA, 3925 bp, Heterodera glycines
  misc_feature (23)..(23): n is a, c, g, or t
ttctggcattttttgaaatattntggaggactttgacccgcccgaattggattgctgaatttgttaaaaaaatttatattttgtaaaatatatgtagtttttcgggtgtaaattcttagaatatatgtgcatttgattggtcctcccgtccaattaatctatgactgatcggacactttagccaatgagcaaaattcccatgaaattttgttcattgctatgctcaaagctgctgaaatggcattttcccaacacgtgttgtacataggtgagagagagaggcgggagagggaaggcggaggatggcacggcgaaagtggcaccctttccactgccaaaggccatttatataggggtatccgcccgaggcaatgtgccaacgtcagccaaagaggagatggcacagaaggggcgggaacattccattttgtccatatgcaaaattaaacatttgaagagggaggggagaggggtttaaagcaacgcgggcaaatccccaaagaaaatatagcacataaaatagattcaatcaaagaaaagcgcatatgttattttaacttatccatagctaatcttgttgatatccaccagtggtaactgaataataagagcattttttaaacagacacaaaagaaaataccaatattttaattgaaatttgaaattaaagatgtctatttacaaatccaggttagcaattaattaactaaagtaaggccgtaatagcatttcatttactaatttatttcgctgctcctatttacaaatatttactcggtgtccttttgtacttacttagccaatgggttgcctgccatttgttcaatggccttgggttgaccaacgattgactctgctcctgatgctgtagtagtttgcgtttcttcgacaacttcatcatcatctacaattacggcatttgccttgtccgattttctgcccccccggcattggaatggtacaaaaattgccaccatcaatcacttcagcacttcgccacataacaataataaatgtttttgttgatgtttttatggatattattcagttggtccttgcatgaataacttttaaaaggaatttgtatttggaccaaatagtcttacacagcgtaataataactgccgaatcggtaacaaaacacttcacatggaatttatggaatttgtttatccaagaaatgtgtaacaaattaataataatgatcaggctgccataattttcatgtttttttgtgcatattttgcgatttttgtgcatatttttgacagccctgataatgatgacaataataataattatcgtaattatcagtcagtctttttggccgtgaattcatctgctctcgcttttgcttcttctgctgttgtttctgtggttagccaacatttgcggaccgacatttgtgactaaattatcaaaaaaaaagagaaaaaaaaattaaaatgaattttcaaataaattttcgtaattaccaaattgaaataatgactgaaggtgataattaaatagtgcttcttgctaaattgattaataaaatgctttatacaaaaatcatatcacaaaatatatagcacgcaaaatttttcgtgtttcacctactagccttagtctaaagagcttagattttgatcaagcatacctaacaattaatatcaagaacaaataaaagatataaaaatatatttttaaaatgaattactcacattatcaatgacaacataattcttgtaaatcaggaatttataaactaatgcattgcacaagttgatcagatcactacttaaggatgatatgaagtgataaaaatttttagcaccaagaggaattgaaaaaagaactttttggaaaaactttataaatttttcatattttcattcgcattaacttgcttaactccgaaaaatcacatataaaattcaataatattcagatgatcatccaatttaagaaaaaaaaatttttttgaaaattaaatccagaaattatgacccgcaaaagacggtccgcaaatgtcagtccgcaaatgtcagtccgcaaatgtcgcactacggtttctgtccaattttaattttcatttccgcctcttccggctttttcattgcttttcatcccctcccccgctttgtcccccattccaatgaaatgagggatgtggattaaagtcattaaaccactcatatacaacattctaaagggattaaaatgatgaatttttgtggaggtggtgagttttggcggggactaaaagcttatccgttcatccaggatcaaaaacaacggctgtcggtgcggcacgagcacacggaaagcaaatgaaaagtgcagttggaccggagagaaaatgtgggacctattttgaaagaaatctattgtatattgaaaattttatatgaaaggaaaattgattgatttaagaaaggagtttccattttcacttgtccttattcggagggaccggaccttaaagttcaaaaatatcattttttgatgaaaaaaggcattttgaatgtttgaagcatatttcatattttaaacccaaaattttattcttgcaatttttctataggaactttgattttatcccattcaaaaactcattatattaaagtaaaatgaagcaataaaactatgtctcattttttcaaaaaatacatcatattaagaattattatattgtagaaatccgaaagatttgtctttatccaagagcaattaattcctttgtgtgtttttttgaaattttcttgcctatgtatttcccattaattggggtgtccctaaaaattaaaaatgagctgaaaagaagagaatcgtgtacgatgctaaaatgtccgaaaataacttaacagaaaattatatcaaaatggcaacttttcatgttaaaatttggataggcttaaaatgtacgcccatagtcgagagatcctatgattggggaacaaacattatgtgaattgatggagtggacaaaattggaaatgcacacaaatggaaaaaagaaaaagagacgtaaaaaggcgcattaagcaactttgtcaaaaaaacgaacaatttgtaaagcagatgttgtttggtttttgatgtaatattggagccgaccaaagatggtaaaaatttgtgagttcatgctatttttataactttgttctgaaattttgtaaaatacattaccgtctcgacccatgttttttttgaaaagttaatatcacaggaccaaaactaaaaactgcttaaagttttcaaaaaagcacttaaaacaaaggaaatgcaaatcccactgtaccggctgcacatcgcatgagctttttgtgaccgggtcccggcttttgtcatttcatgtttatgtttttgtttgttttttaaatgccctattaaaattttggcattgtacggctttccttattgaatttgacacttcagtagcaaattttttcatttaaatgaaaagcgccaccctaattagcattttaattttaaaaatatttgtattttcaaattcctttctatttatttgcagattttggaggattaattccgtgggggataggcatctcggatgatgggttgccaatgccttcgacttaagctgttagccattttcagtgttttcaaaaatatgccgtggtttattgacaacaaaacatgcccctttgagtggagtgatttttgaaagcaaaagcattctctgctttttgtatatcgcgagggatttggcaaggataaacgcaaaagggatgagcatatgagcaaatggcacaaaatatttatttacaaaaaataaaataaaggaatgacattttaaaatagcaaaatggaaaatagaaaactgcggattttcaattggatgtttttcattttatgtcttaagaaatgtcagaagaatgacttggaaatacctaaatttttagcaaaagaaaatga

SEQ ID NO: 5982 - DNA, 1677 bp, Heterodera glycines
cgagatatggcctgtcaaagcagaacggggtcaatgaatttgaattttcgttaatcttcggcagttgcctttatttcgagcctactatactagtgcatcttttcgcaatatggctctgcttcgcgaattattgaactgtttcacgcctgattgctgagataatttttttttgcgattcctttatctccaagcatgagcgttataagtgattgttcatatccttgtcttgaaaaaaattgtcagtaaaaaatcacgttttctgaatattaacaacaagaatttttagacagtttctaaagagtaaggaaaaaaatttttcatttgcgtaatatttatttattctgttgtcctgttggaaatgcagctgatgctgtcggaaaatctcagatttgtaggggaagtttttttcgttcagtttcgacattgattgttgaggcaatttttttcgacaatttcttttgtctacaaacattagttattgcggttcatcctgtagtgggtagagacttttcagtaaaaaaaaacttgttatccgaatatgtgcaagcaaaattcaagaccatttccaaagaggaaggaacaaaaatttttgcctaaattttatattatattgttgaattgtttgaaatgcatctgttgtctgccgtttcgaaatttttcaacttgtcacgaaaagatttagcagaaaatgcatggatcaaataaaaattaaacttctattatgatcacgccggaccccgcacccaatgttccaaaaaagtttttttgaaaaaactcgccaactgaacgtctcgccaactaagccaaattcggacgtttcgccaactcacccaaaaaatgacatttcgccaactaatttcgccaactggactaaaacctatttttaattgtggaaacaataataaaaattcaattaaaagtgcataaatgaatgaaaatctttatattataaaaagtaacaaaaaacgtaaaataaaaaatttcaaaagaaatttcattatataaaaaacgtttaataaaaattttaaaatcaatttccatcgccatcatctgtttcttcgccactatcttcatttccacggacgtgaagcccctccacaaagccttgcatgacgagtccgagcagatttaatgtatttgccaatccttcttctgattcaaagtcggcctcgtcaagaatccgcaccacattctgttcctttatgatgtaccgttgcggacgttttctgcttttctgaagatgttctgcgcgtccgatgtccagctgtttgtcgatgtcccttgtgaatgcagtaatgaagtcactcaatgaacgatgatattatggatgcctgggacactgaacgctaaaattgaaaaaaattcatgacagaataggtgcatttacgagttgtgcttagagtgcgacgcagaagaaagtgtccgacatcagcatgcggttcaaatgcctccgccccgcgatcaatctcaaattgagtggtgccaatgtaggttttggcaaaatacgccagccatccttgaactccaagcggtgccgcgctgacaatagttgaaaaagcgcgccgaacgtaaagtggcggaatgagtgccaaagagagaactgatctgattttgaaaaaacaaataaatacacataagctaataaaagacacctgaatgttttgtgaacggatttcc

SEQ ID NO: 5983 - DNA, 4841 bp, Heterodera glycines
cggagtgaatttgttgcccttgcgctgattcagagacatttcatttgattaatcgtgcaaaatgataagataattgataatccatcagtcaatcggtcgatttccattttttatgttcgcaatttattcatatataaataattaactgatttaattttattttcactcaatttttgggtttttttctgttaaagtcaaagtcatttgccaattgtacgactattaaatttaatgtctatcattttggctcaccttttgtttttgcgagggattggccgaaggaatttggcgttaattaccccaaatattttcgatgaatttgtgcaattaatcaaatcatctgacaatgagagaatgaatattcgatgagtttaaagatgaaaaacaaatcttgcgcatttatttcccaaccaaaaaaaagtttttttttaacgagaaatggccgtacaaaaagacgcggcaattaaagggaaccgattttaatattatctttattttattagcaaatatttaaaataatttaatatatatttttttaaaagatggaaaagtcagtgatttcattgtgttttttggttgggttggcatttcttttgccgtccgaagcagcattcagcaggtggcagaataatgaagcaaaaacaattaaaattcacaatttttgttagcatgcgaacgaagcgaggcggcggaatgggcggagggatgggcagcggaatgggaatgggcagtggcatgggaatgagtggcatgccaggcggtggcatgggaggaatgagtggtggcagttacggaagcagtgggtacggtggaaacagtggttacggtggaagcagtggttacggtggaaccagtgggggaagttacggtggaaatagtggatatggtggaagcagtggaggaagttacggtggaaatagtggatatggtggaagcagtggaggaagttacggtggaaatagtggatatggtggaagcagtggaggaagttacggtggataaggtggctaacaaaaacaaatgcctattgatcaggggagatgatttctatttttgtggtttattattgtatttgcttagtgcgtaaaatgtagatataataaatttgaactgctattttgaatggattacctaatttaaatcgagaaaagtctatgcaatctatcgaataaaatccctattttattttaaaaaatgttttttggaaaggctaatttgttttgctttagctttagccggtacgatatttaaatagctattttttcgtgtttttccgcttattatgataaaacattcattccgttttatttattaactggtttttaaattacccccccccccacccctcccatttgtgaactaatttttgtttttgttctttttcttttaaatgatttgaatttggttatttgggttctgtctgatgaacctacgcatttttcaatgaattaattgcccaaataaacccattcttttcactaatagtttttctcatttttctccatttactcgtcacaattttcaatgtttttaaataaaccaaaagatcaaaaaaaaaatagacgcaataaaaaaataaaaatattaagccatggaaaaactgatgctaattttttacttcttatttgtttcacaattttttgtgccaatggacggagccgaagaaaaagcggacgaatttgggtaagcaatataaagccgaacatcaatcaactcgaccttttttttgaaattttacgaattcagctttttcaaaatcaacttattcattaaccccatttcacaataatcgctcaaacacattccttaagtaaatcaaaacgctctggcggatacggtggtggaagttacggtagcggaagctatggtagtggggtttatggtgcaacgaatttcggcagcggctttggtagtaatggcggagtgtacggcactagcgggagttacggtgggaaaagctacgggagtgggtcatacggtagcagcggttacggcggccgaaattatggaagtggcggttacggcagtagcagttacggtgggagaagctacgggagtgggtcatacggtagcagcggttacggcggccgaaattatggaagtggcggttacggcagtagcagttacggtgggagaagctacggtagtgggtcatacggtagcggcggttacggcggccgaaattatggaagtggcggttacggcagtagcagttacggtgggagaagctacgggagtgggtcatacggtagcagcggttacggtggtcgaagctatggctagcggaggctatggaggcaggaattttgggaacgttggtttcactgctggcagaggaaccatggccatggtagcggttacggtagtggcggatatggctaattctttgtgcaagatgaaacaaggctttcttagttttaaataaaaagttaataaagtggttttctcatttaatttcattgctaaatgtcacaatcggaagaataaatcattaatttcaccgtttaattttacaattctttgtgattagtattcattttttatatgtataaacagaaagaacttatttatcaaaattaagaaaaaataatttttagatttattaggagcattaattcggttgttttacattgttggccaaattaggctctgatttccaagtgtaagataaagccgtacaaatggaaacaccgaataaaatcagaacaattagaaaatggaaatttggttgcatttttctaaattctaattaaaaaatgatattttgcttgcgtttttttttctaaattcttttattaataatctacatatgttggacaagatttttaagcaccaaaaaggtgaattaagcacttaattatctatatcaaaaattccaaaattaagcactaaacaaaaaaagaaaaaaattttacacaaaatatagccaaaaccctaaaaatatgcgctaaaaatcttcaaaacatcaaaaaaaaatttgtttttgtgtgaaaaatctgcaaaaaaatttaaaacctttaaagacttctcctgattacatttgaaacttttagctgcacctcttaaaaaatttctaagttattagcttgattttgaataggttctatgctacatacattttaagaattgcttaagaaatgtatttggctttatgcaaataattttttagaatgatggcttctgcttgtgccatggcccatattaatgccgtccatcagtcattgtttggcattgtgtgcacgtgcgttattatgccatagaaagaagcccttggcaaacgaatgatgaatgaatactacacattaatgcttaaaaataaaatcactctttttcttttcctgccttatatttcgcatattaaaattctctttttcttttcctgccttatatttcgcatattaaaattctctttttcttttcctgccttatatttcgcatattaaaattttctgtttcttttcctgccttatatttcgcatattaaaattttctgtttcttttgccttatatttcgaaccttaaaatactctttttcttttcttgccttatatttcccatcctttgtgtgccattctttttttttgtcacatcatttctttattaattctttccatgccatgtgcaatacaattatatgcactttcataataatttattatatgcaattgacataatattttttattattattgattaatttaatttttatttaaatttaattaatttattacaaaaaaaaaatacaaagtcagtgattgtctataaaacgtaataattgcttttattattttaaaaatatttttttaatttttcataatttttgtaatttctttttgtcaaaattttaattaatttcaaattaattttaaagattaaattgagttgcaattacgcattgtcagcttatattgatcagaagcgaaaaaaggcaatttggtaaaaatgaactccaagaaaagatttggtacttaaattccaatacttttccaaatgcctatgcatttttaatttttaaaagtatgaaaatattcttccaaaggttttcggggttgctgggcacgaatccggcacccattgcgaccaattccaaatcccggacctgaattcgaaacaagtatgtattcgttcatttttcttttattatttctcgcaattttttttcattaattaaaaattgaaatcactggtaaaattattaattgtacatttttttaaataaaattatttcctggtcattcttttctttttttgattaaaaaatagaaatttatggaaaagactaaacaattaattattatattattcatccatactttcattgtatttgattttggttttaaaagtgcttttctttattattcttttcattttttaattaaaaatttgaaatttctgtctgctggcacatataaaaacgagaaaaattttcaaataaaacatttaatcaaaaccaaccattggcttactacaaatgaaaactcaattcatttttcttttggcacttctgccatttctgttggtcccaatttgttgtgaacaatgcagttgggacgacgtgaataacatttgcgtgggagattgttcatcactgtgtgtgctgaaagattttgacaattgcaactgcaaccgcttaccaaaagtcactattttattgtattttttcaaaaaatattttttaaatttcaaaaaatattttatttatgtaacaataggcacttgattagtatactgtaggatattagctagaaaccaccaaaaagggtggacgaaaatattgacataaattgcaaaaatatgggcataaatttctaaattaatgttgaaattctctattttgttca

SEQ ID NO: 5984 - DNA, 1918 bp, Heterodera glycines
gatccgcggtcgcggccgcggcaatttgaatgcgcgaccgcgtttctttttttgtgcgatccgcggtcgcggccgcggcaatttgaatgcgcgactgcggtttttttttctgtgcacgctccacccctggttaataacaacccgattttctacccattttcgctactgttgcctctattttctgacaattttttaaaggcactcaaaagggtttttagctgccatccgccgatgtcacgaaacatttgaaagtattcgtcattactaaattttattttttattaaaaagtaaatataattttttatttctaaaatgaaaaaataataatttagttcttttccgttatgccacacttcaccaaaaatgtcattaccgcaaaaaaaaacattttttatatagaatataaataaagaattcaaaatccaaaaaaaaaacaaaaattttttttattatttggataatttaaattaattcaaggggctatcagggattgaaaaaacttaagctgaatccgagtttggacataggcgcaaatgtccgaggcgcaaatttcatgtaaccaataaatcttagagtttaaaaaaaatgaatccgactttttcttccaattcgggttcgagttcctgaatgggtcgaaagggatatcagaatcggtctgtccctgaaaaccccctaaatttaattcgtcccgaaaaattaagattttcgaaaaaggatgcccaccatcttaacgattaccaagatgacgttttagcggatactcgatctatcccaaaaacgcaaaaacaatagaatactactagcaaattttgaatacaatttcagagtattctttgattaaaaaaggaatcaaattttgtcataagtagggatgcgatttttagatttttacatatttttttcctgagatccccgtggcctgaaacgcacgaaaaacatgtttttttgggctgttgttaagctacttttcgagttattagcacctattttctaggtttttatttttagcacctaaaaaacctaaaaaaaattttaaaaacttattttcacctattttggcattttgcccaaaatttgttaacaaaaatacaataaaaggaaaaatagacccctaagaatcgacccaattttttttcaaaaaatataccccgaagaatcgacccaattttttttcaaaaaatataccccgaagaatcgaattgaaaattttcaaaaatataccctgagaaatgaaaatttctcaaaaattcatctacaaaatttatttgtttaattttttgacgagaattgttgattttgaaaattatgtatctcattaatgatttggcgtaatatttttgccttttgaagaaaattttcgattttacacccctaaattcgaaactttttggcacctattttcccatttttagcacctattttggggtttttttataacttaaaacctacctattttggcagtttttagcacctaaaaatcgcatccctattcatgactttgttatgaattttttttcaagttaaagtaacaattaaatatgcaaaatttgtgaacgttttaattttaaatctttttatttatctgcaaaattaaaaaaaataatttcacctaaataattttttttgagcaatttcaacctctaatcctcggcatttatttataattgtttgtcttctctaaagattaaatttattattatttttactattttaatggctaaacggaaggcgagttcgatgctgctgttgtcatcgtcaagtgaaagtgccggcgtttccgaacaaaacgaaagcgggttggatttatgaacttttgaaaatatttattttgctaatttatttgtatatatatttggcagttaggcttaagattcatttcggcctggatctggacataggcctggttttttcaccccc

SEQ ID NO: 5985 - DNA, 7785 bp, Heterodera glycines
acaacaggggtggagcgcgcacagaaaaatcccgcggtcgcggatcgcgcatcgcggattgaatttgccgcggtcgcggatcgcgcatcgcggattccatttgccgcggtcgcggatcgcgcatcgcggatttaaaatcccgcggtcgcggatcgcgcatcgcgggttcaatttgccgcggtcgcggatcgcgcaaaaaaaatgccgcgaatcgcgtatcgcggatcgcggtcgcgcatttttcaattttttaaaccatttttaaaattttttaaaaattttcttatataaactagggtgaagcgggaccggaattttgggcaaaaccgggacttgccgggacctgagaagtcgggaccggaacctcgatttttgttcgggaccgagaaccgggaccaaccaggaaattttaaaaattcaaacaaaaattttaaaaatatttaatttttaattcatttcatctgaaaataaaattgatttttatttgtttttatttaaaaaaaaataaaaagttaaaagctaaattaaattaatataattttcaaatcaaattttcttcaattagttcaaataatttatcaattttggactaaatcatcgaatattaatagaagttcagatttacttttcatatcacttttttcggcgcgctttttccaaaaaacttttccggagcaagggcggtccggcggtgccgatacccgccgacggggaaaatttgaaagtttgagtgtaatttgttaacagatttccaacaaaaaaggcaggtttttgggggagaggtccggcggagccgataggagccgccggggaaatttttgtaatttttaattcgatttgttaacaattttgtccaaaaatggacaaatttttaaataatttatatttaaaacaatcgcttcaataaaaattttctttttaaaatcttataaaaattgccgcggattcacaaatcccgcggatcgcgcatcgcgtatttaaaatcccgcagtcgcggatcgcggaaaaaaatgccgcgaatcgcggatcgcggtcgcgctccacccctgcttgcatacttttcataatattttttggtttttccttttccttatctttttttcaaatttcgaatttgccttttttcgcaataataccacaaaattataccgactttttccgcttttgtaattttttttggcaatttttatgatttttgaatccactttttgatgattctcgtctgtttttacatttggattttgagttcaactttctcttccactactccgacgagtacttcgaccaccaccaataaattgtcctctacgcctcccgcggaaatcaaaaataaattgcaatgtttggcatggaatatttgcaatttgttagtttatttctaatttgaaagttaaaatttatcattttcaaggagcacgaaattgaagcagtcaaaggtttcgcgacgatttgcaattagtcaaaactgcgaggaaatggccaaagactggggacagattgaagaagatgaaaaaatcggagatgaatacgaccaaagtgccgacgaagatggccaagtgtttttggcggattttttcgttgggcgaattaatgcaaagatttaattgattttcaacaaaaaatccaattgatttggtttaattgaaagaaatgggaaattaattcaataatttaaaaaattcaattgcccggggcaatggcaaaaaaaataataaaacaaacagtttcattataaatattttctatttcactttgaaaactcagcacaattcgtcctaaaagatagattctgtccacaaaatgaaccgaaattatgaaaatatttatttttgttatttagcttattttaccattttaaaattaataatttttgagatttgcgtggtttttaaagtgttgtgcctatttttaaaaatattgtcaattatttatgttacagatttttaatctttggcgataaatttctctaaaattgaattttaaaatattttaattaaaacccaaataatcttcgttcagtttttatatacgtttaatgggattgcgtgtgttcgggatcccgaccgggtttcgttcttgaataccgattttggaatcccgcttcggttctcggttttcaaaaagctttacctctctgaatcccgaattttcaatcttggcgggaccaggacagaaaataagcactggtaagagagtgttgctttcgttctaatgtctaaacctcgctggtttttactacacaattagttgaaattcgaataaaactttttcacacttttgatgcaacacttttttccggcactgaatgttaaatgatctaaaataatatattttgtaggtttttgatttaaaatcgaaaattcgaatggacaaaacgtggaaaaatttggtaatccttaaaaatgtgggcaattcgctttgcacactctaatcgttataattaggaccggcaattttagtgtcgagaatgtcatccataatcaaaaaagctggttgttttttaattttgctcttgctgtcagaatgcccgatttccatttttaagaattttttgcggcgtgttttttccaaaaaatctcgaggaatgggcgaggggagagagtccggcggtgccgataagcgcttccggaaaatttttgtaattctttctgatttattagcatattttcatcaaaaaaatgatcaatttttagctctacctctctgaatcccgaattttcaatcccggcgggaccgggacagaaaataagcactggtaagaatggtgactactccaattaattgatagtttattacaaaatgtttaaatgtatttttgtaaaattatgcggtggcagaaacagaaagaaatggttaagaaagaggcggagaagacaaaatatgttgtggaccataacgttttatgcaatgcgcaaaggcaatttacaaacttaattatcatgaaaatctataaaagttttagtttatttacaaaaataaatgccaaaatactcaaaaaagctgtgtttttcctaccaatttggccatagatgtttttagcaacggacaatgaatgaaataaatgttaatttggtgtatagaaaattcacactttcggagtgccgaacaaaattctgcgtgtttcgatgttgtgtgagtccggtgattactggcatcctagtagcctcttaaagtgatgaaaaaaaattgattgaaaaacagcagaaatccgatgaaatcccggctcaagaaagtacggattaccccaataccgcagcgggatccgcaaatttttttttgttatgacaccccgaactttcttaaccctcagagccattcgaaaaatcttggtcaacccatcaccccctttttatgcattccgccagcccctaaaaatttctttcccaaattaggctcagttattgttaaaataatttaatttaattatgcgattcgctaaattcatataaatattatacccataaattataagaagtaattttaaataataatattgctaaaatttttaaaaaatgaaaaaaatttttctttgaggtaattcttgaccaggaaattagagaatttcggcttgcttaaggcctattcattgacacccatttatataatcaattaattattttatgaaaagtaagacatgtgataaatgcggcactttctctccttgtgcctatgtggcagtggagacaaaaggaagtaatttcgccccaaagataaggggaattgagagtaagagagtggattagagcacggcacggattgatggggttcaagtcccaccgcgggttgatcttttactcttccgcacaaagaacaggacggaccaaaattaatttttttaggattttttgcattttttcgtgcttttttgacatatttttttgactttttattcaactttttggaaatttttcgtgacttaaattcccagcccagtcataagagactgattgaaatattatttcgattttttacaatctaataaactgactgagatgaaaacacttaccagctaggaatacttcccaggtggttccaaacaatggtatccccccaggcgtttttggtgtttttgctttattcggatattgttgttgcagccattctttgttgcacgaaaacacgcaatttgactttgaaggcattttatacggtttgcagcccgtgttcatcgtatggttggttccggatactgtcagattacggtaatatttccacgcataaaaaggatttcctccaccgcaccttaaagtgaaagaaatacggtggactatttttaaaaaggccactaggcaacgagagatttaaaatggtggaaaaacaattttaaaaatgatcttaagctttctcagcttttttgaaagttttcagtcaaacgaaagtgttgttttaataaagggggcggttctaatagagttttttaatgccaaaatatgaaataccagtgttgccagatgtgctgatttatcagcatttacctacttttaaaggtgtcaaagctgattttctttgtaaagttttctttcatgaaaataattatttttgtggaaaaattgttaaaaccgaaaaaaatttcaaaaacttctcccggcgccgtctcactgtaaattcctttaaaattccttaaatttcagcctaaaatccagaaaattgtgtttttttggattagaaaacattgaaatccctaacaattcattatttgtaatttacccttttgtgtctggggtgcattccatggtgaattgtgccgaaacatatgccctcgggtcactgctgttcgttttctttccctttttcagacgggcaatgcaaattcggtcggtcagcgttcgggcagctgtcacagcccaacaggaaccacagtcgccttgaaattttttgtaaatgaaaaaactttcaagaaataacggttcctttaaaagttttaggggcgtattttttgaaaattttaggtcaattcttaggagtgtattttccgtttttattgcatttttgttaacatattttggcaaaacgtcacaatagttgaaaaaattcggaacaggacggttcggtgctcgcagtttcggtaccagcctaagttttataatgctgttcgggaccgaaaatttcccacgactcttcgagactcgagagtctcgaacagcactacaaatcatcctccaatccaccttgtgcatagccactttggatgatttcggcacaatctttccatgcttcgcgtgcgtcaaattctgttggaagatcatttttgtcttcctctccatcggctgccttcagctcagatcgcaaatggatgttgttgttctcatttttgtcctcctcaacagtctcatcgacaggagtgccaaaaaaattcaagaaatcctcatctttcatcagtgcaaatctttcattgacaacggcctgaaaaatgagtgtttaatctgaaagtaaaataaattggcaaaacaaattttctttgtgattttaatacatactatgtatacaatacatatttttcaatattatgcttcttttgcgggctttagaccctaaaaattacgggtgcaaaaaaattttcaaattttctggaatttttataaaaaatatttcttcacaaaattaaaaaacggttgaaattttccaatttttctttgtaagctttttttgtttgaaattttattttaaattttcgggggaggggggaagaagctgccccaaatcccggccattatgacgccaaatttcatacccatgatgtgttcatcatatcaacttccttctgtgcggctgttagcctctctgctctgtactccgacttaaaaaacatgaaaattaatttcgttatttaaatttttttttaattatttacaaaattatttggaaattcatttggctcctcctcaattttttgttccaagcagtagacagtagtagtatcagtgctcaacgccaattcgtccgaataggtgactaataggtccagcacagtgccaattgtccagccaaaattgaactgggttattaaattaacagatattttttcaaaatgcaatcagtcgaattaatttggatgaagtgagctaagttatgcatttatatatataattttttgttttcggacacattggcggatttaagaaacgcgccagcacaccctcccttcacatggatattgtctaattacagtagtaattttcactttctccctctcacttggacattgggtaatactgtgctttgtccctcctcttttttcgaaaaattttttatgtttccaaaagtcatgaaaacatgtttcgaagtcgggtctagaattcggaattgtcccaaaagaatgccggattcatgatcagcaactccgaaaaccttgaaaacatgttttcatgacttttggaaaaattttttcaaaaaaagggggataaagcacagtattaccggacattgaactacagtagtaattttcaccccctcctcctcacttgaacattgtattctccgcctctgcccggcgtggctgcatccgctgaaatcttttcccacattttcttcccacaatttttgttgttctggtaaagtttgtaattggcggacacccacttttgagccaattcaaatgcttttcctttcattctaaatttttgtagttgttttttaaattaaattcatttccaaatattttttaaaacaataaaaaacttgctttttagtgcctgaccggcgcagaccctcaataagcatgtgttgtaaaggctgaagaaaattttgagattttttaaattcatgactaacactcatttggcatgaatactgtccaactttgtataaaaaaaatgtttaatatttttttattttcatgtttccccaggtcgtctcgagagatttctccggtttcgaaattttttttttaaatccataatttggataaatgagaaaatttcctgtgaaatcctcaaaaagtttttaccggaaaaatgtttgggaagtcccattgttgtgacgagtcattgattaagctgaaaaattggtcatttattaaatacaaatccaaaaaatggcgtgaccaaccggaaaatactttaatttggacattcgactttttgtccaagtttgaaatatatttttaaattttaatttaaaaatttaagaaaactacgaaaaattaaaaaaatcctaataaacttctctcgtgcccaaacggctgcgcccaaatggccctgtcccgtcaaaaattctattttagaggtgtaaatttttaaacctttaaaaatcagttggaaggagttcaacacttccaaaacccctcaccaccttgccggcacaccaaacgggtggctgatcaatttcctgttcgtcgccgtgtccaatcgctccatccgcgcgaacattcgctcggccgtgcccaaatcgctgacatcgtaacagcgcgtgaacaatggcatcgccgcactaccgtagtacgcctcattcgatgtgccgctttccaagttgaagtcgtaccaaatgccgtgttctttgttgtagaacagatgcttgaaatcctccaaaaacagttggtgttttgcgtggtattccctggactttgctttgttgccttgaattattttttttttcagtcaattggaaataattagagttattttgatttccgcatcaccaatttgaaggtacatatgtgccatcatttcgaaattgccacaaatcaacgcattcaaatccaccggcacaatttttgttgtcatcaaattggtcagtttccacggcctttctttatcctgctcatcttttcttatccatcgggctaaa

SEQ ID NO: 5986 - DNA, 2217 bp, Heterodera glycines
aagtgctaacaaaaaaataaagccgaaattttaaaaaaatgccaaaagaattcgaaggcattggcataaaataaatggcaagacgcgaaaattaaattaattaagcaaaaaacaattattgtatagttttattaagtgaaaaaaagaatgtcaatggcaaagggaatttaatgaactgttggcttaagttttaattaacggaacccaacgaattgtgaataaaaatcagaggattgcgtattgaaaaggggaaagaaaatgccaactcaaagagggacagctaattggttgaaaatgggggaaacaattgggggggggggggggaaagagaatttgtgaacttcggcggtaagggatatccggtggaaaatgaaaattaattcataaaagtcagaagtcaggacagctgctagcgagtgaagtgaatgaacattcatgccgaactcacctgctgctgactgatgactgctgatggtcggtcggcattttcattctgtcaattaccatagtaaatgagcgaaaatttgttggtattggcccatcgccgtgccattaattgttattttgagcgttcgttggattggtccaaaaatggccattccgtgcgattttttgtgcctttgtttgaacggcacgcaacattcattctgtcattccttcatattgtttaagcagtttttgtgtttgttttgttggatttattatgcacaaaacaattactgggagaaaaataaggcaattagcagaattacgaacgataataggcatttatatgcaaaacaaaagaaaaagctgaatggcgcgagggaacggcacgaaggaaagtttgtgccaaagcttggtggattactacggtgaatttaatttaagaaatgatgacttctcatcaacagaattctgctcatatattttaattttaattagttcattaacataattttaaatgtattcccaaatattttcttaactgaaattgtcaaattacaaaatgataaattatcagccaattgttggttgatctgttttgtcaatcaatcgtccctgttgtcctcacttttccctcttttcttctgtcattttcatttgctttgaagaacaaaaagtgctataggaacaaattaattttataattaatttaatttttatgaggctatttttgcccaatcgctgacaatttccaaatcactaattggccaacaattaattaatgcttgattaattgaccgatgaaaatggccaaaagtgtcgctgcgaaagtgccgcccaaaaagcggtggtttgcccccgctccgttgcacagttcgcccgtgcaattggtgcatgccaattggccgctcgcccggcaaagcatcgccacgggccccgactcgcacgcgtccattcccccgcagcccaaagagtaataagccgacccattccctgcacaaaataacacccgccatggcacggtattcattacggtaagttaccgtatttgcagtactttcggtggcaatttgtcacttctaccgcgcattgctcctcctcaactttggtgcttacgttgaacagactcaccgtcatattggagccggaccagcatttgagagctgaaaatgaagcagaacaaaattaacaatttaatcagtctttgcgggcgatgatcgctaatcaatcgctaattggtcaaacacttaaaaatattaaaaagggtaattaaaggggaagagatttgacttgccattggtcgtcaaaaatgagcagatcaaaagaaaaaacagcaaaatgaaatatttggaaaaagttgaaagaaaacgatacatttctgtaaaaaaggtaattaataaaaaagaaaagaaaattttaaaattataaataaataaacaaaatgtgaaagaaaaacgacggaaggaataaatgcgggaaaattatgctgagattgtaaaatttcagccgtttttaatgggcaaataacacaaccaataaataaataaataaacggaaaattggaaaatgaaattggaaattttggggaattgcttagagaataataagcaaaaataaaattaaaagaaaagaaataaataggagaaacttcaattaaagtgatatgaagagaaatatcagcaaaataatttattaagaaagtaattatcaaaaacgaacagtgattatggaaagggtcgaagattattaattagaagggcccctatttttggcaattaatctcattccaaa

SEQ ID NO: 5987 - DNA, 4554 bp, Heterodera glycines
tgctattgttggctcaattttctcgaagcccggagagatttggaatagagaaaccaaagaaatagcgaatatttataaaaaccaaagaatgtttatttttctttattcattatcataaaatggtaacaagtctaaaaatatataatatataaaatgcatacaatttcaaaattttgttcgtggaatttgattttatgatcatttttttgaaactaaagtgcgctcattttatttgcaattaggtaggttttttttattaattttcttcgtgttttgaacggttgaaaaacctcacaaatggcgtcggttcgatttcgcctctgcttttcggcataacttatcaagagcgctcgaataatgccaaattcgtccgggttggacagttttaaaaggttagattgagttttctttgttttcagcgcctaaaaaaatctaaaaaaatgtgatttttgagtgtttttgtatatgcgcaatatgatgcacatttacaacaaattaattaattatatcaataattatgctttttccaacaattctctttaagttttctatttctaaaatttcccatttattattttttaaattcgttttccttttttcctttttccattcttttgattttggtttgtttcacttcctttttaattatttttgaattcctttcgcatttattcatttttttgttttaacttttcaatttaaccgccgtttctttccctccgccgttcattcgaagcgaaatttgcgcccaaagagacgccgacggatgaatcatttttcaattcaaaaaaagcattttccttcctccgataaatatttagttttgtttggttatttatttatttattttatttaattacccgcgcacggaaagaaagaaagggccattccttcgcttctttaaaaggtgtgaccgatcagacgacgacgaacagccgaagaagaagaagagagagagataagggtaaatcaaagaagcaaaaagaagaaagaagagtaagaggaaagcgcgagagagagagagagagagagagagagagagaaagtaggaaagagaaaagggaaagagaaaggaacagagagagagagaaaaaggggaagggaaaactgaaaggaagaggaagaggagcagagaaaagggaaagaggaaaaggaaaagagagagagaaaaaggggaagggaaaactgaaaggaagaggaagaggagcagagaaaagggaaagaggaaaaggaaaagctacaaaagggaaaggccaaatgaaaggggaggggagaaaagagaaaaggaagcgaaaattagagcaagaggaagcccgttttggttggagcaaaaacagcaaaaggcggggagggaaagaaagtggtcgcgcaaaaacaaacacttttgctcacgctttcagcagcaattaacaattaatgggaatttaattttgaaatgcaaatattttaattgtttaattactaaagtttcacttcaagatcatgaattgcataattaggaatcaaattctaaaccatttctttttcagttcctcaattagtaattctaattagttaattaattcgttaattgccttccgtccctttcgatgtccgttaataattcttcgtccgttctttcgccttcctccgctgttccttttccttcccattttgccaccgtttcccctcacttttctcttttcttcggctctttgatcgcttttgtcacttttgtcggcgttttggccaatgcttttgttgtggtggccgtcgctggcgataagaaaatgcgtcgttctccgatgaatttgctgctgctaaatttggtcagttttgttccgttaccgtatctttttacggtattttctgttttggatcgtactgtacatcaaaatttaaaaatcgacaaaaatgctcataaattcactaatttcgcacccatcaacgggaggggcactcactaccaattttcctccctaccaaactgtcccataccgtaacgtgccatttcactttcgcttctttctttgccccgcccccttttttcgtcaaatgccttcccaccgcagtttctttaggctgttgccgatttgctttatctgctggcatttacgcccttttgggcttcgatgtccgtccacggggacggcggatggcatttccccgagagtttttgcccaattggacgctatctgagcaattgtctgctgattgtgtccatcttcacttatgtggccatttgtgtggaaaggtgaaaaatcttttatatgaaaatcaaatactaatttgcttatttggccaatattaattgtaaattgtgcctaattaagccaataattcttataattacgcatttgatttccaaagattcgtcgccattgtccacccaatgcatgcccaagtgtggtgcactcgtagtcgtgcactgctcgctgttctcggcctttggacctttgtgatggcctatcaattaccttatttggcactctttcagactcaaccggcgccatggaatggttttgaattattaataaaatatgtttatcaatcccatccctatttaattttaaagttgaaatgcgcatttgtcgcagtcgtttggctggtaagagttcgttgtggcgtgcctacaaatggtccgaatttgtgctcacttacgctcttccggtgctcctttcggcatcactttatgcgcgaatttgtcgggttttgtgggcaaaaagtgccattttgcaaaacaacggtaatttgggcatactgtattgggaaattgccaaaaattatatgtttgtaatttaccattctttcttttgttctcgctaacttaattggcattttgagtgcccaagcgcagtgccatcattggcactgcctcgatgacggcggtgccctccgcgacttatcggccgaatggcacaattcgccgcgttttggagacaaaattagtgaacggaataagcaaagtggcaccgattaagccaacgacggcggcagcacaaaagccacaaaaaggttcacaaaagtcatcatcatcatcagcaggtggccaaatggaattttgaattggcatttcgtttaattaatattttaaaagtatagcaaatgataaagcaaggcgcaacgtggtcaaaatgttgatggtttgtgtcacactgttctttctctgctacacgccgatggtcgtttactttttgtgggggtaagcaaacgcaaaattcacaaatacgccaattaagcatctgtatcggatatcgctactccacccctccctctctttttctcttactcattctatccttcctttcctcccttcactctctctctcttgccccctctctctctctctcatcatttgctattcatcccttctttcatccctttccctccctcccctctcccttttcagtgcgttgttcggccgtccccttccgttgcccttcgaatttgttttcctcaccagcactttcgtccaattccaaagcgcatttaacccttttctttacacactttttgcaacaaaattccgagaaaagttggcaaaattagtgaaaaggaagcaaaaacaacggaaggacaatttgagggacaaaaatgaacaaaaggcggagggaagagaagagaaaggggaaaagatggaacaaaatgggcacaaagccagcgcaaagtcgagtatatcatcattgggaggaggagtatgaaggaagaggaggaagaagagaggaagagaaaaggaagaggaggaaaaagagagaaccaagaggaagaggagaaaaaagaaatggagaggaggggagaggaggaaaaagagagaaccaagaggaagaggaggaaaaaagaatgagaggaggggagatgaggaaaaagagagaaccaagaggaagaggaggaaaaagaatggagaggaggggagatgaggaaaaagagagaaccaagaggaagaggaggaaaaagaatggagaggaggggagaggaggaaaaagagattacggaggaagaagatggataataaaaggaaaaagaggaggaagggcatgagaaaacagaagacgatctccgcaaatgaaagtttcgtttgcacagtctttgtgaaagaagctaaagctgcaattttagttttcaaatttaaaatttgtattttattgagcaaaccacaggcacattagtgctcttatgtggcgcataaaaaatcaaaatcaaaataaaaaatgtcaaatagtacaacaatataaaaaagtataaaatttttacataaaaaacgtagaataattgtaaattaaaaattataccgtattacaaaatgctaattgtcgaattaaattgcattcgattcggcacaccaaaatcaaaaagaaataaaaaaaaggcttacttggaaaaccccaatggaccaatggaaaatgaaaataactttcgaattcatcggcacggcattcatttgaagggaaaagggcaattgagcggaatgaaagaaaaaatggggtttttattgggagaatgagcaaaaaaagggaaagaaaccttcactttttaactaaacaaactcaaaaggaaagcagcagcaaaatcaaacaa

SEQ ID NO: 5988 - DNA, 2409 bp, Heterodera glycines
  misc_feature (1571)..(1571): n is a, c, g, or t
aggaagaggagaaaaaacctctaagcaagaggaagaggaggaaaaagaatagagaggagggtagaggaggaaaaagagaggagagaaaaggaagaggaggaaaaagagattacggaggaagaagatggagaataaaaggaaaaagaggaggaagggcatgagaaaacagaagacgatctccgcaaatgaaagtttcgtttgcacagtctttgtgaaagaagctaaagctgcaattttagttttcaaatttaaaatttgtattttattgagcaaaccacaggcacattaatgctcttatgtggcgcataaaaaatcaaaatcaaaataaaaaatgtcaaatagtacaacaatataaaaaagtataaaatttttacataaaaaacgtagaataattgtaaattaaaaaatataccgtattacaaaatgctaattgtcgaattaaattgcattcgattcggcacaccaaaatcaaaaagaaataaaaaaggcttacttggaaaaccccaatggaccaatggaaaatgaaaataactttcgaattcatcggcacggcattcatttgaagggaaaagggcaattgagcggaatgaaagaaaaaatggggtttttattgggagaatgagcaaaaaaagggaaagaaaccttcactttttaactaaacaaactcaaaaggaaagcagcagcaaaatcaaacaacaattaattgattaattaggccttattaattagtacattaattactcactctttgtttcataattccaccaattaaccaatgaattaattactcgctacaccaattaattaatgcattaatcaccaattagtagattaattacccactaaccaaaacacgtattaattacccaattagtttaaataattatttatttttcattttttttcctttttcgattatgtttaatcggattaatgaatgaatgaatatcatcagatgcatcagttgctctttttttcttctgtttatgtttttcattctattttcattcttttcttttgttttgatcactttttgtgatgactcatcgacggaaaactcacaaattcaatcgattaaagtgaaaatgaattcacaattaaatttatataatatcaattaaagtaaaattcatttatttttttacttattgtaaattcaataaaaaaggtacaattttttgacattttttctgtgtgatttgttggtaaaagtaaaccaacctttattttgtatattgaccattaaaaatcgattgatcacttttctttctgatcaattccccttttattacgtatttatttgtttatttctccgtttgtttttgttcccttcgtacaaaacaacacatttctttctttcttatttcccatttccataacatatgcctcctctcaatttgttatttctgaattatttactgggctaaaaaattcccacaaaaataatccctctcttttctctttccttttatctctttctcttttttctctcttttctctctctccccttcttttcttttctctccttcccctctctttctctccactctttcctttttctctctctctcnccttcttttcttttctctccttcccctctctttctctccactctttcctttttctctctctctccccttcttttcttttctctccttcccctctctttctctccactctttcctttttctctttttctcccctttctttttctattggtaaatttttgcattttccttttccaatgtctttggcgcttctctctttattaattatttattcttttctgttattttctcgcctattttttcctcttatttttctattttctttttcttttttttctccaaagattcattatatactggtatgtttttcttctactgttgtgcataattcatcaaaatgcgttaaacggggaggaggtaaaagaaatttgaaatagttcacaaaagtgagaggaaaaaagagaagggaggaagagcgaggaagaaagaggggagagaagaagaagagagagagggagagggagggagagagaggagaaaggacagagagggagggaaagaaggaagagaaagagagagagagagagagagacggttattcattcattaggttggaagaaaccgtgggaagaagcatcagaatgatgcggagggaggaaagaaataatgctggctggcttaatgttggggtttgaatggatatgggcagattaagcgggacaaatccatccaaaaacgacggcagcagcggaggagggggggggcaactgaaagcgaaggaaaaacatcaaagtaccaccgcaaaagcattagcggcaaattgaggacggacggactgcccggggggagggggaggggtcagctgttggtttggggtgatttgcttttcatttgaaaacat

SEQ ID NO: 5989 - DNA, 6455 bp, Heterodera glycines
aacgataagtctttcccttcggaccgccgggtccccctcacattaaccttaaaattgctcaaaatcgaaattatcatttttggatagtgaaataattagtagaaatcggattgtatggtttcatattttttgcacagttatacctgcctaaaaatcagtaaatatagatcccggtgcgggacggctcccgcgcggggctttgcgggatcccagtcgacaatgcgggattttgccgggttaatcccgccgggtcccgcccaaaatgtcgagtcctaatccacagcgttatgctcaaatttgaaatttgcgggttccaattttccatattttccacaatcctatttttttggaactcgctttttaaaaaggaaacggccgatttcacataattttttgatctttgctaagccaattgaagtccgacgaaaactgtcctaattatttgcctcaatatggaacttttgttgagcaccggcaatggcgcggatgtgcactttttggttggggaagacgaagaaaaggaggcgagtgactgacaatttaatagaaatcgagggcatttaaaaactttaaaatattgatcagttaattttgacatatcctgtagtaatttaaagcaaatatatgtggtgtatttgtctactaagaccaagaaatccatttagccataaaagaaaattatggcacgtgacaaaggaaagaaaaagtcgatttttttttcgtcgggatcgcaattctgcagggttaccttaatttcgacctatgtctaattccgaacccgaattcgagcaaaaagtcgaaaattcaaagtttcgaattaaagggagggacggttggggtaccatcgatagtattaattagtagggtttgtaattatatgcacatgcatatttttttcctggaacgtgggaggtctgaaatgcacgaaaaacatgtttttagcttgttttgaagcttctagaatggatttctatatgcatattttgcatatttgtgcatattttggcatttcgtgcatattttatgtgcatattttggcgtttttccaaaaaaacctctaatagatcggcccccaacagacaaattggcctttttgacctcaaaaaccggaaaattttctaaaaaaaataattttttagcaaaattttcacgaaaaatattgaataaataaattttctcaaaaaatggttaatttatgtcaaaaataagcaaaattttgcttttcaggttgatttttcgctaaaatgagtaaattttaagctgtatcgtgtttttttctcctaaaatgatttttaataccacatttagccatttttgaagattttactttatgtttaacaaatttgaagaaattttggaaaattttacccttaatttgaaaaaattatgtgcatatttttcactttttatatgcatattttgcaatttttggtgcatatttcatgcgcatattttaagattttatgtgcatataattacaaaccctatttagtagagatcggatacggaccggatccgtatacgtacttttacggatccgtagtccgtaatacgtattttttttggccgatacgtatttttacgtactaaggattttccgtatttttagtacgtaagtacgtaatccgtatcgatgtcaagtacgtaatactgatactgatccgtataaattatgatacgtattacggactatttttttttggcgtttttaaggtgaaatggagtaattttttaaattttgtgcagtcaattcgccaaaattttgaaatttgagggtctattccgtaaaattttcgatgaaaatcgaaaaagcactggaaatatgggaaaattactaaattggaaaaaagcaaaattttgtgcaaaaactcaaaacctttacgttattaaattgcatttcgtttaaattttacgaaattctttttcatttttttccattttgtaaatttttcaaaattatcgaacacataataaacctacaactaaaatctgcagtttgctccactaaactacaagagttcaatgaaattgcctttttttactaaaaaagtcattcttatgggtgtaaatattttcgtctttttcgtaaaattttgctcgaacgaaaacgaaaacgaaacgaaaatccaaaattttaaaaaccgaaaacgaaacacgaaacgaaaaacaaaaatttgaaaaccgaaaacgaaacgaaaaactttagcggacgaaaacgaaacacgaaaacgaaactcaaaaagtgccgaaaaaggggacgacacgaaaacgacacgaaatttcgtgcagccctgcgccggatccccccccccccccctccctgtttccaaaaaaaattttttttttaatctgaacgcagataattaacaagtaccaatattttaccctcacttccatttgttgccaattttttgttatcttgaattttgttgcttagaattgataataaatttgttataaaaaatcctctagctttaatattcaagatttgtatttattaaaccaatttttatcaaaaaatttaaaaaatacttatacgtatacggatccgtattttttctggatacggatttttacggactacggattttccgtatttttagtccgtaagtacttaatccgtatcggtgccaagtacgtaatactgatacttatccgtattttcgcaaaattccgatctctagtattgattatcaaattttttgcatcatcgtttcttgcatggtaatttaaacccattgattggaggaaaagtgaccaccgactttatcattaggttaaaagaatgagcctgtaatttcaggaaatcgcttaatttatcctaaaggcatatataccaggggtgtgacttgtctttcttttatgcacactgcttgctctttccccgcccatttcccatggacttcttgtccaaattcgatcgatcttcggctgttcatcgagctttttggccaatgtaatctcttcgatttcctcatcgacagttaaatcaagactcgtcgatgtcaatgcgcctgcagaagacgaaaaagccctaaaagtaaaaaatgttgttttgtattatgttccgtgtgaccgttttatgccaaaagtctgttgctgctctttggctgcccccgttttttctgtaaattccttgtataattctgagtgtttgtgcttcaaatgagtggccaatgtcgtcgttggtgttttgggcggaaaattcgttttgtagtcacaatttttgcagaaagcgattccgatttcctttttgaaataattccatattttcgacatactccttctaacaacctgtaaaagttaattaaattactgaccatttatcaaaaaataattgttctctaattttaaaacatagaggaagcagagaaagagaattattatggcgtttttcgcgtaaatttgaatatttttctgactggtcaaaagttcaatctttaggggtatattttcaactctcgcctctcgtcccaaaacgagagacgagaggcgagagtaccaaaaatggcgagagttggcgagagttgtcccacccctgatatatacatataatacaatttgtgatcactgcaacaaaacaacaattttatatacatcagatgggctcaaattcattatccaatccacatcaattaaatggatcatttctcaacaaatcgtccagtcatttctgcttctgatcacttggattgatcactgcgtcaagaggcctaaaaatcgaaaagcaataagtttggatatctgcataagaagcatcattcactgacccatctcaaatgtcgatccggttccactggtccataaagttccatccaatcgcttccttctcccatttggcccatttgctttcgtcgcgcacaatcggacaacggatcacgcctgtccttccgacgcctcggcactgtcatcgcatggaaatttggtgaagaaaccactggaataggcattgacaacgcgaagtgatggacagtcgtcgagaattgacgggacgaattgacgcaaacggcagaaactttctttggacaattggatgccacgaatgtttgtcgcgatcatgggccaaatgttgagcaaaatcgactccaaagtgcgttgatcgaagtacgtgtcgatggtcaaatgaatggggcgggcggcgagaattggacgaaaacggtggagaaaagtgatgacattgttgttgaagtacctgtgaaaaatgatggaattgttttacaaacagaaaaaaaaatcatcaaaatctcacttcaatgaaatggctttgaatccgacgactctctttggcaacggcttttgcgtaattccaaacgattcccaattggcattgacaacatccatttccttggtgccatccgcttcgaacttcattttgattttcatggatctcagagtccagtagcgagtcttgaagtgttcatccacgtagaagtcaaaacggtggctgatcatcgcaattccaaggccaagttgtgaagccggaagcaattcgaacacacaaagccaaccgtcgccagagataaaactgaaaaaaggaaaacaaaatttaaaaattgaaattgaaaattggcattttaattttaattttacattgctttcgccattttctcctccgcttcgtttcggttgtcagacattttattgaggcaaataattaagacagttttcgtcggacttcaattggcttgcaaagatgaaaaaattatgtgaaatcggccgtttcctttttaaaatgtgtggacttttgctgctgaatgacaccccttttgccccccgaaaagataaaagttagggactcttttggtttgcaataaatcatgaaaaactttttcccggatgtttttgaggtctctgatcgcgcaatagattagttttaaaagaggttttaattctaatcatttttgaaggaattttcaggagaaaaattcaaaaaagcgacaaaagaaaaaaaacgccgaaattgagaaaaattcgaagaagcgacgaaaagaaataaatgacgaatggaaaaaataaaaatgaaaagtggcgggagagaagcaactaattttatactaatttattttgccaatatttacacgattttaataatcaatcgtatttcgacaccttactataaaaggcatcactcctcttccattttctttcattcatcaatcactttttccttccttttgcttccgcaaaggatttccttgcttttctctggttttttaagataactagggcatccaattatatgcacatgcatatttttttcctggactttggtcggcctgaaacgcacgaaaaacatgtttttagctttgaagcttctaggacgtatttccatatgcatatttgtgcatatttcgcgatttatttgcatattttggcatttcgtgcatattttatgtgcatatttgagcattttttcaacaaatcctctattaaaacggccctctattaaagcggccatttttgcctctaattgttagtctgtgttgatacgctgagccgacaactgtttgttgagccagtaaaaagtaagaagtgaggttcttgcgatgataataatttttaggagaaaaaatgaaaaaaaaattgaattttgataattgttcgaatccgggttcggagttcgaaatgggtcgaaacggacatcatattcgggttctacgacccctaaaacccatagaaacgacttttattaatttaaaatcaatttaataaagaaaaattttgttgacacaaaacccgaaagtacctcgaattgtttctcaaaagaacggtgttgaggattttaaagaatgcgatgaaacagatgtttttaacaatgatacactgtctttgggttttgaaaatttcatttcttttgcggtgagtggcaatataattaaaataatgtgactttatttttaaatggcaaattaaggaattgatggacccgagcaaaggcttgtacaacaaagacgaggataaagtcaccttggccattgattttacatgtgaatagcgtaatcattttgagaagaattgaaaagtgttgaaaatcgaagagaaatcagcaaaaattccgaataaaaagattttttgatttctattataaaccaaaaaaatttttatgatatcgcaacgaagaaaatttacagattttttgaatccttttttacacaatcactctcccgtggatcatttcgctcaaattattaatgaaaaatgataatttaaagagcatttagagcacatttttctcttccatcaatcaaaggcccaaagtttttcgttgtccactgattgatgagtttctgctaaaaaaattactttaatttcgaatgaattttattaattatccagtgatttttcaaaatgaactgacggaatgttgcattttaattagcacaaaaagtgaaaacaaaactgctataatggatattgattttgtcttgcctgttaaatggaaggaaaatgcctat

SEQ ID NO: 5990 - DNA, 1121 bp, Heterodera glycines
tttaaaatgattttatttttcaatctaaaatgaattgctttcaaagatttcaatattaacataaatcaattcaatactttatattaatttaatattctcaatttttcttacagcttatcattgtgcagttattcttgaaccagtgtgatgtttctcattttctgcaatttaaaaaaatatataaataatctaatttgaacttttcgtttaaaaaaataattaaattgggtaaaaatatttaatttacgtattttattataaaattagcacttgtattccaatttttttaattttactaaggcttttatttgggttttattatgaaaacatatttggacgtattattttttatctggctaaatatatttgtgtttttggtaaaattgttttaaaatttatttatctgaatgagtttctaagcttttgttaatttttgcaattaaattatactcttattttaatttcatttttgaaagtaatagcttaaaccttgtcctgaccacttcataaatgtttgatgctccatttgaaattcgctagcaaaacgagcacaaatggctgagctggtaggttaaagttgttccgcaacttgttattgttctagtttctgttgcgccacatgaggaaaaagggtggaagttggattgggatttgaatttggatactttagtgccaagcacttttaaatttggtttttaattgtaaagctattaattagagaccggacaagagggtcggtcggtcggtttcggtataaaaaccgaaaaaaccgaaaccgaaaaaaaccgaaaaactcaaaaatttgtcggtcggtcggtttcggttaaaaaaccgaaaaaaaccgaaccgaaaaaaaccgaagaaaaattttcggtataccgtttcggtttcggtttttttgaatttttatattttttccaaaaaaagcaataaaacatttttatcaatagaaaaagcgaaagatcacctctgagtaaaattgtagagctattgaagctcttatcaatggtgtataagttgggaaaataattgaaaaaggcagccaaaaaacgtttgttagcttcctgattcttcttataaactagggttgctccccgacccctgggggggggggggggggg

SEQ ID NO: 5991 - DNA, 1202 bp, Heterodera glycines
ctcttgtataacaatatatagtctagtctttaaaaagatttaattcacgcatgctagtaagggtttcccctttgctctccggtatacttttcattgagtctaaattattttagattatgttttaaaaatttaaataaccatagtctcaattatataaataagaattttatatattgcaaatttaatgttaagttccaattttattcaaattattatataaattttctgttattttttatttattattaactaatatagacgattgctttactccttgttctacgacgcaaatcagtagtaatttcacgtatggaaacgtttttcaaatataaattttaattaaaggttgttgcttcctttttttacaatagattcatttatttacaaattattatttttatctaattagaaaaatataatattgcaaagctaatattcataattaagctaattgtctcgctcctctttgttctaatcgtttaatatttattttaatatatcaaaaaattaatgatttttattactattttatgatttcaataaattaaaaatttcaaaagtcacaatatcacttgcgtcatcagcaacggcattctatccattaagaatgctcataatcaagcttttaggttattttctgaaccggaaaaattgtttatattcgaatttttcaatattttagctatactcaaatatttaatttaatttaaatttatgatttgctttgagaaaatacatgctcaaagaagcactcgttttttccatattattttatgagttttttatattttgcttcttcgatggaatgctctttatattagattaaatttctgaataattgttctcgtattaaatcaccttaacatcataacttttttcttactaagtcaatattcttgttatcagatgaaagcttaaggtctatagaagcttttgaataactttatttttagctaaaggcaatagacaaaaaattatactcggaaaagttgaatttcttgttttcacgttgtaatttttttaacttgttgtcagtatttgttctttctttacattcatgaattcccgagacttttatcttttgcttggtaccaaaaacatgggtattgaaaaagtaagaaaaaagttatggcctaagtaattggggatggtcatttatgggaggcataatctgtcatggacgcataaaaccgaccagaacc

SEQ ID NO: 5992 - DNA, 3899 bp, Heterodera glycines
agagttggtcggtaatcggtaattgtaaaaaaaccggtaccggtactgaccggtactgcaagaaccggtaccggtactaaccttttccaccggtaccgctaaaaaccggtaattttgtaaagttaaaaatttttgaacaaaatttttaattttcgcgcgagtgactgtttttaaccaagtttttttttcaaattcaggtaaagaacactaaaaccagatttagactctaaaattaagattttttgtaaaacaagggggtcagcggtcaattttccaattttgcgaaggggtccgaggtgtaaaatgcaaaaaagggatctgatcggtggatgggaaaaaaatactttgattgaagattacttttgaaaaaatgttacttttaagtaataaacccgttgtaaatgtgcaaattgatcaacaaattttttgcggtgcatttttccaagaaattttggagaactggcgtaggtagtgagtccggcggtgccgataggcgccgccggggaaatttttaatgatatttgttaacagattttatccgaaaaatgaccaaattaggttaatttttggggtttttaggctgtaaaaaagaaaaaaataataattattaagtttaaatatttataattaattaatttcaattaaaataatggtaaagaaatatgaaaaatattctattccatggggaactgaacccaagcgaaaaataatgaaagtcagaaggttagccactagacaacatttgaattcgaataaatgctataaatgaaataaaataatttaattttttcctcaaaaatttccacttcttcaccatttcctactcttttctcacctagacacccattcataccagtgtaaatttttaccggcggtaccggtactagacaaaccggtaccggtaccaaaaaaaccggtaattaccggccagtaccggtaccggtaccaaaaaaccggtaattaccggccagtaccggtaccggtaccaaaaaaaccggtaattaccggccagtaccggtaccggtaccgtgcaactcagttttcaatgaaattcaaatgaccccactttttaagtagcgctaattattttatatttttccttgttctacaaaattttaaggcgctagttaaaaagaggacctttttgaaaattttttcacttttttttggtcaatttttttttcgtttattttgatgcagaattcgcttttttaccagatggtatgcttcattatttaataaatagaaaaaaaaatattaaagcaaatttggcgctagttaaaaagtgacagattttgaattttatcaaaaatcataagggcgacccttttgttttacaaaaattttttgtgatacaaaatcgtgaatatacttttattcgccataattgtgctgttaattagagacaggcgcaggacaggatcctgcgcaggattttgcaggatcccagtccgcaatcctgcatattttggaaaatacaggatttacaggatttgctggattaatcctgccggatcctgtcctgtaaaaaattttgaattccaatcctgcaacaggacccgcaaatttgatttttatgcaggattcagcaggatcctgcattgattttttgaaaatttttaaaaatagaatgccaaatattcagaaactttcttttttcaaaaatttttttcttaataaaaatttttcgtttaaaaacttatccttattcgaagccacccaatttggcaaatcggtctttttaaacgcattaaagaagattcagtcgattgcttggagtgtaagcaaaaaaacgttattaatttttcatcttcatcattttttggtttaaaaatatattgaatacttttttatactttgaaagacttttttattaatacagaattttttgaaatttcctaaaatccgcaatcctgcgcagggtcctgcagattttaaatgcaggatttgctggattaatcctgccggatcctgtcctgtaaaaaattttgaattccaatcctgcaacaggatccgcaaatttgaaatttccggtctctactgttaatgcttaatattcatcattatgtgtaaataaacaaaacaaaacaaaaattgaccaaaaaaagagaaaaaattttcaaaaaggtcctcttttttaactagcgcaatatcttctaaatattcattcggtatatataattttgaaatagcaatttttagagaattttggtgataaaatcacacaaaactttttcatctttagtttaaattcgtgaaatgacaaaaaattcaaataaccgccttttttacgccaatttttaaatggcgggaacatttttattcaaatattttttgtttttcaaattttcttcattttctttgctcattttccgcctacgcctaatgaaatgacttaattcaatttgaaaacttcatattttaacaaaaaatatttttaggcctatttttctacaataaaattgcaaaatgtccagcacttcgtccactgctggtggtgatggaggagaaggggaaagtgaacgcaccgcaagtccaactccgctcgtcccgctcaacgaatttgaacggaatacgcttcgaagcgcttcccagcaggagggcagcggtccgtccccctttttgggctttaagcatccaattaatcggcttttagggcgtccaatcattttttttttgagggatcatggcctatttaaaaatgccaaatggtgagtgatacattggcatttcccaattaagagtatggcggtcttgactatcccgcttcggaaagcggcttctccggcgtcagtgcatcaacggtggccaccggacagggacgagcgggcggcacgggcaaacgcaagcggacggacatgaccatgacaccggcacaccagcgcacgttggcagtggatgccaacaatgaccaattgaggcatgagaaaggctgggcaaaatttttccgccatttggcaagccaaatttattttacggaatttcaattttctcaaaaatataaaattcccgtaaatttttatgtgcctttccttatgaattcacaaaatttcttccgtttttctgtgcaaattccctccaaaaatcggaaaaaactttattggtgctagaaatctaacctctatttcgtcaattccgaattctaaatgaatttcaaaacaaaaattcaaaatcggttttcgacctttcgttcgagttcggattagggactcggaattggttatcaaggtcgcaaaaagaatacacaaaagaaaaaatatcgaaataggtgtcagattcatgcttaacatttgattttggactgagaaaatgtgggagcaatcgaaaaaatgcctaaaattgtttaagtgccatttcagaaccgatctcgatgacactttggggccaactgcggccgacgacggcgccggcggtgctgcgattgaccaacgcgtttacatttggggcacccgtgtttgtgttgcggaagtgcaggccaagttcaagcagttcatcaccacatttgtctccgagcaggtggacgacgacgaaaacgccattcaggtgcgtacccgctttttaatgccgaaattcgggtgccaattttgattggcaccccatcatttttcgactcttattcgaatggataatttttttttattagagaaagcctgcctttttggttagggttttttttgaaaaataaatcatggcccaatacccgtaaactttggaaatttttggtgactaattgaaagaaaaaacagggcctaaaattttcagtttttgcttgacggtgccttttggctcggtatagccgaaccaccactaaattggttttaaaatttttcaaaatttggatccagaaatcatccacaacccactgattttgaatgaaaatttttgcacgacagatggac

SEQ ID NO: 5993 - DNA, 1426 bp, Heterodera glycines
ggggtgtagcccccctggccccccccccctagctatgcccttgattggcacggaaaattataaatttttctcaaaaatttcattggttttttttcttgtgcagatatcaaccaattggtcaccacccaaggcatggtcacgcgcatttcgccgctcatcccacaaatggtcgaaggctatttccaatgctcattctgcaactatccggtccaatttttttgagagttgctcgggctaggtgaactgttcactctcaacaccaaccgggattttctgagggggcaggttttggggcaaaaattagtcttcatgttttactgagattactggctattgctgctgttgtaggaggtgcgtaaggtggacatgggcgtggtggaggagccgatcaactgcatcaactgcaataaccaaggctgcttccaactcatccacaaccgatccactttcatggacaagcaggtgatcaagctgcaggagataccaggtgggcgagaaagggcagtgttttggtgtcaattaacaatcaacaaattcaatactcactctcataatccaccaataaagagttcgagcagtacatcgacccgaataccaaaaatgagccaaaattaaattttaaatgacccatttagccccgaaaaattaccatgagaattcaaccccaataaattggctcgcacttttcaattttttttttgagttcaaagtcaacgccgtttggccgttacaaaaaaagcttaattattgacaggcgacatgccggccgggcaaacccagcacacagtcacgctgttcgtgcacggtgcgctggtggagagtgttcacccgggcgatcggatcaccgtcaccggcatctaccgggccagtccggtccggctgaacccggtgcagcgcgcggtgcacgccatcttccggacgagcatggacgtgatacacttccgcaaaatgtgccaggaccgactccatgatgtcggagacggcactttcttgacggaggagcgggtggcaaaaatcaaggcactcgcccagtgcgaggacgtgattgaacgactgatgcaggcaattggtcagttggggaggggagagagggtacaaattaaaaaatggactttttttaattccaactattttttaattgaaaaattctattttacgattaaagatttgtgattggctagaaaatccggactttcataatttttttcgaagcttttacataagttttattatattcgaaaaggcattaaaaatttgtttttgtttctaattttatgaaagaaaaatagaatattttttgaaatttttaattttttttaaaaaatttccaaattttttttctaaaaattacaattttttttatttctccctaagcgggagtggatgaattgggtaaataagagtgggatgagaaagaaatagagag

SEQ ID NO: 5994 - DNA, 1585 bp, Heterodera glycines
ccccccccccccaaaaatgaaaaatgtttaaaaaatttttatttttcggcatttcaaccgcgttttttcagcgcccaacatttttggccatgacgaaatcaagcgtggccttctgtgcctgctgtttggcggcacgcgcaaagcggtggacccgacggacgacgcgtcccgtgtccgactgcgcagcgacgtgaacattttgctgtgcggcgacccgggcaccgccaagtcgcagctgctccagtacgtgttccagctggtcccgcgctcgcagtacacatccggaaaggttgccattgtggttcctttttaattaatattttaaaaaaattccccaccccgaaaaaatggagtagagtaaaaccctccgccgataaattattttccgtttttttttgaattaaacatacattttttcaaggaaaggaggggtcgcaaattctaggaattttctttaaagacaataaaaattccaatatttttcccggggcgcctatcggcaacgctggacaaaaaactccaatttttattaaaaaattaaccgaaaatcataagatttgatcatttttgaacaaaatctttaaccaatcgcatgaaaaattacactttacctctctgttcccaaaattttttttggaaaaacgcaccgcaaaaaaaaagcgggtttttaaaaaaaagttatcaaaatcggcggccgacctccctccccctaaaattctgtcgtttaatgatgaaattgaatttcagggctcttccgcggtcggcctgagtgcgtcgatcacgcgcgactcggactccaagtcggtggtgttgcagacgggcgcgctggtgctggcggacaacggcgtctgctgcattgacgagtttgacaaaatgagcgacggcacgcgcagcattttgcacgaggtcacaaaaaaatgggtggggattgatcagaccacccagaaaggataagggtcaggacctccgaccattcggggtaattcccgcaacttttgtcttgccccgagcccaattaccaattcgggacccgacggagtgacaaataaaacgaaaacagccgaaaaaaacgatgggttttgtttatttttcacaaattttcaataagttttttggggtatggaacagggatgcttcgggtcaagaaaaagtcgggttaggtcgaccgaaaaactttggaccgtgaaaaaaaagtccggtgccggacttcgggtaacccgtacaaatccctgcgcgcatatggaacaaagagctgccccattaaaaattggtgatcagcaagcagcggcgatcaaacaaacaaaccctgatcactcactactactgatcaaccaattaatttttcaggtgatggagcagcagacgctgtccattgccaaggcgggcatcatttgtcagctgaacgcgcgcacttccgttttggccgcggccaacccaatcgactccaaatggaacaagcggaagaacattgtgaagaacgtgaacctgccccacacgctgttgtcccgctttgacctcatctttttggtgttggacccgcaggacgaggcgtacgaccgccgattggcacggcatttggtaaatg

SEQ ID NO: 5995 - DNA, 1749 bp, Heterodera glycines
  misc_feature (1360)..(1360): n is a, c, g, or t
caatgcccctgtccgtcttgtcctttatgtgcaaaatgtggttttctttgtccgccttaattttggttgaaaatttttcggttgccacaagttctgttgcgtttgccggcgaaagggaccgaatttgtcctggtcatccgacgaattggagtccttactacagtgcaaattttcgggaatcggtttttcaactatttcggcccaacgcagtcccactggatcacaaaattcaggctcatcgccttgtccctccataaatcgctgttgtaaactcactgcaaccttgtcaaaagcaacacacaaacgctgtgaagtttcataaaaaaattgacctccgcggcttcgtttgaatttgtcgtcaattgactcactcatcataagataaatggtcatggctctgctgtaaagtatgtatgcgtcctcctcatttccttcctgcattttcgtttttcctttccgttcgacttccaccaaaaagttgagccgagtaaaattgtcgagccgtcgaagtgaataaagcaatcgattgtcaatgtcgttagcatgttttttgagcacctcataagattcgtacctcaacggatgcaaatttgtcgatgaagtccgcataattttgtcttatcaacacgagataaaacaaaaatccaaatgcataaagcaacacgagctttttataaaagattgtttggcgagcacaacacgagtgctttagacgaatttgtaaacgtggacgaaataaggcggatgaagaagaacccaacacgagggtattaaaatttgacgagcagttgccgaacccaacacgagggtattaaaacagtcgataaacccaacacgagggtttttgccaaattaggtagtcgcgtttttaaaatgagaaattcactgaagaaaaataaagccgtccgccactgagctaacctttgttaccaggagcgccatgttggaaaagaagaaaggaattgcgccgggggttttctttgccacacttctaaattttgcacaaatagtctatgaaatgggcaaaacctgctttaaaaatccaacaccaaacaaaataaatttatgcaacaaataattaaaagacaatccaaaataaataaaattcaatcaacaacaaattaataaaaacacaaaaaaaatcgacgaccaacaaaacgcctaaaattatcaccgacgataacaaaaaatccacccctaccagagaagaaaaacgaaaatatttgggtcgaattcaaatcaaacattatgccaaacaaattcaaaacaatcaaataaaagggtcaaacagtcactaataccacatcctcggcctttaagaaagacggtcccctcgtctttgagtaaatggtgaatgcgncatccgaatggtggggttcaaggctttcagctagtgacgttacggcttttaaaaatgtgggcatttgtgtcctcgaaaaattttaatgtgtttgtccaaaagaattttatcgggaattttgatgaagatccacgttttgagccattttgcacggtccgctaatattcgtccgtcggctttcacactgcaattttcaaatccccaaactccaacccgaacttttttcttgcccgtctccctgcagccaattttcttcccctcacccgaaaatttcatcgtccccgatgaaaataccaaattttgaatttggaatgcgccagcgatcggcggcatcttattggtgaaggagtagtcgcttttctctagttccgaatgccttcgcatccaaa

SEQ ID NO: 5996 - DNA, 5343 bp, Heterodera glycines
  misc_feature (2721)..(2721): n is a, c, g, or t
tagaaagggaaattggtggggccccgaaaattaggaatacgaaaattctccgatttaaacttgttccgtggaaatggagtttggtcccaatttgccccttccaatttaatatttaatttattctttaattcctcgtttcatcctccatttctgtgagaaaatcatgagggggcgtgccctagtgcggtatgatgcccaagttaaaaattcaagttcccattgcactcactacaaactgacgacctaatgaaaaaaaaatccccgaaggagaatttaattaaacccattccttcggggaaccggttcgggtgccgcggggtaagcagtgctggtttggtttcatcacggcacccatccttttggcaagctagccatcgttgcttaacttgccagatcggacgggtgcgcatgattccacttttccaaaaaattgttcgaaataactaatatatagagaccgcattttgaggcatatgccttttttctgcgcactagttcccgtatattaagcataaataacacattttccacttggtttgaggcttctatgttgacttttattatgcctttttttgcctttttcgggattttcgtgccttaaatgccttttttggcattttgccgttttggtgcctttttttggcgtttttccgaaaattccattaaaaacagaataaaatcgggaaaatacacccttaagaaatgacttaaaattttcagaaaatacacccctaagaattgaaaaattttctcaaaaattaatcgccaaaatactttttttttcttgataaaaaattctcggtttaaaaattttccttattagaaaacattataaaatatttaataaccatttagatgaccaaaattaagtttttggttaagttttacgtgttttgctccctaaaaaccttagaaaaatttttttaaatgccttttttcatgcctttttcgggattttcgtgccttttcatgcccttttttcaattttttcgtgcctattatagtgcctttttcgcgatttttggtgcctttttttgcggtctctactaatatataagaaaaaatttaactctaaaaccgagccattttcgaatacaagcataaaaatgctataattacatttaaaaacacgtagcatcattttttattgagaatagaaagagctgagttcgaagaaactttttttaatttaagcctacgaatatgcatatatttcaaaattcataaaaaatttatagaacagaattcattcgagattttcagaaatatatacgcatatgaggccattatgaacatgtaaataaaatttggtgcgcttctgatcacaactcgaaaaattatgagtaattgaattttcactaaaaagttaagcctaaaattattggcccaattaaaaagcaattttaaattttaaaaatttttattcctcacaatttttcagaatataagcattatttaacatgtaaataaaatttggtgcgtttcagagcactttattattatgaattaattttgcaaaaaaaaattaaaaaaatagaagactcagaatttcgaaaaaaaatttatttcaggaaactgattagaaatgtttaaaataggttaattctcttcttttcagtatccctgcaaagtttggtgcgcttctgatcagtttaaaaaaaatcacaaatttacaattttataaatttaatgagttcctggtaatattttattaaaatatttttccagccttttttttgattcttctttcaaattacaaaaatttatcaaacataacaacacattgactaaaccctgaaaattgaaataaattctcaatcattccgtattcagaacgccttcactttttctcttgaattccgctttatatttttctaatgatcctgtcgccaaagtttctcttggcgacgagaaggcggaggatggaagcgggagaattcccgggcgcagtttgggggagctcggcttcctggtgttcaaccaggacggtacgtcggtggaattggacgaagaggaggaaaatcagtggggaggcggcgtccttgatcatcccgaagcggctccgcggcgcgcaccgaaggacgaaaaacgaaagaaatggcgccgatgagacggacggctcccacacttcaccgggagagccactcccgacagccaatttcgatccttccgccatttccctcgcaatttccccacatttattttgccatttcttatttttattcacatttattattctctctctctctctctcttctcttcgcctatcgtatccaatcgtctcacttctccgatttgcaaattgtttatgcatttcttcgccacttttcccaatcccccatttttcgctggcctttggccgtcatttatccgaaaacattttctttgtcccaatttctgcacattttccatttcattcatttattcaatcccccctttttcccttttgcattaccattttgtttatctgatcagcctttggccgattcattttgccgtctttgaattagttattcgccagcaattcttcgggggcgtctcccccggtctcctccccctccctttgtcattgcgtaacttggccatttctcattttcattttcaaatcgttcgccaatttgtaagggggctcctccccctgctctcttccgtcctcatttttcatttatgcataattctatcgcattttcaacattttgttttccactaatcaccactggnggagttgtctccccccaatttcaaattcccgcaccacaaatcgcggcattttttttacccccctgccgtttgtcactctccccccccccatgttcggtttaattacccaagtttgagctgcttaataaattgtgcttttaatcttgtgtgcttcaaagggtgggaaagaaaaaaaaaaaaggggagcgaactcccttcggacgaactcttcttagcccacggacgggctcgcgcatcgatcggtcacacgggactccctcacttggagtgcccagctcgccttagccctcgcacgggctcagcacgttaaaacgggactcctgcctccggagtgcccagccgtcccatttttctctcccttccccctccccaacgtcctctctccccctccgagagtcggaccatcggaaatcttcagcgcaagatgggagaagcacgctcccggcagttcaacttgtgggattagccaaagagtcccggcttctccaaattctaagtcggtggtgccgttattcacatcactcggcgccctcgcctgcgccttttgctgacagtactcaagcccaagggagccacctctccctttgccggccactgccagcttcactcgttcggcgcctctgcctgtgccgacgatcgcagcactcaagcccaagggagtcacccctccctctgccggccgctgcctttccttagggagtccaatttctcccgcgcaaatctttgtttgcctccccgacccctccgcctcactccccttgggaaagggacccggacggcatcgcgaatcggaacggcactttgaggagtgaggcggtgccagtggaacgggagaaactctcgaccgaacagaggaaggagttttcgccacaaacaaatttggtgccgttagcagggggacaccagcaacagtcaggtcgccgaggaccaacagcacaaccggtcgccgaggaccaacaacaattcggtcgccgaggaccaacccaacaacgaatcgcgccagcggcaatttggcggctcgatcaacagtgaacggaatggagtcgtcggatagtgaggagtacggagatgagcagcacacccaaaaaggaccaagcgggagtcgtcccgaaactttggacggaggaaagaagtctaaagtgaccggcaaaacgactacgagaagcgaatggaaaactcagtggagggggggcgaagcaaacgggtgggacacccgtcgatcagcacagcgctcgggcaaacatcgcagtccgaacgagtcgagatcagatcgagagagcggccgggacactcgccgcacgaattgctgaggcacgtggaacgctggacgaggacatgtcggacggggaagcagctcaacacgcagcgaagctaatggtcatgcagagaggcctacgagaagctgccacgatttttcaggggcatttcaacaaaggaattgcggcagtgggtgatgcaccctatgaacgccaggacgaattgtacgacttcctcaccgctgcatacgataacaaatcaactgaggctgaattgtcatcccaccccggccgaagcgcttcaaatcgcagcggagcacatcggtgacttgaggatgctgcgcaggactctcgaggacgaggacagggagtcaagccgccctgactcggggggctcggacagaacagaaggcagcctagctcggggggacgacccccgcccgttcgaaacgcgacaccgagaggactgggataagagctttcaagcggcatccgcgcggtggcagcccgactcaacggctgaaccacggccacgccatgaccatcagccaattcgggtgccaacacccatgatttcatccgccgcacaggtgctccagcgacgcaacatcgctccctcggtagcgagcctacgagttaacccagctcgggaatgggtgaatcagaacagcgcacaaatgggggcgaacccccaaaggcagatcgctcagccaatccccgtgcttggacagccaactgcgggagccggaccgacccaagcccacacgtggcgggacagacagccgcctgacatgcgagcgacgcgcgagacagggaggtgctccctacggagtcaatcgcttgaccgagcagatgggccagcttacaacgttcgagacggtcagactacaaccacccaccttctccggaaaggcagaggactggacgacgttttgggcctatttcaaacgagcggtggatgaaaagcccatcccaggcgtggagaagcagcttcacctgctgcggtgtttgaaggagggatcgccggcgagacgagcggtggaggtttacccaccgacggacggcaactacccggtggttgtccagctactgaaggagcggttcggcaacacaaatgacctacagcgagcgatccgggcacagcttctccatctccccccagccaaggacaccgtggcgagccttacgactatgatcgacgaatttgaacggggagtctgccagctcgagcagctgggggcaaacgtggacgatgcctcgtttggaccgctgttggaggccaaactgccggtgcggatcctgacggagttgcgcatccgcgagaaaagggatgggagcggagtggacggtccgggaattcgaaaag

SEQ ID NO: 5997 - DNA, 4160 bp, Heterodera glycines
  misc_feature (3272)..(3272): n is a, c, g, or t
ttattggcaaacaaaaaaagaaaacccaaaaatcagtgctcttctaattggaaaacattgaaaatttgtaaaaagaatattttaaatggaagaaactgtttggataaaagaatcattgaaaattgaaaggatgattataagaaaaattggataaattggccgaaaaaattatcagaaaaactatgtcaatttctagtttttttttcaaattttttgtatttgtattaaaaaaattattttaattaccctaaattttgaaatttttcttagtgaaaataagtgaaaacagtcaattcaaggattgggagggtatcattaaaaactgaacaatgttggaactgggctcccagtatgcctaaattttcgattttagaggccctgtaaaactccttggggttttgctagggtgaaaaataataaaaattaaaaaagcataaactaatattcaataacaaataagtttttaaaaaatgaaattgagaagcaaatgtttgggtcaaaataatctcaaaatgttgtataatctgcttaataaaatccaaaatgattagatttcactattaatgggccatttatttatttgtgaaatgattttaaaaaaataaattggttttctaattaaaataaactataaaacattacaaaactcaactgatcaccaaaaaataatatttattcatttaaaaataagtatattttcaatgccttacaaagatttgcattcgaatcagaacaaatttaaaattcatgacatttttatattttcaataaatcaaattttcacataataaaatcaatggaaaaaattttgtttacttttctttatttaaaaaaaacatgccaagccaaatacaatacaatgatttataaaatataagaattgaccagtttttaaaacataaataattttataagaaaatttatccatttttttcaaaaaatatttttttgctttcctccaaggcgcgtctggccaccaaacacttttcgaagaaacattccaaagccttcttttgatcttcatccgttgggtactgtccggtcgccacaaaatctccctttttggccacaaataagcgaatttcttcttttggctcgccttcaattattacgcaattagggacaattgcaaaaataggcggtgaaggagggataatgaaatctgatatcccgggaattttggctccggaaatcaataaaatggagaaacgcaaaaattgcccctttgcagtgatggaagtcgatgaggaagacgacgacaaaacgtttgactgggacgtcctgtgtgctgaggatcaggatgatcacgaattttgtgccgtgctccgcgtgtctgaactcgtcccggcgctagggaatgccgaacttggcacaatggccgtgaaaacccctctacacgctcttttggcggtgtttttgctgaaagcgggaacagtcaagtcaatgaccgcagcgcgaagtctggtcaaagcgataattgaaggcgagccaaaagaagaaattcgcttatttgtggccaaaaagggagattttgtggcgaccggacagtacccaacggagaaagatcaaaagaaggctttggaatgcttcttcgaaaagtgtttggtggccagacgcgccttggagaaagcaaatttgagaagattggcatgacggcgcccgctggactcaaccacttggccgaatcagagaagaaaaagtgggaagaagcgtccaaggaaacgccatgggcgttagaacaattgagggcaaaaatcgtgcacaagcctcaaaactgatggcacacccgcgtatcataatcggtgatcagtctgctcaccaattggcggaaatcctggaccaaacggcagtgattgggcccaaaaatggaacattggcggaaacagtgcgcactctgaagccagtggtactgtcgagcaaagtgaaggcagctctgattattgccggacgcgactctcttctgagagtagaaactgtcgaaatgatgatggaacagtacgaaatgatcgcgaatctgtgcgccgttttgcacatgtgaagttcttctggacatgctcgccttatgtccatgagaagcacgacgaatacgaagaactggtcgcacgtcttggaccaatgatgagcctaaaccccttcattcccgtctgggtgacggaaaaagggtgatcaattcacgaacttttccgattcggcaactcctttgacaatatgagagtgacttccaacggactaatgaaggacgctggcgtgcgagcactgaaggcctgacttttcactcagtcagacttcccgggtgatcaaaaattgaaaattcggacaattcggtcggcagttcacgtcgctgcttcggttggtctgggtgaccaccgacagccgagcacttcgagttcgggctcgattggtctgggggaccatcggcgccacaccattggttcgatcggttatcgtgatcagcatcgccgtggttcgggctcgattggtctgggtgaccatcgacgccacacgttcggaggaagagcccaccgagatcaccaccacccgtacagcagtggagacaaccgcgtcttctggccgaaccgtggatcgtcgtcgaatcaccgcaattaaaacgttatagttctgctcgaatcaccacacctttcgatcgaacggcagggacgccttttttgttgtgatggggatgtagtgatcagttgacttttgaccatttgatattattttaaatcatatttgtttggcattttatttatgattttgttttgttattttgttttgtgtaatttagttagttcgctgttttatgtaatttggagaataattggatatgtgctgtgctgtgccaatttgagttttaatattatttgacggagttggataatttgtgaacaataatcattggtcaaagtcctaatcaattgtccccatccttccgacctaattaaaagactgtccccgtgtgtccctgcctaattaattaaaagcaattaaagcagcggagaaaagtgactattataccaaggaaaatttttacgtgtttcacttccatgctttggtaaagtcggtccgcaaatgtcggctaaccttttttactcctttatttgaatggaatacaaaaattatgagatgaaaagaatacggtgaatacaaaaattgatgtggtcaaaataaaaataaaataaggtagacaacaaaaggccataatttttaaattttacaactattttcattaaatggctcgtttaatagtcctctccaattttttttctccattntaaaacgttagaaagccaatttatttttttaaaatcatttcacaaataaataaatggcccattaatagtgaaatctaatcattttggattttattaagcaaattatacaacattttgagattattttgacccaaacatttgcttctcaatttcattttttaaaaacttatttgttattgaatattagtttatgctatttaatttttattgtttttcaccctagcaaaaccccaaggagttttacaaggcctctaaaatcgaaaatttaggcatactgggagcccagttccaacattgttcagtttttaatgattccctcccaatccttgaattgactgttttcacttattttcactaagaaaaatttcaaaatttagggtatttaaaataatttttttttaagccccaattccttgatccatttataaattgtcgttcgatttgtccccaattttttcgctatttttaattcaattttttcccattcttttgttgagtattttcttcctttttgcttgattttctcttttattttataaaattttgcaattatttctctttttttgagttcatttcgcctttcttcttctttttcttcccgtttttctccaaatatttcatcaaatgatttctgttgcaattttttcttttccgttttaatttgatcaatttcgatgattaaaaatataattaaaactaataataggtggagtttcattttcttcttaaattctcaaaaataaatttggtaattttttatttttataaataatataaatctaaatcttctgcttttacaaacataaaaaaataatttaatgtaaataaaatttattaagattttaataaattttgttctactgaacaaattattggcaataataagta

SEQ ID NO: 5998 - DNA, 1870 bp, Heterodera glycines
  misc_feature (74)..(74): n is a, c, g, or t
  misc_feature (126)..(126): n is a, c, g, or t
  misc_feature (172)..(172): n is a, c, g, or t
ggcctctaaaatcgaaattttaggcatactgggagccccagttccaccatgtttcagtttttaatgatacctcnccatccctgaaattgactgttttcacttattttcactaagaaaaatttcaanatttagggtaattaaaataatttttttaatacaaatacaaaaaatntgaaaaaaaaactagaaattgacatagtttttctgataattttttcggcaaatttatccaatttttcttataatcatcctttcaattttcaatgattcttttatccaaacagtttcttccattttgaaatgttctttctatcaattttcatcatttttgcaatttccttgtcactcattttcggattttctctttttatttcccaataaattttcattttttccattttttctttttccgttaattttatactgcgtatagcaaattgtttcttccatttctcaattattctttgactaactccaattttcttacaaatttcggcataattttgtttccattctttggtcgaatattttcttttctctttaagctcatttgccatttcaatgaatttttgtacaatttctaacttttcttcatccgtttttgatttatagcttttctttatttgtttttgaagccccaattctttaatccattcataaatatttttgcgatatgtccccatttttttcgcaatttttctttcaattttattccattcttttcttgggtattttcttcctttttgctttattttctcttttattttataaaattttgcaattatttctctttttttgagttcatttcgtttttcttcttctttttcttcccatttttctccaaatatttcttcaaatgatttctgttgtaattttttcttttccgttttaatttgatcaatttcgatgattaaaaatataattaaaactaataataggtggagtttcattttcttcttaaattctcaaaataaatttggtaattttttatttttataaataatataaatctaaatcttctgcttttacaaatataaaaaaataatttaatgtaaataaaaaatttttagattttaataaattttgttctactgaacaaattattggcaataataagtaaaataatgattagtttttaaatgttttttttccattaattcacattttattaaaatggtccccattgaaaaatattataaaataaaagaaaaaaataagtaaaaaggaagaaaatactcaagaaaagaatggaataaaattgaagaaaaaataacgaataattttatactgcgtatagcaaattgtttcttccatttctcaattattctttgactaactccaattttcttacaaatttcggcataattttgtttccattctttggtcgaatattttcttttctctttaagctcatttgccatttcaatgaatttttgtacaatttctaacttttcttcatccgtttttgatttatagcttttctttatttgtttttgaagccccaattctttaatccattcataaatatttttgcgatatgtccccatttttttcgcaatttttctttcaattttattccattcttttcttgggtattttcttcctttttgctttattttctcttttattttataaaattttgcaattatttctctttttttgagttcatttcgcctttcttcttccttttcttcccatttttctccaaatatttcgtcaaatgacttttgtttcaattttttcttctctgctccaaatttgatcaatttcgatgattaaaatataattaaaactaataataaggtgaagtttcattctcttcttaaattctcaaatagatttggtaattattatttttataataatataa

SEQ ID NO: 5999 - DNA, 900 bp, Heterodera glycines
aacagatgatcacccaaaatgcagcaaaagcagccgaacaaagagacacgaatttttgccaaaattttgaacaccgccgacaatttaatttccgatcatcgaaaattatgccccaccacaatataatgcatcggctacgagaatttttgaacccaagccgtcagaccttgcgcgtcatcgacataaatggggaggaagttaaatgctacggaattgtttcgttgccggtgagaagaatgggaaggaccgtgtcagttcgtctccacgtggcccaaacatcgttcggctacgatttgctcttcggaacaaattcactttcggacctgggttttaaacttttttgacgaattgtccgacacaattgtcgatttcaaaccggcatcgaacaatgacaataaggcagtaaacatcatttatggtttgactttgattcaaaattccacgccatgtttgctagggaaagaacgaacagaaaaggctcggaaaaatggtgtagccatcagccaagaacaaaaagtcgcagatgataatgttgccaaaattccaaaagtcagcaaaagtcgtcgcaacaaaagaatcgatcgaagtggcaagcaaaaaacgggaaaaattcggcacagaaaggaggaaaattggagaaaaaatatgtgtatgaggaacgtaaatttggggaaaaagggagtgaaaagagtaggaaagatgtagaatgccaaacagaaaagtcgattttagaggttcaaaaaaatggaaaagtctgccgaaatcttagaggacggagttctcaattggggacaattgaatttttggagggcgggaaggaattggacccgaaaaagtcgaccactggtaaaaagaatggcaaagcgaacccgatcttcagaaattttggtggatcgtaca

SEQ ID NO: 6000 - DNA, 2174 bp, Heterodera glycines
ccaccagaatcggggatttgccatttcatttggcggaggggaaggaagcggggaaggcttggaaggagcattgggcatcgatgggggacaaatggcactggtggagcagcaaaacgaagcattggccgagagggtggccgaaaaaatggcggtaattcggacgatggacggcattttgtgaccgcattttagaagtttttgagcagccaaatggaaccgaagttcgcctcaattctgtcggaattgcattctctgaacaaatccgtggaggaactgaaacggacggtggcgacggtgcacactccgccacaacggcgcggactcatttcagtcccggggatggtgggctcaaccggaagcagtggcagcagcacaaccaagcagacaatgctgaacggttgccaaaactacgcaaaggcgccagtttccaccggtggcagcgcaacgccaacaaaaattgcgttccgtccctacccaatgaacaacggctcacttcggtatcagcagcacaacaacgccaaggcgccggcagaaaataccgtcaatttggaaattggcagacaaacggcacaacagcagcagcaacatcaggtggggaagagcaaagacggacactggccaaattgtggccaattttgctgcttttacccgatgctttttctttagcgcgttcggctaattaacacgcgcaatgactttgccgggggcactgatcactttccgcctgcttcatcttctgctgctgacaatgtgatgaaattcccgcctctcaaaaacgacttcaaattgatgcctttgacttcttcttcttcttcgacaaattgcggcgaaaatgccctcctcaaaatgccattctcgtcctcctcaattccgtgggccaccacgaagccatcgacgcatgtgttggagccgccaaaattgaccaaaatgggcacggttgggctgaaaaacgggcggaggagcgttcggaagtcggtgcacgcgtacagacagcggaggaaggaattgtcatatcggcacatgaaagagatcggactgaccgtaagcgaagctgagggaacgaagcaccgaaacaaaaaacaatctcaccaaacagttggtcatcaacggagtgccaaagtccattttccattgccgcgtcactgacataacaaacgccgtgcagacgaagcgaagggaattggcccagcagggccaaagagtggtcagtgccatcaaaagcatccatcactttgccatgtcattttgcttttgcagttctaccggggccgggacgtgaccgacgcgctgtaccgcgtggagtgttcccgcgtgatggtcaacggccgtcgctgtggccaaatgatcgcggactctctgtggccgcggggcttcttccgccaacgcatgcttatgccaatccttcgcggggttagccatcgcacgaaaaggcgcaccgacggaacgatgagagaggcggtggccaacgaccaattcgaagtgttcaaaggtcgaaaatgccgagggaaaagaaatgagtggaaaatattattccgtttgagaggctttgcttcggttgggcggctttttgatggacgagccggacagatacaaatggatggaaacggcacgggagggggtgaaccaacgggggctggacgaattggcaaactcaaagagggcgcacttcgaatttgagggcggtccgctattcggggacgaaattgtgggcggggaggagcagcaacagattggcattgacaacgaaacggcacaggtgggtgaggagagagtgttagagagatggaaaaagagagagagagaaggaggaacgagagagagagaaacgagtggaaatagagagagagcaaaacgagtggaatgagtgagagaaaggggacggggtgaatgaaagagagcgagagaatgagagggagagagagagagagagaatcagattttttattgcagcttctcacgtccaaactgttcgcttcttcgtattcggaattaccggcaaatttattattggctgaaaatggccaatatgatgaggacgacgaagagatggaagaggaaaacggagaaaatggggagagagcggagggggaggacggacaaagcccagtggaagaagatgaagaggcggaggagctgaatttgtaagcgagcggaagaaaggcactcactaatga

SEQ ID NO: 6001 - DNA, 3063 bp, Heterodera glycines
ttttggttcactcctcaaaagttccgctacaaagtctcacatctcactgaagtccttggcgtttccgattgtggccgcaaaacattggggggaggggtcggaatgaatggggaggggtgcccttgttttttacctcctttttttggcaacatcgtcgggaatccgttcttgctgaatgccaaactgtcctaattttcatttatttgccaaattcaagacacaaatcaaaggtcaaacgaacgtaatggaggatggatttgtagtcgtacggctgaccgtaataactcgttttggtcaagtcaattttgccgaattggtcaagggcacctcaacaaaatgaccagagtaaataaaagtgattttcccaatttaatttttaataatttaataaaattattgcttctaaaaattcgcataaattttaatgttgacacttcgaaactccgacattttggaaacgcaacattaagtataaattacttttgtcgatgttttgccatattatgtcaatgtaaaagtcgcggtcccatcgctctgaataattaataattatgataattaaacactatcatttcatattagccaactaattaatgaatatgactatcatttaattattagctgattaattaatgaaaattaacaaaaatggaccgtgttcgtggtaaaagccaacgacatgcattatctattggaaagggataacaaactcaaaagtcattttcccattgaatggttttattacctcgtgaattattgtagagtaatccatgcaactgaaatggttggaattaattactctttttggtttaattgcccatttaattgccgattaattacccattgtccagcgaaaggacttggactccgctggtgcgaccgacttcggagaagcagccgtcaactttgccgatgaagagataatcactgtttaaaacggatggcatttttgtaaacgaaaaagcaaatgggcaattaagccttatctgaagcggaacgaggcaaaaagcgaacgcaggtacggtcgtggtactgtaataggggcaaaaagaatttcccattcgtccacacctcctcctaaggcttcttcaattcagcccattcccctatttggccattcctcccacatttgcccatttatttccccatcccccttcggcttcttcccatttgcccattaagctatccatcacccttaggcttgtccttatttggccatttctcccccatttgcccattaagctactccttcccctttaggcttcttccctttgcccattttcctgcctgtttgactgccttggccagcagtgccctctcgtgtgggctgtaatgtgtgctgatcacataagggatgcgtgcgtttggccacagtttggccgctctgctcactccgttccgtttgtctctttgtccgcttttgctccgtcgcgtcgaccgaatgtccgactggtaaatccatctctgaagtgcgtgcgtttcagctgctcatttgtccatttcgctttaccttttccgcttggctcagttctctgttcagttcctctaggcaaattcttttgtattttttttaaattttttccgcaaaaaacttttacctcttgacagtttttctgcatttgtaaagtccatttcgtttaaactgctgatggaaagactgttgaaattggcacttcccaacggaaaaatgactaaaaacattccttacggtcatacagtatgaaagaaatatgagttttcttaagcattgccccacatttgtcccagtcaaacaaaatgccaatcccaaaaatgccatttcgttttgtcgcacttgcctaaaagaaatgggagcatccatctgctgttgtgtgctgtgttcgccttttttgatgatggcactgattttggcattcttttcccattttggcacatttcattcacccgatttgacaccgtttcgtcccaaagttaggaaagtgacgctgttcttgataatttatgcgaaatttcaagggttcgcgtgtcactttctgcgttgtttggttcgggtgggttggcgtttcgtcgctttgacgggaaaggggcgggggagtacggccacgcttcggcttcttctcctcccaccgttccttgggctttttcccttctgctgctgtttcgctttcactttcgtccacgcgttgcagcagtcgcttttcctcctcttcctcctcctttgcccattagcagcaattagttaatgaggggggggggggtggtgttaatgatgcttcttccccttcttctgctgcttcttcctctgattgatgttgttctgcttcttctgcttttgctcttctgtttttgtcctttgctgttccgttgtctccccttttgtgcttattattaattattattaatgttttgccttttctccttcgtcttcccctgcttcttctcccattagcattgtccgatggattggaaaggtgcgattgctgcgcacgtcttcttcctccgctgcttttcctactggttcctgttactttggctgaatcgtcggcaaatttgtggagaagaagctttcattgcttcgagcgatcgacaataaaaaaaattgggcatggacagaatggggagggggagaaggggtactcgaaaagaggaataaagtgatctaatagggaagaggaagttgagagagggagggaggaagagagagaaaagggaaaagcttgggggtagggaatgggaaaagcttggggtagggaggaggagggggcaaagccggggggagggaatgggaaaagcctggggcagggagtaatggggggggaagccggggggaacccggaggaggggaccaggatgggtccgctagcactgcaagtgaatgcaattaaatgccgagtgtttctgttttaagcaaaaacactgacctttcgcttactcaatattattattcttattatgctcttattcaaatgcttttgctcaattgccttttgctgctttgcgctttcgcagtgccaatgcgcccaatgggagaaaaagtcaattttgggggagaaagaacattttttgagggaggggggggggggg

SEQ ID NO: 6002 - DNA, 2406 bp, Heterodera glycines
atcagcagccacaagcgggttgaccgtcttccttccgtggtcatcatcttccctctccctccctctttctcccttccctcgtcttcttttggtcatccccccccccctcttctgttgaccattccccccaaatgattaatccatggttagtcaccccccccacccccaccaatgcttttgctttcctttctccacgacacatccatcaatcagttattagtggtcgtcgttctgctgctgatgctgctgaacacccctccccctctcttcccctcccttttctctttctctcctccctttggcttttttccaccacccattccgattcactttcaaaagttccctcttgaaaaccgcaaaaaacccataatgaaccaattatttaatggcttgatgaaagtttttttctgacgcttttattcttgaagaagtggcattacgccagaaattagagaaaaaataagaagagaagcggaagggatgaggtaaaataaaatatttaaaacaaagttaaatttacgctttgccataaaaaattatgcaatttaaaggaaagagaatctccaaaaagagaaaaaaactatgcagaaattgagacgtaatgaaatgaacgaagaaatttttaaagaataaaattggaaaaggaaacatttgagaggattattttttaaatcaccggggaacgatcgatcgatttgattgattttttccgtcgatcgatcggttcgagttccgccattcttgcgctttatctgatcgggaccagaggttggagtggcacttctcgcacgaccattgggtccattgtcagagaagcggccacattagtccaattgcatttttcgatgcccaccaggggcagattgaacgtggcgatgttctcacggccttccgcactgatcaacaccaacttgtagactccggtcagcgatttgtccaaattctgaaatccgtggccaatccgtcgctcacttcgtccctcccactgactttgatctcgcagatgaacttgtccctgttcgtgtcctgctgttcctggctgaactcaaaccgtccgtccgttttgctcagttcgctctctccgaatagccatttggcctttgtcggctccgaaaagctggccacacactccaagtacaccttgccaaggcttgtgtccggctgtgttgggcttcggctcatattcggcggcttcagcggaccgtggcgaatttgggcgttatgaatggtcggcggaaaatgcattacggataattaattagttaattaattaataactaaatttagttaatttacaaaaattattatgaaatttcaaatgaaaaaggaaagaatatttcaaatgaagtttgttgtgaaaacataagcaagcaataaggaacaatcagctggcttatcgataattatctgcccattttttagcgaaaatattttgaagcattgcgaagggatcggaagagacggaggaaaggggggggggatgatgaaagaacgggacggaccaaccgaccgacctctttcgcaattgccccgtggaatgatcacccaattccgatcactcgcttttccatcggcacgccccacttttatacggtcgaagacgtatgatcaaaggaatgaaggaatggcgaattattggccatttaacaaaaacgcgtgggccaattcgccactttggccgaacagcggcagctgttcacttggccaacggaacgaatgtcaagcgaaaggcgagcgtcagaagggcctccggcggcggatcattgctccgtcggcccattgatcactccccccccccccctccgatcgcttcctatttcattttcctttttccgtgcctttctctttttgggattgccatttattttggtaatatttaccaattggcatcgatggcaaagagaggcaaatggcaaatgaaatttgaacaaactttgaaaaggaaaatgagaaaaatgaaacgaacggcaaaaagaaattccaacggaacaaatgtcaagtcaattaaaatagtttattatcaattcaaagggaatgaatggaattaatcaccgacaaagcaaaaaaaaaagaaaagaaagacaacggaatgtttgtttaattaattaagcgaatgtttggcaatttcaacagcaaaaagttaaatggatgtgcttaataatgtccaaattggcacttccatttgctcttttctcactttcttttcgtcactttgcatttgtaatccgccaatttgacagcgaatgtttgtcgcttttcaaatttcggcggatttaaaggatcacaaggataaaccttaaaaggaaaagtggtctttccattcaaattcaatgagtggcacatggaatttgtggaagaaattcgccgtgaaaaggaccaattccattctgccgagggtttcgccag

SEQ ID NO: 6003 - DNA, 4144 bp, Heterodera glycines
  misc_feature (95)..(95): n is a, c, g, or t
  misc_feature (101)..(101): n is a, c, g, or t
  misc_feature (105)..(105): n is a, c, g, or t
  misc_feature (112)..(113): n is a, c, g, or t
  misc_feature (119)..(121): n is a, c, g, or t
  misc_feature (137)..(137): n is a, c, g, or t
  misc_feature (145)..(145): n is a, c, g, or t
  misc_feature (147)..(147): n is a, c, g, or t
  misc_feature (149)..(149): n is a, c, g, or t
  misc_feature (152)..(153): n is a, c, g, or t
  misc_feature (162)..(162): n is a, c, g, or t
  misc_feature (177)..(178): n is a, c, g, or t
  misc_feature (181)..(181): n is a, c, g, or t
  misc_feature (194)..(194): n is a, c, g, or t
  misc_feature (202)..(203): n is a, c, g, or t
  misc_feature (210)..(210): n is a, c, g, or t
  misc_feature (214)..(216): n is a, c, g, or t
  misc_feature (225)..(225): n is a, c, g, or t
  misc_feature (228)..(229): n is a, c, g, or t
  misc_feature (231)..(231): n is a, c, g, or t
  misc_feature (235)..(236): n is a, c, g, or t
  misc_feature (238)..(238): n is a, c, g, or t
  misc_feature (240)..(240): n is a, c, g, or t
  misc_feature (242)..(243): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (256)..(256): n is a, c, g, or t
  misc_feature (260)..(261): n is a, c, g, or t
  misc_feature (263)..(264): n is a, c, g, or t
  misc_feature (267)..(267): n is a, c, g, or t
  misc_feature (276)..(276): n is a, c, g, or t
  misc_feature (284)..(284): n is a, c, g, or t
  misc_feature (289)..(289): n is a, c, g, or t
  misc_feature (294)..(294): n is a, c, g, or t
  misc_feature (308)..(308): n is a, c, g, or t
  misc_feature (310)..(311): n is a, c, g, or t
  misc_feature (319)..(319): n is a, c, g, or t
  misc_feature (328)..(329): n is a, c, g, or t
  misc_feature (332)..(332): n is a, c, g, or t
  misc_feature (334)..(335): n is a, c, g, or t
  misc_feature (337)..(337): n is a, c, g, or t
  misc_feature (344)..(344): n is a, c, g, or t
  misc_feature (361)..(363): n is a, c, g, or t
  misc_feature (365)..(365): n is a, c, g, or t
  misc_feature (376)..(377): n is a, c, g, or t
  misc_feature (396)..(396): n is a, c, g, or t
  misc_feature (399)..(399): n is a, c, g, or t
  misc_feature (426)..(426): n is a, c, g, or t
  misc_feature (463)..(463): n is a, c, g, or t
  misc_feature (466)..(466): n is a, c, g, or t
  misc_feature (508)..(508): n is a, c, g, or t
  misc_feature (523)..(523): n is a, c, g, or t
  misc_feature (541)..(541): n is a, c, g, or t
  misc_feature (553)..(553): n is a, c, g, or t
  misc_feature (566)..(566): n is a, c, g, or t
  misc_feature (581)..(581): n is a, c, g, or t
tgccttcgagactgaaccgtcgagtgggtaaaacgttccaccacggcaaaatctattatggttcctctcatttggagttcctccaacggaagacnaaaaanagcnaacgaanncggcannnacagaccgagagacgncaaaggananancanncacagaacngaacgaggcacaccnncancagaagggcagancggacgcnncgaaaanaaannnacaaacaanaannangacnncncncnngcncnancacccnccgnnanncgngcgcacaancagcggcncccgncccancccaacaccgaggnanncgacgggnacgcccagnngananngnaagaacnccaaagaggcacggcannngnccggcaacggnncccacggacgggcaccggncgnaggcgacagcaccgacaccaccaccgncaccagcaaccgcaccacccaccacacccgcccgacnccnccacgcagcaccgacaccacccaccaacaacgacaacacccnccaacaacgacaggnccagcctccttcggcagncctcgaagatgnccgtgcataccancttacaatactcgcnctggctgtggcggtggcggtccagccctccttcggctttttcgaccctgcggtggacagggggggagggaattacgatgaacaaaatggaaaattactcatttctcccttctctcccacttttcctccttcctttcactctcctcagttcgccgcctcctcctgcgtctcctcctccatcttctccgtcgtcgtctccaccgcctccttcggtcgcctcaaaaatacccatcatgccactcacaatgctcgcctggctgtggcgatggcggtcgagcctccttcggctttttcgaccctggggtggacagggggaggagggaattacgatgaacataaatggaaaattactcatttctcccttctctcccctctcccatttttcaatcagttccctgcggcgtcatttaccccccccccccccccccctccctcacttctccccatttcgcctctcctcactgaccgattgttttattttcacacaaagttcgttgagcaatgttcggtcaatgcgaatcgcaaattcttgcaccaacgcctccagcagtttgatttggacaatgttcgtatgttccgattgactcatcacaaatgcacactccaggaatggctttggctctaaaaaaagaacaaatgcaacatttgtgcccccaatttccatagagttaaatattatttaaatgggaaattaaaaagaaaatgactctgttcacaatttaaaaattggacacggaaagaaatggacattttagttctaaataaaaaagcaaccatttttgaccactgatttcggctgtggtaccataaggattatttgaaaaataaaaagccatttaaaggacagaaacagcaccattcagcgagtcggtccacgcaaatggtgccatttggttagccttgacaatttgccactgtccgtggcccgtctgtcggtagcgaattgggtatttggtgtcgttcatcagaatcgccggcaccattccgggcacaaaattctccatgtgaatgacggacgattcgtcggacagagagacgataacgtaaaggccgatcaactaaaatatggaaaaaattaaaatttcggaacgacggaagcattacgttgttccggatttgacaaaagccttcgtatgcctctgtgaattgcaccgattcctcctccgtgttggcataacgtgccaccaacgttttgcgtttctctttctgcatggtcaccactttagtgaggccggactgacccaattggacatcgacagtcatctgaacggagaaaggcattaaaacaaacaaatgttttcagattgtgcctcaaattcaaactcgcgctgtccttcggcgatgcctttgcaaataactcgcccactgctgccagccatgtccaaagggaattcggcagaccaatcggactcgtccacgattttcaccttcgcctttttcttagactcaaatttacttttgttcaaaagcaaaatcatctaaaatataattgttggttctagtcggttttacgcgtcccatcacattttacgcgtcccaacaacagtttacgcgtcccatgacatttttttgtgtccatggcggggatggcattccggccacaaattttcggaattccgtgcggcaatctttcggaattgtggtcccgaaaattttttaatttgtatggcactttttctaggcttaaaaatacgctaatcacgaatatgaactcggatttgcccaattccgaaccccggacccgaattcgaacaaaaacttgaattattttttcaaaagtatacgttaaaatcgatcaaattttggcgtaaaccgcgcatttttatccaattaacaatttgaagcattattttaatcaaaaaataatagttgttgcatgaattagagttttttatcccaaaaaaatgcattcttgaaatttttttttcaatttttgttcgaactcgggtcaggagttcggatttgggccaatccaagttcagattcgtaatcagcacccttgaaaacccttaaactatgaattttaaataaaaaaaattttttcgggaccacaattccgaaagattgccttccgtgccatccctaactaagaggaaacctatttttttgtcgtgtatttagtaaattttcaactaaaaatttcgttactaaaccaaagtatcatgtcaactcatacacaggcaactcgatcaatggcttagactaggcgtaggcttttgaaaatttcttttgtgtttactgactgttgacatcaataagtttgcttagggttgcttttgcacatttcgataatcaaagtatacaatcaagaacaattatacgattcggaaggtataaagttttgattgacggttcgaaaaaagggtaatccttcggaattggtgtcccgactggaaaaagagataaaaatttttgtgcgcgtaaatgatgggacgcgtaaactgtcgttgggacgcgtaaaatgtgatgggacgcgtaaactgtcgttgggacgcgtaaaatgtgataggacgcgtaaactgtcgttgggacgcgtaaaatgtgatgggacgcgtaaaatgccatgggactcgtaaagtcaagggacgcgtaaaaccgactagaacctaattgtttgcaaaaaaacacttaaaaacaaagaccacaagcaaaagaaaggtgcacgtatttaggaggggaaatgagaagaaaagaataaaatatgtacatttataggcagttaaaaatgtttgtgaaatctatcccgtaaactaaacaagtacccacaccgtttcaaaaacgagatgtgtaccaataaatagagagtgccagagaaaaatgcatctctcattttggcgtactatttctttgtctctgttagtagagaaaaactgaatttacttcatcctgtttaactttttttctgcttgttaaatccgcttcaaattttgcatatcgatagagaaaaatattctgcatctaatgataggtcaagttaatattaaaataggtcaaactcaaaagttataagaaaaacaaaattttaaagcctcataacttttctctggtacaccaaatcgcttagcatttgcttagaaaaagcttctcctcatcaagagctttcgaatgataccatgattgtccaagttggttggcccaaaaataattcccaaaattcgtcattttttaatattttggacaaaaataaataaaaatattcatgttgcacaacggactcgaaccgcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcataaattaattcttaaatattttttcagaaagggttctgaaacgcaccag

SEQ ID NO: 6004 - DNA, 2855 bp, Heterodera glycines
  misc_feature (155)..(155): n is a, c, g, or t
gatcaaattaacataatttttgggccaagtacatacatcggcgtcaagcagttcagtcggaaatgacccggagcggacacgcgtttggtaggctttgaccacgccgatgacgcgacggacggctgtcggcggaatgccaaggccggtgatgcacncgccgacggtggaattggacgaagtgacgaacggatagggaccaatgctgccgggttgaatggtgccacgttttctgcaaattgatcggtgttcaataatttcgttttttggtttacgagttttgatccgttatggcatcgcgcgacaatgtcaatctgagaaagtgagagggtttaacaaacaaaacaacaaagcaaatgcattaaaagaaagcccaatgaacaaatactttccccagggatattttcttttattttgtaattatttccatcggcggaatgccggaatccttcggaattggtgtcccgacagaaaaaaattcaaattttctttacactttctcatgaaacctcgtatgcctctgtgaattgcaccgattcctcctccgtgttggcataacgtgccatgtcgttggaaaacaaagaccacaagcaaaagaaaaggtgcacgtatttaggaggggaaatgagaagaaaagaataaaatatgtacatttataggcagttaaaaatgtttgtgaaatctatcccgtaaactaaacaagtacccacaccgtttcaaaaaacgagatgtgtaccaataaatagagagtgccagagaaaaatgcatctctcattttggcgtactatttttttgtctctgttattagagaaaaactgaatttacttcatcctgtttaactttttttctgcttgttaaatccgcttcaaattttgcatatcgatagagaaaaatattctgcatctaatgataggtcaagttaatattaaaataggtcaaactcaaaagttataagaaaaacaaaattttaaagcctcataacttttctctggtacaccaaatcgcttagcatttgcttagaaaaagcttctcctcatcaagagctttcgaatgataccatgattgtccaagttggttggcccaaaaataattcccaaaattcgtcattttttaatattttggacaaaaataaataaaaatattcatgttgcacaacggactcgaaccaccaccctttgtccctttactatcttacaaaaaccacttcgccacacatgcaaatctttttggaactgggaggcaaaaactgaaacggtgtgtacccaaggcccggaaagatttaatttgaactgttcctttctacctatatattgacaaaattctttctttggcgatatatgcacacggcgagtcaattttgggctccaagcgcaaataagttggacttttcgtcggagtggtctgtgagttagtcaccaaaaggggggtcccaggttcaagtcctccctatgttgtgtgttaatttcaatttcttcttttaaagaagaaggcagaaatattttttattaaaaaagttttcgtgtcaaaaaaaattattttcataagagttagttacgtacagcatcgataatttttatgaaattttttagcctataactttgtcaatactagatcaaataaaaccaatttatgctcattttgaagggaaaattctagagaatattgttagttttatttgatttggccttaaattgagcacttggctaaaaaagaattaaagtattgaaatgtttgccatggaaaaaattttttcctgtgggtaactttttttgaaattttgtataggcccatattttgtccccctctactatcgaatcacagtttattttttagctgtctagtttttaactcgagatcggctcttctatttttacaagggaaaatcccaaaaaaattttaagttttgcaaagttttggcgttctgattactaaataaataataaacctatttgcactgagagcccaaaattgggccgctgtgtatattacaaaaagagcactatttagagaagggtcgaaaaagtcaaagtggggttcgaaaaccaaacgagggatccttttcaaggaacaaaaatgggtaggctaaatgccttcgagactgaaccgtcgagtgggtaaaacatataatgttcaacaaaatctaaaacggttcccctcatttggagtttacccatcttttgtctaaaaaattctttcgaattcggcatttacagaccgagagacgtcaaatgatatatcatttatagaattgaatgaggcacacttttattagaatggcagattggatgcttcgaaaataaatttacaaacaataattatgacttctctctttctctatcaccctccgttattcgtgcgcacaatcagctgctcccgtcccttcccaactccgatgtattcgacgggtacgcccagttgattttgtatgaactccaaataggcacggcatttgtccggcaactgttcccactgacgggcactggtcgttggcgactgctccgtctcctcctccgtctcctgctccgtctcctcctccttctcctgctccgtctcctcctcctgctccgtctcctcctccttcttcgtcatctcctccttcttcgtcatgtccgcctccttcggcagcctcgaagatgccgtgcataccacttacaatactcgcctggctgtggcggtggcggtccagcctccttcggctttttcgaccctgcggtggacagggggggagggaattacgatgaacaaaatggaaaattactcatttctcccttctctcccacttttccctcttcctttcactctcctcagttcgccgcctcctcctccatcttctccgtcgtcgtctccaccgcctcctt

SEQ ID NO: 6005 - DNA, 5355 bp, Heterodera glycines
  misc_feature (5334)..(5335): n is a, c, g, or t
acgaatgccaaccgttgtcctcacgatatttttaccattttgtgttcctttcttgtggattcattcaaccgcctcacaattgtatgctttttgcggaagtcgacagtgattgttttggcacaaaggggaaaaccgcacaaacggcccagaaaacgttcctcgaccacttcacaccaggaagttggatccaaaacggacagcttgaaaaagaaagagagcaattactgcagacaatcacacagctataagttcgtttacgcaaacgacagtttttaaagattaaacattaacatttaattttacccccccccccccccctataaatgctttccgtttccctcacatgtcgttgcagttccgattcgttcacagtgtcggtcaaagcacaaattgcttcatatgcatagcgttttcgcaatttgtcctgctgaagtcgttccctttccgcttctattctttccgaaatcatttcatcattaatcggcaaagtcttcttcatcataacttattcgctaaagaaaaattgagtcggcaaaaattaaattaaaaatcgttttcaaacttccaagtcattgctcacgaaaatataagaatcatacatattaaacataataaaaattgatgaagattgggctttttattaatcggggtgttaatggagagatgaataatcggtttcagttaattacccccctccccccccccctccatcctttttagggatggtcaaaaataatgtcagattcatgatcactgatcagagcgatcccccacgggaacaatttagatccagatcaaggtcgagctctaaattttactacaaaatatctaccttttgatgaaaatggttgattctgacaaaaatatccgtaaacatttaaaattttttgcaattttgattttgattaaaaagctctaaaattttttgcaattttgattttgattaaaaagctcgctcactttttttttttaaatgtgcttaaaataataccctttttaattctgtacaataaaaagactgaaatgcttgcgcggggagatgcaaaaggaaagagacatttttcaaggggattaaaaaggttataataaatacataataattgcgagtaataaatttttcagagtgggcgatgcttcatctgaaaaggaatgccaagggttcgttggaaattcttcccgaaaaacacccaacatttcccgttggtcgctcattttgtgcctttcgcgttactgtgagctttattggcggtggttggcattggcattcctttttcttttaactgagtccatcggtctgtgtttctttttgattttctttccaaaatgcccatttagctcaagtttgtatgcctttgtttattgcgcgagttatctctgttatggttcgggcaagtcaaatgagcgagttggtcaattccgttttgatattgactggtacgactgtggtcgctactgtggctgggggattacggtaatttttatacgcccttaacatggccggggctgattgtgaatggcgatgaagactttgtatttaacaaaatctcgcaatcaaaacgaattcaaacaaaacccgaatttaaatgtttgtcttcaggaatttcgtcagtgattgtgaatcttaaattcagagttggcactttccattttgtgaccgctaaactcaatcgccagatgcgtcatgatctgttccattcgatcactgctcagggaatcgatttctttgacaattctccgactggtcattagttccacgaaaggctgagtttgctaaactttgcctatttaggcgaaattctgtctcgacttatttcggactgcgaagttcctttcccttctcttttcggccctctaattttggctaatttagagcgtttcttcgactctttcgtcctccgtcgatgtctttttcagcaatggtttgatggtcctcggctccttggtgctcatggtggagagtagttggcagctttctctgatcactcttttactcattcccatacttgccgtgttcatcaaagtgtacagcgtttattacgatgtgagggaagaaaagcgacgccaattcagtgcaattacttttagaatatcgccgaacgttcccaaatgtccaaagcgaatgccaatcgaatcgcggaggaaacgatcagcagcatgcgaagtgtccgcgcgttcgcagccgagcggcgggagcggcaaagatttgaagccgaattggacgccactcttcgggtggacagagtgcgcttttgaaccatttattgtactatatatatgtaaatgctgaatgaccaactgtcctttcgtccttatttattactttatttttcaattttagaccaaatccttcgctttggtcggttcccattggttgaacgaattcgccaacaatctcattttggttgggttgattagttgcgtttcctttgcattttcccaattttcggtggctgtgcttttatttggcggttatttggtgctgaagaagaaaatgacaaacgaacaaatatttgcttttcttctctatcagctgaaacttggcgggaacttttaccaattgagcaggtcatttagagagagaatacgaatattcttttccttaggctttgtgaacttatcgcctaaaaatggccattttgtgatattttttgggtataaattatacagattctcaaaaaacaaaacaaaattttccattaaaaaagtttttctttttcgtttagtgttgcaaatcggctgatggaaagtatcggtgcttcccgtaaagtctttgattatttgtcgcggcaaccaatgaattcttttgaaattggcaaagtgcggcccacacccgtgacgggcactttggaatttcgttgtgtgactttcgtttatccgacacggccgaacattttcgttttgaaggtgcctcctaatgaatgtgtccatgttttgaacaacgaacttttcagaatgtttcgtttattgttcgccccggtgaaatggtcgctttggtgggcccaagcggtgcggggaaatcgacggttttttctctattggaacgtttttacgagccaacgcaaggccaaattttgctcgatggcattccaataacgcgatgggaacatatttattaccaccataaggtccttttcaaggagggtttaattttgcctttcaattttaggtttcactggtgccgcaagaaccgattttgtacagctgttcaatccgcgacaacattctttacggtttcgacaatccttcggcggaagatgaagatggcggtgatgcggcggttaatgccgcgaaaatggccaacattcaagaatatgtggcgcatgagacggagaagggcttcgccacgaaatgcggcgagaagggcatccagctaagcggtgatattggcattctgaatcaaatcctataattgtttcgtttttttggcgaaggggttggggtgcattcagtttgtattcacaatttttcgatttttaaagatgtatttttttaattcgccaaaaattcgatccttaggagtgtttttttattttgcatttttgtgaaaatttccaaaaaatgccgaaatttgctataaaatgtcaaaatatgcatttatatgcagtaaaagccttcaccaaatcaaaaaaattaacgtaaaaccaatttcaggattatggaaaaactcgggattagccaaaaatttaaaggaaatatttatttctgtttccctttaaggcggtcaaaagcagcgaattgccatcgctcgcgcattggtgagacaaccgaaagtccttttgctggacgaggcgacttccgcgttggatgcgcgcaacgaacagctgataagggagtcgttgtccgcttgtgcgaagggtcgcaccgttctgatgatcgctcatcgcctttccaccgtaagacgtgccgaccgtattttggtgatggaacatggccaaattgtgcaggtccgaaataggaaacggttgttgtgagaattagcgcacttccaaataggacggaaatcatgcggaactgatgaaactgaaggacggcctttattactcaatggtgcaaaaacaaatgggagaaatgttggagaaccaatgaattgcctctgccatttagctgatctcatttcctcttttgtaatctgtgataactcatgcttctgctgctccaggataaatgtgttgtttttgtacatgtttgtccggtttgtccacgccttttaaatgcaaatcatttcactgggcacggggaatgggcagtggggggagaagaagcggatagttgcggaagggcgggggaaggcgagcacatcactcccccccccccacttccctccctccgtcgcactctaaccgatcaaattgaatccttcctcttcttctctcccttcccttccttagccttcgcttttctcattttcccctccctccaaatccttcttatcccccacttatccctgctttcaatttcctgttcatctgttgctgctgctgcatttcggagaagggacgggtggggaggggcattggcgctaataaaaaagcggaaccattcgcctcatattgacaaaaattagtaaaatgaacgcaaaaaagtgccaaagcaatgctttgtgctgaccctccaatctttcgtcatccgttcctttacaaattaattgttcttttcctaattgccctattaataattaattgttattttcttaattgtccaattataattaactgttgttttcctaattgccccctcctccgtccctttttgcatcgatggcttcatttatgccgaatgctgtttccggccattacccgggctggcgcggccgatttccctcctctcataagcggcgttctgagcccgagtggtctgtgaaggagctgatcagaatgaacccattgcatctgtcagtgtctttcaatcggtcaacaaaaaacgaatgcttttccttttgcagctttttcctaggctttgtccctccctttttgggggcgattgggtcaattgtgacggcactgcttctgcacaatgatgaaataaggcaaatttgaaattcattcaaaattcgtcctataattttaatttcagtaattacaattggcagtgcggggtaaacgttgagcaattaacttttaagctaattttaaaactgcagagagctcggctcccttcgctttcgcgaataataaaccttccgatggaaagtgagtggaatttgcaaaataaatgaccaattaaagtcgacgattaaccaagggattttctggcaaatcactttccttttagacattccgctgagagcagtcgaaattgcagtggcctgtaagtgtctctcccagtcgaagactnntatttgatggtccccttggt

SEQ ID NO: 6006 - DNA, 2890 bp, Heterodera glycines
ttcctttacaattaattgttcttttcctaattgccctaataattaattgttattttcttaattgtccaattataattaactgttgttttcctaattgccccctcctccgtccctttttgccatcgatggcttcgtttatgccgaatgctgtttccggccattacccgggctggcgcggccgatttccctcctctcataagcggcgttctgagcccgagtggtctgtgaaggagctgatcagaatgaacccattgcatctgtcagtgtctttcaatcggtcaacaaaaaacgaatgcttttccttttgcagctttttcctaggctttgtccctccctttttgggggcgattgggtcaattgtgacggcactgcttctgcacaatgatgaaataaggcaaatttaaaattcattcaaaattcgtcctataattttaatttcagtaattacaattggcagtgcggggtaaacgttgagcaattaacttttaagctaattttaaaactgcagagagctcggctcccttcgctttcgcgaataataaaccttccgatggaaagtgagtggaatttgcaaaataaatgaccaattaaagtcgacgattaaccaagggattttctggcaaatcactttccttttccacattccgctgagagcagtcgaaattgcagtgggatgtgagtttctctccagtcgaagacttatttgatggtcccttggtcatttcctttcagttttccgttatggccgtttacggagtgtccactgcaattggccgcgtctctattcgctgtgccgacacttttacctttggctcggctctttggaattgatttttctggtcgtaaatttcgtagtgattaggctatccgaggatggcacatgaccgggctgggctcaaaaaaacagctttttgggatttggtctggtttttccaaggttttcctggtccaaacatttgggttcgggggtaaacaatggaccaaacaatcactggcaagaatgtaaattgtaaggatagaataaaacacttcaaaaaatatactacatttggtacaagggtttaacgaacttttctttttcgattttaattttattatcaaattaaattaattgttttttgagttgtcctaatcttagccattttaaaatactttctctgttttccaacattaccccaaatgtggacactttgtcacattaccccaaatgtggacactttgtcacattaccccaaatgtggacactttgtcacattaccccaaatgtggacactttgtcacattaccccaaatgtggacactttgtcacattaccccaaatgtggacactttgtcacattaccccaaatgtggacgctttgtcacattaccccaaatgtggacactttgtcacattaccccaaatgtggacactttgtcccattcgttgctttttgttaattaccccccccccattttcaaaggtcgctctgtcggtggtcggggagcgtgagttcatctgttggtttggctttttgatctcctttagccgccatctttccttaagcttaccatgtgatcttcttttacgccttcggtgccttcgccattggcttctttctgaccaatgtcatctgtcactcgcagtccctttattatttgaacccttatgtattgccaattttctttgttgtccatttttttacatttaattacgcagggtcgaatttcgtaccatttcaaaattgtggtgaccattctgtaagaaagtgggcattcgtcgttagcttaactcagtatttttaaagttacgtcatctccgtgcccgttctgttcggcgcttttgtgctttattggcgaaaatgcatcaccatcagtcagtttttcatttcatttctttctcattttcgcccttcataaaacaatgcttttcaaatgcttttcagtgtacgatgttttcgcagtcgccgaatatatcgacgtgtttttgaccatcgcttatcattgctgtgccttctttgacattcgctacaaagtgattttcagtgtcagggaagtccgagaaaggaaaatgcaatgagagaaggaaaagaaaaggaccgaagaacggacgaacgaaagtgacggcaaaagaaagacaaagtgacaaacggacggacaaaatgtcaaaaaatgctcaagaatttaaatgttcagcaaagaaaccatttgaaaataaattttgaacaaattgggcatttattaggctgtttttcataaataggaagggatggtccggtggtgccaatgtttttggagtttagtcttaaaagaattactgcttaaaaatcattttgcttttttgaaaaataattatttattctggagttaaatctggagactgaacttaatcttttacatattttctcaacttttcacatttatttttatcttttttattaaatttaaataatattgtagttagtgaatgttaatttaaatgatttagtatgccgtattatattttttctctcgggtaactaaagcatggaagtgaaacacgataataatttttcgtgctatgaaattcttgaactgacttttatatttaatttagcgaatttttttcgccaattttcacagtttaattataagtcagaaattctataaaaaagaccgaaaaaagttatgtcaaataagacttctctccaattgagacagatcgctttgcatcagcttaccttcactaattcaattcggaataatgaatttattaaaattgcttattatttttttctttatttagacagatctatcgagaaatagaggccccgtaaagtctctctacgacccaaaaaaccctgttttttgccaaaaattctttgaactgcaacgccaattcccaccactgctccagtcgaagtatttccac

SEQ ID NO: 6007 - DNA, 1500 bp, Heterodera glycines
  misc_feature (30)..(31): n is a, c, g, or t
  misc_feature (116)..(116): n is a, c, g, or t
  misc_feature (131)..(131): n is a, c, g, or t
  misc_feature (141)..(141): n is a, c, g, or t
  misc_feature (171)..(171): n is a, c, g, or t
tcattttgcttttttgaaaaatattattannttctggagttaaatctggagactgactttaatcttttacatatttctcactttttcacatttatttttatcttttttattagttntaatttatgtgtatntagtaaattntaataaaaattattaattcaatttattttntattttctacactgcgttttttttaatggtcataaaattttttatcttcagtgctatatgcctttaatattttcataaatgctgttttatgtaaagttaattatagcctgctgatcgtttttcatgaaaattttaaattcacaaaaaaatgtggttttttttaaaatttactgcgacgcacttttttattccttttttatgaaatttcatcaatccccgctttccgcgtcttaaaaacccaatcagcttcttactgtataacatttttagatacagtaattttaaaatgtattatttgactaaagtccgtcaacagtggtggaagtttaaaagaggcggtttatttgaaatgttttttgtcgaagaaaagcgcgaaaaacttcgcattcagaagaaaaggacaaaattagcggacatcttcttgcacaggcacagaagatcaacttatgttgcttctcttctaacaaatattccttttcagcagttccgatgattattatgcgcttcgtttgctgtacaatttgcccgtcggattcggaattgcgcttctcatttacgacttggcttggtatcgcatcaacttcgccgattccattctgatcaacccgttctggaaggactttgtcaaatggctgatgatcgtctcttccgccctgtcctatacgcttaatcctgttggtggtctccaacggatgcttccacgctgaatgatgttcgttttcagttggtccgtgcttctctcggctgtgccctgttcgccagtttgggcagcaccgggcaggggtcggttttggcattggtcggcacaatcagtgagcgattcaatttgcagattactctcagtttttgtggtcgaaaacctaaacaaaggtgagcacattctccccatccaacattgttttttgttaatacattcgttttttttcttcaaaggacccattgaaaatatcattcaaaatttcaacatttccacgatgataacagtctgtcatttgcaacttcaagctcggataaccaaaagtcgaatggaattgcaagcgggtccaatcgaagcactttttgagaaaaattttggtatttgtataattttatcgctgacaatattttttccatcaattaggaaaagttacaacgattggaaacaaagtcgtccatacgctgaagtctttgcttcagccctttgacgacgacgttgaggaggacagcgaagaagattcccatttggcagcgattattgacacggcccgaagtgattgcttttgattgtgaggattcacgggcgaggggtgttaaatggaaagttttgtggcaacgttactaaagaatttt

SEQ ID NO: 6008 - DNA, 2319 bp, Heterodera glycines
  misc_feature (2211)..(2211): n is a, c, g, or t
aacacatggtgctctctctaaagcatgagaggcacatcgcgcccgtcacaaaataatacattttaaaaaacgttgacaaatttcacttctgtgtctcatggattaaagatggggtgaaaataaggaagggatgcgatacgaatggggaccggtaaattggacaccggaaaattggacaccagaaaaaaaattttgtttttttcggttgcgggattccgactcctgaaatgttgtgcaaagttttgaaaaattttgcggaagttattttcgaatttttatatccagtaaaaatttctttaagggcaccgaatacatattttccatatatttatacatttcagtccattttttatccaaatttcggcatttcatggaaatatttttttttggaaacaactcttaatttaaggaaagttttcgtccaatgtgtgattattcatctgatatccatcatttcaattccattttatcagtgtaagtttatgatatgcgtttcaagataatttttcgccaaatatttaagatgttttcttcaacacttcttatttgttcgttacttgtcttttttatttggcaattgtaattcgtctggcatggattaagggttaattaaggatttaatttcctaaaagattggcacatctcatttttgatagagaatttgcaaatttttgaaaaataaaaaaatttaaataataaatccaacaaaattttaaacataaaaatattcgattatggcctaattacaaaaaattaaatccaatttttcgaaattttttggccctgtagaactaaatttaaaattattcttgccgaaatcggttgggcttaaccatggaaatgcaacaataaataataatagttttttgcatgttttttatttcaattagaagtgaaattttcaattttttgctctaaatttatcatttttggtcaatattttcttaaattttttggcatgctttttcataaacatttatttaaatagttcagaattttttttttttgtaataattcctcctcatccttttcataaatgagaccagtaccagcaggagggttttaaaattttaagcacaaaagcgccgttggaataatgccgccactgatgcggcgacggcacaaaatcctttggacaaggaaagtgcgcgaatcactgtgctatgcattgctgtccaaatccatggcatatgttttgtgttacttggtaatctcaccattacgccatggtacacgatgttgacgatatgtacaaattacgacccaatcttgcaacaattgtattacccaatcaatgcgttcacatcgttgttttacatatcagacgaggcaatcaatttacaatttaattatttggaatcaaaaaaatttaaaaattaattaaatatcattagggtgcgatttttttgtttttaacggattttttttgcggttttattccgctgttagagaactgcttgaaaaacacaaataaataaatgaattaatgaaatgctgttagcatcatcggcattgaaaaaaggtttctttgcatgacatagaatttgttatttttggacaccaaatttgaatcgtctaattataaatttaattactttattgacactgagacaaattttcgaattagcccacactgacaatatattttttggttcaacctagcaccgttaaaacattaattaaaactaaattaattcgcccgtcaattgtccaaaattatttttgcagctctttttgttggccgtctgtatggacatgcgtgtgcaatttgcgcaaatgattcggaaaatgtttgtgccgtttcggaggcgtggaactcaaacaatgacagttcaaactgtacaggccaatttcaatagccgaatgcggcacaatgccaatgcgaattagtctcgacatacactctcgaatcattccaggacttgactgatttgctaacaaatgtcttggaaaattgttttatagcaatttaacatttcatcgagaaacaattacttatttcgagcatttaatattgttttttaaaaagagaacaatgaatgaaacaatgtaaaaatttgtatttaattggtcaatattattctacgcttttcaatattagctgacctaattaaaatttttcaagtttgtgttaatttgtggaaccataagctgtagttaatttctgacctttgtcggctacccatttattcgtcaaaaacatatttttanattttcttgaaaatgtttttgatttaatatttattcaccataaaatatatttacataaatttgaatgtttttttccaccttttattcatttttcaataaaatatcaat

SEQ ID NO: 6009 - DNA, 2540 bp, Heterodera glycines
ttctgcttctaggctaattggtttgcattcaaaacgtcatgctgaaatttgcacaatattaaaaaggaaattctttaaaaaaattaaaaaaaaatttaatataagactcactttgaaaaatttttcatatttctgaaacaaaacaaaaaacattcgacaagaggaaatatgcgagttatgcaaatcgaaaagtacacaatgaaaaatttttaaaattttctcaaaaataactaactctctatatgcttagagcaaattttcaattttatttaaatcgagacatgttcaaaaataaaattgcttttaaaaaggccagcaaccgcctctgttcatttgtgaatttttttgcgctttaaaaaaaatttgttttgtgccaaagaaaaaaaccgggtcctaggccttaatccagtttttttttaatattgccaaaaaatcaaaaccgaaacctcaagtgtagcgcactcacacgctgcttccgtgttataagggcaaccgcttgggcacccaaagttttgacatttgccgttgacgttgtcccattggcacaaattttgactggcagcgaatggtggtgatgtgaaaagcagcagaaggcacaaaaatattgggagaataattgggcaattcttcattttttaaaattttattgaaacgaagctttaagtttttttatgatttttgaataaaatttatatttaattgaagattttttcgtagcttttatatcgaaaaagttttgctattttttaaataaaatgaaaattaaggccaaagatttaatgtcaaacaatggaaaggtgttaagcactttttcgtgtgcaggaatttttttaattaaattttcgttcaagacattttttacgtttatattattgaataatatcggaaagcttttttcattttttatttttcatttcttcgatgaaaaattccgttttttaaattaaattcaaaaattattttttcaaaagcaaaaacaaattattacattaattatttttatatgtaatttggagaaaaacaaaattcgtcaattattttttaaatgtaaaagataagcttacacagtaatgtaatccaatttatgcaaaaataaaaaaataaaattgaatttgatcaataaatgcattcaaattaaaataaacactgataattaattgatttggtcgatctattattatttgcctttctctagtcgtagactcactatttaaaaggcaattggtagagaatttttgctctttctgactgtcctactgaaattttacagaaaaattttcacaaccctctagggattcttttcggaaatttcccagattttcaatgtgtttcgtggtgtcccggtcactataaaggagtgatctgatcaagttgctgtaaaagacttttttgatcagcatcaaaagttagcttagcagaataaaaaacgttcttgtacatcgttttttcgtaaaactggtaactttgcggtatttgaagttgttcaagattcaatggcacagctggtggcgcatctactagatgtcttgttcggtttatcatctaagcgaaagatcttttaacaaattttatgattgaaaagatttaccaaatttgttgccttttttgacggcacttctgaaagtgcaggcgaactaatgctttgagtagaaaccgcacgaattacagagggagctttctcaacagaacgccttttgatggcagtcgtgactttttgcgcaacgacgtgacttgtattccgttcacatgtgtgagttgtcgccatgcggatgaattcatctcgaagtgaagtccaaatccgtcctttgcacttgtccacaccgctgtctttgaactcacatcgccaaaatttaatcgtcccgtcggtacttgtcttagcaaatttgtaaagatggccatcatgttgtagcgttgacctgtttcttttggcgtcaatttgatgttgcatacggtacataataaatcttaaaaagtttaaatttatgttcgaattaaaattaaaaatataaaaataagaataacactattaatttaaaaaagtcattttgcttgctaatttttgcgtgaaattttatttgaaaaattaattgttttatttgtggccgaaacgtgctggggccgaactgaggtagaccggaaaggagtgataaatgagggggagggagaaaaaaaaagaaaagagagagagacagagagaaaaagagaaagaaaaaggagagatgtatgagagggaggggggggggtgggaaaaagagagagagagtgagagagattagagaaaaattagaaagagggagattagataaagagaagtattagaaaaattcgcgaatcaattttggaatcagcttatgtaattggaatcttaaatataataaaatatcattatactttactttctctggctctttttacttttaacatttaacaaataatgtggtaattatttaaaatattgataaaatcataacgaagtggtgaaaaagaatgaaaagacacgaaaattgtaagctgtgaaagtcaccacaaaaatacaacaa

SEQ ID NO: 6010 - DNA, 3781 bp, Heterodera glycines
  misc_feature (3682)..(3682): n is a, c, g, or t
ccgaaaaagggggaaaatgccaattgacaacgccgctagggcacaaaaagaatgtgtaatttgcatacgaaaatccgcgccatctttcgtttccccccccccttaaaatgtttctagatacgcccctgacccaacacaacaaccatcatccaatcgcccattcattctctcccgcaattcctccctcatcctcgtcccatcaattcattctcgtcccaattgttgtgttccttcgccaatccatccgccatttcccccgcatcgaccgaccatcaccaaattgcgattttgatcgaacaacacaaacaaaataacattgagagaattggaggggggggaaggcaaaaaatggaaatgaacgaaggaaggaattggcggacaatcggtgcggaagggtaccacacaaaaaaaaataaattgagggaaggaaatggacttaatggaagaaggacggaagagcgagggaaaaagggggggggggacgaaagtggacgattaaaaagagaaagaaaggggaggaaaagcaatggacggggggagggagggagagggaggggatatagttattaataatatcaaagggacggaagaggaaattgcggagagaaatgagagagagaaagtgatgagcaaacaatgaatgggcaacaaaaataaattctccccccccccaactatttttgtgatggctttaaattgggaatggggggtggtggtggggggacggggcatattcttgaaaaaaattcaatttaggcaccaaattatttattaattacacacattctgaaattggttaccagcaaatgaaaaatgcgattgattgattgggttcgttcggtttcccttatgagtctgtccattcacaaccaaaaggcacttttcatccgaccacaccgtcaaaagcagccgatggccactgtctttggcatttgtccgacccgtcgatggcaccaatttgaagtgccgacgcctttaggtcgcctcctgcgccaccgcctccctccgtcgttttggctccttctcctctaaaaaataagtgaagtgaaaaccactgataatgccattccaaaaaggtaattaagcgaaaacaattgagcaataaatagaaattcttcacatttttctaataataaatttcttctttcatttaaggaaccgagagacattaaatttttaatttaatcaatgttcaaatgcaaaattcaaccgaaaattttctaaaatgtaaaaaagcggacaatacgtaatttgttgcccctcccccaatgggtacattccattttatgataagtgaccaacaaatcccacaataagttaccccaccccattcaccgtaccctttgtcctctcttcgtccgctgttttccgtccctcttttgtgtccgtcggttgctccgttggcactgccggcatttgttcggagagcattcgctcgaactcttcctccaccatgtcgttgtcctcctccgacatttgttggcccaaaatggtggacaattcctggaaatcagcgagacagagggcaataacaacacaaaatattgactctatcttagaaaggacctcctgaaactcttgcgcctctttgctctcctccattaaacgttcaacttcgtccaaagaaattgtctaaaagaaattttcaaattttctaggaatagttggcaatgtgagcgggtcaattattccgaaagtgcctgcctcgttcagtgccttcaatgcctcggtgccaagccgaaggttgtcgaacacttccctgttgatctgtgccatttccatgtcggtgatcgtccgctccacctgctccatgaatccgccgatccgattgatcatcgtctcctggaagcgcttccttttcaacagtaacaatgctcggcttcaaagggggtggtgagtttgtcactgtgtgcttttcctcattagcatccgttccccatttgctcactctttgcgtccgtctctgagcagtgcccgcgctctctccgcgtccttggcgatgttgcgctcgtaccgttgacacgcttggcgcaatttgtcgcgctgcattttcaacgactgaaaattgatgcaactgcatttatataaaacaatgccatgcaattaacaaatgttggactcaattttctcctaaatattgcaaaaattctgtgttcttaaactataatcatttcgggagcgcgtcgacaaaactttgtccagaatcttaaaattgtcacaatcagcaaagtactcactgaaagcggacccttaaaattccggcttataagtcaaagttttttgtaatcgtttgtacttaccaaggtcgttcggtcatgatcagttaccgctggcggagatctgttcgcttttgtccgaatgccaaagaaattacccatcagagaaaaatcataaaaacaatgaaaaaattatagaaaaagaaattttgaattagtaaaggtaaaatgacaacaaacaattgccatttgaaataggaatacaaaaaatttttctcaaatagcgaaaaaacatcaaatgagtataaaaaatgttggaatgataagcaattaaagctgggatcacggccgcaatttgcgcaaagacaagataaaatatcatggcaaaaatttttaggggaaagaacaacaataaatcaaacggagtcggtttcgggactgagcatgacattcagcagcacggacggctcaaattcattctgaagcatatatcgcgcatttggacagggccgaaaggcaacgccgagaacatcagtcaaagaaacgatctgaaaaaatcaaataagtttaaaaaatagagttaaaaacacaaaaaatggcaacaaaaatggacctcggcaaagagggaattgccctgcgccgccgttttggcttcgttgcccaatttgagttgctgtagctcgacttgaagcagtgccatctcctcaacctgaaagggcaccactcaatggcacaatgccaacaatccaaacaatgccttttcgttgtatcttctgttgaactcctcctcctgcactttcattttgctcttcagctcccgaactttggccttgtactgcccaacttggtcttccaatttgcgcgtttcctgcaaaaaataaaaaaattatgtcatttctcagtggggcgattaaaatttcgacccaagaagatgcaaaataaatggactattttctcatactttacaaaattttggagtcccgatccaccttcgagttttttttctgattgcgtaaacatgcaccgtacctttcggagttgttccaccgcgtccgaatcgtcccgtgacattcgaatcatggcgctttgctcttccaccatcttctccaagtgatcatgtttgatgtccatctttttcaactcaaactgcaggtcggccgcgaatttctccgcattcttggccatgttggcattctgtgactccatcgcctgcacttggtcctccaaaagtgggacgcgttcggcattcggtgcgatgaatgtgatttgtgcctgcaacctgaaaatgtaattcaccgtacataaagcaacaacaaatagtgcgaaatgccaagttcgtttaagtagggctatgtaccggcaatggcacgcctttttcttttttgaaaaatccgacttacacttaaccaggcatttggtgccgaaaatgaataaaccacctgtccccaatttatacctctcaattntcttcaacagattgttgttctcgcgttccttctgctgacaaattcctcggctctgtccttttcttggccaaaaatgtcgcgaattgcgcgcaatgactt

SEQ ID NO: 6011 - DNA, 2149 bp, Heterodera glycines
ctcacaatcagcacacgtacttgcattcgtaagaccccacggaccttgagaattggactgtttccgctagggaaaaacgactttctggccgaattgaacttcggcgtttgtgcaaagttgagcgagctgtgccgacgccgttcgccattctctttgtcctcctctttgatgtcgctgtgcaacagtttgggccatggagcgaaagtccaacagcgacggtcgtcgagacattcaatctgaaacaaatccaaggacaaaaatgagtatttgcaggatgaaacttacgacagtggcaaagtgccgttgatgtttgtcctccaaccgttcacaaatggtcgaaaatgcctccgtttggagtaaacggaaagtgtatagcatagccaaatgaatcttagggtcaaaaaaaagtgaaagaacaaaaactgggtgccactttggtcgcctcggacaaatccccactctccgcagcctcgggacgcaaatgcgaatgaaactcctcatccaaaccgtgcgcaatgatatcaatggcattgcgaaaaccaaagttagggtcgtcaatgaaagtgagtgtgccggacttcctggtgagaaaagcaaagtaaaaagatggaaggaaaacgaataataaaagtacatgtaattggctaaaattggcatcaaattgcgcacttccttcagcgattggcagtcttccaggccaattctggccgccaataaattatactaaattgaaaacactgcaaaaagagaatcgcattttactaacaaatgccaaaatagcagcgatattggcgtcgtccatgtggcgagcagtgagtgatgtgtctgtcgatggagagttttattctcaatttttgtaagggcccaaatgttttgaatttatactatttttcctgaattattggtaagaagaagaaaataagtttttaggaggtttacataaaaaattaggagtgtttttttttaaattttataaagaaaagttatttgtgattgtgaaaaggtattatttttatgaattttatttcaaatgagtagattataatatttaaatcttaaaattttgagatcatgtttcccactaccttctcccagggatattatttagtaaagagtttttttccccaatacacttttcaaaccccatttttcggcaccgcgaattgctatttttattgaattctgaaccgatttgagaacattagactatataaaaatgaaaattttgaaaatcatgtttcccactcccttctcccaggggtattattttgtaaagtcttttttccccaataaacttgtcaaaccccatttttcgcaccgtgaatgttatttttattgaattcttaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtagtctttttttccccaataaacttttcaaaccccatttttcgcaccgtgaatgttatttttatcgaattctgaaccgttttgagtagattagactagaaaaaattgaaaatttttaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttcccccaataaacttgtcaaaccccatttttcgcaccgtgaatgttatttttattgaattctgaaccgtt

SEQ ID NO: 6012 - DNA, 1040 bp, Heterodera glycines
tggtggaagagcaaagcgccatgattcgaatgtcacgggacgattcggacgcggtggaacaactccgaaaggtacggtgcatgtttacgcaatcagaaaaaaaaaatcgaaggtggatcgggactccaaaattttgtaaagtatgagaaaatagtccatttattttgcatcttcttgggtcgaaattttaatcgccccactgagaaatgacataatttttctattttttgcaggaaacgcgcaaattggaagaccaagttgggcagtacaaggccaaagttcgggagctgaagagcaaaatgaaagtgcaggaggaggagttcaacagaagatacaacgaaaaggcattgtttggattgttggcattgtgccgttgagtggtgccctttcaggttgaggagatggcactgcttcaagtcgagctacagcaactcaaattgggcaacgaagctaaaacggcggcgcagggcaattccctctttgccgaggtccatttttgttgccattttttggattttcattgctttgttaaggtgattgatggaaagtcaaaattagaggaacaattgtcaatattgcacaccgacaatggcactcttcggcgtgaaaatgaacggttgaagaaaatggtcgatgaaaaggacaaacttttggtgttgcacaacggaaaagaattgactgggccgactttgggtatgaaaatgtgacaatttaattttatatcgtaataaccaaaaaagggatgccaatgttttttcgtaacacgcacgaaaagggtaacgataaaaagaacttgacccccactcccataaaacaaaattttcataaatttacgaccgttttttcagtattatttgattttgccatgttttttttaaggttttacctgttaatgttgtatttgggggttttttctttgtttatttcattttccaattaattaaccaatattctctctttttattatcatttccccttaagctgttctgtttgcagtgaaaaatgagttggaggagctgttgagtgagaagaaaagtctg

SEQ ID NO: 6013 - DNA, 3740 bp, Heterodera glycines
agagattacagcggacagcatttcactcaattcttcatgatggaggaacgattcgtgttcattttcggagtggggatgggcacccaaaaaataaaccaaagcgtccaagtcacggagttgattaggagctgaaacaaatgattacccattttccagttaacacaccctacgacccctctactatcaaaaggacgtgagggtcatatggaaggttttttgccataaagacggtctgaccaaataattcagaaatattcccgactattgtactataaaatgttaaaatttaaaacgcttacgccttccaagcatagagagccattgaccacggccgattttcttagtttcgcgtgaaaaaatgtcgacgtacaaaaagcctattcttgaatcttaaatggtaaaaatgtaatgtagacatttcaaaactgcaaaagtcacttgttgcattatcagtcacatcgaaaagtcgaaccgatgggtcgcaacgctcaaaactctgattttcataatcatttgtgacttcctaaagtgatggagtggaaaataaaggccaactgggtattaaaaaccaaccctaaactcaatgttgaacaattctgaactgaggagcagcattttgtcaaaggttgaaagtacggggaaatgtttcatcagctcaagagagtcaacactaaacgaaacgactgaatacactcattaattatgtcaacaattcgactcacttttggttatgttctgcctctttacgacaaatgtaaaagagatcaaaggcttccaaatcggaaatcaccctttcttcctgttcttcggcatacgttttccaagcgccttcgagtcgggagaaaaacacgggacgaaagcgcctggaaagtctaaaagggaaagaaatttagaaaaaatggagaggggtaaaagatactcgtcgacaaagacgcggacagtttggggactcccggccattttggaagaaattcggtggtgcgcagtcgacgaaaagccaagcgctttggcaaagccctcacttaatggaccccgattgataaagtaacaaaacaaagaatcaacgtgttatgccgcaattcctcgatgttttgtgagttgttcaacatttgcgaactgaatgcctgcaaaagtctcacgtttccccatcgatgcgttcatttgttaattgttctcacggatcttgtgacgtaactctgccacaacccttgccgaatctcccgcgcactgcaataatttaaggcagcgaaaagagcgtcgtgttttttgcttgtcacttcccacggaccattctccgggtcatttcttagcaaaagctcgcaattaataaacaaagcatcgagaaacaaaccctttggagagtaacgcgagagcacgcggaggggcacttttgagcaaatagcgatgttcgatagggacaatgacgccattgtcctgcatgtgattggccctgaaaaagaggtaaaacggaacgaatgggcaaattacagaaatcggaagcagaattggtttgtagcggaattccacgagaaattcacttcctgttggagttgtgcctttttgtcgttctttttcacctaaaaacaacataagttaaaacatccaatgccataaaaccgtcaaatagccacagagtcgagcttggaggatcatccagtcgagataccgttgctgccatggcttcaattttccggcgtcattttcatgcgcttgctaaaaagggaataattatgggctgaactcaaaggcacaaaggtcaaaaagcgagagaaattccacgactaaaagtcaaagttactaaaggtacacacccaaaagaagagaaaaaaattacaaacatttaaactcttttacttttattttcaaaaccaattcacctttacagcttcgacccaagtgggctcagtccatcgttcactcaattccctttggaaggtgttttgaacttgcttagaatataaaaatcagaaaaaatgctggactaagaattacataaaggtcttccctgaacagggaaggatggcattcgggccaatcagtgaacattttcacgaggagtgtgttcagctgaataagttactttttgtaaaactttactaaaaaataagctgaggcttacagcatactgaacgtcgtattcctcgtctattagtgaactgactgtgttgtcgaatgtacgcctttgtacgtttgggtctccttttgccgttttcttcgcatcttttatggagtaggtatttcaagcattttgttttgttatatgtcgaaatttaatcattaccttcgtcaagtaagtccaaatgttcccaaacactggcgccatattccaggattagtttcacggttccttcataaaactcatctgctaaaattaaaatatttaaataggaaaataaaaaagcaaacgtacgtgtggcactttgcagtgggggccattttgaattatgttcaatactttccaaaagagcgttattttctgcattttcatccggaacatttggaagactaaagtaaacagtgagacaagcagtgatggattggtcattattatcacactcacgtaataaaatatcccgtttgattgtgcggctttcggttttgcatcacccatcgtattgcttcaagtttttttgtgtttgaaaaacacctaaactggttatgtaagctagatttaggttaacaataagcaagccaagccttttattttcctttccaattccagaaaccaatggttgagaataaattaatgccacaattccattagtgatagcctctaaaatctcgagttcgagaatttggtgggtgagagaggtgttttttcgggtctgtgataaaaaaggatcagtcagtgacagatcagcggcggtggggaatatttacttttggttcaatttactattttttggcttactctgatcattggtccgatcgactaagctaatccctgatcacaggacttggacacgagatgaataacagtagcaacatcttcaacaacaacaacaacaacaatagcaacaattgtgccgttgcagtcgtcggcggcgagccatcatcttcagccgctgcttcctcctcctcctgctgtggtctaagtggggtcatgggtaagttttattttatttttgacggtacgtcaagggcctctcaaataatttaaaatgttaggttttcaaaaaagtaaataaataaatgagggaattgaaccagccggagggagagctcgtccggagatgtgtatttttttctggcctggctataaattgagcattttcaaagtaaaatatttggcatttcaacggacaaatgaataagatcggcaatttgttgcatggaagctgagagagtgggatgaaagtccgtccaaactggaaatcagcagaaaatgggggggggggcggggaaatggcaattaaaaaacggggaagagggcgataatatagggatgccatctgaaaattttaaaaatcaaaacgactgcctcaaaaattaacacaattggactcatttggggggttcgaaatcaaggaagttattcaaaaaattgctttttgatcagttgggagaggaaacaagcaaatcacacatttttgaacaggataaatcattttaaaaaaattataacccattctggacttttgatgcaagaaaaagcaacaacaattcttcccattttaaattttaattttaacagcagcagcagcttcttcccccaccctcatcttcatctgcatcatcat

SEQ ID NO: 6014 - DNA, 3241 bp, Heterodera glycines
  misc_feature (109)..(109): n is a, c, g, or t
cggctttcgttttgcatcacccatcgtatgcttcaagttttttgtgttgaaaaacacctaaactggttatgtaagctagatttaggtacaaataagcaagccaagcctnttattttctttccaattccagctgttttgacaataaaccgttgaagaataaaatgcgcccgagacatctttgataaagtgcactgaatattgcccaaagatttgaaacgaatacaggccaacataaacttaaaagttttttttactaagtttttgggaaaatgcgggatttttaagattaatccagcgggattcgtgatgccaaaaaatttaataatgccaaaatttaattaggtataataattttttcaattcatatttccgattcccaatttttgggccgttagaattcagattgccgaaaataaattatgacgtcgtgaagagaggactctactgtctttcaaaaccattgattgtcagacaaatacccaattttttttggtactgagtgtgagaggctaaaactaaaaccgtctttagataaaatttttataatatgggatttggtggtcgaggaggtggtggatttcgtggccgtggcggtggtcgaggtcgcggaggaagagacggcgggcgaccgatgacagactatgggcctccccaagaagttgttggtcagtgtcaacacaatctattataaacagaatatattgcacttattgcagcttcccatcagaaaaagcacaaattacttccatttagagcttggccatttcacgcattcttgcgagaatgacatcgtttgcttaaccacctgcggaaaaatcccctacttcaatgcgcctgtttattttcaaaataaagaacaaattggaaaaatagacgaaattttcggtggacccaaagacaatgtaagttttatttattgctttatttttaacttgaataattttgcctcggatttttggtaatactgccggcggaggacggaccccttgagcaaaaaaattcgacctttatttaaaaccgcttcaaatgcacaaaggaacaacgagttcgccagtgttttcagcataatattggctctattgcactttatgagtccaattgctttttatgaggtttcgacggatggtttaaatacctcttgaaaagccttaagaaacaattttaagttactcttattccgttgtaaatgtaaatgtttcagggcttctcagtcaagctcaatgaagggctaaaatcttcatccttcaagaaagaacaaaagctttttatcgaccctgctaaattgcttccattggagcgttttctcggcggaaatcagtccggcggtgggagaggcaggggacagcagcgggggagaggaggcgcgggacgagggggccgtggaggcgggggaggacgcggccgaggctttaacgcttcaggcgcaggcagcggagggagaggtaccatattaacatacaaatagaattggccaattccaatggaatggtgtcgctttttgtaaccgcttttaataaatttgccaataattgaaaattttttggtttcggtaagggggtgggctacgtaagttacacatgttgatattattgtaattggtggagattaaattctttctcaatcattgctaattttttgaactttttatgatacatgacctattagatgcaggcctatttccaaccacacacattgataggctataatataaaatttcaaaatttataggtggaggaggatttagaggcggaggacgtggaggaggaggcttcagaggcgcttcagggggccaagggggtaatttccgtggccaacggggcggtggtggtgggttcaagagaccattcgaaggcacacccgcggccggaggactttccaagcggaagaagtttaacgaatgatccatcattttcttgattcatttcctttgttgccgtgttctctttttggatgttctcttgaattaatctttcccttttcttgagaatttactgacggaaagcatccaaacaaaattcattgttgcttgtttcaatttccaattataaaggttttgcttttaattccatttcttaacattgccaagtcggtgattgaacatgccatccatttccttctttaatttactggcacatcttttccaccgtcgttcctcctttcccgacttcgtgcttctccaaagactgaaagtgaatcatcacgcggtcgggcggaatcccaaggcgactttggacgaattcgctgatgttcttacagtgaattacattttcatctgcgctgacacagccaattgatttgatcttataataaacaacaaacaatcaattaaaatcgctgagtgacttttcacccctttttttattttctttttacttgcagaatcatcgctggttcggcagggtcacttccgatttggcaacagtttggtcccgactggacaattagtgctgtcgattccactggcttttgcattgaattggccactgtcgcgaggaatgttcgtctgaattcgttgtccaatttgagttcgggaaggttggtccaaagatttataaatggcatttcaaaatgtatttttgtaagtttgcttgaaaaagtccaaattaaatcagtgtgctttttgaaattacaatttcggagtctatcgttctgtcattttgtcgcaaaatgattgcatgaatgggtgggttggtgttagataagtgtctctgtcagtcagtcgttggtttcgtcgtctctatcggttactttctttatctcttctctctctctctctcccttttacctcccttttgtcactttctcccttcgtccgtttctccatctcgtcactctgtgtttgccctgctcattctcggcttcccctcctcccttatgaattgacctctctctcttggtcattaattttaatttccactcgatgaggtccaatccaaggacgtcctttgaaccaaggacagtcccacccctgcgtaactcgtcactgtcgttcatttgtggcccctcccctcccctttaacagtacgatttccgacctccgctcaaatgtccacaatttgcagcatatccgtcggatgattctttggtctttccatcgttggcatttgcgccctcccctcgcccaatcccatgaattatttgtccatgaatgtgcctacttattgtactacgaatctatttttggaaacttctccgttatggggggcatcagattcagaaaaactctttcctttcattatta

SEQ ID NO: 6015 - DNA, 2000 bp, Heterodera glycines
cagggctgccagattaaaattttcaaaagcctcatttggcaggtaaaaaagcctcattttgggtcgaaaagcctcattttacaaaatttattcaaaacacgtttaaaatattcaaatgttatatttttgattgtccatgatcaatttgagcatttttttgttagaaataagcattttttgggattctgaacatgaaaaacgaagttgattttttgcggcgcttttcccaaaaaacttttgggggacagggggaccggcggtgccgataggcgccgtcgggaaaaattttgtaattttcaatgcgatttgttaacagattttgtccgagaaatgaccaaattttgcgattttgagcaaatttttgcttgtaaattaaggatttttacggtccggcggtgccgataggcgccgccgggggaaaaattaagaattttgaccatatttttagcatattttcattaaaaaaattctttaaattgccaaacattatgccaatttatcaaaatttaaaagattctgaggattttccccaaaagcctcaaaatttctcaaaaaaccacaaaaagcctcattttgcaaatttagcctcattgacctatcaaaaaaccacaaaatgaggctaaagcctcagatatggcagccctgctcatttgccttggtcctctaataattagtaataatatactttaaatgcttttgtcagttttaatgtgtgctgtttgatttgccgattcaagtttcgcctatttttgttcataaatgtttttatgctcttattttgtgtcgtttccttttttacactttctttttcattcctaatgttcactctgcttaataatttgcttatgctaattgccactgccccgtccatttccaacaatttgggcgagtgcactcgcggggggggggggggcgttggggagggattgattggtcctccctctccctctgcggtggttcttccgccgccgcgatgctactgatgaaaatgaatgggaaatatgtgaacaccgctgcgcacgcgcacttgcattgccaataaaacacacgacgcccgccccactcactttcgttggtttggcgcgtgtgcggcgactgctgacacagcggaagcccgtgaaccaccaaaatgggagttgtcgggagggaggggataatgtgggtgttacatatgagaatgcctcttaaaactcagtctgtcatgctgcgcttcctcaatttgggcgtgcgtttgggctgaatgagtgggaggaattgccaaattcttttggttcgttcacctgctgatggacccctgaaatttgccagtttgtttaacttacaaccagccaaacattcgattggaattcactgtcaaagcccactctctccccccaccctctcacaacgtctcaaaatacgttaaccattacaaaatattattttttttattcttttggtgggcgtaacagcaaattaatggaaataaaccccacttttttttactttagcttggaatgtacggctcacaaaattttcatcagcagcagcaaaattacgataaaggcgaaaaacaccgaatcgaacctccctttgagctgacaacgactacacaaagttcagatttatgcacttcagcaaaaagcaaagttggcattttgaaagtttcgatattcaacaaatgaattaatataaatgtgtttggacattcgtttgaaccgtcttaataatgatcccttctcaatttgcagatgtctccctccggcgtttgttgtgacaaaggttcagtgcgcggtttaatttcaactggcggcagcgcgaggcatttgtgcgcttacggcgacgaccattcggaggaccaaaccacacacgcgaagatggacaatgctcacgcgtcagtgcactgccactgtcggccgttgcccgcccattatgggtccaccagcacgacttagtctgattttgccttacttttaacccgttttattttcaaatgccaaatttgataataatctttttat

SEQ ID NO: 6016 - DNA, 1934 bp, Heterodera glycines
taaaatgtgatcatgtattcgtgatcatcggcccaaataacccctaaagacatgtttttggaagatttttggtgaaaaaatttctcaactcaaaaatcatgtgctcccccctttggtctggaatctcaaaatcacttttatttttataaaaattcttaaaaaaatgataaaaatgccaaataaaatttatataatagagcaaaaaactgcggatttttgtagtattttatctttccagaatatcttttcaaaaccgagttatgaatttttttctgaaaattcgaatttttccagaaattctggaataacttttttccttttttagatagaaattccaaataaattccataaaattctcctgatttttctctaaaaaaaataatgaaattctttaatttaaaaaaaataaatttaaataatttaaaagaaatcttcaaattaattaaaaacagtcaaaataacccaaaaatgcacagaaaaataatgttacaccgtccggattcgaactttgcaccccccccccccccaaaaatgatgcctcagaatccccaatcacacagggattctgaggtcttgactatgtcaaaagtaaaactgattacgtattcgtgatcagcggcccaaataacccctaaatacatatttttggaagatttttgtgagaaaaatttttccactcaaaaatcatgtgctccccccagtgattaaaatttgaacaaaagtgattagaagaggtacaatcatggtttaaaatgaaataaataagaaaattgtattattggatgtattataaatttatcaaattaaaaaaatccttttacttattaaaaataaagttagaaatttataatatagaatatttattgaaattgaaaggaattaattctcgaaaattcaaattaaataaaacatttattcatcagaaaataatttaaaataattaataaaacaatattaaattaaataatttaaattaacacattagttcaccaaaataatttaatttaaattaaaaatttttatttatttttaataatacaaaacaaattaattaacatgtaaaagtaatcaaaaaatgcacagaaaaataatgttacaccgtccggattcgaacctgccccctcccccctcaaaatgatgactcagaatccccaatcacacagggattctgaggtttaaacgatgtcaaaagtaaaatctgatcacgtattcgtgatcagcggcccaaataaccactaaagacatgtttttggaagatttttggtgaaaaaatttctcaactcaaaaatcatgtgctcccccctttggtcccgaatcccaaaatcacttttatttttatatctttttttaaaaatgtgataaaaatgtaaaataaaatttatattatagaggaaaaaattgcggatttttgtagtattttacttttacagtatgacctttcagaaccgagttatgaatttttttctgaaaaatcgaaaatttccagaaattctggaataactttttttcttttgaacattataaaaccaaataaacctcataaaattctcccgattttttgctatttttaaagctttaattcacttaaattgagcagtccttcattgagttatgaattttcaaattttaacccaaatttccaaggaccaaaaaaattaaaaatattttagaatttttaaaaaattccaaaaaatctgaaacttaaaataaacatcatatttgtgctcaggaccctaatttaccccagaaaaatatttttaaccctctttttcaacccaaaaaaaatttttgaaaatttctagggggcctagctcgaaaatttttgaaaatttccggccatatggcacaccattcgatagagcttaaaaaagtctacaattttgcccttaggagttttttcgataaaaccaacccctaacgagttatggacccgg

SEQ ID NO: 6017 - DNA, 3067 bp, Heterodera glycines
  misc_feature (2940)..(2940): n is a, c, g, or t
  misc_feature (2957)..(2957): n is a, c, g, or t
  misc_feature (2987)..(2987): n is a, c, g, or t
  misc_feature (3044)..(3044): n is a, c, g, or t
  misc_feature (3051)..(3051): n is a, c, g, or t
aaaaaataaaaaatcctggattatagaggacacttctgcggagtaccctcacaacgggaattttttgatccgagtttcagaaaaaaagttatgggccgtcaaacgcacgaaaaaatgagaaatccgtccctgggactcagtcgtccgcgctgaatttttttctatagttttgccggattctcctcaaaaagtagtaagacccttccaccactttcagggcgctcccggccttcggccgggagattttgttttttgaaacgaaactccttgtcaatataacatatatagtaactagcgggtgcgtgaaccgtcggctatttagctgggaaaaagcgcttcgcgctttgggagcttcgctacctaggctgtgaagcgattcaaattgatcgaattggttggagagatttttttgaatttttaaaaaattataaggggtttttagtccacatcgaggctcaagacgggcgcttcgcgcccttcgcgtcctcgaacgggcgcttcgcgcccgtttctaatttttgttgtgcttttcggccgcttcgcggccgttttttaaattgtgttgagtcggacgggcgcttcgcgcccgttatttatgggttgtggagtaattgttggatccgaagcagttattagaagaggtgcaacagtgcttagaagaggtgcaacagtcatcagaagaggtgaaaaggttgaaaaataatataccatggcatataaaaagagcaaatacggtattcgtgataagcggcccaaaacgacttttcgggccataactttttattcgaaaattttcagaaattttgaaatatcttttttcttatccgttgtttaaataccaaataaaaggcataaaatgtgccgtatttttcctcattttttaattatttgattgtgaaaattcaccctccctaacccgagttacgaatttttgaaaattacaccaaattcccaggggccaaaaaatcctgaattttcaaaaaatttttaaacgaacccaaagtatctgaaaagaagaggtacaaaagtgtttagaagaggtacaaaagtgattagaagaggttcaacagtgattaaaaaaggtacaacagtaaatagaagaggtacaacagcgattagaagagtgattagaagaggtacaacagagattagaagaggtataaatttgataaaagaggtacaaaagtgattagaagaggtacaacatagattagaagaggtacaaatttgataaaagaggtacaacagcgattagaagagtgattagaagaggtacaacagagattagaagaggtacaaatttgataaaagaggtacaaaagtgattagaagaggtacaacggtgattagaagaggtacaaatttgataaaagaggtacaaaagtgattagaagaggtacaacagggattagaagaggtacaactgtgattagaagaggtacaactgtgattgattagaagaggcacaacggtgattagaagaggtacaaatttgataaaagaggtacaaaagtgattagaagaggtacaaaagtgattagaagaggtacaacatagattagaagaggtacaaatttgataaaagaggtacaacagcgattagaagagtgattagaagaggtacaacagagattagaagaggtacaaatttgataaaagagcaaaaaagtgattagaagaggtacaacggtgattagaagaggtacaaatttgataaaagaggtacaaaagtgattagaagaggtacaacagggattagaagaggtacaactgtgattagaagaggtacaaatgtgattgattagaagaggcacaacattgatgagaagaggtacaaaagtgataaaagaggtacaaaagtgattagaagaggtacaaaagtgattagaagaggtacaacatggtttaaaattaaataaataatgaaagtttttataaaaatcgattgcattttaatttaaaatttttttataataaaatactctttttattcattaaatataattttgaaaattaataattgaatatttattttgaaatgaaattgattttttataaattcaaaaaataaataatgaaattaaataaattaattaaataatttataaaaatcttgaaattaattaaaacattaaaaataacccaaaaatacaaagaaaaataatgaacaccgcccgggtccgaacttcgcctatatgaaattctttaatcaaacaaaaaattaattttaaaaaatttttcacaaaaaaataatttaatttaaattgaaaagtaattaaaaaaacaaacactcttttaaatgaattaaaaacattaaaaataaccaaaaatgcatagcaaaaataatgtacaccgcccgaattcgaacttcccccccccctcaaaatgatgcctcagaatccccaatcacacagggattctgaggtctgaacgatgtcaaaagtaaaatctgatcacgtattcgtgatcagcgtcataaaatacccctaaagacatgtttttggaatattttcggtgaaaaaatttttccacccaaaaatcctggtcacccccctatggtcccgaaaccaaaaatcacttttatttttataacaattcgcaaaaaagatataaaaatgtaaaataaaatttatattatagagaaaaaaattgcggatttttgtagtattttacttttacagaatgacttttcagaagggagttctgaatttttttctgaaaaatctaaaatttccagaatttctggaataactttttttctttagaagatagaaatcccaaataaatcccataaaattctcccgattttttactatttttaaagctttaattcacttaaattgaccggccctccattgagttatgaattttcaaattttaacccaaaatcctgagggtcaaaaaattgccaaatatttttgaatttttaaaaaattctanaatttactaaactgaanattaacatcagattcgtgctcagcacatcnaaataccccagaaaaatatttttgacccccattttcacccaaaaaaaattttcgaanattctanggggcctagctcgaaa

SEQ ID NO: 6018 - DNA, 5795 bp, Heterodera glycines
  misc_feature (33)..(33): n is a, c, g, or t
ctcgaccatgagacacgaaagattcagccttgntggaccttcctgtggccgcacacgttccaacacccaagcgctctgttcgatcacattcttccaatcctcctggtccgtccccatcagcgtttccattccgtccggcggtccgatcgccaatgatttgaagccagtggcactcacagcttcacgtgccgcacaacatgattccaaccatttttcgagcgccttcgattggtcctcctcctgtggaaatttgcctgtttccacataatccccccttttctcggagaaagcggccatttcgttttttggtccgtttttaataatcaattccacgaaaattcgggcggcggtgtttgaagagacggtcccggagcgcaacaagaaaatggccaagagtgcttgtagcggtgtttggacgatggttgctccgatcccggtctggccaagcaccgggtccagctcccccaatttcaaaacactgcaaaattcatgcccctcttctttggggttgcaaattgagttccaactgatcccggcgtccgaattcatttgacctgaaattttcaaagggaattccgtccctttgatcgagaaagatttattaatcccgctatcttttcccccatttttctcttcttttccctcttcgtcgcctttaatagcaattgtcccaaattgcttattttcggctagcgattcttcccttctttggcattccatttgaaccgacacgctaagaatcattgcatttaatatatttttatagggatttttccctcgtggcaatgttgaaatgtttggaatcgatttagggacttttataagcctttccaatggtacagtgatgggattagccgtctttttgtcgactggcactacttctgctgaggaatcggttatttttacgataaagtaagggccgaaatgtgtccatagtaattttttgtgtcgggaattacggtgcattcccggaaaagctaccataaccctttccgatatttcaaatttgtttgccttcactcggggctttgcgtcataccactctttactctttttcctgtattcctccaaattttgtttggctttgtcttgaatatttaagagattttccaagaacaattgaaaatagttttcgtgatcaattgtatatatcggattaaaatttatttgcgtaattttgtccgatgcaattattgctggtcgtccaaacatcaacaagaaaggggaaaagcctgtagattcagtcggcgttatattgtaggcgaaaacagtaaacggcaaccgttcgtcccacgtccaattgctagccgttgacctttttaacatcccaattataatcccattcactctttcgaccagtccgtttccttgtgggtcgtaacccgctgtaaatgacatttcagttccaagaattttgcttatcccttttagtgttgcatttacaaattcctttcctctatctgaatgtatctttttgggggttccaaaaatcactaaaaatttttccacaaatatttttgcgactgagtctgctgacttattcggaataggttcggcgaccaaatatttagtgaaatgatcgatgattacgcaaatgtatttaaaatttgattggcttggtccgatgtctaaaatgtccatacaaactaattcaagtggttcagaagaatgaactacttttagtggtggttcatttgagcgggcatttcgggtatgtgcgcatattctacaggcgagatgaaagcgaatacaatctgatagcatattaggccaaaaatataattccgaaagctgtttatacaattttttgccgctcatatgccctgaacattttccttcgtgtcgttcctttaccaaattttcacggaaggattttggaacaaagaggcgcattcttccatcatcttcacagagatacaaaagtttttcgaaaattgtatatctgtgggacttatccataacactttgtcgaatttgagggtcatttggaaccacttttttggccaaaaattcatagatcggctgcatttcactgcttttagtctcttcctcccatttttctttgtgatcagtgaaatcttgtatagaatctggaacttcatttgttcgtaccttcccaattaatgcaatttcttgattgtcttttggctccaaaatttggtcagctgctttagaacgagaaagaatatcggctataacatttttcttccccggttggaattcaacttttagaatgaagcgggagcttaattcgagaagccatcggtcgactcgggaatttccggtttcgtttttactctgaaacatccaaataagtgctttatgatccgtaatcactcttgttgggatcatgatgatgaattgggcaaatttttttacaccaaatttaacagccaaggcctctaattcggtagcactgtaacgagattcgtgatggttgcattgccgtgaggcaaagtaaattggtctaattctcttttcgggatccggttggcataaaaccgctgcaatacctattttactagcatcagtcataattataaactgcctgctcgggtcattttctgctgctttgaaatccggaaaataaagtacaacatctcgaattattttcgatttaagttcctctagtgcttccttttccttttctcccattttgaattcaactttttcgctcagtagcttaaaaagtggggcggcaattgtaccaaaggaatgtataaatttcctatagtatgtcaaaaatcctagcaaagaatgaagctctttttttgttgtgggcgttggcaattcgatcactggtttcagtttatctgcgtccatttttattccttctctcgtaaggatgtgacccaaaaatggtagttcggtcgcacaaaaatggcatttttccaattttaattttaaaccggcagttttaatccgagaaaagactaattcgatgtgtatcaaatgctcttcgaatgattctgaggcaattagaatgtcatcgatatacacgaacaaaaattggttaatcattccgtcaaaaagacgagacatgaacctttggaaggtagccactgcgttagttaagccaaaaggcataaccatgaattcataaaggccatattctgttgtgaaggcagttttttcgatggaattttcttccattttgatctgccagtaacctgacataaagtctaaggtactgaaaaatttacgtccgccaagcattaaaagtgtattgtcaatgtttggaagcggaaagcaatcttttcgggttattgagttcaaccccctataatcgacacagaatcgcagagttccatccctttttgggactatcacaattgggctggcccaaggtgacattgaaggtctaatgagacctcggcctaagtaattttgaatcatttcggcaattttttcgcggtaagcatatgggacaggtcgcgtttttgtctttattggcgcttttccttcggtttcaatttcatgttcgaccaaattagtctgcttcaggtcttcatcactgagcgcaaaaatttcaggaaattttttgccaaatttttgtagtttttccatatgttcttcagggaggtccccagttctggtttgtaaaatttccaaaaatttcattgcgtctagtcgaaaggccgcaattggatcgttttttttggaacaaataatttggctgtttaagaaattttctgcttcttcgactgattttgcgagttcgacttttccaacttttgagttttcgaaaagtgtaatggctgacattgaaaaatttgtcactggaacaataatttttcctttttgggcaagccctactgttggttcaacacgaattgcggcgacggaattttcgtccggcgttgcgacaatttcagctccttcgaattgactatcaatgcttaactccaaatttttaactgaattcggctcaatggtcgttctgtaaatgaccgtgagaaaatccctttttcccgactctgttttttcgaattcgaccatagctttattgcgttcatcataaagtttgaatcctaaatcttgtaatgcgttggtgccaatcaaaagtccgaatccaattggagcgtttgtgatatgaagaaaaatggacaccgggtctgaaaacccatgacgatgaactggcaatttaacagttccaaggcacttaacaaattttccgttaacatcaaaaatttgagtttttgacttaaaaatttccaacgactccaatttcacttgcttttctttgaccaacttatgcaaaaagtcgccgccgattagtgattacccgcgttttgttgaagacttcttcccgctgaaccaccaaacaattgtgctttaaaaaattggatgaatttggtttgaatgtgtttttgttattatttggggtctgaatttgagtccgatttgctcccgtcacaacaaaatttctattttgttgattattggtgtcctgattttgcgaaaaatcttttggacgcgtgcaattgcgtgacaaatggccgggttccccgcaattgtaacatttccattggaaatgttgaccttctttggactgatgattggtattgtaagtctgcgaaaatctttcgcttgttcctgttccgaaatttgagttgacaacagaattttgtcgccatttctgcgtttgtacccgatgctgaaatgtgtcattcgtcggtgtgacgaaacgttttgctgcgcgttgtgctgattcagcccgagcagccaacgaaacgaagtgatcgagtgtcatgcccacagtgcgaattagctccaaatttagagcgagatcgggattacccatcgcccggattaagaacttaattgaatactcatcacttagattgtttgtaaggccagggtaggcccgtttaactaaggcagaaatccttccggccaaatcatcaatcggttcatttaattttctgcggacgcccatcattaattcgtcaaaagcgttgagattttttgagtcagtttcttctaactgctgcagcatttcgcgacggatgagttcataacggtatggctgagttgcctttgctgcttcaagcgctctctcggctttgttaaacactttgctttccaacgccaaaattctttttgaatttggccattcgtccgtgtaggcatcaaattttttgaaaaaacgccttacgatctcaatgccctcatttccatttaaatctgggattcgttccaagatcagattaaattcaaggttgcttagaaccgttgaattgggttgtgtatgcataacaaattgtttttcgcagggattcataatcggtttttgaaaaatttgctcatttccttggaacgggaaagcatttggctgtcttggttgctgattttgtgggtatacaaaattaatgttctcctctgctccttgccagagttctgcttctgcaggaatttttcgaatgaaacgactacccgcctgaattggtgcgtttggtggatcaatacgatgaccaccactggagaaaaattccatgttaatgctacgctgagcatttgctgctatttggtttatctgcgggggtctcagtgggatagggcggaaaactgtgttagcaacaggttgctgcattgcaatttgtcgcattcgctcagcttgaccaactattatcggaaaaggtccgaatcgctgtcgattttcaatatttacagacggagttgaggtatgtgggggttggagaaaatttcgagggctagctggttggcttggcgcaaaattttctactcgaatttctatgcaaatcattctggcgaacgaatgttgtccgtgaatc

SEQ ID NO: 6019 - DNA, 1809 bp, Heterodera glycines
  misc_feature (1752)..(1754): n is a, c, g, or t
gcagtcatttagcaaaaggtgtcccctccaccgccgcgccggagggcacaaaattgagcggtggcgaaatttccgtcacggcaccgtttgccggaggccgatttgcacaattattattattttaatgcttgtaccaacaactttccggagggttaaatgggcgaggcaccacctcaccgcccaaacattgtgccaaaattatttgtgccaatgccacccgtccccctaccccgcccatccatcgcttaatttaccaccaccttccacccccacacccgccacccgccttaaatgggcgacatgccgtactctccagcacggcgcggcgtgccgtccgtgcccgccggggctgttcacaaaagcgcgttgagccgtgaaacagtgccgcaggggaggggggaagcctaaacacacactaatttggccactagttcagcaaaagtaaatggatgaagggaaaggtgctcatttgtccctaacggggccattgttaatagaagagaccggcacggtcggaattttcggcatttttcggtttttttttgggaattttaattgaaaaattaaattaataaattatggtgggactccaagctccgacctttcaaaccacgcgactagactttaatcctgcatgattaaagcaatttaaaaattaaatttttcgacgaaggctattggcacaatgcaagccaaaaaaatcaaatttttgtcgtcaaaaaaatataatcgcaaatttaattttacttacttttatatctgtaattagcaattattgtaaataaaaattaattacttataccaaaaagcagcctaaatgtgaaattattattgtaacacgaaaacatttttaattgccggtcaaatgtctctggagaccaaacaattcaccctgaaggaattgggagaaggggtcattcattggttaattagtgcaatgcaattgaacctaattatatcccttctctggatatcttattattatgatatattccaagaatatcgcgagcgatcaaccattgaaaaaaagccatcggcgggaggcagcacatcattaactaattgccctcaatttggtggcccacccctcccaccaaaaaccaccgtttgacaaaattgtcaaattatgaacgaagtaaatatgtgccgcctcaaatttcattgcccaaatttattgtctgtcgtgcctgcccacaccatttttctcccgcattcattcatttccatgccaatttacggtagattacggtagggagaggccttggggacagagggggcgccggggggaatgaccgccgcaaaacgacacgacgatgacggcgactccccatcattatgatgaggatgatcggcaatgtcatcaacggtttccctccccgcccctgtccccgtctccccgaaaaattcgcgggaatttgtattagaggagagagagaagcagaacgccaaattggcgatatttttctgcccccgcccctctcattgcaataatcttccaaatttggtgatgatggccttcacacttcttcacaacgttgccccgcccccgcctctccccgcaggcgaggcgataattctcaatttataataataatttggcgctaccctccggggacaaatttgtttattctccgctaacgacgagtgccaaacttggacactgcagagcggaggaggaacaagaagcaactccatcagggccgagtagaagtttagtccgagcaacagttgaaggctcaatttattgccaannntaggcgcttatatcatttgccgctggcgatgtcggcatttccacggtgccaaaat

SEQ ID NO: 6020 - DNA, 974 bp, Heterodera glycines
atcggagaaagggggtgccatgccacaccttaatttccctcccaatattttttccgaataatgcataatggcaaaggcaccaatacccgttgtcggtttctgtttgatcaaagcttcataattattgacaaattcaaatgcaataaaacagttaaaaaactgatgaaatgcggatgttcggatgggatttgatcatggtatcaatttcaccgcctgtcaaattttaaatttttcaaaatttgaaattttgtaaatgatgtcaaatgctctaacaaaagctgtatatgaattaaatggtagaatgataataattaaatgtgctgctcacacataagcttattcccggccaggcgacttcctcagtgccgcacttggccattccgcagcgttcatgccggcggctaacatcaatggcattccgtcctcatcatcatcattaggggcagccgcttcaactagttctggcaccgccacaacaccaacaggtggcgtcggcaccggtgccggccaactggtggcacggaacagcaccaaaacgttgaagtgccccaagtgcaattggcactataagtaccaggaaacgctggagatccacatgcgggataagcacgcggatgctgaggtgagtttttttagtcatttggcacatggccaataattttgaatttgttcggcttaatagtggcggtaacggtaattggttgggtaattagcagtattacccgattttttaaacaaattcgaaagagaaaatgccgtattttacaagttaatttatccgacaattgaccggtttaacgctaatttccacggcaattagccgtgccaaacaaaaccaacagtgtcatttcacccggcagatgagtcattaggccaaaggatacggtaccctcaaaaaaaaacgagaaagcaaacggtgccggataaatgcgaaaaagccggaaaatgagttcccctaaatttgctaaaaaaaa

SEQ ID NO: 6021 - DNA, 3969 bp, Heterodera glycines
catgccatgcaggaaatgccgcagtcaattgccggtacagtttttgaagcgggcactaattggttttgatcgggaatgaaaaattgattggtctcgagaattagctgagagtaaaagaattttctaaagcaaatgctctaaactgtttaagactaattaatttttgattgggaacgagaattagttagtttaaaaaccgtttagggttaattagttttggtcggggatgcaacttctcgaaggaagaccctaaaaattctagcttctaaaactctaacttttcttttatggaactagaaaatttccgattttttaaaagggatactgtattctcaccaaacgttgtaagcctaatgtatactgtattctcatcaaacactgtaagccaccgtaaaggtcaaggaatgcggtcgagagtttagactcattgttccctaaaaattcaagttttgttttatagaattaaaaatttatgattttttatacaaaagtatactgtatttctcactcaaatactgtaagctaccgtaaaaatcaaaccaagttgcgggtcaagagagtttaggctccttgcttggccaatttggccaccagcagcagcaccaagcagcggcggcagttggacaacattcgtctccgttggatgcgacgatgccgacggcaccgaatgccgtggcacagcgtgccgaactgtccgccacgctccaatgcctgatctgcttgaacttctcggccaactcgttggtggacatgttggcccatttagagcgtgaccggggccaggcccaggagggcgacaccgccgcactgcacggatttttccaggtgccaatctctgctgggcgaaaatggttggcggttgacaaacaactgataaactcgggctatccggtcactatttgtgggagtgttctggccactctcaattagcgttgttcgagattctcggttctcgagtcgagaaattcttgggtttttagggtctctggctcaagtttaggctttttaagtctcggtcttgagacgcgaggccgagaaaaatttttccaacgcttgaaaatagggaatttttgaaattttgattatttcatttatccaaaactctgttctcgagacttggaaaacattttaaatctcgggctataattaatcccattggaatttgatgaatgataattttatgaaatgcttttccttaatattttgtgtaaaaatttctcaaaaatccaaatttttgaccatttagaacgaaatttgtgagacaaatctcacccaaaattcatttggcatgataattagctaattaggagcttaaatgttttttaaatttgcgctttcagtgccttctctgtccgtacagcaccaatttgaaggccaactttcagctgcacacgcgcactgacaagcacatccaacgagttcaacttgtgggttttccaattgatttagaattttttttgaaaaaaattgcaattttttagtaaaaattgaaaaacaagtttgagtgaccattttacccaattaatgataattggttttttttgagaattttcaaacattgccgaaaaaccacttgatcagatttggaaaaagaaagatctgatgagattttccataatcatatccaattttttaaactccaataatcaaattggacttaaagagacgctaaaaatgcaatttttccctgggggcgcataaatttaaaaattagcaccggaaaaattttttggacacctaaaaaccagtctttgggttttttttgttcccgttacgggcctgatcaccaccacagatgcaaaatcatcgccaccggcaaaaaaaaaaaagttaattgtgccctccacgccaattaaaaaagggggcgctggtgggggtttttggcgttttgttgctgctgccccgcattttcaaaaatcgtccaaaaataggtgtgtctgagttgtgtgtatgttgtgtgagcgcaatttctcatcaaacaaatcgcccgaggggggcaatttttgggtccgaaataaatttgccctttttgttgtccaccgccgccccccccccccggcacccaaatgaatttgtcccccccccgcccccctaatttgttccacaaactctgtggtgctgttgctcatttccctcaccgcgacgatttgcgcgcggttaatgagccgatggattcaggggaaaatttaggggaaggatcggttggatgacaccaaaattgggggaggggacgaagagggggggagggacaacactttgcaaacaaatgcacttctgctgctaatgattgctggcgaaattccttccaagccgatgccctgggggggaattggaattttgaaaattcttagttttcaatttttgaaacttgggagggacccattggaatttttcaaccgaggttctcggacttcatttttggctaacgttgaagcccatccaagttgaagcagggggttggggtttttttttttttgaaaattctcagtttacacttttgcaactaggagggaccgattagaatttttaccgagggtctctgtcttaatttggccatctttcaagctcgtcccagccgaagtcttagaaggaggaagagagaaagattttttttttgaaaatcttttttacaaggcccttcctgctttttctaattccggtccgggcttaacctaagaatcgttagggcgaaagttttttaaccgacatttggtcggccaataaatgttttttcataatctaaagcctaatttaattgaaaattttaaattagacaaaatagggcctaattgtttttacacgtacagatcaaccacctgcgcgaaggcagtgccgtgatgggcgtgccggaacagttcgcgcggcttggcaacctgaagagtgcggtccaagtgcgttgtcaactgtgcgaggaggtgttctcctggtaaataaatgtctatgccaaactggtttgatcagtttttatcactaaaataaatttctaaatgttctaagcattctggtaactcataatttacctttagttgctatttcattttcaaaatgatcagaaagactctgagaataaattgatcagattttccatcatgcaaaatgcttcaaatgatcaaaaagctaaaaacacctctgtttgtctatacgtacttttctgcatttgtcaaattccatggatttattaatgccttgcaccaatgcttttccttttattattgtccgagggcgaaaattatttgtgccttccctccgaccattttcggcattttcctttcgcgcaaagggcaaacaaaatccaaatccgccccgccgcggctcatttgtataccccacaaaggggcaaaccttccgctgggcttaacggggtaaagcatgatcgtaaagcgcactttaaagcctctccatggtacccacgattcaccacaaaaattcagctacggcgcgcatcagcgggccccctcccccgagggctcggcgctcatagacaaccgacggacgacgtaccgtaggggcggggggggcaacgatgacaaacacaaattaatggggggattatcgcacctccgtttcccaccaatcaaacaaaaagcacatcctttttcttctgtgttcatcctagacccctcttacaatgccttttgatcacttttctgatcacccgagtcaccactattccttttggtcgagttttacctttctgatcagtccatccattaatggccaagctggatcttctgatcacttcatctccaaaactggtaattcccaccaaaaaatggtgtttctttttttgatcactcactcactctcactaaaattgtttcatcttgaccgttttacaacttaatacactgtaagcatttgtttttgatcactttcccatatcagttgatcactactgatcagtgatcaccgtcctctccgtcccacataaaatgcctttttaatcatttttcaccaataattctctcc

SEQ ID NO: 6022 - DNA, 908 bp, Heterodera glycines
aattttgagatcggaaattttcaaaaacgggttttgatctgaatcagtggtttccaaaattgcagaccctccctaaaaaattcgcaaatttcattagggctattttaaaattgccatttaactattacaaaatcccccttaatttttttgtaaactgggcacaaaaatgcgtataaaaaattagggtaaaaagataccgagtccgccctggatttcagaattacacaagattcgcatcggggtacataggtgaggcatcatatttttttcaaatggatacggttccggcttttccccaaaaaatcattaattgcttcattaaatgctaattagccaaacgacacggacatggcttttccccataaaaatgatcgatagagagagagtggaaaaccaattttttggggttggactccggcgggaggttggtgggctttttccgtagtgatcacagcgggacatttcacccctaaaaccgacacgcgccccccatccaaaatcccatcgacggtcgttggtcctatcgcattaaataaactcacacacacaaaagccctcaagggcggagttgtattggttatccccccccccccctggccaatttcagtcccgcaaattccgtccctgcagaagattagagcatcgtattataaccatgttcgttgttgttgaccaaatctaactaaattgatatgattagaatttcgaaaattatagacaggttgctctaattagcctagtaaaatttcgatgaaaatataaactctaaaataaattataataatttaaaatttgaaaaaaagattttttgcggattttttaatcaagtagcaaaagccttaacattgatttctacataagcagagcatgtgaaggatatcaaactcataaaattcggtcaactgaga

SEQ ID NO: 6023 - DNA, 1248 bp, Heterodera glycines
  misc_feature (1227)..(1227): n is a, c, g, or t
cccccacccaccgcccagcgaacagtttgacttggaaaattttttgatgtttttaaatttaaaatattttaaaattgctgggggctaaaatcctcctccttccttaaaaaagagaaaaattaaaaagaaataaattttgtcaccttgggacaaattaaatgccaaaattttttgcttttgtttatcaatctttgtaattaacaaatgaccactaaaaattttttaaaatagtgattttgaaattttattttcaaacaatatttttttataaaatgcaaaaattttagatgtttttgcaataaataaaatattggtttttaaagtttgaacttggaacagaaagagctaatttgccgacgctgaaaaaattttattttaaaattcaatactctttttcactggcaaaactacactttaaaaacttggcattgccattttgccaacacttaattaatgccatttaacattgctgggtctaacaataattatccattttttctgtccactgccggaaatgttcgaaaattcggcatttgtccccgcgaagaaattggtgtgaaaatgggggggggggcagggatggctagtaacattgcaaattgaaggcaaatattgccgcccctcccccggggggagggatcaaaagaatctgccgacaccgtcgccccctccctcacataatctgcgcgataaatatttgcgaggccattttcgcccttcacctccctccccccggctccttccggcacgctttgttcaatgggcggtggtgctttatgaggctgtttagcctcggcttattagtcccctcccccccccccacgggcgtaatgagtggctttgtcccgcgctccgaagggtcaaattttggcacacaccttttgacgacacatttagaatttgttttgtttacattggatacaacatatatggaatgacccagattggttttaattttttgtcgaccatttgtcccaataatttaccatttgtcccattaatgccaaattttccatctgaaagggtttatttagtaattgtcggtggttgttttttttatcatttgtcttaatgactaatttttggcgctaattcctggatttttactatttgtcggcaatatgtcccaaattatttatcatttttcccaatttaattttttaagaccctcatttttattttcgaccttttgtcctgatgataaaagattttgaccatttgtccaanttattttttagatcttttttt

SEQ ID NO: 6024 - DNA, 1543 bp, Heterodera glycines
agttttgtgctgtcacagtgcttttaatttacataaaccaacttggactgttccacgtgaacagaacttccaaaggatgtacatctcctctttctcgttgaatgacatcccttggccaattaaacatcagtcgaaattgtaatgttcagatgcccgagagtctcgacttcgattcttctcgactctctcccgaacagccctataagattggcaaacgccaactcacccaaaaacggattgatattgtcgtggaccgcatctttgacagcggtcaacagcactaaatcttcgcgtaggaatttcagcggttgcttttgaacgaagcggcgatacgtcgcgtgggtattcactcccaaaatggcgtgctttcggtttccacctgtgctcatattgctcaatttggtattgccactggcgagggacaactgaaacaaaaaagggacgaaatcggaagaaaattcagtgaattattatcgatttaaagggcaatcatcgatcactgatcaatcagaatctccaatcaaccggtgattatcaattgattgatttagtgatcaatggatgattgagcaattgatttttagtaaagcaattggtgattgattgtggattaattatctgtgatcggtaaaattgattgatcaatttaccaatgatttggccgtttcttcgtcgattagtcgaaaatcgtcacagaacaagcgccacgacattttgttcaacgcgcgagtttggctaaacatggccaaaaaatagttaagtcaaccgtgaccaattcccaaaagtgaccaataacggcgtaacatccaagccaaaagaattagcaaaatcaaagccaaaatcgtgacagcgatggcaatttcgatggtataagagcaacgctgaattgaggggataagcaggaaatgaatgcttaaaagtcattattacaattcattacctgacccctgaagccgcaaattggctcatccggtggcaaagaaccgttttcggaaggccaaaagccggtcattacatcggccaatttcttaattagtaaatagattaggggggaggggcacttaagccaaattgaaccagatcgtagcatccgcttttgttgatcagcccatcacaattttgcacgcggtaagcggtcatttggaccattttcagcactttgtcgcggtttggcgcgataaaaaaggcggcaaattggggggccctaaaaagcgccggtttcgtcagttcctaacaaataagcgtttgtttgtccaaagtgtcgtccacctgtccgcgaggtcgtccatttgtacgaatccggtggacgcggcaccgacactgccaatgccttaaagggcggcacaattccctttggaaagtccgtcaagtgccaaccctcaaaggacagtcttctcatggcattccaaatttggtgtccgtccaacaccgcctccgtcccatttccgtccatttccatcgttttgttcaacacatgacgcgctgccaacgcgtacagtttcagcgagtcgtaaaggtggaggtaggcaaaagtgtttgtctg

SEQ ID NO: 6025 - DNA, 2147 bp, Heterodera glycines
agacggcttacggcactcatgaactcgcgagttaattcacgtgtgtaggagaagatgcacaccaccactgaaagaaaaatgagttgagtctggggccaattgtcgtgccattcccgtctaaattcacctcccccctcccccactctcttcttaaatcgtactctctctccctctctcccccctttgtttttcattctctctctctctctctctttctgtctgtctgtctgtctgtatcaccatcttcctttattttttcattgtctctctacgccttcccccaaagtcccaaaattcaacgatttctggccctgtttgcgcatctgtctcgcccccacaatgctttagtccagtccgattcatccatcgacaaaccaatcaatccaccgccccctcccattgctcaattcgtcttcctcccccgcccattcattagccgcttcatccctctctttccaaattcaaagttgaattcgtcctcccctccccctcatttgctgctgttctgcacctcttcccctcgggtaaagatgtgatgagttccttcctgctcatctcttccttccgatgaggtcattccccaaccccccccccttccccaatctcttcagcccctcctcagaatcccttctcctatcgatgcttcttcctctcctctccgcccttttgctgctgcttctgcctcctttccatcgcttccctttggcccaattcgcttccaaaccgcgtgagtaagccctttgcccgtttctgtcacccccgttcatctgaacaaaccatttcagcacctctctccccaaatcccaagcctaagtctcctcttgccgctgggcctttgttgctgaaagcatgctgtggcgacaattgtgaggagttccaacggcccgaggaggtacaaaaagatgacaataggcaattaccgtatccctttgcaattcagatgtacggtatcacttggtgggttctgttcacactgactttttttactcgggcaagaaaaattgccgttttaaagttgcggcaacgaaccaagcaaccaattcgaggaaatctgttgcgacaatgtgccgagaaggtaagtgccgacgagttcgactttggaagccgtgtcattgttaatccgtgccattatttccatttcctcaggcgtcgccagccctccagcttcatcgaccgctgctgcggcgaccaaacccttgcctatgaccagacttgctgccaaggcgtggtactcatataattatggcaaagcattgtttaaaagttgctgctaattgctcttagtccaggtgcacaacattccctcgggcgaatgctgcggacggatggcctacccgcggaacagcttcaacactttgtgctgcgaggagacgctgatcaccaacgtggacccgtcgctgatttgttgcggtaattacgctaattatactagtaaaagccaaaagaaagtgtcatcaattttaattatatttttaattggacattagcggatttttttgtgtgtccctttggcaggtaaaaatgcgtacgatggcggaaagagggaaatgtgctgtgggggtgccgtttatctgaaggaactgttcgacgggtgctgctccatatacgtgagacgagtctcagtagataatttagattttaaaagttttagggtaaaaatccgccggagtatcagcagttcagcagccgaacccaccaatgttgtgacaaacccatcgaacggttcggcacaatcaaatgctgctacctgaaggactcccagggccgcttcttcccgaagagttacgactcgtcaaaacagtgctgtgcctatccgtacaacaaaataacggcaaaaaatgcaaagggaaaatgcacggactgaaaatatgccaaaaccgaccctttgttacttattccattcccaaagcccaaagtaaattttggactatttattaattaattacccatgccgacgaaggcattcattccatattttattattattttattgtcgaattggttgtttgtcagcacaattgtatgacctaactaacttcagtttttcttacgattagctcttttttatatttctttctctttgctcctccaaattccctctttctctccccccactgatcaaattgccgaatttccaatccccggct

SEQ ID NO: 6026 - DNA, 772 bp, Heterodera glycines
tttacctgtgtttgtcacaatggccagctaaaataaaaaaaaccattaaaaatcgtttaaaattggctttaatccaatcgattgcttatccccctaccgtcccccattcttcgctttctcgcctttttccaattgtaatgctccaccagtctaatcagtgctcttgcgatcgaattgctgtttttcgaggaggtgcgggccaacgttttgtaaatgttccggtcggacaccgccgtcgtcgttggcatgtacgaaatggcggggatgttccagaaagagcacattttggccaccgcttcaaactctgttcaaccaatcaaacccaacccaatctgtctctgatcatttgccaactcaccactggcacaatacggacccaaaaaggctctaactttctgaaaaagtgtaaggaatgttctgcgaatggcattcgaacctctttgtggtacattgcggccgcaacagcgaccccttcgtacgaatcgccgcaggcggcgaccgattggatactgtaagaggaggtaaggctaaaggggggagacggtaacacctaagaacaggccatttgcgagcggaattatgtacaccagcgacacattactgctgatcgcgatcatatcgctaattatgttatttgcgttaaaattggatttttagttttggcttaaaatcaaaacaaatttctcatcgtaaaacaaattgaaaaaagagtctgaggactcattcagatttggaaaaatattttaattttaacgacccagggacggtcttt

SEQ ID NO: 6027 - DNA, 1449 bp, Heterodera glycines
ccccccccccccccacattttatctccgatagggcgcctcccatcccgagggggcgcttaaaaggaaatggagaaccagccaaaggggtcagttggatcagtcgggagcagggctggccgtgattgaatttccaatcacggaaatccgtgagccgtgatcacggggctttaaaaaaatccgtggcccgtgatccgagatcacggcacccccaaaaccccgtgatttccgtgatccgtgattaaaaatttttttttctaatgattttttaatttaaatttatttagaaaaacggaatttaatcgctggaaaaattcctaaaatatattttaaagaaaccaaaacacaatccgctttttttgctgcgtaccttttccaaaaaatgactaagtttacgattttgagcaaattttttgatgaaagttagagctttttgtagaaatctccaaggataaattttattttttaactaagtttattaagaaaatttttcaaatttttcttaaatttaacgaaaaatctatttatatagagaaaaaaatcagaaaaatttcctttaatttgtaagctaacttttgatgctgaacaaaaaaatcttttggaccaacatgatcagattactccttcatggcgatctgaacaccccaaaagatacagaaagtggggaaaattttagaaaaattcatagggtgtttggaaaatttttctggaaattttgattaagcctttcattataatttaagcgacggagagaaaaaatagggatttttagccgtttttgcgacaaaaatgggttattttttgctattttggggtcaaaatttcaaaaataccggtaaaatgttccgtccgccggtggtgccgacaggcgccgccgggaaaaattttgaattttgagtgaatttcttaacagattttgtccaaaatatgtcaaatcattggttaatttattggtctatggacgttttaaaaataaagaaaaataattttcaatgttaggaaatttcttattaattaaatttcaattaaaattatcaaaacaaaatataaaaattctcctatcccaatggtgaattgaacccaagagatatttatttctctccattagtcaaacactcgaggttaaatgatcttaaattattttaatcaaagaatttccaatcgcgcgaaacaaaaacaaaaaaacaaaagaaaactcgcccatccaatcgtttctctcctccaattcactgttatcacttgtcattttcggcttttacatttatgtacaataattgcttaattagctttttggttctttcgttttcctttgtgcgtttcgtaattttaattttggggtcattagtgagacaaagtgaaaatgaggcgagaattcccagcagaataaccgggggggggggggggcggatgacgacgcgcttttttggtgctttctctccggcagcacttta

SEQ ID NO: 6028 - DNA, 965 bp, Heterodera glycines
gaatttccggggggattatggggggaaaagggggggaaaaggggccaagccggaagattagcgagaaagtttatggtgaaatttccccccaatttctcgagataaacattaataatatttttttttttgtgatttttttattattttaatttttaaataagtttgtggagagacaaagtgccaacgacaggggacgaaggccgaattaaattttatgagagaaaactgagcagcagcaaaatatggcaaaattggaacaaatggaaattgagcaacgaagaagcagggcaaaggtggtcccagggagacgggagacgggccaaatccgatcccacccatggcattattcactccccccacccaaagtagcaaaaagttaaatcaaactaaattaaaatttttgtactttttgtgggaagtgcgcggacgatggcaaagaaaagaaaaaatatccccccccccccaaatgttttcgttgtgtacgtgcacatgttgttgttgtctcccagtttatgtgcacaggtttcttttcgaagatcgcttcgatatgtctgttcttttcccttttctgtccgacaaatcaatccgaaaatgaatttctgtcagcgcaatttccaaatttccatcatttttcccctaaattcaattaattttttctagtctctggcacaggctggaccagatgctgaaagacatgggtagtatgagacgttcgtgtgtgtaaatgccaaaagtcgtgtcatctactctgtttttcggcatttgcctctcgctaaagtgccaaccgaagaattttttctctctattaattaattattattttcacatttttgccagccataatgctggcggctatttccattaattttatttttattcgcgctaattttcgtgaccaattaattaattaatcgatgtgcttggtttgtacgcctaaagcggcgccagtgatttgtcgcgtttat

SEQ ID NO: 6029 - DNA, 4433 bp, Heterodera glycines
tatcatttcagcaattttccgatcactcattttagatttcctatttttatttgccaaaattttttcattttttccattttttcattcaccgttattctttttttgtgaatgccaaattgtttcttccatttcctaatgacagctctttttttggagaccaaattctttgatccattttttaatataattttgggttgtgcccaaactttttgctatttttgtgttaatttgattcaattctttttttggatattttcttcctttttgcttaattttctcttttattttataatattttcttattatttcccgtttcttctgttcattttgcattttttgttctttttcttcccatttttctccaaatatttcatcaaatgacttttgttgcaactttttctcttctgattcaattggactaattagggcaattaaaattaaaattaaacagataatatgaataaattcatttttccggtatgacttatattcccttatatgaatttaaattttattttctttaataaatccacattttagtttagtcgattaagagccttttattcacatgaaaaaattacatctctctacagatctccggcaaaaaattgatttaaaaaagaaaaaaagatgattatctttttttctactctatttattaaaaaaagaaaaattaatttctttttttttggaaaatatgtaaactgataatccgaatgtgagtgattagaaaatttcaaaatgatgaaaattagtggttgacaaatgagcgtaattttgttgttcagctaaaaatttattagcattaaggcaaaatgccttgattggaatctacaataattccaaatattgaatcagggccagaatttttcaggtaaaatgccattaaaatatttatataacaaatccccatttaaatttcgtgtagtcttcttttttctaaattgtgtatcataaacttttgtcattttttcaatagtcttcatagcccatataatcgagctgttaattagttaattaattaattacaaatattgaattaacttagtttaacttttttaatgtatagaattgaaaaattttcattattttacttattgacaatatttttggtcaatagattcgaattttacattaataaacagggctgcaaaaaatatacacgaaagttgaaaatgagccctcaagcacaaaatttcgatttttgaggccctgtaacttttgaagcaggcaaaatgcaccgctaaaattaaaaattcacactagaagtcgatcctgctctatccaatggtatatcatttatatgcaatttcctagtcactgtctcggagatgttttcccctgtttgtttgcattattaaaaattgttcaaagaaaaccaaaattttttcttttcaaattcggaatctttcaaaaacccgagaaagaaattttttaactcgaaagcatccaatctcgaatttttgttgtaaaaattcggggtttttagtgaaaaggaagagatcatttccccaatgtatacagtacatagttagttctacagtacctcgtcagtgtactgtacgattccggtgatgtttgcctggagcaaaatgcaatacattcggtggtctttgacacccagcatcaaagcgtggccagcgccgagaaacaaaagcccgaaatagcacacagccagactgtaaaagatggtcgacatacctcggcctaaggcggaggaaattttttgtaaaatatttttttattaaaatattaattaaattaatttttttttacaccctcagcctccctcccccgtattaaaaccttgtgaaggagaagccattttaagttggatggatattttttttaaaaataatgttgtcttgataaaaaaataagttaattttttattattttgaaaaagcaatgtttataaataaatagttgtccttatttctaagattgtcctttctttttaaaggaggggtaaatttcgctaacataattaattattagtaaaaatcgtaattataaattgtccttatttctaagattgtcctttataaaggatggttaatttttattatcattaaaaaatagaaagttttatttataaatagcgtataaaattgaaattttttagtctagaaacttttcacgcttgaattttgtaaaattttgaaaaacgataatttttgggcaaaatctattagcaaattatgatcaaatttagaaattcctttggcaattagaagagagcaaaccctcccaaattacataataaacaaaaaagcaaggaatagagtgagagttgatcaacgaacacttctctgttgctcctcaattacctaataattagataacgggcgaagaaagaaactacattttagtgaacaacaaaatgatgaaaataatattttgtaggctaaaaatcgtggatgagaatgatgatggacagaagagagagaagagaagagaagagataaactcctcctcctccccccgccccaaaaaaacgaaaaaaaaatcaatttcatcgattcatttggtgaatgggattaaatataatgaatagatagagagatataatgtaatgaaaatgtgtggatagcggggacattggagaacacttttctttaagggggcttttaatttttaaatttaaaatccagtgttttatattacataaatttggaacatttttccgagtttgtgttgcttttaacaatttttttttatgtttaatttagaaagccaaattttaggcgtttttaacggaattaccccctccccccccaaaaaaaaaaaattaattaattaacttaaatgttgaatatgaaaaagcaaattaaaacattaagagaaaatttacaacgaaaaaacacgagatccaggttttatcgagtatattcaagaattcttttttgtttgttgctttttcccataatttagttaaataaaaatttaatagacttcaaagctttagttttcgttggcactttttcgttttttttttaactttttttttcacttattttagataccaatttttacgattttatgtactttaaaatccatgcctttatgagacaactttaagaagccatatttttttttctctgttcgtcaaatttaaaaacttgttaacattcgaaagctctataagtttcgaaattatttatgcgacttttataagcgattaaataaccaataaaaaatttaaaattgaaaactgaaaaaggtttttgtcaatttttatttttaactgttttacttctttacgaaccattgtcaattttggttagctgatcaagttttttaagttcttttgaatgataccatgtttacttggatctgatcaacaaagaaaaaaaaacttatggcttcttaaatttgtctcattgtcagacgcggttggcccgtttcgtttttagacatccgatttttttgaattcaaaaatgacggaacgccatgtcatgtatttgctgttgcgtgccgatttgctcgacgtgttgcgctggccccttggcgcggtgttcacgcaaattgcacacgcggcaaccgcatgcatttggacgttccgcgaggacccggaggttgccgcttatatgaccgacatggacaacatgcacaaagtgacgctcaaggtgggaaaaatactcaaaatttaatgaattattttaaaatattataaatatttataatttttaattattttaagtggcttttcaaaaaaacttttttgccaaatatttgcaaaattaaataaacaaaagggtctaccttttaaattatttttttgttgaaaattttatatatcaagggtcaaaagtaatttttatttctgagaaattttaagccttcgaatttttatttctgaatttttaaaatccccgaaattgtgattttcgagaaaggttcacaattgcatcacttgtatctatttcatgattcataaaaaaaataaaagaataattaatttctaatgaattaagcagttttgtactaatttaaaaaaatgccatattttgcaattttgtgtcgggattttggtccattttttatgtctatctatcatttcgagatttaatattcaaataattcaaattctttacttgaaaaataagacattgttggtcaattagtttttcgatcatctctaaggtgccagatgagaaaacgcttttggaacatgccaaacggttggctgacgaaggcattgggcacagagtttggcacgaggatggcatggctgtttgtattgcggtgaagccgatgccgaaacaaaagctgaagccattccttggcaatttgcctttgtacaaatgaaacttattcatgaatgatatctgtctgattgcttattatacttttttggtgaattttaaatatttggacaaaaaaatgaattgaaaatgaatttcaaatatattaaaaaactgttgtgact

SEQ ID NO: 6030 - DNA, 3155 bp, Heterodera glycines
agtcacaacaaaaacacaaaatgatggctaagtaaagaaaagtacattaaacaaaaataacttttttcttttaataaatgtctataatttccccgtcattaaattttttaataattttatcataatttattttaataatttattttatttaataatgttttaatactaccaaaatcaataaaaacagtaaaaaattgattttttttaaatctatttaaaaaaataaaaaaactgtgaataatttattcatagcagaatgataatcattttataaaaaattattatccataaaatactcccgaataaatgaatttgtagcttttgatatttataatattttttattttttataaaattgaatccggcaaaatccgaccaaattttgatgaaatatttggcaacgggtggaacacaaatgaaaatgaagaaaagctgataaaaattgaacaaaatgaaaactcagaagttgatcaaatgggtggagcaaatgggaaactagccaaatgatcaacagaaaaagaaacaattttaaaatttgatgcaattaaagataagttaaaagaaaaggggaaaaatcaatggaaaaacaattcaaaaattgagatgaaaactgtaaaattattaggcataagtcgcgacaaaatatacaaatggaaaaaagaaatgaatttaaataaaaagaaaattatgaaaaagagtttttatgaaacgaaaaaaaaagaatttattgaaagatttgatgaatttaaaagtttataaggataaagcaaacagaaagaatttgtgaaggaattgggcatttctgaattgacatttcgaaaatggaaaaaggaattgatggcaaattagcataaaagtaagagaattttagttttacttaaatttttatttccaagcatataattcttattccaatgaggataaattgcaaaggatgaagcaatacttgaaaatgaaagaagaaaatccaaaaattagtgacgaaacaattactaagaaattgggaattggaagaacatcactgattagatgacaaaaaattttaaattaatatttactctgtgatgttttgatcaaaagagcattgttattgttatggccttgaataaaactcatttcttaaaaaaaaactcattcgaaaaattatagagactaaatttcatttatttcttatttcatttgaaaaacataacacatatttaataaatcgcttttaataaatgttaaacccaccaaattaatataaaaaagggagtaaaaaattgattcagtaaaatgtaaatattctgaatgatttctttatatatatgattaccattttataaaaacatttttttattcaaaaatatttacgaatcaaaaatgtagagctttaatattatggaatttaataattatattaaccaaaattatagagaaaatggacaacaaaaaagaaaaataattcaaaaatttgaagcaattaaagaaaagtcgaaacaaaaaagaaaatttcaatggaaaaacagaggtaaaattgagagaaaaattggacaattattaggcacaaatcgcgacaaaatacaaaaatggaaaaaagaaatgaatttaaataaaagaaaaattatgaaaaagagtttttatgaggagaaaaagattgaattcattgaacgaattggtgaaaagacagaaagaatttgtgaaggaattggtcatttccaaagacacatttataaaatggaaaaaagaattggtgccaaaatattgtaaaagtaagagaactttcactaaatattttatctaaattaatttaagtgagacttttagcaattccttaaattgtgtcgagttaatgatttttatgctagggatgggatattatgagtaagaagataaaattttcatatccgtagctgtagctagtttcataaatatttccgaattgcaaaaatgaatttgtggcatttaatatttataatattttttcatatttttaatagtgaaaccggcaaaatccaaccaaatttcgatgaaatattactgcgaacgatgggacaaaaatgaaagagaagcagaaatgagaaaaattgaacaaaatgaaaactcaggggccttatgctcgtctcgcggtttagagctaaaccacggttaacggcgttaaccgtggttaaaaatccttaaccggtatgctcgtccttccctttttaaccgtggttaaggctaaaacacggttgagttaaccatggtttactccatccttaaccacggttacgcaaattaaccgttgtttatttccaatcgatatgctcatctaaccgtggtttcgtaaattatttagtaatttaattgtaaaataaataaataagttttttctaggataatttacatgcagaatagaatctgacatttttgtataatatacaaattattacggaattaaaattaacgaaataaatgaaattgaaatggaataatatatccaaaaatcaatgaacattgatattttaaagatccccaatattgtatcccaagtgatggcgcatttctcgatccttttccagcttcaaaagctctatttcaagcttatgcttctcaattgccaaatccagtttggcactttctttcaaacactttaatctgtaaatcgcgtgcagttttgttgatgattatgttggaaatatttccacaattttctttttttggcagacatgtaatcagcagcagcagaagcagtagaaaagtttcgtattttgctactgatcacgccgcccgagtgatgacgaatcggtgtcaagtctgtaaatgatggcggaacagcagaagaagttgttgcagtagcagaataagtctccgatctagagcaaaagcttgagtcgagaattgcagtagatgatttggggcgttcccctatggccaattaataaattagaaaaatggcaatattgagatagttcaatggggttttcgccaatgatgccaataattcgcgtgtcctccgccataaattgatcaaaaatatcaaaaaaaggcttccgctcagtcggtctcccactaccagttggtggcatttttgtttcagcaatgaagtttttgtactgcttcagcatgtttctgtagcgttgcttaatttgctcctgatcacgcactgatcgagcgtcctaaatttatccatagaa

SEQ ID NO: 6031 - DNA, 5672 bp, Heterodera glycines
ggatttaaactgatcgacaaagtcaacatgaatgtttttgaattctccccgatggaaacacatgcaaattcggcacatataatctatcgagtcacacttctgcctcaatcatccacacttgtcgaattgtcaatggccaatggacaagaagacaaagaagtcactgtaataggaagaaatgatttggatgagcaactaagaattgagcctactttaacatcttgcaaaaacggacaaatcgctgtgccgatcacaaacttttcgtcaattccaattacactggaagcgaatgaaagtgtcgcattggtcgagcatgtcgatgaatggcacgaattggaacattcgtttttccctccgttcttcgtcagcagcgtcacacatgaaaatgaaaacatacgcactgaacaaatcaaagaaatcttacgaactcgtattggccgtattggcatgtctcagcaacacgaagcggacaaattggaacgtttaataattggtttcgaacaaatttttgcactcgatgacagcgaactgacacaaactgaaataactcagcatttcattaacaccggcgatgcctcaccaattcgaggccggatgcgtccactgccatttgcacatcgtaaaaaagtttcgtcaatgctccaggactatttaagcagaggattaattcgaccatcaaaatcgccatgggcaagtcccattgtccttgtgccgaaacgtgatggaagcttaagattttgtgttgattatcgagggattaattcggtcacagtgaaagacgcatacccgttgccgaacattgattacatccttctcgcactaggaggaaagaaatacttctcgactctcgacttcctttcgggctactggcaaatcagaatggacgaaaagtccgttgaaaagactgcgtttgttactgaattcgggttgcacgagtttaccgttcttccattcgggctttgtaatgccgttgcgacttaccaacggttcatgtctcggctttttgaggatctgattaatgactttgttttcgtctacattgatgatattttggttgcatcagagtcgtttgaacagcatttggaacatttagaaattgtgttcgagcggataaaagattccgagctgaaattgaaaattgaaaaatgtcgtttttctgcctccgaattgccatttctgggacatgtgttaactcgccgtggtttgaaaatgaatgccgataaagtaaggcctgtcattgaactgcctttaccgtcgaccaaaaagcaattgcattcatttctcgggttcatgacgtattatcggaaattcatctatggctttggagagattgctgcacctctgtttcacctcctaaaaaagaacacaccatttgttttgggagagaaggaaatattggtagtcgagaaattgaaagaaaaacttcttgaagatgcggttctctatttcccggacttcaaaagcgcaatgaatgatgctgaacgatgtttcatcatcctcaccgacgcgagtaaaattgggatttccgcagttttgtgccaagctgacgagaacagacgagtccgtccaatttacttcgcatcacgtcaatgcagtagacacgaaagtaattattgcccaacggagctggaagctcttgcggttcgatttggtgcctggaaattcgcacaatttattaccggaattccgaccaaaataatcaccgatcataaagcgcttccgccaatgtttcggagtaagaaacaaacaggaaactctcgagttgaccgctggttaatggaattgaacgcacgattcactctaactgtcgagtacagtcctgggaaatccaacattgttgctgatgttttatcacggtccggtgctttaataagtgaagtcactgagaattttgacatggattcagcttttgtctgtaaattaaaagagaatgaaggcgaaaaaaatctggaagtggatgagatcggagaaaaagagagaatcgattgggtcgaagcgacaaaggtcagcgaattcagcgaaatatacaacttcttgcaaaaacgaattttgccagacgaaatccggaagaaacaaaaaattttggatacttttcataaattttccataatggatggattgctgtattttataccatcgaaacctgaaggaccaaaacttttcgtccccagcaaattcaggcaaacttttattgatcagcgtcattcgggaatttgttcgggccatttcagtggaaaaaaactttttcgtcaattgtcggaaaagtacttttggccaaatatgttcggcgactgcgttaaaacctgtctgagttgtagaatttgtgcacacagcagaaaaccccgatcaaatgaaccgccactccggataatccagacgtccgaaccgttggaacttgtctgtgtcgatattttatcgatcggaatgtccgaaaacggtaatcggtatgtgcttgtctcaatcgatcacttcacaaaatacatcgtcgcaaccccaatcccggacaaaagcaaagacacagtctcaaaagcatttgtaaaagattttgtgttgctgttcggggcaccaaaaagattccatagtgaccaaggaaaggaattcgtcaacgaaactctaaaagaaattttcgccattctaggcgtcgaaaagaccacaactgctgggtacgacccacaagcaaatggagctgcggaacgggcaaatcaaactttgcttaatatgcttaaaaagtctacgtcctcgcactggagttgggatgaacgacttcctttcgttgtgttctcgtacaacactacaccgtctgaagtcactggattttcgccatttcaactgatgttcggaaaaattgcaaattttccaggggaaatagactttaaaaagtatggaaacccgttctacaccgtggacgaggaaacatatttacaagcatttaaagaacatttgcagttaattctcgaatatgcgcgtaaaaatgccgaaatttcacggacggaaacaaaaaaccggtacgattctcgcccaaatgtgaccgcaaacaaatttgcgattggcgacaaatgcatggtcatttatcccggatcgaaatcccgaatacagcacaaaaaactgcattggaatcagttcgggccgtacaaaattgttaaaatgttcgaatcatccgcagacgttgtcccagttgataaaagttcagctgaaccgattaccgtcccaatagaacgtctcgtccgtgtaccagtcggagttcccgacatatcaacgctcccacacggaaaaaacccataccggaacattttggctactattttgcttgcaaatttagaaataatatacccaaaaagagaacaagtaaacgaaactccggtgtcgagtgaggaatgccaaaaaaggggaatcacagaaaactcagcagaaaatttcgatcaaaatcagttagggacaactgacattttaggtgggcggaagatgcagcaggacgaaagcgccgagcttatttggaccatgaaatgcgaaggcgaaagccacgaattctgtggaaaacttctgtgcgcggagttggacccggttttggacgcaaaaacggagcccggaaacgtggaaattggcactcctctgcaggccattttgtgccttttcatcctccgttccggtgccacagtctcttccgcggcggcaaaaagccttgttcatcttatacttggctctgaacccgggatggagttggtcgtttatgaaggagtccgaaaagacaacattcgtgccggtgcccttccacgagaagaagacgtagagaaaatttggtcaatgtggtgtgaaaagtgcgcggtgaccaaaaagcttctccaatcgtcaggatttgagaagattcgagtgcaaaattccgacggagagcccaaagaaaagcccgaaactattcaggtcgaaatgccggaagcggtgcccaaattgcccgaatcagagcgtgacggttggagcacattgttcgaacagaccgggtggattctggaaaaagtccgttccatggccattcatcgttgccgcacattggttgagactccacgagttctgatcggtgactcgacggctttccaactcctctccgaaatgcgggcacaaacgcaattcattggcaccgaacgagggctgttaactgaagtaatccgtccactcagcgagtgcgtcttctcaagcaaagtgcgcgccgcaatgatcatcctcggtcgtgattcgctggtcaaagacgagaccgttgatcagatcatggaacagtgccaacggatccaacaactgtgttcccgttttccgtctgtttcgttcatttggttgcctccaccgtacgttcgtcagtacgatttggcctatcacgaaatgatcggccgtctttctgaactgctcggcgattggtttgttttcgtgactccgtttggtaggagtttgattgaaatctggcgttatggcgattcctttgatcggagtcgtgtcaatgcagatggatggatgactgaaaatggcattaaagcattgtcggcgtggatcagcacacaaattccgaaatggccaaacaacagacaacttgggattcgaacggtccgctccagcgtttcggtcactaggagagtctatgggttgggtctatgcgaccgcccggagactgcggcttcttcttcggctcgtggggggttgggtctatgcgaccgccgcccgaattctcgttctcgatcgccgtttagacgccgcgacaaccgccaatcgcaaccattcgttcgaggaggacaccgccgagatgatgtgacgcgcgaccgccggcactagcttgctcagaccaccaccgatcggatgccgaatcaacttatcggcagggacgccttttctttggggggttgtgatgtgttaaatgggaaataatttggcttttctataatatttttcttctctaattatgtgccgtttcccttgcctctgactgccttttattcttttaattcaattctctaattatatgttattttccttttgtttttctctctaatttattcctatttttctcaatcgatattcctttgcttttcttctcccttgtgctttcctttattcattctatttggtgttcacaaatttggacctcagacttttctcctctaaatattttgtgtgtggactcttaattttcgtcgtcttcgcattgaatttaaattaaataaattgaactgtccccgactatttcgccgtccttaattaataagcattggccccgtttgtcctttctgtgctaattaattatttgacccgagaagaggaaaagccgaacgaagcaaagcaaaagagacgagcccctccgaccaattggactccaatttttgcacgagtatcggcgtaattattctgagaatgcggttggaattcctattactgttgagcagaaaaagagataaccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgccgagaaacaaattccagaacaattagtatcggcgtaattattcagagaatgcagttggaattcctattactgttgagcagaaaaa

SEQ ID NO: 6032 - DNA, 5397 bp, Heterodera glycines
  misc_feature (2368)..(2368): n is a, c, g, or t
  misc_feature (2388)..(2388): n is a, c, g, or t
atttttccaattaaaagaatggtctattgtgagcctgttgatatatttcaaggtgaagtgtatttgctcgctactcttatcgtggttatttttactttggctacaactgtaatttatattatcatggctattatgctaaagggtaaatttaattacacaattaaaaatatattactatataaaatttaaatgacggtattacaattggttaaaataatgcctttttattgctcagtgatcagaacaacagcaggaattcttcccagtcccaaattgaaattactcgtcgcattttcaaatctttggctgtgatcatgccagtgatcttctgtctttggtttttatccgctctaaccaacaactttgttgtgccgcgaatattcactaatgatcagtcactgcaatttttgatcatacgattagtggcacaattggtcacaattgcctgagcgattaacctacctaatcataatccaccagtcgttgttgtatctgacgggtcacaaattctccattcttcgaacaatcaaatgcaaaacaactgaaaatgtaaaaataattcttttttgaatatgttttactgttggcttaatgaatgcacaatttttactctctataaaagtgtcaattgcaccattttacattgaaaaagagctccgccgaacgaccaattctaactcaaaaattgaattagtcactaaaatattataaaaaaatttcgctcatgtataaaagtcagggtcaaatgctctaaaaaacaagaatttttctgtccattagccatgttaatttgttcaacaactaaaaaattatgttctaaaaaaagttagacgctttggccagctactttttattcgctcaagcaatcaaaattcaactcccttaaagtaaattattttgaatctctctagacataatacgatttttcgggtatttgggtcggaatccggcgagggaaaggaaattgattcggataagtggtcacaactttttttaagcggcaacacaaagtcaattttggtttataactttattttctgtataaagtattctgtataaaaattccaatacaattcttgtgttttcatgtctcgtattttgtttttattttggcaacatcactgaattgtagatatggtgctaggtcgaacctaaaaaagtattaatgatagtaatactcaaacttagatatttggcactttttctttaaatatttccaaggcccaaaaggcccggggaagggactgggccgagtccataattaggcttttcaattacggaaatccacaaccaattacgggagtcgaaatttggcggatttaagcaacggcccaacacggatagaaatgtgactcacaccagaagtttttttttgaaaaatttctttttcctaaaaaataaaacctttattattttttatctttttcctaaaaaataaaacacttattatttgcacaaaaataatcacgcaattttaaaagttgccttttgtcttgtcgacaagaaaatccgctacttttttatattcatccacttttttgtgcttgaatcatttttgaagtcagacaatttctctatttctctgccatatatggtttcatataatattgctttcacaattctatttaattgcgtgagaattttttaatcgtacataacaaaagttaattatcaagcaattaaaaaatttgtactcagagaaccatacactttaaaaccccatgaatcgaatgaattgcatcattaggaagcgatgcacatcagaaatttgacccaattaaatattttattaggctttttaagtactttaattaacatcaaattgctaacattagagcacgactgtaacgaatgtaattcaatttttttttttttgattttggtttattaaagtctaatgtgaacaacaaaaagttaggaggcataacaggcgaattatttcgaggggcaagtttcattttctttttatatttaaataaaattcaataatgaaatttcctgaggatatcctgatcccagattgaattagattttcatgcgtataatatttttaagtcccattaaattaccatctaattttttaatgaaataataaatcgactaatggataacaacagtaattcatcaccatcttctgttaatgagtttggagagtccgaccaaatttacgtgtacaccgtttgggtgacaatcattcaacaaattttgtcactttttggcattgccctaaacagtgccatcgtttacatcaccatcaagcacaagtaaagaatagatgcgattgggtaatagttttcaattatctttctttttaatttccacccccccccccctccgcccacttttcgtacaatttttcctcctcccncaaatttaaacaaacacaanctgcggccgctgtgcagtggttcatccgatttatctcagctgcttgtcatttcccattagccgccgataaaatgcaaaaatatggaaaaggcgttaattagaatttaaaaaatggtacaattactggctgattaaataaatttggatatcacttgtccaattcgtcattttgtccattgtgttttgtctgcatgtttttctccgcctgcttcttcttcccttctctatttaagtatttcctggtttcgtatgccgtttttactcgtctctccccttttggcattttgtccatttcggcattttgtgtgttttgtctgtatgtctattttttgcctcctgcttttcctctcccttttatcccctttagctgcttcttcttgactttttcctctctccccttttggcattttcctcccctctctcccccaaaatgcccttcccttttcggcattgcttttcctccctcctcctccatctaccgttgtttctgctactgttccatactattgctcttcatcgatgttcttcgatgactccgtttcccttctccgctccgtccgtcgccgtctgtcccatcactttccatgcccaggcaatttccactcgccaactctcttccgtcgaatttttcctcacaaagtcagtgggtggtgctttcatttattgggcgctacccgaaataaagccggctgctaatcactgatatgaaactcggctacccgacttttggggatttgcaacttggggacccgacatttggggacccgacttttggggatccgacacttagggatcccgacatttggggatcccgacattaggggacccgacttttggggatccgacatttggggatcccgacatttggggacccgacatttgggcaccgaacgacatttgagcaaaagacacttaagaaaaccacggacatttggcaacccgacatttagggacccgacatttggggatttcaataaaacaaaaaaaatttaaaaatttaattctaagccacaaaattagacaaaattacgtctgcttttagccagagttaattccattgcaaaaaaattaattaatattttaaaaattaactctgtttccggactcaccgcgaggaggcgcagaattttgagcccatactaaccacaacacaatagacaaaccacaatacattttttaactacagtagacctttttccaatttttatttaaagtgcctttcccaagggccaacgggaacagaaatccgtcaaggacattcaaaaagttccagccgactttgctgtctaattgcgtacagcaacaaaatgccgaggtcatcttttcggtttcttatatttcgagtgactttgttcggtgctttaaatgaattttttaacgaattaattttttgtggctgacctgcaaaacaaatctcttccactggtcgccctatttcggtatttatttttccaaaaatatatccagggttgtagtcatcaacattcacactgaattcataagaattcagagtgagcacaaatgggaaaaagtcctttaagatctgtttctcttcgcaagctaaaataattatatcttttcaaaaaataaagatttttaaccttttatttctactattaatttttaacgtatatttattaaacatttagccgccaaaaatgcatatacaactatttttggagaaaacctacaaattcgtttttgcttgttccacttaggacaggcaattaatcgtagattgaagaccgggaaacttagccactattacacaacaaataatgaatacaaaatcttggttcggagtttggctgcgctctcttttctggaggaaattcgagttgtgccagctttttacttgcttcgacacgagcgaatgagctcggcatacaagttgttccaaatgcaggacaaccagtcgcaatattcaattactttggacggtattgttaaaataaattggattgtttattcattatatccaagaaactatgtgcgtggtcacgatggaagacctccactgtttcctgttcatacctggaatcaccatgatagtgttcttcaggacttggggcgcacaaataacgcccaagaagggttccatttggctttaagaatgcaatttaacagtgtgcatccgccattatcgaagtgaaaatcgcgtttaatcagcttaatattttaattatcagagttatcactgttctgaaagaagagcgaatcgcagccgataagctgcggcagtatgagttggacccaactcaagggataagaattcgagaacggaagaaaacataccgtgaaaatgatttggctatcagaaatttggttgaaggctttgatgccattgagaacccaaacgaagatgagattcttgctcatctcagatcgttgcaatacagacttatgcgcaatgattttgagaattgggacgaccaaaatggtgattaattctgttttcacatcccgttggcccttgggaaaggcactttaaataaaaattggaaaaaggtctactgtagttaaaaaatgtattgtggtttgtctattgtgttgtggttagtatgggctcaaaattctgcgcctcctcgcggtgagtccggaaacagagttaatttttaaaatattaattaatttttttgcaatggaattaactctggctaaaagcagatgtaattttgtctaattttgtggcttagaattaaatttttaaatttttttttgttttattgaaatccccaaatgtcgggtccctaaatgtcgggttgccaaatgtccgtggttttcttaagtgtcttttgctcaaatgtcgttcggtccccaaatgtcgggtccccaaatgtcgggatccccaaatgtcggatccccaaaagtcgggtccacaaatgtcgggatccccaaatgtcgggatccccaaatgtcggatccccaaaagtcgggtccccaaaaaaattatcaaaaatttttagttacctagcctggtccggaaaaattctagaaaatttgaaaaaa

SEQ ID NO: 6033 - DNA, 2332 bp, Heterodera glycines
cccaaagtcgcaccacgatgaaactcattcttatttcccatttgatttttagaattctttaaaaaaagttttctgtacagtttacctgtaaagaaaatacagccatttgcttttgattcaattctattcttttatttaattattgagatgggatcgggatgggtccaataagtggaaaagatttgatgggatcagacggatcaaataggaaaaattttattaggatagcggtggtacgaccccttcagttgcaattggtaaaccccttatcgagtctttgtcggtgttggtcgggtaaatctgatcgggattggatttgtcaggctcccgaagatgttcccggcgcatttggtccgatttggctaataaatccattaattgagttagtttatttttaacagtccgtcggtgccgtccgcttccgtttgtgccctccaatgtgcccacaacacattgtgccaatcggccgtgttcaaccacgacacgcgcacctgcgcactttcccagcaaaattggcacaaccattgcaagggcagcaaagagcgcttcaaaaccttccatttgtccgcggacggagtcggtgttttgtccggcccaatttgtggcgatgctcgagagttttggcggttgcactttttaatcactttcgactctcgatttaattctggcttctcgggcatcgcttttccgagttcttcccatccctaacaaaaacaaatgcacaggcagacgccctctcattgatcacttgcattgagcagtgcggagcgatcggtggcacgcgggcaaatgaaaaagttggggaaaggaaatccgggagggggggggggaaggaagtgggagggggcgcaccccaaaatgtcgccggaagattccaaatctaaaaaatttctttaaattaaaaaaaaattatggcgccgaaggaactcaaaaacccagcttttcgaatttttgccatgatttcaaaatttgcagattaatagagtttttcaagtctttcgaacataccaagaatttttaattttttgaaaaaaaagttacagtccaaaaattcttccggacattttgtcctgctaccggctgggggggggggggaggttggtccaaaccccaaagcccaagcccatcaatgggcttgtattaatttccatgacaccccaatccaaatccatcgacttcgctgaaaggaatttcaaaaagccttttcctctgatcattccaatccgatcactaaccttcaaaggaaggcaatgacattgcgcatttgttgaacattcttcgcgcccgcggtgccatcgacggcggactccgttacgcgcccaccaatggcatgatcagtgccatggcagctgatcaaatttcttctcaaatgcgctccattgagccggttggcatttaagcagattggcacacaatgccaagccaattaaacaccttttgccaaataaaggaaaaagtgccgacattgagcgggaaaacaaggcaattggctgatcagcaacaatttccattgccagagtttctctcgctgcacgatggacggcaccttctcgataaagcacaacggcaggtaaaattgatcagagacaactttcattgatgttaataccaatgctgaatatgatgaagattagcaaaggttagccccaaacggattttggtcccattgtgtttgatcctttcctaaacccattttcggcattttaaagttccgccacttcaatctcggtttagtttttgccggacggaggaggaggaaaattgtcggaggcgaataaaagtgctggcgatcagaaggacggctttttgggtgccgtccgacaattgcatcaaatgcagcaaaagctggaaatgcttctgatgaatgcggtgaacagagaggagaaagtgatgccacaacgaactgtccaatggaaggccaatggcatcggagttcaagccgaaaatggggacggaaaggtggagaagcttaaaatgttaggtggggccgattaatcggcttaatcgtttcgcaatagagcatctaattaactaatcacttaattagtggcattgaaaacccaataattgcttagggcaacagccctacagtaccgtcaaagccaatttcacaattgtcttcgtcaattgcttcttcctccgttcttttgccgtcctccaattattcagtccatggcaataatccctcgggggaaaatgagctcataaacaatggcagcgattatcgggaacagcaaaatgacaccaatttcatcaaattgttaaagccgggtagggaaaaaaattggggggggggggcaaaaaagagacaattagctgaagctgatcaatc

SEQ ID NO: 6034 - DNA, 5325 bp, Heterodera glycines
  misc_feature (119)..(119): n is a, c, g, or t
aaattacttagtgacgaaaatgtagtgtcgaaattacttagtgtcgaaaatactcagtgtcgaatttacccagtgtcgaaattacatagcgccttgtcaaaatgatgatatatgtgttntaaattaaatataaaataaaatagttaattttgaatttttcgacctttttagaattaatttttgtgacttttaaattttttaaaaaagagtggttttacatccatttttccatatttcgagatcagcatgtaactatgttcaccatatccatattcaaatattcatatacttggtacctatcataaatttgaataaaattgcttacacctacaaataaaattgaagcgaatggcgctaattcaaacatattttgattaccaaactgatcaaatttgatcaaacaaaatttagctttttcaaattgaaacaatatacatatatttggtcaaatattttaattttattgaataagaaagagaaggatatagagtgtgatatatttagttccaaatatacgttcacgaatttttaatacttaatctgcttcctgtggaccaatcgagttgaattttttgcaaaactcgaatttgaacaaaaactaaaaatccgaatttcagaaaagttcacttcacatgtatgcaacaaacccaattcaatccatgaaatgacaaaaaatatataacaaaaggcttccgataaacagtatttctacctggattcctcggttttgtttttgaccaatttacctgcttcgaatcgccaaaaattcccagtttcaattaaccctattttcgggtcaaaaatgagggcggttcctacattaaatgttttttttttactaaatacataactaagcgcgtaagcttcggcctaagcccaagcagtctaagtcttagtgcctaagcctaggcttaagcctaaagattaggcttattctaagcctgtgtggactgccgattatacgaagtgccaattgtcgaactgccataacactcatgttcttcgccttccccccactttcttatgcccataatcatagctaaaagttgggttttttctgattagtttcaaagcaatgggaaccaagcgcaattataacaacaacataaagtattggtgcaaaaatctgtgggatctcggcaaacgaacttcgcaaggcttggcaaactccgtcagcatgccgaacaacaatttgctgcaaactctgcgacctcggcgctcaaacgtcgcaaggcttggctttctccatcggcatgccgaactcttcatcatttttcagacttggcattgctttttcatgccggtaaaatgccgttttagtcgataattcatcaaaataattcccaattttccatttacaaattagcctgttgctgtgttcctccgcggctatcttcgagatgggaaattatgctcaatgcatatcagggatgtgccgagccagacaaaatccgattccgattatggcccaaaatccgattaattgcgattccgatttttttttaataattttttcccaaaaattttattcataatcaaaatcataaattttaagattgtgatgcaaaaataaaagtttctacacattctcaggcaataaacgttttctcagatctgtcacaatcaacccagcggtggagaatattcccagatatttgacatttttgctaaataacaaaaaacttgattatatcggggagaattaatccggcactgctttgtgagaaagatttaatttcagtcattatgttaaaataagattaaaacattcgtttcagaaaacattttttttcaaaattcattggtattctcactaaaaaaattccttcaaaaggtcaattcttaggggtgtaataattagggctgggatttttatgtgctaaaaatcctgaaatatgtaataaaatatgtgctaaaaaaacccaaaatatgtgctaaaaaccaaaaaaaggcctaaatatgtgttaaaaaatgcaaaaatatgtgctaaaaattggaaaaaccaatggtatttttgcataaaaattccaaaaaactcattctttatcatttttgcccgcacaattgcaaataaaaaacatttggaggtgtttgggggtaaaattagtccttttttgataaattgtttttaaagataatttttccatcagttgagtaagtgccagcaagaaacttcgatatccagtaacgaattaatgaagaattcgattttcggtacacgaaataaataaagaaaattttgaaagagcctataaaaatggcaagaaagttgatttttaggggtgcatttttgaattttttgtgtttttcttagatatttttttcaaaaatgccaaaatatgtgcaaaatatgtgccaaaccccgaaatatgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctagtaataatcggatttcaaggcaaaatccgattacgattatccgattccgattatggcccaaaatccgattaattgcgattccgattcggcacatccctgatgcatatcatttacagcatcattttgtggtgggaggcggcggggaggggtgccaaaaaatcgcattagtacatttgtatccgtttttttttgtccaatttttcaaagattgaaaatatctgacgcatattttctttcataaacgccttctggactggtcagctgaggacaactcacaatcagcttttttttatttttcaaaataatattttaatttataatacattttttaaactgacaaaatccgtatttttaataattttaattaaaataaatcttataaaattaaaattaataaaataattagtagaaaaattctgataacgaaagacaagtgttaaatataaaaaataatagtttattataattaaaattaaaccaaatattttggtttatattatttagttaaatttaattattttttaattttataattattttgtaaattgtcgtaaagctgatcgatcgttcattaagtcttagtttggtggtatgaattagatttttgggcaacattagctccctcccctttaaattagaaccccacccccctaaaataaagcacctattcgatgggggttgaaaaataaagcccccgggggctcttattttaggaaatacggtaattcaattttggtattatgcaaattttgtccccatttgcacagctttttcctctgggtgcctggtgttgtacacgcattttggtactgcttcagcggcatgttcaagagaacggccccaatgtgatctgaaaaagcggagttttcattttgggtttcgttccagtttcatcccagcagacacttggttggccgtgttcgaattgcttacgccggcgcaaaacggactcgaaattgcacttatcagtccccgatttgagtgccgtgtgaacgaacacttcaaaacccgcaaatgggcattgggacaaatgaaaattcgaagcaaaattggaaaaaatggcgtgaaagaaatggaaattgtcaattccaatcaaaaatcgctgccaataccgaaaataccgctgccaaataaagtcatcggattcaacagcattgcaatcgagtggaaattgaactgaccaatgcattgtgatcgtgttccttctttttcagttatgtcgaccaaaatgtcatcgcttttctccgccgttttcatccactgttggcccatttgaacattaatttgtccattgcggcaatggatggcagcatttcattgtggtttttgcgcacccattggccaatgcttcaagataacattggcggcctgtcttttgccaactttggcattggccgcttccgccttatgcatgaacacattttcgttgatttgcctattgacgaacgcccatccttcgccaattgtccatcgcttcgcgttgtccaagtcccctttgggcaccacttcttccccgactttccgcccgataacagttcctccgcaaatgatggacaatcactggcgcactggcttttgtcgcctcggccggacaattcgccaaaattgtcgtctgtgctgatctatctgaatatggaagacaaaaaatagaaatgcttaaaacggtgttaataattttatgcaatatagtcagttttttgtaataatttatgttatttggttttagcatttcgaaaatgccacttctgctgtcaattatgttattgtatttactttggcccttggcgtcactgtggccccttttgaattgtttaacaaacgtaccggggaaaaaatgttcctttcaagagtcaaaaaatcgcgcatgaagcacggttctgctcgtcaaatgttgttggtccgctgcccgattaaccgcgatttgaatgaatgggtgtgatgtgaaaaggaggcgattgactggcaaatttgtgaccaataaaacaaaatttttgatttaatttaccgtatatataatttaccctttgttgatttttggtcataaataggtaaataaatcttttatttaattcaaataaaattcaaataccgtacttgctcgattattgcccccgggggctctattgttcaacccccctccgaaagggggctttattcgagaggggggatctaatcgaggggggggctttatagttcaaccctttttttacaaaaatctgacaaaaaattgtgtttttttggtaaaatttttgccaaaataccaaaatttttcagtggtattaggtaattaaaaatgttttttttttcattttcggcaaactaattttgtgcaattttttagaaatatctactaaattttcatttaaaattctaccaatacctaattgtcagggatggtatatctgaggctttagcctcattttgtggtttttttaataggtcaatgaggctaaattttcaaaatgaggctttgaggctttttgtggttttttgagaaaaacctaaaaataaagaattttttaatgaaaatatgctaaaaatatggtcaaaattcttaattttttccccggcggcgcctatcggcaccgccggaccgtaaaatctctgaatttacaagcaaaatttgcttaaaatcgcaaaatttggtcatttttcggacaaaatctgttaacaaatcgcattgaaaattacaaaaatttttcccggccgtgcatattggcaccgccagccccccttgttccccaaaagttttttggaaaaagcgccgcaaaaaaatcaacttcgtttttca

SEQ ID NO: 6035 - DNA, 1615 bp, Heterodera glycines
caaaaaataaagaaatttacccagattcttttatattgtgtcaaacccgtaaaattagactttttgacaaaatctgtttacaaattgcactcaaattttcagaatttctccggcgggcgccgggggggggggtgaactatagtgaacgccccgtgaaaaaaagggtgatataccaatcgattcgtctcgagtagctacgcacggaaaaatatgtctcgagttgcgaaatgccaaaaaaccgggttttgaaccggtttaaaactcgaaaaattgagtgaaaacttgagcctcgatatggactaaaaacccctaattattttttaagaattccaaatctccacaaccagatagctaatctaggtagcgaagctcaagaagcacgaagcgctttatcccattcccagagccgacggttcacgcacccgctagtttatatataactaaagaaacaaggcaactcatttccaaaaacaaaatctcctacggggcgggacgtagggaggagttcgaaatttcgaccttggggacaactttttgaggcgcatctgggaaactatagattttcgatccgagggccaactgagcgccaggcgccgaaaagtgactttttaattttgcttcttcaccgacctcgtagggcctaccagtttttctgaaaaactggctaaaaatggcctacttttttgggccatttcagcgccggcggaataactcgccggggtttgattggaggaggtcggtgtaagcggcttttttgtagagcttgacgagctctatccaaccatgttttcggatttagaaaatttcagaaattttcgagctaggccccctcgaaaattttccgtttttgaattttattattttttgcagatttttccgggcaaaacgaagaccactttcaagcaaccgtttttcatgctctatcgattggtgtcattttcagaaaaaattttcaaaaattttttggaaatagaaaatttttggttgctaggcctcaatttcagttctggcgcaataactcgtcaggagttgattttatcaaaaaatcgtataagagctttttagtagagaattttaagcgcaatgtaatgtgctttatctcatgtttttaacatgagtttaaaaaaagttataaaattaattgtgattttgaaactcaaatccatagggggcgaccccacggttttgcatttcaggaaaaatagtttttctcctcaactacctacctccataaaaatttcatggccccgacaatggaaagcacttttatatggtagttttaagcgctgatcaagaatctgacgtcaaaactgcaaaaatctatgattttctcaatgattcctttgccgcgacatgacattttcatggggggtagcaaaacttacaagtacccgacaacgaaccggcctttgccgcagggaatttactacctcaatgacaatgacgacaaaatgatgacggattcgcgattcatttcctttaccatttattgcctcaccaaatatttcggattcccccacatcaattgttgtattcttcagcattttgctctcttgcccttattgtccttttgtgtgtccaattgttgttgaattctttttttttaaatctaact

SEQ ID NO: 6036 - DNA, 4014 bp, Heterodera glycines
  misc_feature (4000)..(4000): n is a, c, g, or t
cccttatttaaggccttagtttggactttttcgcgcttaaaaatccgttccctagtcatcattttgcaaaatattctcctctgttgcggttccctttttcttccaatccgtcgtcattttatgccaaaatgtttccgcgccttccgtttttgtcaatgggttttcgcctcccattggcaacaatttaagacgaacaaaattcaaaaattttttggataaaatgtggttttctgtttctttcatccaaagtacaatccgtaaaaaataggaaaccctaaaaatccaggctttatccaacgcaattaattcttctgctatttgtgtgacatcattcggaactcggccaaaattgtgctaattgccacaaaaatgaacagacggtaaaaggattttaaaagccaaacaaattagtcatttatttaactaacaataaactgttttcccacttcagttggatttgcaacgacgtttggatggacattttcccctcttttgaccgtcctcaactcggcctcaaaatggcacttctttcgccacgtttcaatgcgttggtggacaaacatttcgatggcaaaagcgaattgacaatttggagaacgatcgtaattcgtcgcaaggacaaaggaccagaaccgaaactgactgtatggttcgattacaaatttgtgccatttccattgcccgacgaccgtccgctgcccagcaaaatccgttttaaatgccttcggattaagtaattcaaaatcagatagctatgacaataaaagctttccttccattttcacagttacattgatcactccgtcatcgcttttcttcgttcaaatcaccaaatttttgagaaaagaggcaccaatttatatttgtcgattccatcatcacactctacgaatggccagcggatttgggatgtttttgttcgtgaaatttggccaattttttcgacaaacattcaccgtttgcgcattaccggtcgtgatcatttggacaatttgcttcgtcgcacttcgccaacaattctcaccgatctcaaccaattggcttcaatcgattcctatgatttgttgcccgctgcgattggtgatgattttgatgtgccaaattcaacaatttctgctggccaagcattgtccaaatggttgcacacgccgagaaaagatggacaacccaaacgattgcattgcaaagacattcaagaacaaacgaacttcgattggatcaacaatttcaaggaggtgtggtccggggggggggggggggagcttcaagttttttattttctgaaatcggaattccgaccccataaacgtcgtaagtcggaaatttttgaaaatttccgaattttatcaaaatttcggaaatccgaattctgtgccatccctgctggtttggctccacatttttggcaaatgactgattgttgttttccaatcaaattgtttagcattttctccgtgccaatgccatttcttccgtctgttaccaaattcatttttctgttcatgtgccgtcaatgcaagtgccatttgaattgcttaacgaatggacaaaggaaaagctgacattgaccaaagcaaatgaattggacaacagttggataatgaagcgttgtaaaattattggggagtccgcggcggttcagcagcagaagaaagatgataattgggacaacaattgtaacaatgtgttcttttggcttgttgctggcactaattgcattgggtgagcaattaaaaaaagcatttgatttttatccgaatttgaattgcgcttaatttttgccattgccgccaccggaagaagtggaagaagaagcgggacaaagcatcacaaaagggacgtcttctgctgacaatgagtgacggataaaagaacaaaatcaatgagcagacgcagaagaaatgaatattaattgaaaatgaccgagcataattcatcagtgatcaaatgtattttatgaagaaaatcctctcaatttcggtaaataaatcggacgcataaaaatggcaaaaaagtcactcttattgaattttcgttgcacttttttcaaaacattttttgatgagttaaggactggcggtgtcaaaacgccagttttaccaagaatgtttttaatttggtcgaccttaacaaaagttatgacatttttttgtcgaaaaacagtacgagttggagcagtacgagttggagcagtacgagttggagcagtacgagttggagcagtacgagttggagcagtacgagttggagcagtacgagttggagcagtacgagttggagcagtacgcgttggagcagtacgagttggagcagtacgagttggagcagtacgcgttggagcagtacgagttggagcagtacgcgttggagcagtacgcgttggagcagtacgagttggagcagtacgagttgggtgtcgtccgtttcaggcatcccactgtccaggaaaaaaaatatggatttccatataattcccagcccaagtcataacttttcaaggagaaattcatacattcgatagatagcaaaaatttttgtgttatgcgtgggttgttaaactctgtaaaatttatagccggagcatatagcctgtgttccgcaaatcccattcaatgatttttgaaaaaatcattgaatttcccagggaatttcggcaaatttcaaacaatcgtattgaaaatagggcttatatttttagggttttgccctatttttttcctgagcttccagtgcaatgaaacgcataaaaaacaagttgtttttttttgttgttcattattttgtgcaaatctaagttgttatgttttcgtacattttttgccatttttatgcgtccgatttatttaccgaaattgagaggtttttcttcataaaatgcacttgatcactgatgaattatgatcgtccggtcattttcaattaatattcacttcttctgcgtctgatcattgattttgttcttttgtccgtcactcatttgtcagcagaagacgtcccttttgtgatgctttgtcccgtttgttcttccacttcttccggtggcgtagacaatggcctaaattaagcgcaaaattcaaattcggataaaaatcaaatgctttttttaattgctcacccaatgcaattagtgtcactatcaagccaaaagtacacatagtgacaattgttgtcccaatttttatctttctgctgcttctcctctttctccccaataattttacaacgtttcattatccaatgatcatcatcggtaaagcgcaaacagcgaatgtttgtcgaaaaaattggccaaatttcacgaccaaaaatgtcccaaatccgctggccatccgtgctgtttgaataagtaatccacaaatgtaaatcgatgcctcttttatcaaaaatttggtgatttgaacgaagaaaagcgatgacgaagtgatcaatgtaactgtgaaaatggaaggaatgcttttattgccataaagctttgatttttaattactaaatctcaaggctcttaaagcgaattttgctgggcagcggacggtcgggcaatggaaattccacaaatttgttagatttgtcatccatccgcacagatagtttcgtttctggtcctttgtccttgcgacgaatttcgattggtctccaaattgtcaattcgcttttgccatcaaaatgtttgtccaccaacgcattgaaacgtggcgaaagaagtgccaatttgaggccgagttgggcatggtcaaaggatgggaaaatgtccatccaaacgtcattgcaaatccaactgaaatgggaaaacagtttagtgaaataaatgaagaatttgtgacttttcaaaaatgccttaccgtcggttcattttttggcaattagcacaattgggccgagaatgatgactagggaacggatttttaagcgcgaaaaagtccaaactaaggccttaaataaggtaaaaggttagaaattttctttgtcaaccaaatccaacatttgttggtagcaaaaatgngagaaacaagggaa

SEQ ID NO: 6037 - DNA, 3068 bp, Heterodera glycines
  misc_feature (5)..(5): n is a, c, g, or t
taaancaatttgattgggaaaaacaaaaatcacaaaaatgttgggccccacctccttgaaattgttgatccaatcgaagttcgtttgttctttaatgtctttgcaatgcaatcgcttgggttggccatcttttctcggtgtgtgcaaccatttggacaatgcttggccagcagaaattgtttcatttggcacattaaaacaatcaccaatcgcagcgggcaacaaagcaccggaatggattgaagtcaactgatcaagatcggtgagaattgtcggcgaagtgcgacgaagcaaattgtccaaatgatcaccaccggtaaagcgcaaacagcgaatgtttgtcgaaaaaattggccaaatttcacgaccaaaaatgtcccaaatccggtggccatccgtggtgtttgaataaggaatacacaaatgtaaatcgatgcctcttttgtcaaaaatttggtgatttgaacgaagaaaagcgatgacggagtgatcgatgtacctgaaaatgggatgaatgcttttattgtcataaagctttgatttttaattactcaatccgaaggcgcttaaaacggattttgctgggcaacagacggtcgggcaatggaaatggcacaaatttgtaatcgaaccatacaaacagcttcgtttctggtcctttgtccttgcgacgaatttcgattggtctccaaattgtcaattcgcttttgccatcgaaatgtttgtccaccaacgcatcgaaacgtggcgaaagaagtgccaatttgaggccgagttgaggacggtcaaaacaaggcaaaatgtccatccaaacgtcgttgcaaatccaactgaaattatggaaaacagtttattgttagtgaaataaatgaagaatttgtgacttttcaaatgccttaccgtcggttcattttttggcaattagcacaattgggccgagtccgaatgatgagacacaaatagcagaagaatgaattgcgttggataaagcctggatttttacggtttcctattttttacggattgtactttggatgaaagaagcacgaaaatcaattttatccaaaaaatttttgaattttgttcgtcttaaattgttgccaatgggaggcgaaaagccattgccaaaaacggaaggcgcggaaacattttggcataaaatgacgacggattggaagaaaaagggaaccgcaacagaggagaatattttgcaaaatgatgactagggaacggatttttaagcgcgaaaaagtccaaactaaggccttaaataagggcgaaaaaaccaaaatttggtcaatgaaaaaataaatttatgtggaaaattttttgaaaatttgcaaaaatgtgatctcgtcaagaaaaattttcgaataaatgcgtcaaagcgaagaatttccgagcgaaaaatgtgtttttcgtgcatttctcgtcgagttaaagccgcagaaaaataagcaaaaacttaaaaatccgatccctaatgatgacatttgccgggcgttttaccttatccccaaatcaatcaattcgatggataatttttatccaactttcatttgtaaaaggttagaaattttcttcgaaaagtaccgatattgttagatttggcttacgaagaaaaaagtgaatagttcaaagctccaaaacatgccaacggctgacggattccgatgcattcataagcagcgaaaacaaaacaaaataaacaaattagatttttcattttcaaaccaacaaaaaacaaatcgaatcaaaacgaaatcgtgacaaaaaaaaggccatttattcaatcccaagtctccatccatcgtccgggttggtcgtgttcaaagagaatccggcacttccactcccgtgttgatcagatctaagcgacagtgacgactccgcttttattggggcaaatgctttcgcagccaatgcctttctgcgacgcctccgtataaagcacagcgtaagcacagcaagtccaatggcagcagcgatgagaagaataatagtaaagtttatccctccctccttttttcgaaaaaaaatgagaaatgcggatcaggcgccgttttcacgagttttggaactttaacttttttcattgtctaacaaatccaacaatcatggtagcattggatggcactagatgtcctctattagcctgcaaaatttcaaaatttttttgttaggtttcaaaacagttatggccaaaaatgtttgggcaaccagtttcttgaatttcttctggccacaacttttttgaaccttaatgaaatttttcgaaatttgcaggctaatagaggacacttagggctatcgaatgatacaaaaattgttggatttggttgacaatgaaacaaggcaaagttcaaaactcggccacacgaaaaaaagaaatgcaactgaccagcacaacaccacaatagcagtgccccattcgcttaacattattataaccgttttttggtcctttttatggcattttgtgattagttcactttttacgaagaattttttccaaaaaaatgaccatttaaaaatttttatttacatattttcgtatatatttgggagttttagtacatatttaatacatatttagcatttttcatacatattttatgtacatatttcgcgatttttcttacataaaaaaagaatccctaataattaatattagggttcgagcgccgtgggcgggggtggcttttcgcgagggcgagggttggcggcactatgggtactagagtccggtccgggagcgggatcgggagtttaaaattttccggtacgggagtcccgaacgggaatcccgtccatttttaactggagtcccgggcgggagcgggagtaattcgaaaatttataaaaaatcacaaaaatatttttaatgcacaaattggaaggacacaatccttttataaagaaaaatatacagaaaaattttgcaagcggtcgaaaatcagaaaaatttttcaaattgcttcaaataaatattttttataatttattcgaacaaaaaatttattaactttatatattgggactccctttattaattttaacaacttttt

SEQ ID NO: 6038 - DNA, 6695 bp, Heterodera glycines
atggaagagcgagagcgatgatggctcatcgattagccgaaagtgaatttatgctaaggagtttttaaatgataatagaaaatgaggactatgcaaataatatttaaatgcgtgattttgcgggattaagccccggcgggatctcgtctagcaaaaactttaacgccaatcccgcagcagggacccgcaaatttgaaattttcaggatctaatttctaccggcagttgagtttgccggtgtttgctggtgcagctgcggtgtattagccgccgaaaatgcggcaaaatcacggtgcagtgaagagcgaggcccgcgcacacagtccgtcactttggcacgctttcgacgaggggagctgaaaaaaatggtggataattattattaaagtaaaaaatccaaaaagggatactgtaatccttgtacagtttgattggcctttctacccatccatataagtatgatcaatatagctaaaaaaaacaactcttaatgatcagcaagtagtgtcatacgttatatatgtaaccaggtcgctgtactttttaattttttgtgccggaattcaaggtttcgaaaaattttaatgacagaattttacggcaaaattttaatgacagaattttacggcaaaattttaatgacagaattttacggcaaaattttaatgacagaattttacggcaaaattttaatgacagaattttacggcaaaattttgagccttcggttagaaaacaattctattagcttttgtacgcactcatcacaatctgccgatgatcgatggcttaagcgtaacgggtaattgttgtgctgttgcgattgtttgtgatgataataatgcccatttgtaggagaacattgtgccgaaattgcggaatttctaaaaaaaataattaattattttccattttaaatctacattgattatggtttcattggtgatgttaattaattaattcttagaaagaattattggagtacaaataattcgtaaaatgattagcaaattcaattttaattactcggtaattaaattcattaattaaaaaaaatgattttaattatttcgtgccggcaaataaaaacactactgtatgatacagtcaaatgtccgtacaaattctgttggtccgacattaagttgtgagcggcggcggcagccattgtggactgagttggcacgggcggaggcggaaaaataccacttccgccccgggaagttggtgccacggtcgattgtgccgcggcatttgccaaaaaagctccaatcgcagtggaaaagaacggattctgctgagcggcactgaattttgtaatttattttaatatgtgtaaaattttttttgaatattttcttacgcgaataatgtcgcaacagctgctgaattcattgtttgcattgttggcacggaaaaccatggaaaagtctaaagaaaaaattttgataaggcaaattttggaaaattcggacccgttttgggggaaactccaactcgagattcccggccaatccagttattcccggctaattatcggcgatcaaaaactatttttataaccaagccgatcacaatcccaaaaagttaattaattattaaccgagtttggcaattgcgccattccgccacccccacgcattgtgcacgatggcaccaccattgacgatgccaatgaaaagggtggttgtgatgcaggtggtcggcatgtgccagctgcggctggcacaaattgcggttgctgttggtcgggcagtaattggtgctgctgctgctgctgttgttgctgtctagtggcggctaatgccaacgcggctgtccataaacgggcctgaattggccagaaaaaaatactatttttgggggattgtcaatttattagacctgaatttttttttttgaaaaaattttgtgattttaggggaggtctatttattaaaatttaattttttgtattcaattttaaattggctgttcggaatatggaagattttgaagggtgctatttcattctctccttaattctcgggaaattaacccaatttacttaaaaatttattttaacaattaaatgtaaagggacaggaaaaagcatacaaatgcaaaattgattaatcaggaaaaagatgtcgcttcttcttcacccccaattgagtgagcggtgcgccttttatagaggagcacccgcaggggaagggaggggcgggatgaatcatcacatgaatttaaggaaaaatgatttcaaaataaattgatcaaatggatcaatttgggtcgctttggcccatgagataattattaaaatttaattttattttcgtctctttttaaattcacaattcgaaatttggaagattttaaaggccgctattttcctcccccgggcataaaaattttattacgctaattagggcgcttgcaattttcctgttattaactgactttacctgaactgcttgaaattgttgttgttgaaccgcattctggtgttgttgctgctggcattgttgcgcgtactgttcgtcaacatggtcacggttattgtccactgacgaaccgttggaagcggatgaggaggatgaagttgtagaaaagtcaccgaccacctgagcgattaaaaataaattgaaattaaaaaacaaaaaaaaaaaattatttgtgtcgccacgctcactttgtccacggcaccggcacaggccccggccaactcagttttcaaaaatcgcgcaaaatagccaaggttattgtactgtagctttttttcgcgcactgacgcatcatcctcatcaccatcatctttttgaagttgaccatctgctgatgactcctcctcatcagctaaatttgctaatgaatgttgtcaaattaaacggtgaatttttcgagattgatacaattttatgcgccaacattgtgaccaaaaactggactctaactcaagattaaatcgagacataatttttccatatgcttaatactaattaatactcgagactcttctcagagctttaaatttaattcatgccttcaagcgggaacaactgtggtgggaaatgtgtgaacgcattcagcggtgttgtgctgctgaggattgtcatattgttgttgtccataaacaaattcaccttaaaaaaatattaaaatgaaaaaaaaagtttaaaaaattgaaaaatgattttcttactttgttgttcatttgctgccgattgatcggacccatttgttcatcatccgctccttcttcgccttcgtcatgacgcttgttgaacgctgaattgacaaaatatgatgtctctcttgatctgattacgggctattgatcagaatcagagaaaatgctaattgaattatccctgagttaagtgatcggacaatactgattgccaaagactaacaaacacataaaactacaatgatcagcagcgatttagacggatcagattagcttagggaaataaattaactatctagcagataagataaattgactaatcagtcgctaattaaggctgaatgatcagattaagcggcatacaaatgataatggtttaaaaattcattaatcaatctaaatttgattatttctctgccccaccttgagaatgttgtttttgttgctgttgttcaacagcagcagttgtttctgctccagctacatgttcttggccatcattttctgtctgcataggctcctctttgattcggaccggattaaagctttttcgacgtgccgacgatgaagcggatgccgaagtggaggaaagtgcccaattgttattgcttttgcaaatttttggctgttcgttagcaactacaacaatgacattggcaccaccattcaaaattggcgacggttggcacgatgccaaagcaattgccatttccttctcttttaaaataataaattcttgtttttgggctaatttaaaataattttggtttgacgctgcaaattttgaatcccgaaaatcttttacccattttcccgagaaaattactggccagttttttttatcactctaccgtatccgtcagcagtacagtgtcgtccatttgactgctgttgggcattgctgttattttcaaaactgtccatttccgccaatttggcgatctgttcgaacaaacattcgccattctgttgctgtttttgttgttgtacatcattgtcttcactgtgttgttcaccatctccatcgccatgagcagatgcaacagatgatgatgaatatgaagcatttgaagaaactgaagtgatgattggcagcggctgagaccagcagacgaatgatggcggaaaatggaggtccttaaggggtcaaaaaattaattaattaattaattatgtcactaattaatcgccccggcaaaaaaaaacgctcccaacgccgaaacggtcccgactctcagaaaattttccttgggggggtgagggtataaacgggggggggggcggggttgagtgaattttcggaaaatttttccatggaggcgaagtttaaaaggggaggggcggagtgtgtaagacctgtccttgtttaaaattagtagtttgacaaaaaattatcgtcatcccctcactctgatcactctcaaagccccagatcccgagattctcgaggcaattaaaaaacacataaaaaggatacctcctccccaatttgttctaccgttttgtcctcgtcttctccatgctcattagtgacaggttgccgttctccctcatcttccccctcctcctcaattgttacaccatttttgtgagaccaaatttgttgtagggtaatgatgattcatcattacacaaagacattttttcagggaattttctgtcgctgtaataattaattagggaattaattagaacgttcaacattcacggtattaccggcccgtaattttcagccatttttaattagaaattcattagatcggccaatattcggggtacccaggaagttgcaaattaatgtattatatgacaccgacacatctcggaaatgggattgttgggtgggcatgtcgggatcagggtaaacccaaataaaggtcgggaatcgggttaaaagcgcgaatggtcagggatggaagaggggtcgagaccaacgagatcaaacacagttcaacgcattaggtgttcaacaaaaaaagaattgtgatggtttctttctcaactgtctgggactcaatttcagacccgaaatttcccaccgattttattagaaattaattggccgatatctcgggaattaaaaatgggtcgagagcaaacatcgtttaacgcatttgactattctacaaaaatttcttcctcaattatctgagactcaaatgtcggcctctacattttccaccgttttttaaaatttttttgcaaataaattcatttttttggatatgaattgtttttcctttttttaaaagaaagaagcacagttattattcgttcattcattcattatttcatttattctgcagatcatccatcgtttaagtggtggtcgtttttttcttcgatgattatttatgcaaatgagctaaaatagggtgctgaagacgaagaagaagaagaagaagtgggagaacttcttacacttacttatgtatgttgtgtaagtgtgtcaatgtgaaaagaaaaaattgtccaatccaatgtaattaatgccaacaattagcactcggaattcattaagttttttgacatgttcaaatttttcatcatttttaattataaaaaaaatttcttcttttcaaaaaagataattaaaaatgaattttctggtgatccgcggatcagggtaaaatcaatcaaacaagcgcggctaatggcttcattaaatagagccgttctataataatttgtttttaagacaatttgatattagaaaaatatgaatggattgcaaaagaaacttgttatgattttagtttacccaccaaaaacattgtctaaacaatctttcggttatttaccggcaagtttaatccttaaattatggacccaaagaaatgcaaaaactaaaataaatttaaacaaaattaatgaatggtaaagaaaaaaaatgatccgtggatcataaatttaaacaaaattaatgaatggtaaagaaaaaaatgatccgtggatcgggtcaggtcaaagaaaaagcaaatagcataggggtcgctgaatccggtctttatgcatacgggttttggtccgcggatttgggctcgagatccctgtctcggtatagtccccgccaaaatactcggcatcccaacaaatcccagttgcggtaccttcaacaacactggattcggaatctcggggaaatcccggtcgggatctaaagccctcctccctccattacaaccccctctccataaagttccccctttctctgggtattgaaaaagagccccaggagcggagtatatgccaaatttcataataattttagacaattttatttcttatactgattgctctgctctgatcacttccctcacccatttctcacaatcagcaacaaacaccagcagattaggaaagattgtgtggaaagaaaacacatagaagatggagacgattttgtgtcggtgcggtggtgcggcgattattatgggattaggcgcgtagcgccgcgggggcaaccaacaacaacggagggcggcggcgtattgtattcgaggggaggcgggggcggggggag

SEQ ID NO: 6039 - DNA, 2629 bp, Heterodera glycines
ttatttatttttagaaggaatacaaaaaacatttgcttttgaaattccttcatcgatagcgaaattaatggatttttagaagaaaattgcactgccctttctgttgctcggcctaattacccttatcctttcacaaaaatggggtgacttttgttttattgcatataattaagggacggacggagggaaagcgaaaagaaaatgcatttaaaataaatgatttgaaaaagttttttccaatatttaattgtgtaatgcgttttaattgctttgtgctttgttctttaattaatcccccgcccgcccccaattttaccccatttatttgttcatttttgaacagaaacaaaaagcattaaaaatcaaaatccattttattcgatcagcaacattaacgcaacaactcgctaaagctaaaccaattaacaaaaaagcacacaattaaagaaaaggagcggagaaattggcgaagagaagcaaaaattaattgggaggaaaagaaaaaagttgaaaaaaagcgaaaaagaacattaattgattctgtggtaaattgaaaatgggaggaggtacaaaagcgaagccatgccattcattccatctgctgaccatggccaattccgtctgatcaggcatattttaatggccataacttttttttctaaatagaaccaaattctgctgacattatttgaaagttcaattaaccattaaaagaaaaaaattgttttaaccaaatgaaaaagaattaaaaaaaacatggatatcaagttaatttttttttgagttacatattaatcacttcatgcgcatttattagcgattgtttatttactttgtttttgctatgtaaagatggggaacatttgttcacattcctccccaccgtacgccgatgaaaataataatcaaatttaattgctatgaatgggcaaaattaatttgggcctatgaaattataataataaatctgccgttgggtgtgcccgagggtatgccgaaatgagtgaaatggagtaaggggggggggggggggaatgttgtggttgtggtgaggccaaggaattattaataaaagctcttccgccgaccgttggtaatgaaatccatgcgatgagcaatcatcagagaagaagcagaagcacacccattcattcattcaacagtttttttgtggatctttttccgatcaaaacactaataattaacataattaacacattaattacccaatcaattaattataggtgggtgatccggtttaggaggtgagtgagtgagtgaagtactttaagtgcataatatagtaggaatccaagcaataaaaatttttgtatttgatgtcagcattattttattaattgctacagctgtttgctgattagtataataacagactgatgtgatttgggagtaaaactgattaaagccatggctcaattatcgaaattgccatatccggcagatcaattgatgaaagttcagtaattaagtgatcaacagcagatgttcatttttacattcaatgttttctgattaaaatgataagagctaattttggggagagctttaaacgatcaattgaatcgaacagaaatcctaattagagttaagaaatgtatcaaatgaatagtgatcaggaattaaaaactgaaaagtgatcggggaagaattttaagaaatttaatagctctcgttgcagcaaaagaccattcacttatttatttattataaacaaaaatgtcattttcatcgtcatttgcttgtcccccccccctcacattttctgctgctgactgttctgttggttctttattatttgttggagcagcaaaaattggcggaacggacggacggacaaacgggacggaatgccacccatttccgttacttctccgtcgttttggtaaaaaaaaatatcccaaacaaaaaattacccactccaagcaatttggatagatgaaattatcattttcacactaaaaacaacaatttttcatattttttcatttgtgcggtaaagtaaattgcgaccaaaaaataatttggattttcgtcaaaaattttggataaaattttggcattttgtaggtttgactaccccaaagaggttttttttgtataaatatttgttaattctttgtgaaaattcataaataaattatttaaatagaaaaaaatatatataatcatttgagagaaaagccaccataaactcagttaaacattaaaattctaattttttttataaaattagcaagtagaaaaggtaaaaattgcttcaaagattgtttaaaagtgaaagttttctcacttaaattccattataagccaaaggaatttttctgccgcaaaaaatgaagaaaaagccgccgttgaattgtgtgaatgtgtgtggccgacggtgaacacaaaaaaatgggggagagactttcttaatcataccacaattttactgatctgatcgctgtcggagataaaggaaaaatgcggaaaattggaagagacaatcactgacattgatcattgaatggttcataaaatggacggtttaaggcgaagaaagtgattgatagggggggggggatagatagatgtaaaaaggtgaattttaaaattaaaaaaaaataaa

SEQ ID NO: 6040 - DNA, 1614 bp, Heterodera glycines
  misc_feature (53)..(53): n is a, c, g, or t
  misc_feature (76)..(76): n is a, c, g, or t
taatgaaatccatgcgatgagcaatcatcagagaagaagcagaagcacacacncattcattcattcaacagttttnttgtggataaattagtctttttccgatcaaaacactaataattaacataattaacacattaattacccaatcaattaattataattaattcataattttctttgtctgcagtcttttctcgctctcttttccaatacataagtatgatatgaccaaatcgtccttcctccgaatcggtcgaaacactggtcaatatcaggcgattatttcgtgcattaatctcacaaatcgccgcggattaatcagtctcccctcccccggccgattaatccatcggcggacagtgaaaaaagaaagtgacggacgaataatgaaataaatgcatgacaaaatgcaaatggacacaccagtaaatttgtatgcacttatatcattattttttatcatttaatcattaacattttgaaaattcattttgcttttgcttcttaaaataattcatattttattaaatcaaattaaaaacagaaattgtaaaaatgcattggattgattccctttttcccttattatttccttttttttgctctgatttgtgaggtctttcgtttgcctttgcttttgcctttctccgttataaaatgtttgaaaatgcttcgccaatgccattttattttcatttcattgaatgttccgtcttttcccatttctcctcatttattactttcgtttctttcttatcactttcggcagattatgcccatttccctattttccccacttccttttcacttttcagaatcttttgttatttttggaaattatgcaaattttgttgatgattgccattttggcaaatcgttccaaaaatgggcggctaattggctacgggggggggggcggcataccccgcaaatgacaagagcaatttggccaattcggacagatccattcaaaactttcacgtgccatgatggtcattcgcgttgcccattaccaaaatgccatgtcggcacatttcctcccgtccggtacttccaatttcactttcattgccccgggcgggacaaaacatccccaaattggcagattcactcattcattcattctcaatccaagtggcttcatcgagaatggtcacccgtcggtcataatatgcgagggactgagcgagcggcggagtcgccccgccgggggggggtggagggaggagaagctaacaaaacacgcagtaaaagggagggagcggagcaaaggatgctgccgctgctgttgagtgtctctgtccgccttccaatctctcgctttagcttatctatcgtcttcctctctctctctctcactctctctcaattcctttctctctctttttccctgcggggatttgcctgctgtcgtcgcttctttctcttctctagcaaaaccattcgataatacaaacatccgccggccgcccaatgtgcacaacgcacaattgacggcgttcctattacaatttaataattggaaagtgcaagacgacaaaacaaacaattaaaataaaattatatccataatagtattataatgttaattaattacctaatttcctaaatttt

SEQ ID NO: 6041 - DNA, 1192 bp, Heterodera glycines
gggacgcgtaaaatgtcacgggacgtcgtacaatttcacgggacgcgtaaaatgtcacgggacgcgtaaaacgtcatgggacgcgtaaaatgtcacgggacgcgtaaaatgtcacgggacgcgtaaaatgccacgggacgcgtaaaatgtcacgggacgcgtaaaacgtcatgggacgcgtaaaatgtcacgggacgcataaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcatgggacgcgtaaaatgtcacgggacgcgtaaaacgtcatgggacgcgtaaaatgtcacgggacgcataaaatgtcacgggacgcgtaaaatgtcacgggacgcgtaaaatgtcatgggatgcgtaaaatgtcatgggacgcgtaaaatgtcatgggacgcgtaaaatgtcatgggacgcgtaaaatgtcatgggatgcgtaaaatgtcatgggacgcgtaaaatgtcatgggacgcgtaaaatgtcacgggacgcgtaaaatgtcacgggacgcgtaaaatgtcacgggacgcgtaaaatgtcatgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaacgtcatgggacgcgtaaaatgtcacgggacgcgtaaaatgtcacgggacgcgtaaaatgtcacgggacgcgtaaaatgtcatgggacgcgtaaaatgtcatgggacgcgtaaaatgtcacgggacgcgtaaaatgtcacgggacgcgtaaaatgtcacgggacgcgtaaaatgtcacgggacgcgtaaaacgtcatgggacgcgtaaaatgtcacgggacgcgtaaaatgtcacgggacgcgtaaaatgtcacgggacgcgtataatgtcacgggacgcgtaaaatgtcatgtgacgcgtacgatgtcatgtgacgcgtaaaatgtcacgtgacgcgtaagatgtcatgggacgcgtacaatgtcactggacgcgtaaatgtcatgggacgcgtaaaatgtcacgtgacgcgtaaaat

SEQ ID NO: 6042 - DNA, 1036 bp, Heterodera glycines
cgtaaaatgtcacgggacgcgtaaaatgtcatgggatgcgtaaaatgtcatgggacgcgtaaaatgtcatgggacgcgtaaaatgtcatgggacgcgtaaaatgtcacgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaacgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaatgtcacgggacgcgtaaaatgtcatgggacgcgtaaaatgtcacgggacgcgtaaaatgtcacgggacgcgtaaaatgtcacgggacgcgtaaaatgtcatgggacgcgtaaaatgtcacgggacgcgtaaaacgtcatgggacgcgtaaaatgtcacgggacgcataaaatgtcacgggacgcgtaaaatgtcacgggacgcgtaaaatgtcacgggacgcgtaaaatgtcacgggacgcgtaaaatgtcacgggacgcgtaaaatgtcacgggacgcgtagaatgtcatgccacgcgcgtaaaat

SEQ ID NO: 6043 - DNA, 1168 bp, Heterodera glycines
acgcgtaaaatgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaacgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaacgtcatgggacgcgtaaaatgtcacgggacgcgtaaaatgtcacgggacgcgtaaaatgtcacgggacgcgtaaaatgtcacgggacgcgtaaaacgtcatgggacgcgtaaaatgtcacgggacgcgtaaaacgtcatgggacgcgtaaaatgtcacgggacgcgtaaaatgtcacgggacgcgtaaaatgtcacgggacgcgtaaaatgtcatgggacgcgtaaatgtcacgggacgcttaaatgtcacgggacgcgtaaaatgtcatgggacgcgtaaaatgtcatgggacgcgtaaaatgtcacgggacgcctaaaatgtcacgggacgcctaaaaatgtcacggggacgcgtaaa

SEQ ID NO: 6044 - DNA, 3823 bp, Heterodera glycines
agaaataattaaaacgagaaaacacgaaacacacctttttttgagaatattcatggataattttttgtctgttgcttttagcctaaatttaggtatataaattctatagactttaagctttcgtttgatatcaagaatataggtaaccgaatagatagactaaagaatgagaagaaaaagggtaaaattgaaaaaatacgcacaacgtacagaatcatttttgaaggtattgtcagggaaaaagtcatgacgaatggaaaataatgaaaagtggcggaggagcaatcacttttatatgaatttactgattttactgtcttttcaatttaggtagtatacggtttgcattttccaattttcttgcgacgataaaagcaaattcactcatttttcgggtcggggtcacttcggcgcggccatactttgaaagaaaatgccaaaagttatgcacaatgaaagcgcaaattaacacttttttaattttttggggtttctaaacattggcgcctaaatatgcgcattttgcgcttcttcattatccctactttcaacttactgtatgggttttcttttttccttttctgatttggtttatctatgtccctttttaatgaaattttgccgccgatttgacgaacatttcaaaacgcgcaaatgtacatcagggatggagttccgaggcactaaaaattttcggaagtcggaagtcggaatttttcaaaaaaaataaaatataataaattttttttttaaatatttaataggctaaatttttaattttgtaatttttaatgtaaattgttaacaaattttgtccaaaaaatggaaaatttagcgattttgagcaaattttcaagaaaattaagtttttttgagtccggcagtgccgataggtgccgtcggaaaaaaaaatgaaaatttctatgcaatttattaacataaattgtacaaaaattgctaattttttgaaaaaaaaactcaaaaaaattccgacttttcatcaaaaatttcggaagtcggaagtcgggattccgaggccccaaaaattttcggaagtcggaagtcggaattccgaccccaaaaatgtcggaagtcggaactcggaagtcggaattccgtgccatccctgatacacaccatcccagaaatgagctcctttaccggaaaagatttgcatgtgtggcttagtggtttttgtaagatagtaaagggacaaagggtggtggttcgagtccgttgtgcaacatgaatattttcatttatttttgtccaaaatattaaaaaatgacgatatttgggaattatttttgaaggtttttgccaaccaaattggtccattgtattaattaaatttagttattttggctacaaaagcggatctcgattggggattttctctttgtttttcagaaattagtttttgctctcctcgcaacactgaaaatacgagattatgttggaaatcgttgtttttcagtttttggaattaaaatgagcttaaactgtgcaaaattatttgctgttatttgctatttaaataattaaagattaatataaattttaattatatagcgaatatttgaaataatatatattaaatacaatctttttgttattaatttttaatttttagtcataactttcttgaaatttaacgaaactttttgaaattttttaggctaatagaaaacacttagtgctatctaatacccgcgattctggcaaaattttaattgtggaatcgactctaaatatcgtttatagttttatttaatttaataatgctgtcaaatttacattttatatctactttttctcatctttctcctcctcccatcccatcattttatttactttttttttgggtcagcattttgcctaattaagaaaatgaaggagatgcaaattttatgagttttctgccctctgcttcgccatttgggtcatccatcattttgccattaaatatttgaacgaaaatccttcacagcaggaatgttttttacaataaaaaaatgcaaggacgtccttggacgaatgacgctttgaacggttctgaatattcatgtccaagggcggcattgaaacgtttgcggtacttttccctttagtgacctactccagaaattttttttagattttttctcggataatttaggattgaaaaaaacgcatctgctgtttattttaaggtaacgtacaagcagcagatgcatttttagcgcctcaaattaccgaagaaaaaaatattaaatttttttagggaggggggcacaaaagggataagtgccacgattgcttttcaacttattgtattttggaattttttatctattaatgaagtaatattctaaataaatttttgtgtgtcctttaaaagggattttttgttccattctaaacttttcttctttgacatgtttctcatttccatcccattttacttttttaggtcaacgatttgcttaatcctaaaataataataataattgtaataaaagaaaacgaatgaggaagttatgtgaagaaaagttttttgtccatctgttctccacccattttgaggtcatcactcagaaagtttaatgtttctccccacaaataagcaaaaaaataaaattgttaatattatttttgttaaataattcgtaaaaactttttcccaggattttggagtccctgatcacgaatttgatatttattttgaccatttctaatccccaacccgaactttaacaaaaattcaatttcttcatagcgtcgatttttgataaatcgaatgtcactttcgatcggtagcagttcatctgaggacgatttcacatctgatcaaccagaaataactgctgaaggtttaacaaaaaaaaatagaaaaacaaagatgaaaggcttagaaaattaaaaatccgtacgaaatttaatttaattcataatttcacaagttaatggcccatcaattacctcatggacaatcataactgataatcctacgacggagatggactgttcggcacaacagcagcagcggcagatgatgagaacgttggcattatcgccacggagaagccaagcagcaaaaatttcaacgccaaataaaggtggaagagggagaaaaaaagcaattaatatcattttttaaaatttaatggtactttcatagtttacaggctacttttagcatacattttcaaatgcatataaatgtgttttaaaatttaatgaaaataaatttttaaggggtttttgaggtcgctgatcacgaatccgggctcagatcagcgctacctttcactacatgagctgtacaggaacaaagaattgataggcttcctgtaccaataataccctcattggaaaaatgcccataagggaccatacataccattttcgaattgtatatttcctgatacagagttaccctgctgatgggtaagatgtcaatgacgatatcatgaggacattagttatatgattgttcgaatattcgtcagggtgtcaaagatttcaaaagatgcgtggtagtgttttcattcatctgctgctagattttatgtgaacaaaatttaactcattatgactgaatttgagcgccggtttttcccccccgaggttaattatggggtcggaccataattaaagttttgcaattaggtttaataaattctttgaaattttattgaatcatagaaaaacaaatacttttagcgatcaaaattatcaacattttcaaatctgataaaaagtcaaattttttcgctttcaaaaattaattacctccagaccaagggcgtaacccaatccttggcttcgggggggggggggg

SEQ ID NO: 6045 - DNA, 932 bp, Heterodera glycines
aggggttttcgaggtcgctgatcacgaatccgggctctttcagcgctaacgttcgctacatgagctgcacagggacaacaaatttactgtcatactgtatcaataataccctcattggcaagatgcccatgaggataccatccatacaattttcgaattttatgtttcctgtaccagggttaccctcatgggtaagatgccaatgaggatatcatccatacaaattttttatttttgttcgagttcgggtcaggggttcgaaattggcaaaaatgggtgttgtattcgtgatcagcgacctcaaaaaccccttaaaaattattttcattaatttctaaaacacatttataggaatctgaaaatgtatgttaaaagtagcctgtaaactaggaaagtaccaatttaattcacatcatcgaaagtttaagaatgaatcttttttaaattttataccaaatttcttctttttaacagaaaatgacaattggtgaagaaatgaagcagcaaaaagtgatggcacaacacattttattgttgcaggagaaagttgccaaaatggagcaggaaaaagagcaacagaagaagaagaaggaaaatgagaaatacggtaggatggattggattactgtaaaaaataattactgttcaatgaaccgttaatattttaattatttgaaagtgatttaaatttgtaaggtttcagtcgatcaattcatcaaaatgcaaaatgatcactttgctattttggaacgcatcagtgaattggaaaagcagcaactgaaagaacaaaaacagcaagacgagaatgggaaaggaaaatacggtaatgcatacggtaacagtgttaaaattaatataatttatttatttaatattaaaatcatttttagcttccgatcaattcacaaagttacaagatgatcagcagcaga

SEQ ID NO: 6046 - DNA, 2096 bp, Heterodera glycines
gacgggaaaatgaattttttttattaaaaattcaattttataaattttacttcgggttgctctccgactctatccgtagaattgttaatgtcatctgctgctgttctccgaatcggatgagagtgtttttttctcaactttatgaaaaatttcttccctggttgctccactgcattttttaaattctccagccatccccgacaaattatcggggaatttcctccccgatcctcggtttcgcccactcccggaggaccagaaattgcctatttaatttgcatttcttaaaaatttctcaatcattacaattgttttttaaattttccaaaaatttgagaaaaatgaatcaatgaaaatgatttttaaaaatacagcttacaaacggttgggatgccaatttctgtcacagtgacctcgaaataattggcaacgaatgtttgacggtccatcacattggggatgcagttcatggtaagttttcttattttgtattaaaatattagagattgaaatttgaaaaaatattggattttgtgaattgcgcttgaaatacttttttttggattactaatccggttccgaaatgcgcttagatccaagaaaaaagaccaaaaataatttagtgtctaaaagtaaaattttattaaaaaatttttttttagtatacatcaaaaatttggagagagaaacggaaagatttttgaaaatcattttacaataattcatttcaaattttttgtcaaaagagaggttaggcacttccgagaaatatttttttatttgctataattttcaacattaatttaatccaagaatgaaatcccggatatttatgtgaaaaataatcaagaaaacaatgacaggacacaattctcttgtccgagctctaatgattaatttacacatatatataaagcatttttcttcacaaaaggacaccgctccgtctatgcaaaacatccgatttttctgctgaaaaattatcaaaatgactcggccaacagtttttattttgaaatttcgatcaaaaaaatgaaaaagtaagaccaaagactgttcatttgttagctttaccttttctctaataattttcagttgtgccgctgtaggatttaccgcccataggcaagtgccatcgaatgcgtacctttacgctctcaacggcacttatgcgtacgttagcgatggcgttttgtggaaaaacggttccttcaccactggcactcacagtaaatgttcatacggtgctggcgatacggtcggatgtggcattgatttggccactcggaaaattttcttcaccaaaaatggcattcgtttgggtacgaacaaataaattacaatcacgttgttaagcacagggtcagacgatgtcggaatttcggaaatagagtaaaaaaaaaactaatttcaaaaattttttttattaacccaattaaaattaaaatctttattctttgaccaaattagccatcttgagaatttttgctttaaattttcaaacatttctatggaaaatgaagcccaattgaataactacataaattcagagtctcatttattaaatttatttacatgtttagttcacttaattaatcaattagtaaattttcagatagcgtcgatttgcgcctttatctttccattccgtctgatgttggccaactgttcccattcgtttcattgtgtgactctgatgacaaaattgagacgaactttagcaccaatttcatggccatcactccgacgacgattaacaaaatgtggtcgtccataattcatgaacttagtttccgcattccgacgacgagtccgctgatagatcttactggatttcttatcgttatctttttggcttttgcgcttggtctttttttaagtctttttttttgcaatttttactaaaaaaacatttcttctaaccattctcagttcaccgttttcatgtaatgttacgacattttttcttgttaaataataaaatgatggacctaagagattttccaaaattgtttagggggaatgttttgaatttgctagttcatgaatgggtttacccagaaaataaaaaggataaaaaaagtaatcgttgggcc

SEQ ID NO: 6047 - DNA, 8328 bp, Heterodera glycines
cgtaaattctgtttaattttttgaaaaaatgcaatttgttcagctcattgtcagctcagccaactcggcgacaaaatgaccaaataagcgaaaacgggcgacatcaaaacgggggacaatgcgtaaggggagaggaaaaggccggacaaaaatttgggagagaaaatttgcggggttagcaccaacggggagagcacaatgggcgacatcattgacgggttcagaagggccggggtcagcaccagcggggacagaatggcggggtggaagaaatgggaggacattatttgcggatttaagatgaacggactcaaaatctgggcaaaaatggaaaatatgggttttcaaattaaaaagaaacttacgatactgttcaaaaatcctaaaaaataaatttaattattttttaattacatttttaatcgacctggcgacaaaatgaatggctgcataattattggagtcagaataatggatgagaagataaacggagacaacaccaggggcgtcattatacgaggcgacaaaatccaaaatgattaggcaattaaacataattaaaaggtgaatgaattaacgcgaaccggaggagagaaaaagcgaggcgacaaaattgcaggtcaaaagatgtgaaaataataaataaaagcaattagacaattaagccaaaatagtaccccataatggtcggagacaaaatggtcggagagaagacaagcggagagagcacaagcgaattaccaattctatgaagcattagctaattaattttttttaattattatttttcctaccttggctttttgatacccggtttaaacacactcggggaaagctgaaaatagaaaaaaaggaatggacgattcaattgctaattttagccagcaaaaacaacagatatcggaatcaatcatttcatagtttagctccccgttccccaatattaaacagaccacgtcattttgtcggagatcaaatgaggccatttcagacagccgacgaatgtcggcttcgatcatctgcaaaaagcaaatatttttttatcaatttaattatttccatgaattctatccatttatttatgcccaataatttgtttgtttggcccactttgctgacggaagtgccgttcttcacaattggcagtaatcgccgcagagtttgcgagtcgttgaagggcgaactcggcccgtaaatcagacggagctgttcggcactcatcgacacaacgcccgtcctgttcatttctgccaacttggaatggaaattaaatataaatgcttttaattaattaatttattttgtttttcattttacttgctctttgctcaaattttgcaccaatttttcccatgtgtccgattttcgttgttcgttctgtccatacatttcgcgcacctttcaaatcaacgagtgaacaattgtccattttgcccatttgctcctcacattttccttcgtcagataaaggccatcaaattcgcgtttgtatcgtttctccacttttttggcaatctcatcatcagtgccgtacccatcatcagcagaggacaacaaatgctgagaattgaaaatcattgctaattctggtgaaaattattttcttttaattggaggaggtttcagccaaatggacgacttaagttatatccagggctcccagatctgaggctttagcctcattttgtggttttttgataggtcaatgaggctaaattttcaaaatgaggctttttgacccaaaatgaggcttttttgcctgccaaatgaggcttttgaaaattttgatctgggagccctggttatatccaaaaattgtaattaataaaaagctaaatagaattacaaaacaagctaaaggtttgctaggggagatgagctagttggggaattcaaaataaatgatagttctggggcattggaaaatgaaaaattgtttttgcattattcttccatccaccttcactgtgtccacttgctcgttgacccccgatgcttccatgatcagattaagccattcgttttggtctcggtccactaaatggacccccttcttcatcaaatttggcaaactcatttgcctttcaaggccatgcccttttgtgtgcaggctgaacagtgatggggacagaaaattagcctaaaacaagaaaaataaaaataaaaattttctattttcgaattatatataacattccaatagtttttcaggaatttgggtgaaagggggcctcctgctgggcagcaggggatcaactcagtcccatcaacccgaactagctgagtacagtgtcttaaaccgtttgggactgagttggccggggaccgtgttgtcgcgtttcgtccctgtcccgccccttctgatccgcgttggctgatcaattatctgccaaaattaggcacctttcccctcgacttgctggccgtaacgctcataaaccgtggcgataaaacgtcaaccaatcggcccgcttccattgcttttgctctcgccgcttctccgccctttgccctccgttcgccgcttttaccgtattcctcgctctgttccctaccgtactcctccccctccatttcttcgtcataatttgccatttcatttcttttctctccgttaaattcgtccgattttgaatattcgattgactttgactttctttccaactccgccaatcgcatgccgactttgatgccgtcattgaccaatttggcaatttgcgcttccaatttgcccactttgctaccgtaagccgttgtttcatcggccgaattcattttcagcagtgtttttttgtcatattttttatttgttgcaattgccgattttatgggctgaataaagcaaaagttattattcttttaataacaacaaattaccatttctttaagcgcataatccttccattttttttcttctcttttcaactgattgtgcgccttttttgccttttgtatttgtgaaattgtttcttgccaacttaaaataataattttaatttgttttattatttactatattaatttgaattatagtattccttttacggtattgtccgtgttttgttcttccttcccaatatgccgctcatcaaaaggcgtgccaatcctccaatgagactgaggccaagtgttcgttttgcctccagcaaattgtatgaatgacttttcaaaattgcaacatttttgcgttttcttgccaaaaagtctttgtctaaatgccgttggtctctggcaaaaactgcttcccttttccgcatttcggcaacttcaaattttggctttgcgctgtaataatcggttttacttgtacctaaataatgccggaaattaaaaaaagataaagctctcaattggaagtgataattaacgggcacagaattcgctcaatttttggcactttttaggctaattatgagtcaaaaatcccatacccctaattatacaatgatacattattaaatttgcgaaaatttcatttaaagaaattcattcccattattcggcattttacttaccattcacagtttctttttctactgctgaattgctttcgtgtcctttttctgcctttttcttctgatgttccgtttgtccgttttcttcggcactttcgctttcgattcgaatttgtcccacccaattttcgcttttcaccaaatttttggtgccagcaacaattttggcatttttgagctcaacttcgaattcgttgttcaacagccgaacgatgcatttggccatccgtggcactgtctgtgcgccaaaataacattcgttgaatttgtccggcactacgtctaattggtctttgttggaatgcctttaaaatatatttttaaagttttaataattaaattccatttaaagagcacaaataacagaaacgaacttttcttgcaaaaatactgacagaacagaggcaaatgcttgggttgtccaatgttcgtaaatctaaacacacacaaaaattaatttaatcaatttaaataattaaaaaaagtattaaatttatttacccgatatccctcctctgtggtcatttgaattgtggtgactttgggagaagaatggtgctgtacagcggagactgaagctgatgaagaagtaagcaaaaagagaaaagcgaatgccaacattgacagacaaataaaataataatttaatcttaaaataatcgcttattaatttcaaaaggaaataattcaaatctctaaattttttcttcatttaattacatttgacagattaatttttcataaattatgttgtactttagagggagggagtaaaagtggcggggcggcatttttgggcaaacaaacaaacaattagtggttgagttgcgctgatgcccctgcccgctaattaatctgccgttttgctgctaacagccgatccggctcgtgccgttggtttctgaccgatggtctctcattcccgacatttttcatcggaaaacactgaaaaaagttgatgaattgcgcctcccgtcaaaagattattaattgattctgctttctttcccatttaagattgatatgaaaagcgccgttaaaataataaatcataagctaacaacaccaccagcaatttgtgttatttcccagcaatttgtttaatttaatggaaaactttaaaataattagcgaaaagcacaaaaaatgtttttatccattaaataaatttaatttcaatttaataattgcctcattaattattgagagtacaataatttgtttggttttcaagaattcaaaaaatgctaagaattggtttgcattgaaaagggcaaattcggcggggcatggaaatgcttaataattcgttgtacttgaagttgttcggtgggcaaatatttgatcaaaaaaggtgggctgaaaagcacgcgaacggagtgatgagtttgaagcggtcatcagaaaagtgcaagaacaattcactgaaatgcttaacaattattaatgttagtggggagaattaaatttgaatgtttcgcgtgtcggtgaaagcgaaaaaaaatgttttaagctttacctttttaagccacaattagcaaccgtaccccataaatcacgcgataaaattgcttcaactgaatgacagtttaaaatacaatttgtacaatggcatgaaatgaacttgaacaaaagttgcactttcatttttggcatttgtcacgaaaactcatttgcatatagaaagtgccgtgtttcaattcacaattcacactttaatttctaaacaaaagaataggaattggcacatgaataagctcaaaatggcaagtttaacagtggaagggttcaaatagtgattctttcgagcagagaaaatttagtaataattttaaaattttatgattaaaaattcgagaaaaattagtgggccaattttcaattttggcatggtcgggaaaaaaggcagaaaaatctatcaatcaaataaaaagtgaaacgatagtaagatataaaagaggacaccatgaagaacaaaataaaaaagaatcatttaaataggcgcagaaataacggagttatgaatttttaaaaattggaaaaaatttgggtatcaaaaattatgttccaccctaagtaaatataaaaacaaatttttttgaaaaatttaatgtgaattagaaaatttaatggaaaattttttattataataaaaaattaatttacttttttaattagtaaaataatgattattttataatatatttaattattttaattttttaggccatattgccgaattatttacaaaatattcataatgaatttccaaaattattccatggccaatgcggcgttcgatcgtttcggcgttggcactttctcaatggaattgtttctgtcgcattcgttccgttggctcatttcgctgcccggtttattgtttaatgccgcccttttgaacacaatcattcgcgaaaagtgataataaatattatctttttttattatagtaataaaattttaagaaatattttcggtaaaaaattattaatttttcaattaaaaaatccgaatgaaattccaaattaattaattcctttttctgtgcttttaggagtgtccatggcacttgtgccacccttttggccattggctcctccgttgactttgtctttttgctttcattttctgtcccttttgccatttcgttggttggtcgcaacatgatcagcaatttcgactgctttttcctccaattcgtgccaaaccttggcctattctcctccgtttcgatcgttttcttcgttggcatcgatcgactgatttccgtccttttcccattatggtaaaagttattagccgcaattagtcgagacactaattcctataatttaatcatttgccaagttcagtaaagtccattttggtttccgctagtcaaaaattgtaaaatgctctgccgttacttaggtactgtcttcttgagcggcactttttcatttacattttcccaatgcttacggtaacctttggctacagtatctatgttctgattgaagcggcacaattggtactctttgtgtacccagattggtaaaaatgtttttattgaaaacatttttagtttctttttcggatttatgcttttagggctgttctatgcaccaacggcgacatgttcagctttggcatgtccgcaatggtgctgagaaatggcctggtgatcaacggtgtctctttcttttgctatttatttgtcgggttggcaatttttcgctgtcggaagcaaagttggacggacaaatgaatataaaatagttaatgtttcacaatgtcaaaatggttcaccttctgttttagatccgaatgccatggtcagacattgaattttcaagtccctcgctgccattatggctttgttggttggcacttacttttccatttgcttcatccttttgttgtttcgctctgtcaaagacccatttttcaattttcacattttgtcttccatcagcgcactgttcacagtcacagcggccagctccaacggactcattctatttatatttaggtaaaaaacaaaaacaaatattgccaaattaaataatagtaattattttttaaatatattttaaaaataattcaatttatttggataaattagcagcgaatatcagctggcgttccacaaacatctcaaaggatggcccctgattggcctgtgcttaagccgaatcggacaacaagtacccgtaaatgttattgtggtcaccaatttcaacatcgctgctaatcaaccgcgcactgttagccgccaatgtgggcaaatgacgacaaaaagagatggatgaaaatgaaatggaacgaattatttgtaatatttccttaaatattcatggaaaattcggtctaattgacacataatacccaacttttgaaactcctcaccaaaactgtcttaaaaattaatcatttgtcctgaattgtgttatttgtggtaatacccttttattaggtgtttctggtgcgacacattttgtgttttcagaacagaaacttttggacggagccaaaaagccgaaaattatcagtagcaaatcaaccatactctgctctacatgaccaaagcaatttttttaatgtgattgggcagcggatattgttcatcagttagaattcgaagagaataatcacgaaaaaaaaatatattaaaagcattttaacaacacttagaatataatacaataaagcattctctttttatcatctctcaaaaagttcgttcagctttgttctcgaccgaagatcactctggattttacaattttaactgatcaattattgatcgatcacccaccaatctgatcggattttgatcaatgcattccagcgcaatttttgcggccaaatcgaactcaattgcccacccggaagaaacaaacaatggcacatgggaagtgcttgaacgcagaatggccaaatcgggaagttgttgttggtcagcattttgcatgacaaacattgccgccccgtccactgttttgcattgctcttccgccgatttcaatgcctaaggcaattttcatttttaaacggatttttaaatttgataatccttctaaggaagcacacatttgggccctgctggtggtgtcaaaaaggagaaaacttacgttcgattgagtgcctttgaaccattttctgtaattttcggagtccgcattttttgacgcaaccaacaaaagaacaaataatgcaaaatgaatatttgtttttcaataattaattcacttcaactggcaattggccaagcttcagcagaggagcgggcgcaaaattctttgccattccaacggtggcaacattcaaa

SEQ ID NO: 6048 - DNA, 2704 bp, Heterodera glycines
aaaagaggcagaacgtgtgattatgcattgtgaatggaaagggtacagcgctcgctccaatagttggattcccgcaaattcaattagcgagaaaaatatataaaaagcattatttaataaaatttataaaaaaaaaatgccttcaaattctttttatgttgttcttccgtcaaacaccaatattgaaggaaataggacaaattctttccgagtgcgtttaccgcgcaaattgcaatttaattcggaatgggaggtgggtcttgccgttattgtatacccccactcttggccttccataggcaccgtggagcaacaatttgttcagattgagtggcagacggggaatacggtacgtatcgaagttccaccatcaaatgtcacaaacccccatgagcttagcaaaaatttatataggctcctgggtgagggaagtgatccgttggcaaaaaaggtacgatcaacacagaattctttcatgcttttgataaacaaggctcggcgatgggccagagaagagtacattaagcgaaagactaaagaaaaacggagcgtccgtgacgaagagctgctcctacaggccctgttgacagatactggaacattggttgacctcaacagcgtggcccaaggctttctgacacgggaaaagcgtgcggaaaccagcaatatagcgttgagaatcccagctgacgataatgattcatatcaacaaaaattggatgaatacttttctaaattaagtgagaaaaatttgagcattcttgatgaattgggcatgacaaaattgaccgccgaaatcaaaaatttgagcgaagaggaacgtgcgatccttgaagccacaaaggaaatgggaacggaagcatggattcaggcgtaccgtgagatacgtcttgtttgccaatttaactatgacgtccatagaaatcgttttgtcctgaacaccgacccacggtacgttaaaaaggtcaaagtctcgcctcagctcgcttacattctcggtttcaacaacacggagtttattcaatctgaaaacgaggcaagattcatgccggacatgagcggtggagtgtcatccttccacgtttacacgccggatcttattgaaccaatgatgattggtgacgtcacggccccagtgttgctcatagtgaccatacgcggaaaccccgaccaagtagttgaagaacaattttttgccatacagtatcataaacttttattaaaggagttttctgaaattctgattgagatacgtaccaatagcggcatcttgatgccattccaatacggaacatgtacattaacattacactttagaaaaatgtcctatttttaaatgatgaacacgttggaaattaacaaaacattgacaagaaacaacgtgactcgccactactatattggctgttttgcagcagatcaaatacccgccggtgcaattgtcaaatttccccactgtatggtggttaatcttgaccccagcacatcacatggttctcattgggtgggcatatattgcgcttctcctttgcatttggagtattatgactcattggggttgtggccaccgcccagtgttcacattgtgaatcatttgtcacgctacaaacaaattcaatataattctcttccccttcagtctgccaactcaagtgcgtgtggtcgacatgtcattttctttttgtattgtcgatgtgttggaatgacctttgaaaaaattgtcagctttttgcactttggaaagatgcaaccggatacgctcgtaaacaattttgtaaaaagcataattttcaaagaatataaataatgtaaaaacgtcaaattaaaaaaaaaatgcatgttgattttgatcctctacaagtggattggtccacattctcgtccgagtatgtgcaatttggtggatacaacatttatcgggggttgccctatcagcgtggagcgggagttggcgcagtgttcagaagtcttatgagatatttgctgccgattggaaagcaaattggctccgcaattggacgtcagggaatggaaaccggaaatcgagtactcaccaatgtgctggagggaaaaaacctcaaagagtctctcgttagtgagagtaaggcaggactaaagaatcttctcgaaaaagcagccaacaacataaacactcagaagggtcaaggttttcattttaagcgatacaaaaaagactcggctcccaaaattggaaaaataaggcgaaaaaatataaataaacttcaatcgtcaatcgggccaccaatggttgataagaccaaaaataaacgtctgcgtgttgactcattaggaacctattaaaaaatgacttgcccacaaaaaatcagcgacagcagtccactagcaattaacagtggtctgaacattttctcagttccaccgaccaatgtgtctgttgtgcgttctttctttcgtcaggtgcttccgctagcaacaatcacgcaagaatcaccgtacctgtttcgactgtacagtgacaatttgtggactgatttatctcggatatatctttatctcgaactgtccattgaaaaaccgggagcaaacgataaatgggttgcgatagatgatgcggatactagtgtttctaccattcaagggattggtcaaacatttgtccagcaactaaaagttacggttgacaatacggaagtatacgatagcggaaacctatacccattca

SEQ ID NO: 6049 - DNA, 3222 bp, Heterodera glycines
ctatcagcgtggagcgggagttggcgcagtgttcaggagtcttatgagatacttgctgccgataggaaagcaaattggatctgcaattggacgtcagggaatggaaagtggaaaccgcgtcctcaccaatgtgttggagggaaaagacctcaaagattcgctcgttagtgagagtaaggcaggactaaagaatcttctcgaaaaagcagccaacaacataaacactcagaagggccaaggttttgattttaagcgatacaaaaacgactcggctcccaaaattggaaaaattaggcgaaaaaatataaataaactgcagtcatcaatcgggccacctatggttgctaagaccaaaaataaacgtctgcgtgttgactcattaggaacctattaaaaatgacttgcccacaaaaaatcagcgacagcagtcccctagcaattaacagtggcctaaacattttctcagttccacctaccaatgtgtctgttgttcgttcattctttcgtcaagtgcttccgctagcaacaatcacgcaagaatcgccttacctatttcggctttacagtgacaatttgtggaccgatttatcgcgggtctatctttatctcgagctgtccattgaaaaaccgggagcaaacgataaatgggttgcgatagatgatgcggatactagtgtctctgccattcaagggattggtcaaacatttgtccagcaactaaaagttacggttggcaatacggaagtatacgatagcggaaacctatacacattcaaggcttatatcaccaatgagttaagctttccaataaatgccaagaaaaattttcttggttcaacagggtattatcacaccgtaaaccaagatgactcaacagacgatgggttcaaagagcgttgtaaaattttcaagggtggaaaaaatgcgcaattcctctcccgtctcgactttgatctgggaaaccaagagctttatctcttaaataatttggacttgctcttcacaatttacaaggccaaagatgtctttcttttgcaaacattaaaagcaaatgattctaccaaatatcgtttgacagttcacgatgtcaagatttatgcaaaaatggttgaggtccaaccctcactaaacatgagcctttacaaaacccttgaaaaacaacccgccacatacgcagtacgcaagaccgaaatcaagtcgtcattcatcagtgttggtcgatacgaatttgagtacaatgtattcagtgcaaccattcctcgacgtgtgacaatagcgttggttggaaattcagcatttcatggtgactacaaactgagtcccttcatgtttgagccgtttgatttgcgtgagatttcggtacatgctggtggcgtagtttacccagctgttccttataaactaaatttttcaaatgatcactttgtcagcgcttttgttgacatgtatgaggcactcggaatggctaactcggaacgttcatttgacatttcaatggcccagttcaaaaaagggtggaccttttttgtcattccattgacttccacgcttgacgacagctgtggatttgagctgttgagaaacggtacgacaaacgtacgagcaacattcaattcaccaattccgcatggtggtgtagagatgattgtcttgggtgaattcgatcaaatgattatggttgattataaccggcacattgtgaccgactcaaagcttgggtaaattataaataaatacataaatattattacataatgttaaaatgaataacaccaacacaacgaaaccggccatacaaattttgaattccccagaagagcctaatgaaactcttttgcatgtactgcttttttctcattatcttcttgcatttcctgtgtttttgcttttttggttcgttttaattaggtggcttaaaagtcacgggcacctctcgcccagcgaggccgagacagtaatggaagagatgaaaaatatacctcgacaaccaccaatatttttcgcaacaaaatgatgcaaaggttagagaaaacagacaatgaactcgctcttcattatgacaaaatcgataatgacgcatgctggcggtgcattctcaaaactactcattcttttcatcattcattttacaaaaaatgtctccaaatgaattttctgaccgtccctttcaacaacccgacaatgttcaaactgttcaactgccgcatcaacaaccggatccagaagcagagttgcgggcacaaattgaagacgcggaggaggatttgctcttgaactggtggcgtgaagacccgacaatcgtaagcttgtttttcaatttatcatttttttaaatttcatcacattttttcagattcgttttctatttggacaccgtcgagcacctaccatcgaagccgcgcttcttcagcgcgccgaacgcgaggccgagattttgcgccaatatgccgagaaccatcaatgaaaagggaggaccaatcagttatcattttcgtatgtgtttttttttcatttttgcaattttaattatgataaaattttttttaaagtgtttagcaaagtacagaactgggggtgggggtgtctgagagctaaaactcgcatagcccttgtccgattgacttcaaatttcataggccgtcattccaccaccacctaagctgaacggcgaaagaatttcgcctctggcaccagtttgagcgaaattttttcccgacgccccgccccctcgcgcatgcgcagcaaaactagcgcaccccttgtccgattgacttcaaattttacaggccatcattccaacatctcctaagctgaacggcgaaagaatttcgcctctggcaccattttgagcggagtttcccgacgccccgccccctcgcgcacccctcccccatgcgtagcaaaactcgcgcacctcttgtccgattgacttcaaatttcataggccgtcattccaccaccacctaagctgaacggcgaaagaatttcgcctctagcaccatttcgagcagtactttcccgacgccccgccccctccccccatgcgcagcaaaactcgcgcaccacttgtccgattgacttcaaacttcacaggccgtcattccaccatctcctaagctgaacggcgaaagaatttcgcctctggcgccatttcaagcagaacaatccccgaacgccccgccccctcccccatgcgcagcaaaactcgcgcgccccttgtcc

SEQ ID NO: 6050 - DNA, 1100 bp, Heterodera glycines
ctcttcagattgatgcaatccgcatgggacatcgctttcgagtacgcccattcgcggattgcgttcggcaatccgatcggcaatgttcaggtactgttttgacttgtgctgctgttttgcgatacccgcatcccacacccccaaatcccgaccccactccatcccgcgcaccagcccccatcccgaacccacctttcccgacgcacccccccaccccaccccattcccgtcagagacgcacacacaaccacccaataggcacggacccgcccagctgatcctctctcccttcagtggagaaaatcaatcgataattcaagtagtcttaccatgtagtaaaagtttattttgaaaaaaagactttacaaaataatacccctgggagaagggagtgggaaacatgatttcaaaattttcaattttttctagtctaatctactcaaaacggttcagaattcaataaaaataatattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaa

SEQ ID NO: 6051 - DNA, 1958 bp, Heterodera glycines
  misc_feature (1243)..(1243): n is a, c, g, or t
cctcatttagtttggtctgcttcgccagctcctctctcgcgtatatgtccgggtagtgggagacttggaaggccttttccaattcggccaattgttcttggctgaacgttgtccgatgacgacgacttaactaagcaaattacgtgaatgtgttaaactttgatattggtgccaatttgttaggtatttttgtgttaaatatgaaagtgcggaattgccaagattgtctgtcagccgaatttcggcactttccccccccccccttaggagggtgacacttatttaataaggtcttttgactttggctgctgtttccaaaccccaaaatcgaagtgttttccaatgcgaattaaggaatttctccttctgactttggcatgggactaaccgagctggtgcggatggatacgaagaagagtgactgaacagggaacttcctcccgtgccaatggatggcgtcggccgaggttcggctttgatgcgttttaaggccgattgttggtgagcagcaacagacaaagcggacgacgaattggacgtggacgattcttagggggggggggggggggattgaagacaaatggggtgaaagagggattttggtaaaaggaatttggaaaatattttgtggctcaactccctcaagttgggagtgagtttctttcttccttggccacatgaatccaaatggaaatgtgctcaaatatcaaaaaaattaaataaaatggacttttgaatgtttttggattgccaatattttcgaatgccgatttcgctttcatttcgaatgccgatttcgctttcatttcaaatgccaaattcgttttgtctcgtgcccttctcacccaatgtatgtccattgatcgcttgtcccagcccacaattgaccgccgtcgtagcagctgataaaacgttgtgcccatcgagaatcggtcgcaaattggcggcggaagcgtagtgattgtattgggaaaagtcgggcaaagtggccggctttaattcctcaaaagaattgcttaaaggagtgaaaagtgaggggaaagggcagccaatgatcggccgcggaaaggccaagcgaatgaatccttccgaagcggcggcggaaagatactcaaaaggcctctaagcggccaagctcttcctgtcaaaatcaaatttggtgttttgtacaaattggacaaaactcaatttggtgccagtgaattatgaaaatgcgtttatgcgcccttccgccactcctgcncgggggctgctcccattcctctcaaactcccccggctgacatgcgacccatcttgtaacgacttccatttgcatcgacgtgccacgccatttgaacacaagctcgcccaggacagtaagggggacgttttgggcatttccagtattcccagccttgctcgattcgagagtcgctctcataagcatattcgaacacaagacgagaaaggagaattttgccacggttggatttcgcttcttcaaatcgaacaagagccatttttggttgcagtaaacgaatgaattttcatatcgttcatttttatgcattgaaaaaactagataaggactaaacaaatatgcaaataggcaggcactcgagaacgcatgggaacgatggcgagataagaagtttgagaagtaaatttactaataatattcaacagttttaaagtacaatttcttttatgtaaatcatttattaaagtacaaataatcacttattttatctagagttaccatacgcaaaaagcgataaatactgtattaaagaatttgataaaaatgaaaaaattttaattttatggatccactgacgaaaatattcactgccgaattggaacactgacgaaaaaaatggaaaacagcaaaataaataaaaagtagtacactgacgaaaatgttcactgacgaaattatccgctgacgaaaatcactgacgaaaatattaaccacga

SEQ ID NO: 6052 - DNA, 2113 bp, Heterodera glycines
tccccctcccccgcttctcccccagtttttccctcccccgcttctccccctcccccgcttctcccccagtttttccctccccccttttttgctcttttgccaataatcaccccctccccttcattctttctgcaataacactgctcttgagaatatttgccgttcaaaatgaacacaaaaggcaaagcgcggcacttgaccaaacgccgcagggaaaatgcagcagagatttggacgatactcaaaatacaataatattagaagaacaaattacaaaagaagaaaaaacagtcgacccaacataaatttacaattttattagaagaaaactcttttgacaccaaaattgacctttttctccaccctttaatttcatagtaaatcctccataataattgatttaatcatctatgaaatccatattttaattaagcataatcccttaattaattgacttgtaaacatccaacaaaacacattcatttagtccgatttgattgtacaaaaatattaataacagtggaccattcgaaatgacattcatttgcaagtgccaaattggctcttttgttgccatttgcccgttcgtcgtctttcctctcgcattcgcttctcctttctccacttttcgcttcgttcaccgtcttccgaacctcaacggacgtgggccgaggcttccccgttttgtgtcgtccatttgtctggaggacaatttgcttagccaaattagccatgccattggctgtccaaccttttcacttccactgggaaaagaaagtgcggaaaggatgagaattgcaatcgctgcgtttggacttctccgccccttccgtttccgtcccattcgcttttcaattgttgcgaattgtcactgatttgatcaaatggaaaaggttcgaccatttgcagttcgggcagcacattagccactgaatttgagcaattaacaaatgaaaaatcatttaactttttgattgaccaatttgtgccgaagtgccaatttttccaaacatttgccgactttgggagggcatttgttggaggggaaaagaggagcaaaatgagcaaaggatggcgaggaaaacagagaacaccagcagagataaggattggccggaggacatttgggacgacacggagagtaattagctaataaaaagcaaaaattgaaaaatgcaaagtaacggaatgaatgggtgggacgagaaatcggccgttttattcaaaatatgacggaaatgaagaaacaaaaagggcaaattggcatttgacaaagggcgcaattcgaattcaattcatcacacagaacagggggggggggaggaatcatcagaaaaagcggcggaatgtttgagaagtgccgtcatccattgaccatggccggcggaaatggcgaagaaagggccgtaaatgcaaaatgcgatggaaaatgaaatcattcgcctttttcatggcacgcaaaatgcttcagaaatgaacaaaaaaatgagcccaactgcacaaacactgagcagagaatggagcacgattcggacaattgccttctcattttcgacctgaaaagaatttaaatcagacgaaagccatggtcaaagccaaaagggcacctgctcaattggccaattcaaataggggaaagagaagtccaacacgcgttcgcagtgctcgtacgtcccctcgggcattgcacaaaatcggagtacgccctgctcgccatcgcccttcagcagtcgtagtgaaagtggcaaaagttcttcattctttgtgcggtacggataatgaaaggtcgttcgatttggacgattggcccaacagaaaatggaaaaggagcaaacggagatcaaagaagtggccaaagcaaaaccgacttaaaagcaaaatttgatcggaaattgaagggagagggagaggagaggggcgggagaaagagagatagagaaagagggggagaggaatgggaggagagagagagagagaggggtgtaagagaatggagtggagaggagggaaaggaagagaatgagaaacaaagcaaaccaatggccaaaaactgccgaaatgcgaatttgcccgaatgggacgtcctgctgctgggaagaagagcaaagatcag

SEQ ID NO: 6053 - DNA, 2852 bp, Heterodera glycines
  misc_feature (53)..(53): n is a, c, g, or t
  misc_feature (55)..(55): n is a, c, g, or t
  misc_feature (59)..(59): n is a, c, g, or t
ctgctgctgggaaaagagcaaagatcagcgagccataaaaggagagggacaangnaagngaagaaaaggggggccctataaagggaaatgatcagagaaagaagcaaaatgacaagagctaattgggaaaagaagtgcatgaaaagaaattgagaaaatcaccaaaaaggcaaagccaatgtgaggaagtgaggcggaatctaaacgaacggcacaacaaattgccaattaaattaaaccaagccaaaatcaaaaccgatcggaacgcgcactgtaactgaaaagaatgatgccagaaaagaactgagcgatggcacaaaatgtgatgagagaggagacgaagagacgagccgaatggagggactgctccaccggggcgggactgaccttctgcacaagataaacttgcaaatggcccaaaatgcgatcgcattgcatctgaagagcaaagggaaaggaccaatcggaaggagaggagagaaacaaaggacttggtttggggtgctgcgattcagcaagccggcacagaagctgagctgaccagcacgagcatggactaattaatgggaaaagtgagcaatcaagaacaattaatctgattgagtaatagtgtgaaatgaatggcaaacccctgcgaatgcacacattctcaaagagagccgtaagtgaaagacaaaaggcgaaaaaggcggacacaaattggaggaggagctcacacctgacaaatggaatcaaaaaacaaagacgaagtgatcgagtgcaaaaactaatgacataattaattagcttatacttatttggataatccaaaagaagggcatagactgaagtaattgcagcagaaatgccggaccaaaagctcagatagaaatgggcgaagggaaggcagaaaaacacgtgggcaagcccaacaatgaactccaactaaattaagaattgagaggaatggggaatcagggatgtgcgaaaatcacaaaaaaaaattttcgtatacgaaaacgaaacgaaaaagggcattcgacacgaaaacgaaacacgaaacgaaaaaagaaattttgaaaaccgaaaacgaaacacgaaacgaaaaaattttgacggacgaaaacgaaacacgaaaacgaaaaaatagccattttcgtacgaaacgaaaaaaccgaaaattttttaaatatattcaattttaattaagaactttaaaattgtatcctctaactgaggaaattaagatcctagtaggtggaaaagcggatgtggctctaggacaggggtatgaccgaaaaattttcaaaataagaacatcaaggacaaaaaattattgaaaaattttacgaaattggaaaaaaatgttttttgtgataaaaactcaaaatttttacgattttgaatagcatttcgttcaattttttatgaaattctatttaatttccaattagtaaatttcataaaatatggttttattgattaaaaaacatttcaaaaaaccctgatccgtatacgggtccgtatttttcctgcatacggacttatacggagtaagggtcttccgggtttttagtccgtaagtctgtagtccgtatggatgcctagtccgtagtcctgatccgtatttttgccgaatgtcgccgctctctagaaaaaattatcaacatttcaaactttacatacaatttcctggcagatttaatacaatacttcaagaaatatcttattttttcttaccaaaaaagtcattcttaagggtgtaaatattttcgtctttttcgtccaattttgctctgacgaaaacgaaacacgaaacgaaaatccaataaaaaccgaaaacgaaacacgaaacgaaaaacaaaattttgaaaaccgaaaacgaaacgaaaaaactttggtagacgaaaacgaaaacgaaactaaaaaagtgccgaaaatgtaggacgaaacgaaaacgaaacgaaatttcgtccatccctgattgcgatgataagccaccgatttgactatttcgttgacgaacatttcaaaacgcgcaaatggacattgggcaaaataaaaattctaaatggggcaaaagaaatgaaaattgtcaattattccaattgggaatcgctgccgatcccacaaaatccgttgccgaacaaagtcatcggattcggaagcattgttatctagtgaaaaattaaatttatagatgattttaagcattacatttaactgatcttcagctacttcgaccaaaatgtgctcacttttctccgccgtttttaccgtttcttcgcctcatgttcaacaacattgttcattcgcactgaaaatgtgcgaatttcggaattcattgtgctcaacatttggccaatgttcaaggacacgactattgtgttggattttgacggccgcaactttccgtcgaatgcgccaattggccccgtcaatgctcaacgaatgtccatcccttcatattattggtttcagttgagcattttaaccggatttttatctgacgacagtgccaatgcgtcggatgaccaagtgtttccaggggttttcggggccgcgatcatggatggatacgaactcgatttgacgcatttcgaaccgctaatcagaaattctaacattttttgaaaattttgttttaaaaatcggttttaaatataccaaaatgcttgctccatgattatccgatgtgttgcttatattaattgttcagacgaagcattgatgcatttattaattttaatataaatattatatttttttggagaaataattacagggctccagttggaagggacgattgactcgtcagaatgcacctcattcaaacacgaaatgcactctttttgcattcatctctgttctcc

SEQ ID NO: 6054 - DNA, 4432 bp, Heterodera glycines
tttgtattgtccccttttttggcgccgttttcgtccgatttcacccgaatttcgaattcttccgaagcttttttttgcccgtcctcataattcgaaggttcgaaatgaatgtcgagaaaatccctcgacacattgttcatattgatgccgaaaatgctgaccaatgaaatgagtaagcattaaaataattatggtaattaatcgtttttttgccattcattcacccattaagcgccacaaaagagttaagccaccacggaatgcacgcgttcactttctccttcaaaattgcgtccacgacacttttggcacactcttcaaccgtcagaaagggcaaccaactgattaattgtatggcatttgacattgacaatggcattttttttttgctttttttttgtcaccgtgccaccggacggagtccctttgaagtgaccatcggagtgcgaacataaaatgggtaaatggtcgtgcagagaatgtcctccagcccgcgttccctcagctccacccgaaggcattccatggcgccacgcaccgcaaattttgttggactgacacaaaattattttttaaaatattaaaaaaatatatctctaattacaaaaatacttttcatctttgcccattgaccacctgtacgccatttggaacacttcgccaaaatgtgaggcgattgagcccatcgcgacaatgtgccctttgccccgggcttccatttcgggcaaaaagacgcgaattgtctgacaaaaagccattagcaattgggaagagaatggaaaatgccaaattggaaaagggaaaaaggacaatttaaagcggggccgggactaccccgagaatttaaaagtcaaaatacatcactgattaaccggttgatcagtgctcacattaatggtgcccatcgcatttacatccatcgatcgctgaatgtccgcgtcgttcagctccaaaatgggcacaacgtaaagcaatgccgcgctgcacagaacaatgtccacgcgaccttttagctaatgattattattatcattatcattcagcctaatcttttcaaatccaaaatagtaaaaaaaatgataataatttaaacaaaatttcacaattttttaccaaaatttttttgtatttctgcggcacagcgccgaatttcgtttgcgtccgaaatatcgcatttccatctttcaatgtttaggtattatgttttaaattattcttcaattttaaatttacgcttttgccacgccgccgttttcgcatattttttcagttactttttttgcgctttcctaaattttaaggcattttactcttttaaatttttttatgttttaaatattttcatggtcgtgttaataatgaatttcgattgttttcccttaccaaattaatgtcaattatcgcaactttggcaccgaaagtccgcgggtcggccaaaagttccgcaattcgctggcccttccattttcattatttttcatttatttttttattttcttacaattcccgaccctccgcctgtattaccaccgtttgtcctttcaccttttttttccaccaacggaccaatcggatgaaatccttcacaaacatttaaatggcaacaaaatttaattgagattacttttggaattgcgacaagaaaaagttgaagcaaagcgccgaaaattgtcgccgccaattgccaacaattttcacgagaattgtttttgggacttttgctcatttaaaagagtattccttttttattaatacggtttatcaccaccaattaaaaacaaaataattaattaaacaagaattgccaaatttaaatatttaatttgttattggagggcgaacaaattaatgaatgaatgggcgggaaattgcggtatttactgctctttctctctctcaactcccataaacggaaataaaaactttaacaaaatgaactcgtggcaacgaattggtaattaattattatttgcgaatgatcgttttacccataaaacaaaattaaactatgaaaaatcagaatttgatcaaatggaagaggaggaggccgtaaacagcacaataaaaaaagcaaaaggaaataaataaattaaaaaaaaagaatattatttatttagtaattaaataattcaaacaaaaaaggaagcgagaaaagaggaaattatcaaagcacttttggcactttttcactaattgcaaataaaacaatggcatcgatcgcattaagcattttgtacgatctaaaggtgaaaaaagatcaattaaatcaaaaattaactttttctaaaatatatgtaaagtataaactatatgtccatcaaaaaaaagtgcgcaataaaacacagagatcggtcggacggagaaatcaatttgaaaataaaactgaaaaacgacaaattaacatcgtatcaatgaaaaatgaacgaattttaatatgtaaatttgcaaaaagtaaaaaggaattaaatggaaaagttatattttttttatatcaattatcacttggttcaatctgatgtcaagtcaattttttttctaatttctattttagaaaatttatattaaaattaaaaaaaaataattaaaaaagaagaaattaagcgatataagccccccccccatacccatcagcaggtgcttacaccactctctttgtgcgtaaattaaaaactcatatgaatctttaaataatttatatgcaaaaggggaataatcacccaaaaatgctgaatacacggaaaagcattcactttaatcttcattggcattggcaccgtttctgcccttccttggctctctgtccatttgctttatcgttcgttcgtttttctttttgtgcctttttttaactttttttaattttaagtcctttcactcattagcataagtctctttactctttaatgaacatcagtggtgccgttttgtcctttcattttgccaataattcgtcttcttcgcctgaggcgacccccgacactaccgtagccgctctgctggtgggcaccgtagtcgagctgcttgtctctgtcatgacggtgcccttctccaccattaatctcgtggtcattggcagatcgtcgttgctccaccccaacctgaagatggtcctcctatggcaaagtgccttcattttgctggtccgccattcctccgcccccaattagccaacaggacgggccgagttttgacactgattcccttttaagcggggcattgtccgtctgctgatcggtgtccacaaattggcactgattgatccctttggccccgaaatgttcgctccgtaccgtctcttccacgtgttcaccttcttcaaccgcaacttcatcgcccatgtgctgctcattgaacggttcatggccaccgcaatggtcaaaacgtacgaaacgcggcgcagttggctgttcacttctgtttggtgcactgccgtggtaagcaatcgcaaatggacaattgccacgggaatgtttgacactttgtgttgttgttagaccaatgctcaaaaatggttgacacaaaacataccgtagcagcggaatattgtgaaacagggtttcaacataatgcacactgtaatgggtgctacagtaaatattttctcacccaaaagttataaagcaaataaccattatttatttagcgaattccgtttaattttccgaggttttccctgacaaatttttgtttttttttcgacttttgagtattttcaattcaatcgtttgctgtccgattcaaaaactcgagacctgagactgaaaaacgcgagacttttttccgagtcgagattcacaacataataattactaattgtccctcaatttgttttctgttcgctgtgtccctttacaataccatcgaattgggccaaatgttcgccaccttcgccagccttctcaccgagtcattcatgcttttctttggcatcgccgaatggcttattttcgcccgactttggcgcttcaacgagcaaaggtacaaactgagcatcgcaaagagtgagcacaatctctcggaaaggtttcaggtaagaaaaaaagggggggggggaaattaaaaaatgaaaataattggggaaattggcattttatgcaaaaaataatttgcgaattcgttttaataatttaattttcagttgtccgaaaacattcggacgggcaaacagctgacgccaactttgtccttccatttttggatgctttttgccagtgttgtcactgctttttggagctatttcgactttccccgattcgaccaaatttacttggccataaatgttgcgaatggcgtcaccggactgatcatcgaaacactgatgatcacgtgggtctctcttaagtcatggtttggcccaccatttcattttgcttgacgtattccattgatcaaagcttatcgccgggatggaccattcccccccccccccccc

SEQ ID NO: 6055 - DNA, 865 bp, Heterodera glycines
ccgggatggaccattccccccccccccccccccctcccgaattgtgccagggatgaataaggaatttcgtttcattttttgattgtaaattgccaatgtgccgcaggtgccatcccttcctaaaacgcgatgctctcttcaccattcatcgaatttttgcgatcaaattgcaaaagaaccgcgtgcatgacgaaggacaagcgatgaaaagtgccgaaaaagagggcacaaaaagcattgcgatgcgcgatttgatcagcggaaagacaatgatcgactcatcgaagagccaaaccattcacttcgacgcacttcgaaagagttgggaggaggccaaatgaagcgaaacaaaaacaaataatataaaaatgacggatgcgtgatttgaatattttgccaaattgacaatggcacgggaaaaaggccgggtattttatggggggggggggaaatttggacggaccaatttaagcatggcatttaattattttgcgattgtacatattatatttacatatataactttgggaggtgccttcacttgtgttgccattcttcgaatttccgctgtctttgcgcgtcaaaattccctccggcggtgcttttgccgtggcggtgcctttcttttggcccttttcttacgacactttccctcttctccactctctctctcttctccccgtgtgctctttttctgcactttttctctgagttgcctctctctgcgctcttttctcctcagttttcgcgcaatgttcgccggcactttgtccgaaaatgactccccccatggcggcaaattcggctgctgttaattatggggagagggggggggggggatcataaactaattaaaatgctaatt

SEQ ID NO: 6056 - DNA, 2026 bp, Heterodera glycines
ttttggtaggtcaaccaccaaaaaaaggacttacgcccccgtcacgggcaatgcccgattctcccagtgccattgccattgtttgaccacctgaacttgccagccgagcagggcaaattggagcaaacagtacaactgcagagaaatgagacaaaatgcaaaaacaattggaaatgagaatggcacgcgaaagaaacaaaattaattttaataaaagttaataatgattaaaattgaatccgctcacaatgttccaaatggcaacggcgatggagaaacagcgaaggcaatggaaagggtcgtggcccacaacggcaacgaatcgctcgcggggataatgcaaattggcattcattaatagggcgaggatttttagtggcaaaaaatcccaaaataattaactaaatagtgacaaaaaaatggcaaaatagtggcaaaaatagtggcgaacaagatccaaatttaggggtgtaattttttaaataggctgttttttaatttgaaaataatttaaaataaggcaaacaactttttcactgattgcagttacaaaatattttcttagcaaatattgaacaagaaaaaaaaaatttgggggaagaatttttgtgaaaattttccaattcttaggggtgtatttttcgtttttattgcattttttgggaaattttccaaaaaatgccaaaatagtggcaaaaataatgacgaaacgccaaaatagtggcaaaaaattattttagtggccaacttccaaaataaattttttttagtggcaaagctccaaaatagtgattcctagtgatgaatagtggcgttaaaacgaagaatttccgagctaaaaatgtgtttttcgtgcatttctcgttgaaataaagccgcagaaaaatagttaaaaaactaaaaatcctcgccctattcattaggatgaattgaaaacggtgagaaatttatagaatttaatcgtttatttattttaattttggccgtaaatcgatcgattggtggcaaaggaaaagcaaaggaaagggccgaaatatttgcgaaaggacgggacgaaagaaggaatattttggggagaaatggacaaaaattgcacaaacattgcgggggaaagataaaataaataaaaattatattttttaaagaaaattgacaacaacatatttttattcactaatgtaataattaataaattcgtttggcatgccccggggcaatgtgccgttgctgacacgggcgaacaccgtggcggtcaacagggcaatgtaatgggacgcattcatcaccaattgggccgcatttgactgggggttgaggacgcgcaacgacgggggcaaaagagtggcctaagggaaggtaattaattaattaggtaattagtcaaatttgagttagtgcctttgtaaaaaatttacaaaacactcaccaatctgttcaattcgcgcatttcctccagtgaaagtgacttttcgctatccaaaggcgtggcacgggacgaatttggcgattttgaggaggacggacaaactgaaaaggggataaaaatgaaataaggaaatggaaatggtattatgtaaatgaaagtacagtaatttatcgtacagtaaccaattggcaaaaggttggtcttcgtctgcccaattttgctcaccttcttgtccaatgctccgtcggattgccattgtccgtcgacggcgccgttccctttgcattcgtcggccaatgccattgctcaaattggcagtgttttcgcgcgaccgggccaaaagacacataagaagttgattaatttaaatggcatttgccccaaaatgccatttattcagtgccctccattccccgacttcacagctgcacttttgccagatgtatatgctcgtgaagagccaaaatgaaggcaaaataagaggacaaaatattattttgtttgttcgtttcttttgctgtgccatcccggcaaaatttaaatattttttcttttttctgcagctgcactccaatggcacagatgtgccattggtgtccg

SEQ ID NO: 6057 - DNA, 953 bp, Heterodera glycines
ttaacattttaaataatgttttgttttttccttccttaccaattaatgattggcactagggttatgccccgaccccgagccccccgaccccgacccccgacatttttgggacctattccccgacccgacccccgacatgacgccccccgaggtccccggcccccgactttttgcccccgaccccccgacactaattcgggggattggggactccgagcgttttaaaaatttaaaagttatgcaaccaaaacatttaaattttacctatcactaagccaaaataaaagtttttttctcactcttttaaaaaaattaataatatataatttgccaaattacggtggaggtcggtttagtctggccggtttagtcagagggtcgttttagtctggcaagctgtttttgtcctacattgatccaattctgataaaatactggtcttaactgtaagcttgccttacactttcccattttcatactgccgtccttttggcattctgtccaccatgtgtagtaagcagtttgttttatcaaatttgtttgaaatttgcttgttctggcttgtttgttagtttgttacatctatcttcctttttttatcccctttctcagatttcaactcactcagctttttttcatcatggtcgtctggaaatctctacaaaactatttttgtgttatcagcaactgggttgcgagcaaaaagaagattcttgcatgtgaggatccgccgcaccaagatcttgcgtcagcaatgcgagcggcagggcttttgccgggacagaagctaactgcgtctgcattacaggagtttgaatttccaatcaccgaagaaacgtttattgactgctttgagcagattcagagtaataacaataatttcatttttaaaaatttaaatacgtttttcaaagatcttggcttatacaatggccaaacgcctaaagaactcc

SEQ ID NO: 6058 - DNA, 2105 bp, Heterodera glycines
ctccttcggcgctggaattgccgacgtacgctgcacccttaggagtaccgggctgtaaggaaggggctgtacggcacgattgcgtcagcagcagcagccgcagacatggacgaggagcagcacgagcacaacattcgggcgaagaaggccaaaatgatcgatctcaagacgcaaattgcggaagcacaccttgagagtatcaagttgcgcaaccgctccatggagttgcgccacatacagatggagtgcgacatcgccaagaaaatctcttgcgtcagcggcaaaagggtgggaacaaatttaaataatagtaaaatgtgagcttgttatctttctgagggattttgctcatgatgctaacaggaaagaatgcttacagttgatttttttaagaagtttgatatgcgtgtcagagaatatgctgaggaatttctggaagatgtgtcttctgacgaagaactccatgatgagacctttaccgacgaccacatgcagcatgaggtttcgccccaggcgtcagcaccagcactgaacagcggcgatagtgatggcacaagctcagctgtggtgcaggtgcgtattgatccgaacgtgtcagcagcacagcaacagcagcagagcaacttcggctgttcgaacagcaccggtactactagcgcatgccaatgctagtaggacagcttattgtgtggctttcagctgcagacgacaacaactctcacgtgtcattggtgtcaaccctatcaacgactccaaatgcatcagagactacgggcggcgaatacaccatcgatgagtcagagacctccggggaaaatgaagatgagggtgcttccgtaagtcttatcttagtgtaagctaatttttcatatggtagaagatggagcctagcataggaatttattgcttacagttgcacatatcccagctcaaaaccaatcaatgttcactttaaacttgtttaatattcctagtcgacgcaagctccacctgtgtcaacgaaaaaaagggtatcttttaatagcactattactgttgaagaatatgtcgcagcaattcctcctccaccaccagcgcaccgccgccggcgccgcccacggcgactcgtcgctttcctccgccgtcacaattcgctgcgaaccttttggtgtgccacaccacgcgccgtactgtcccagcagtgtgccgcccgcaaaccgaggggacgaccatctccatgaaagtgcgttcaggacaacaccccaaaaagactaaatatcgaagggattgttaggcctgtaaccagaaaaattttgctgaaggggggggggtcgaaaattttatctaaaatttattaacgaatttaagccatggatgtgtcgctggcctccgtcgcgaaggacctcggcttcgacggccacgacctgaccgacatgttggccaaactgccggtcgaggagggcttcgagggcgacatggacccggacgaggacaccctgctcagtaattgcccacaacattgggtggctttccagtccaaagtgtccccatgcttagcagacatcaacaaggaggactcggacgaggcgccccccggcacaacgctgggccacagttgggccgacgtggaacagtttctgctcgagcaggaggagggtctgcaccaaccaactagtcatatctattcaaatccgatcgatactcaaaaatgaacaaaacacacacactttgcattgtaaaaattgttgatcatttttccaccgatggacattactagggcgtcaaattatatggaaatccatattttttttcctggactgtgggaggcctgaaacgtacgaaaaacatgtttttggcttggtttgaagcctctaggacgtatttctatacccatatttttccatattttgcgatttatatccatatttgtccatattttggcatttatgtccaattttatgcccatattttggaattttttcaaaaaacctctaatagaacggcccccaacaggcaaattggccttttgacctcaaaaaccagaaaattttccaaaaataattttttagcaaaattttcacgaaaatattgaataatttaaatttgccgacaatcggatgagtttt

SEQ ID NO: 6059 - DNA, 2772 bp, Heterodera glycines
ccctagacattactttcaccacctttccgagagaattaaaaggttcaaaattggctgaccaaaaatggggagaacgagaatgcccaaaaccgctgattaagcccaatgaaaatgcagtggaattgtaccctaaggcaattttaatttcaaatattggggctcagtcactcctttggtttttggcagtggcatgaactattcggcgatcatgtagaatgtgccaactccaactaattgtcgaatgagtgattccattgttcgacgtcgctaaactctaagcaccattctcgacataagttaaccacgactctcgagctgttgtggtgagtgaccaatgaacgaaggaagagagagtggagggaagaaagagaagacagcgcaaattagacatagaggggaattggaaatagtgcatcgccggtcaacaaatctcactctcccctttccttagcctaacactatttcttttctctgttcttctgccgtggcttttccccttttatttttttatttttctttctctccaacaaattagcgtaaacaaaaaacactctctgcccttttccctttctccaattgttgccaatgaccaaattaatgatttttattttttatttttatatgaaaaattcttaattttggaattcaaaagattaaaaacgaatttaaaatatatttaattgacggtacttgtaggttttgtcacccccttgaaatttttctaggctaattttttgtgctggtcacaaatctgacgttttcttaacaataacatatttccatatgttatgtgttaaaaaaaatagaaaatgaagaaattaaagaatgaaacaggatggataaaggcaaaacaatattttgtagaatattatcaaattcatcaaaattttaaattacttaatttaaaaaagagcataataaaaacattaaaaaaaggatgttctataatctgtgactaatcgattggaaatgtattaatctgtgactgagccttgtatgagctgtttttaactttcaataaatatgtcatttggtgtttgatcattcattaattttaaaatgccatattctttcaacacgtaactcactgtatacacataatggtaaaaaataaaggtctaattcgagataagcacattaattagcctagaaaaaatatctaaaaaaattcagagggaggggggggggggggggtgacaaaacctacaagtacctacctacctaattgactatttaatattaattgcttccttcatttatttgcaaattaaaaatgtcgtgtgatgccgccactttggcggatcggattaagctgcttttgaccactgctgctgctgacgatgcggacgtgcattttttagtggggaaaggggaagaaaaagaggcgagtttggccataaaaaataattaacatttaaataatgttttgttttttccttccttacaattaatgatttactcatttgagaagatcaaaaagcaaatttcttgctaattagaagataattaaataaatgccattgatggcaaatccgtgctgatagcattttattataactaattgttaagcttctttctgcgcacaaattgattctgaaaaccgcttccgatgtattccaagcgatgtttcgcttcgatgccgcaaatgcaaaagagaaatatggtgaaaaagcaaaatgcatgaaaattataatttaatttaatttttgcaatttttggctctttgtcgaaccccgtggtggtcactgatgtcgcggccggagatttcaaagcgatgctcaaattcatttacacggacgaattggactcactgttatcatttcacttgtatttatttgctttaaaaacctcaaaatacagttacagcatgcatgggattcgaacctgagaccccccttttggtgactaactcacagaccactaagacgaaaaatccagcatacttgtacttggagcccaaaattgggccgctgtgtaaagcaagcatataattaatttgtttaattaaatttatcttttaatgatataaataattatattaaatgcaaataataattttaattagccaaaaaatacaatgtctccgctttggtcaaagcgtgcgcagaattccctttgtcaaagcttaacaatgtatttgaaacgctgctcaaagcccgctttattgaagaacacgtaaatttacaaaaaaaaattatttacaatttctatttctgttaattaatattttaacaatttccatttggtaatttaatatttaattagtttccaattttgctaatttaatatttaattaattcccgattttgggccttcgcttcgcattatttgcatttcattgacaaaaacgcggaaacgctgttctgctcggatgcctttttacgaattgatcacaaattgttgtgtgaacttttgggacgcgatcagttgcagacaaacggagagatttgcatttggaaagccgtaattcaattcaaaattctcacttttttaattttttgtcttttgccaggccctccgttgggccgacgcgcagtgccgtcagaacggcactgattgctcaacggagaatcggcgtaaattgctcggctcggcactttttcgaattcgttttccgatcatcccaaaaacggaattcgcagagagtgttggtgagcattggcaaaaatcacctcccaacttccatttcctcatatcaattttattttgttttcgcagttccgtccgatctgttgaccaaggaggagctgatcagcgtgttactgtaccatt

SEQ ID NO: 6060 - DNA, 1139 bp, Heterodera glycines
gcggctcaaatgtcggcggcgcaagtgtcggcggcgcaaatggcagcggcgcaagtgtcggcggcgcaaatggcagcggcgcaaatgtcggcggcgcaagtgtcattttggctgggcggcgcaactgtcgcggcgcaaatgtcggccaatcaacgcaaacatggaaaaattgaagttttaaaaggaattctttgagaaaatattttttgttttgcaaatctgaatattcaaaaaaaaaaacggataaactgtagtgaactccccgtgaaaaaaagggtcaaatgatataccaatcgattcgtcccgaggagcaaagaataaaccggttcaaaactcgaaaaattgagagatttcgcactctaacttttttttaaacgatcgaatccccacaaattagtaccattcgaaagctcttggcgagctaagtctaaaaatcattgtatgaagtcgaaccgcgccacctaaaaaccgacaagtataaaccggtggtttttgaaccgattcaaatcctatagtgccaattcagtaccaaaggtaatttttaattatttgaattggcggcgcagggaaactggtgcaaataggtcattttgtttattgcgctaaaaaaccgccgcacactcgactacggcggccagtaggtggggcgagactacgggctacgggagaagtccgcgcgtcgcgggtcgtagtcacgctccacccctgtttgtcctcacattttttgaaaaatttctttttcaaatttaattaagtggttcgggagttaaatatttaattcttcaatcctgattttataggaaatggctattgataagagtgcgcatcaaaagaaatttgtcggcactatttcggtggaaccatcagttaatggtaaaagaatactatgatgataataagtcttctataaaatgaccaaatcatttttcagctcaacgactccgacgcgaacagcagcagcaccagttgttggacggacagaacaccggcgaactcattcaacaaatcttcgacgaattaaatgcccagcacagttcaacaggtcgcattttggagagaaatgggcgtgcgttgttcagaattgccgaccatccggggacggagacgccgtgccatgtcccaaaagggcagcagtaatt

SEQ ID NO: 6061 - DNA, 847 bp, Heterodera glycines
  misc_feature (7)..(8): n is a, c, g, or t
gcaggtnncggaaatatggacataaatcgcgaaatatggaaaaatatggaaaatatggatatagaaatccatcctagaagcttcaaaccaagctaaaaacatgtttttcgtgcgtttcaggccttccacagtccaggaaaaaaatatggatttccatataattcccagccctagttatgagcaattttgtctgacactggggcgtacccatagtgctttacttcagttgggcgcgcacgattgggcgccagcatgtttttccacttattcgaaagcttaacatgtttagaaactttttctaagatattgcttcgcaattagacatttaccaaaaaagttatgctctattgcagttcacacaaccataaaaaaaagacacgactataaaatttttttttgcaactttagtgcaatccaaattaaacattattagtatcattcgatagctctaggagggacccacgcgtttcggcgctcccgtttcggcgctcccgtttcggcgccagctcgtttttccacttaagcttttttctttggcatccaaatccaacaatcttggtatcattcgaaagctcttaacatgctctattagccttatcaaaaacgaaaagtttttcaagcctgtaaaaattttattaagaaaaaacttcaaaaatttcgacttttcgtaattttcatgcataactgttttgataattgtctaatcgcaaagcaatagcttagaaaaagcttctaaatagattaagctttcgaacgacaccaacaatgttggatttggtttacaaagaaaaaagttatagccaaaaacatgctggcgccgaaacgggagcgccgaaacgcagtggac

SEQ ID NO: 6062 - DNA, 3422 bp, Heterodera glycines
  misc_feature (3349)..(3349): n is a, c, g, or t
  misc_feature (3359)..(3359): n is a, c, g, or t
  misc_feature (3371)..(3371): n is a, c, g, or t
  misc_feature (3397)..(3397): n is a, c, g, or t
attgggttttttttccaaattatatattatttgcttgcttttccttaattaatcatttatttttgatggctccaatgtgtaatgactttgccttctcgaatcgttattgtgttgctctgtgccttgctaatcaaaatgatctttcgctttcgcgtcttcaaaatgagctcctcgggggattgactgcaggaatcagcggccatcctttcaatcacaacgttcgttcagctttgctttgcactggcatttatgtgctgtactcacatgggaaggtaggacaatggccgacttcttgttaattatccttgttaagtatgccgaaacgtttggcaatttccttgccgatgcattaaggtcatttgtgcttccatgaattgcttctgaatatcgtttaggtcgttgacaaatttgcgttggtacgatgatggagcgattgacaaatcgaacagtgtgttttttgatttaaatgcattcctttaaaagtatattttatttattttttctaaaagtatattttaatttttttttccttgttttcttttagaaataaccatccatgagcagttcgcattcagttttaccactttgcttagcgatatggccgcacatttcccacacattcgttctcgcattatcagtgaacaaatatcactcattgaagaaatcattgataaactctttgattatcttaacaattcctacaatggacaccttggacccgttaagaatggcaaagagaaccaggaaatcgaagtgatgggtttgtttttctttcgcttgctaaattactccagataactaactcattgtcagttgagcttatgagaacgacttccatactcatcggccttttgagggcatttggcagatattgcaacgacatatcgtttccgctcatttcgcttatttaccctttgccgtacaatttaccaagaaaaccaactgacgagagcatccatcggaagtccaacgcgtgtcatgttgggtaagcaaaagggaatttaaattagaccgaataaaagactcaaaatttttagctcacaaattacccaattatgtagaatcacctcaattaaggatttaaaaaagatatcatactagcaataagacatttttgagttaaaaagcgtttcttttcgttttatttatttatttttttgtcgtgtcggattaaggaatgcgtttttcccgacaataagacactttcagattgaatactgattcttcaaattggttttggaacgaccaaatgaaaactgaaaacgacacaaattgttacaaaaagttgttcacccgacatggaagtagttttttgttgcaaagagaaccgtcatctgttccaaaatttcgcgtttgttttggtgaaattcaaaaaataacgaattgcgtaagttttattaatagagtgctcatttttcagcacaaaaaagcaccaaaattgcaaaattagcacaaaaattaaaaaagcgagaattcagcatgaaaaagttggacttaaagccctcattataacttagaaatgcgtttttcatgcgaagctccaagttagcaaaaaatttcagcaaatgctgcaaaatgggcacgctgtatattatatatttaattttattgattttaaaattatattcacaggtcaaaaagttactttctttggatttattgtccaaacttgattcaatcgcgggtcaagtttttctatcgtcagaattacgcaaatttccttacaaaaccgtttcggagacgctcattttggtatcagttacacttttgagagatattctaagcccactgtcaattggaagcggtgggaatgaagttctggagtgttttgctggcgaggtgattggtttccgaaagatttaaatagtttttgatttactttttgggacaattccaaaccctataaatccacttgggtgcatcgataataaatactctaaaattattcagctgaacgagttcgttctgtctttgttcaaacatggtcaggattccatcgctcagaaaagtcaaattgacgagcgcaacgcttcttccgtcgacagagaccgttctcttccacttaaacaacagattaatgataaagaaattgccgtgaatcgagtcaaaatgctggtcattgccaattctatctgtttggaattgatcgtttggagtgcggtggatgaaagtggtaagcaatggaccaattggagaatgggttcttttgtccatttcagacggggatatgatttgtgggacgatatcagagaaaatgtggctgccgcaccgccacgtgttggctcatatgcccgttaatgtgatggcactggaggcattgggcagtatggcggagaaattcccaactctctcaagcactctcatcattcgtcttctgagcaaatttctgactgatccttgcccaattttgttgaaaattgcctctgaattagtaagatagatgggttttggcttattctaatgaagtgccatttcaagaaaccgaaggatcaacaacaccaacaattaaatgcacgagaagaattactttccactcgacgaaaaattgggctggcaagtctgcgatctgctgcaattaattctttgtcgaggttggtccgttttgaagaccaattttacagcgccgtactttagggcgctgaagtcggcgttgctgatcgatcagagcagccttcaggcgtgtctcgccagtctctcgtcacgtctttacactgtcgcttcggagaatgataggtggggtaagaaataagccacttttagattacttggcgtctttagcaaggctcttttggtgtctgaaaatctcatccaaactcttggcaaattgggcgtttcctttgtcaacgatgcttcttcttccgaacttgtccttcaagtatttgtcctcatcgtcctgtcgatggacagccaaaaaattctttgttcagatatttttgcaacgtttttcgaacccaccttctcagcaggacaatttgatcatttcttccctggccgacatgtggatagcgggagctgtttgtcttttctcttctttttctaacaaatttattttttattgtgtagaattccattcacgacaagacaatgaaactgttcaccagagtcaccattgagtcgagcagtcgcgtttattcttccgatgcgctgcccgacagtcgttatttgtaactctcactggaattaatcgttcacccaaaatgcatttaaggcacgtttcattggcagttgacaatgcactcgcgaaaatagcaaattcattggattctgaagaacagcagactcttttcttattccgtcttttggaacttttcattcaattgggactcgaaggacaacgtggtgggagagnaaatccccanattcactggcanagttgatttttatattaatggcaggnctgctcataagccggcctgcaccgc

SEQ ID NO: 6063 - DNA, 900 bp, Heterodera glycines
ttcaatggggactcgaaggacacgtgtgggagagaaaatccccaaattcactgcaaaagtatgattttattaatggcaggcctgctcataagccggcctgcaccgccaagggcttcccgatcggatacctgataatgagaccttctgtcccgaaaatgtcagggaattgaccgaaatttttgaacgtctgagccggtcttcttaaaaatagtgggccaaattttcaagcctgggtcggcttgccaaacgcaggcctgtattttagtttcactaattgaaaaaaaaacttctagaaatctgctggcgctggaaatttgggcgttttaattccaaaaattgcgtcgttgctttgcaaaatggaaccaattcgaatgccatccgtaaagttgaggaattactttcgtgacttttggttctactgtgtcacacttggctttgcctttcccttaggttgtctttgattattcttattcacttttccccgtatatattgtttaggtccttggcctgaggaatggtacaatgccatttgtaaaatagcatcaaaatctccagcacttttaccgcatgaaaattttaaaacggaaatggtcgagaacgccgcaattaaagtcgatggtatcgcaacggtaaacgatcaaattaatgttgaaaataaattaaaatttttatagactgagcatcagcaagtgcggaatatcatttccaacgagttcaaacaaaatgcggaagtaattgccattgtttctcggatggacattggctattgtctgtttcttttggctgtgtgtcgccttgagaagctgcgagtggtttactcgaggcattccaccgtcgttcaaacgctttttacatatttggaaaatctgttcgaattgtttcgatttgaataatcaattt

SEQ ID NO: 6064 - DNA, 2280 bp, Heterodera glycines
aggtctgcaaaaaaaactaattatttctcacaaatcatcgtacttccccctccctcccccctcctcccatttcgtcaaatgcccccgacctccgatgctatgtgagtggcaatttgcgagttgttctccagtcccaggaacaggcgggccttgagtgcgtttttcgccgcgtccacttcctcgtcggtgatgcccatcgccaaatgcttccacgcgtgcagaacggcacgggtggcttcgccagtaacttcgtcactatgccctttcatcactatgtaaaagccgaagaggctgaaaaaaatatattaaaagtttactaaataaaacagaaaatgtaccctgtgatatcgtagctgatattgaaattttcatatccgatcaaatcgtcgttggcgcacatcttctgcaccgtggacttcggagcgttcagcgatgcggcaaaggaacgatcccatgtgccaacataggcatttgcaacctatgaaaaacatgcaaacgtacaacaattatggatggggacaaacaagttgggaatgggtgcactacgtttgcctcccgccgacccacccccccccctgaaaaaagcatcgaaaattgtactattcaaataaataaaatttaaacaaattcgttaaaaattgtaaacgccatgttgaccgatgtgcccaaaatatgccttcagtgcccccccccccccagttctcccaccagcatggcgatgtagtcaaggtggtttctgccaatgccctccaccgcaattgcgccatgcattagcgggtaattgtcgtcccggtagaggaactcgccggcagtgaaccgataaccctttggacggatttgttcgtgaccaatgttgttcactgacgccacatgtggaggcactttgcgattgtacgaattgccaaggtggccaaagtgtttttcggcctgaaaataaatgaaagaatggaaaaaaaattccaaagaagtccgccaaagtaataatgataatataaaaaacgcaatgttgtaacatgccccaactgaccaaatcgctcattttctcatggtccacaccaccaacagccgtcagcaccattccgctggccttcaaaatgtcgtcagcaaattcggacacggattctttggtcaatgagctaaagcagtcacatcaattgaaccagactccgtctaattgttggtttttaagtttgcttgccccacttttttgtttccaatttggcacttacttcaatgcttttgttgtgccaagtggtgacagtctgagcggtgttccttggaaggcggtggcgtgcaaattgtcgagcactgagccgcgaatgtcgcccttctcggccttatgcagtcgatccaatgccacggcgcgttgctcctcaattttcgacgcgtcaaagttttggttcagcaacgcatcggcaagcaattcgaccactataaagtgatgaaaaagcctaaaataaaagagaaatgaccgaacctttatcggtgtccgatttaagacattccacaaaaaaggccgaatgctcccgggtagtgaaagagcgaagccgagccccaagtttggcgagctccgtttgaagttgcaccgaatttcgtttccctgatccctaaaatttattagttaaccaccaaactataaaatctggtatcaaaaccaatgttaccaaaaaatgagaaaattcgaaccttgtgcagcaacccttcaaaaagtgaagcgattccgttgttctcattggtttcaatcctcgagccagcattcagccaaacaccgacctgagtttttagaatattgtaaattgtaagctaatgcggaaatgcaaatccaaacgcaccgtcactgtcggacgtccgtttgcataagaggcgacacgaaagccgtttttcagctgactcagctcagcagtgtcaccgcggtctcgcaacacttcataagaattgggaagttgagtctgaaaaggggaaagattttgtattactcaaccatttgtttgagttcgtaccaaagagcgaatggagcagaaccgatgaatggaaggaaatttcagcaacatttttaacatacgaataataacactaaacaaagtaaaatgataatcattagatactgaacaagtgctattgcaaataaaattggctctaaccgatccagcaaaattttctctatcgatatgcaaaattaaaaaaaaatctgtaaggtggaaaaaaagttttatagagcgaagtaaattcggtttttctctattaacagagataaggaaaaagtacgccaaaatgagagat

SEQ ID NO: 6065 - DNA, 4650 bp, Heterodera glycines
taaactccgaaaaaatgcgaggggataatcattgttaaaagaggggttctgtttacaataattcatttatcttggttaaaaattatttttttacggaattgttatatgtcaaatgtgtaaatttcatcttgtaaaaacaaaattacgtgtttattcttttcttgtctcaaaaactacctttttatccttgtagagatttttacaattgaaaaattttttgcaaaatcaaagaggaattgaatcttttagcgcttttttcaaaattttatgatccattctaaattttcaaaaattttgcaaaaattaactcaataaattttaataaattttttcttcgtattttttaaaagatatttataatatttttttcttgaaaaatatctagattcctggtcggaaacggtatggggggggcgaactgctcccatccatggatgccttgtttacagaatatcaaaaaaatgacaaaaaatttcccttctctccacagatgctatgtgatcattcaaaatgtcgctgaacacagcggcagtgcggaagaggacacggaacggatcaccagcattgtgtacagcgtcgtgtcctccgatgggtttcgacagcgatgcaatcaaatcaaagtagtaataatacgcatttttagggaatttgtcacgactcgatcccaaattttcagcagaaactcgacctgttgaagaactccgccgtggccaccaacgcgaccgggcagccgattgtggtggcgagcggccatttgccgctgcgaattgagcgtttgccgcgacgcggcaccggcagcagcgcgtcgcgtagcgcaacaacggtgacgacggcacgaggcgagggccaacagcaacagacgacgacaatgacaacgggagcagataaacagtggggcgaaggcaaaacggcggacggtgccaccgggggtgaacaaagtcggcactttggcaatttttggggagacaattagtttgggttaggaaaatacattgaattgtatttccagaagaatatgactggtcaaatgcaatgggatcgtcgcgtcccgcacttatccgtgttcgcttccgtaatcgtgaggccgcaattgcattctgtcagctgttcagggtgggcagggcgtttttctcttttgtttcgtcttttcctttttccccctcttctctacttctcttttattttctctcctccgtttcctttcctcttatcgcttcctttcacccgccctcttcctgtcttatcattctcttcccctctctcttactctttcttcttttccctcccctccactctctctcactcattttccccaaattttaggaacggcaaatatttctgcgtcaaaagagacagcagcaaccaaaggggcaggacgatgagtgcattgtgagacagcacgggacgggcattgattgtggggaccgtgaaacggatgcagggaacgaagaagaaaaagaggagggggacggacagcagacggactcctactcggacttgtccgacttggacgtgttcagcagctgcgatgaggacaccaacggtggccatgagaagacaccgccagtgacgagggaggaaacggcgaccaaagaacacggaaagaaggagggcggagagacgaagacggaaacggaagaaagtgttggtgaagagggacagcagcaaaagacggagagcaaagcgaaggcgacggaggagggagacaccaacaacaacaccaaagccagcaacagcggcatgaagcggaagaagatgcagtcgtcggcttcgcagcgtcaccgtcatggccactgcagcgaacgccgccagaaacacaagcagcacctgttggactcgctcatctgcggtgcgtttgcccaccgggacctgacgccgccggagttggcacttggctacgcactccgtcagcactgccgggtcagtcactttgttcgccaaatcctacaaaaaatattccttttataaatcttatatgaattttttggcgctattgcattttcatgaccataaatacacgactataaaataatttgacaactttaatgcaccatattttaacttcaaaaaactggctttctaaatatttttgactacaagtttttgaatcttggatcaattttgtgcattacagttctcaaattattttatggtcgtgtctttatggttggctaaactgcaatagagccaatttcctaacgaacctcacgagaatgagtttccatgccacttattaattcgatgcttgctttttcaaggagcagaatcgtgtcccaaactctcgtgtttttctgtacccgcgtgccggacgcattttcgaacgcaccgccgccgcggaggcaaaataatgaattggtcgtgtaagagagattattggactgatgactcgaaaataattcatttatttatttcttataatgttattattattgtgtgtgtgtgtcccgttaaggtttgtttgggacggattattatggcacttttgcctctgttattttattattattatttgtgttttaaacgtatctcatttcgttcctcgactctcgccattgctgcataaataaaacgagaaatccgaatgggtcaaatttattttggatttacgcattgaaatgctaaatttgtggatttgtgcagcttttcctctcctccatcccctgaagattttatccgttttcttacgcatttatcgctgttttggttttgatcggtttctgtttgacttttgccgtgaaaacaaatttgttgtctcttctcaatcaatgctttattcctttttgatctgctgatgtcaagaaattatattatgtgctacaaattcacctcaccccccaaatcaaataatttagctttaggccaaaagtgcccaattaatatagcaattttaatcgctcttaaatcacatcaaatgctcccgacatcaattgttttgtgtatttagtctcattattgaaagacatgctttaattcgcttacagtaccgttcctgttcatactgtccacatttgtagtttgtttgttgtatagtgactgagtgagtgaccttgacccgttcattttcttcaatcgagttggatataacgagggcgaggatgaaatcctgagattcctacgggatgaaatcctgcgccccggctccaaccatttttaaatacaatttttgtcctaatccgccattccttcgacacaatgtgcacattttgcatttgttgatcccatttttaaaggtttctttttcataattgtttcaatttgccctttttgtcctttaatcaaataaaattacattttattatatagccaaacaataatcattctcgatatttggaatcccactcattaattgttgacaaaagttcaaaagtaattcaaatattgttctttaaaacattaattaaaattttgagacaggaattctggaaaacttttggttttattcaaataaagaaaattaaaccggaggataaagcccaacgcttaaatataccctgaattatttataatagcccaaaaaacaaatacggtgtctacagtattgtatgcctgttcgatcattaaaaaatagcttttctatcattctttttgcatcggtttccctcccatcgatgtcttaccgtatcatttgccgtccttgtcgttaccgtagtggaattgaggggcagcgcggcacacaaaccctttgagcgtttggggcggtgcccatgggactatcgtggaaatctgctcgaagaggcgttgatccacctaattataaagcaaaatcagcataagtcagtcagtcttttcccttttgattgctcactttggtgccgtcctcaaaataactcgagccgaagaaaatgccgatccaaaagtgccgcaaatcgaaattggcagtgataaagcgaaactcatcaacgctgtgcacagaacagaagctggccttaagttggacgagttcaatttcgaaaaacgtggcaagacccctgcttaggtctgagaagaggcagaaagcaattttctggaaagaaattccaaaaattttttttattgttacaattttccgatacgaaaaacgcaaatgaataatatgcctgtcggggcaaatcaattagcaagggtttcaccaatttggcatttgagttcgcctgcctgaatctgtgcgcacgcccgcacgccgaagtaaaacggcagtcggacttgagacagtccgtaaaagtagggttgcgtccccgacgtcggggttggaaaattcggggttcggggttggaagcgtcgggttcggggtcggggttgccaaatcgttcggggttcgggttcggggtttttcaatttttaccttatgccaaatagtcaaaattttttaaatattttttcggaaataatatttattaatttccataataatatttgtattgtttttatatttttttatttcttttttatcagaaattttgtatagaattaattttatttcttgaaattttaaaattttttattacttttttgttttccaaaacatctttttcacgtcgctcttttctaaagacttaaggagaaagggtacggcgtccggcggtcccgataggcgccgccgggaaaatttgaaaatttggttagatctgttaacaaatattgtccaacaaatgctaaatttttgcgattttg

SEQ ID NO: 6066 - DNA, 2180 bp, Heterodera glycines
caactcgagttaattcgcattcatccggcaccataactttatttggtttttcgtttttggctcaactttggcacaatgtccgcagccaacagccaaagttcggcatattcttccaaaaatggtccaagcattgaattcgtgaaaaattctttgtgccatttatttgtgaccggtgaagctaaaattagtaaatttattgaaaattagtaaatttcgcgaccacctttattaattgtcaaaaattcgcctgaaatcataaatttgaattcgatattaagaaacggagaagaaatgtctttgtacgaattactaaaaaatgaaaaatgtttattaatgtaataatgaattaatatagcataataaattctttgtaaattaataaaattatattccttttttggagatttattggattgtccataaatattgtcaccctttttaataaatatcataacttttgtttgtcttaagtttttattgatatatctgggatattttaaagctatacgtttctcaataatttggcacttttgatatgttctttaggcgttttttgaatttttagcaaatttaagagttatgaaagtcgtatgtagaccctgaaatccgagcacacaaacacataaatgtgttttgattcatttttagtgttgacagtatttatgggataacccaatatttacagtatgctctaaaattacaaccaaataaagtagtatttaatttttctaatttcactgactcgaatatgtaattttgttttccgaaaatgattgttgcgttgcgaagtgaaaattgaattttcctggcattttcgccgcatttgccactgattgttgacccattgagcattttgtcgaatttaaatcttttcgccaatttccatggcacattcttgccaaacaatgtgcttctgtagcacaatgaaaaacttaattatggaattaacaattatatctgactaaatcgtttaatttgttcttaaattgctccaattaaaaaccttgaacaattcccatgaagttcatatttaactttgataggaccaaatttcgtcaactccaacggcactttcctaaattctttttgaataatgaaataattataattaagtaacgaattattttatttaatacattgttctgtttgaaacagcgaaacgaggaagaaagcacataaaaataatatgaagaaaaagcattgatgtgttattacgttattacaattcaaaagcgaaagattatacatttgctcctttttagctaatgaaaatcgctttgaacaaaaaaaatgagtgtgaatcattcatcaatgaataaagagtgtacagaaaaaataatattagtgcgatcatatctaaattatgaaaaattgaatgttatttaaaaaataataataataatagtaataatactggaggaagcaaatgtaaaaagaaaatttaatatttattaaactttgttaagataattgactaaagatttaagcattatttgccagattttatgaaaatgatatgtatgagtcatttttttggcataatattttgggaattttacaacaacaacaaaaatgcaagccgagaaatggaaaaattggcacttaatttagtattttactgaaagtttaaaaggtaaattaacaattatcaaactaaaataaaaatgggacataatttcgattggagttcaattgttgacactcaacctaactaattatctttattcaaattaattgtgaattccaattaaatttattgccaaacgaagaatgttttcacattttatcgggaataccaattaaaaacttaaatttggattttaagacctttaattatatcagtgccaaaaagtaataaatagaatcaaatttattaattttttcaatttcataatttaggataatgaaaatcttttttctaataatatagcccaatttccctggttaattcttcgtcttggaaaaataagcattttttactgagtattttgaccaaattattataaacggaactgattgagtttttcctggttccggaggtcatacctgagaccgggacctgggctttcaacaaaccgggacctctggggatccggaaattccaatcccgggccagtatcactctaatttaaatattattagactcaaaatgcaaatttagaaaaaattgagttttcgaa

SEQ ID NO: 6067 - DNA, 2847 bp, Heterodera glycines
atcctgtgttcgtaattgggcgaaatgtatgcctgattcgtgttcagtgacgccaaaaataaatctacgattaaccctccaaaaatgctgaaaataggtaaatttgtttagaaaaataagcctagaagtaatttcggatttctctgaaaaataacaaatttttacgttgattaaataccaaaatacttaacatgaatgttgtgggttatttgaaaaaactggatcagattcctagtttgtagtttaaaaaatgtatttctaaggcatttttctgccctttcaccaaattaggtaattcttatttccaaggagtcgataaaatattcagtttattaaaagagtagagttcattatgcaactctgtgggcttccagcaatggtaattcgtgtattggtttttccaccggtaacataatataaattgttgcgtgctgacgcattttataaattccgccacccatgcgcgttttataaatccgccaatataaatcagtatgctttatataaatttattatttgttgtgaggacccttgtaagcaaaatatagcaattatttaccaactttaatactggataaatccttatataatattttatctgaataaagcatccgaaaatttttttacttgaatttgtacgacattagctatcacaaaaccttaataactatgctaattaataaagtgttctatggaattaatttaaaaaattcatatcaggtaatggtgcaaaaattttaggagatcagatctcaaaaaaagaaataaatatcctgaagagctgctggaaaatatttgataaattggattgtaattaccctaaggactttattttagacattttgtataaaatatagctgaaattattgcataaaattttaatattattaatgatatatgcaaaaaaatatgctggcggatttataaaacgcactagcaccaattgttggaaggtaaaaatgttttgtcaaaaagctttaggcttaaatatgaccccatgagtagcttttatttttcagtgaaaattttggattttccaaaaaatgtgatcgtgtcaaaaaaaaatcttttttaattgcaattttgttcaataatttgtgaattttataagaaaaattttaaaaatcgcgaaataaaggcgaacataaggatgaaacgccaaaatatgggcaaaaacttattttaagggcgaacatctaaaatatggatttttaagggcgaatacccaatataaggaattctaaggtcgaataagggcgataaaacgcaaaattttcgaacaaaatatgtgtttttcgtacatttctcttcgagttaaagccacagaaaaaataagtaaaaacttagaaatccgatccctacttattactgactagccaaaaggtcgggtgccgtgatgaaccaaaacagcaatgcttcttacaccgctgcacccggtacggtcccccggtggattggatttaattaaattctctccttcggcaattttttttcattaggtcgactcgtcaaattttaaggtcacatttcttaggcttaaatggaagtaaaaattaccagctttaaatgacatacaatcgagattgtggaaagcttatatgacgttcgtcaaaaaccatcatgacaatattttaacaacacaaaatgaacttaacgtgttttctctaattatatgcacgtggtatattatttttcaacctcttcagaaaggttggagataattggagacggggagattaatggagatgggcttataataagtaaaaattcggtatgcctatttttaggcttaaatttaaaaaattcatcgaatttaactctttctatagttaataaaatcgcgccaaattttataagcataatcccgggtacaggactaacttaatctaaactatttcaacgcttattggttttaaaaaaaatactgggttttctattatattattttttcagaaagtgctctgaaacgcaccaaattttgttgtcatattaataagcattctaatgcatatattttagagaaggcttatgaattcgattaaaaaaaaatttatgaattattaaatatgcctatttttaggtttaaatttttagtgaaaattaattacaaataattatccgaaaaatgataagaagttcaacaaaattttttaaaggcatcaataagacaaggaaaagcttctctatgataattttatattttttatgaaattttaaatgatgcctttcattttaggcttataattttagtgaaaattttgtccctcataatttttcggtaaatgatcagaagggcaccaaactttgcaagcatactaaaaggaagagaatcaacccattatcaatttatcatcctattgaaattttctgaccataattttattataattttgtaaaaaaaatttaaaaaaaaattaatttctgtagagctattaaatgataccattaaatattaatttggctgaatttgagccaagttatgagtttatgtgttttacattttttaaaaatttactaccctttggcggcatttaagaaacgacccagcatggtttttaggacgaataaaataaaattttaatataaaaacaaatggaaattttaatttttttttttttaatattttatatttatttgctaaattctaaaattttattttccaatgattcttaaatatattttgtatgataaaattttcattaaaaatttccaatttccattttaacttcggctgcctctccttttatttattatcatgacatttatattatatatctatcgtttttcttaattattcatctaattagctagtacacatatatgtttaatttgtgtgtgtcttccctt

SEQ ID NO: 6068 - DNA, 3077 bp, Heterodera glycines
  misc_feature (1059)..(1059): n is a, c, g, or t
atatttcgccattttttggaaaatttgttaacaaaaatgcaataaaaacggaaaatacacccctaagaatcgaccgaaaattttttaaaaaaacaccactaagaattggaaattttctcaaaaattctttccccaaatttttttttcatgagaaaatttttgatttaaaaaatgtcaatatttgctaaagagaattttataaaagaaatgtagcagctctttggcaagtgcattagtaaaaaaaattttttttattgaatttgcacccctaattttcaatttttagtgcatatttggtgcatattttacgatttttgtgcatatttggtgcatatttcacgactttatttgcatatttatgtgcatattttggccacttttcgtgcatattttttgcatccctgctaataataatatatatttttatttaaaatattaaaagcataattaaacagaaaaagtaattactgagacaaaagctaataaatcgttcattcatttaaagaattcatttaactgttttttattccctacataagtaaaactttataataatcttataaaactaagtctgtgaaaattctttttataaaaatttttgtttaataataagaaaaattaaataactattttcattattcagtgagtaaggctgcgatttttaggcaatttcctaaaataactttgcctatttgagactttttgtgcttactgccgaaatgcctatttttcgagcctatttcgcgattttttgtgcctaaaaattgcatcgctataaatgagaataaataataatagaaatatcaattttcttattattaaattaaaaaattttataaaaaataaacaattgtttcacagaatatatttaaaaaaattatttctttattaagttttattatatagtaaatatgcaaaataatattattattaaatagttaaaataatttgcttttcatttttaaatattttaaataattattttgtttatagtttgatcactagcagggatgtgcgaaaatcacaaaaaaaaaatttcgtatacgaaaccgaaacganaaagggcattcgacaagaaaacgaaacacaaaacgaaaaaattttgacggacgaaaacgaaacacgaaaacgaaaaaatagccattttcgtacgaaacgaaacgaaaaaaccgaaaatttttaaatatattcaattttaattaagaactttaaaattgtatcctctaactgagggaattaagatcctagtaggtggaaaagcggatgtggctctaggacaggggtatgaccgaaaaattttcaaaataagaacatcaaggacaaaaaattattgaaaaattttgcaaattggaaaaaaatgttttttgtgataaaaactcaaaatttttacgattttgaatagcatttcgttcaattttttatgaaattctatttaatctccaattcgtaaatttcttatgaaatgaatttcgttttaaatttcttaacttttttacggtggatttgtaaattttttcaaaattatacatagatagatacctaattttcgtgaaaatctgttagcaaaattcatgtaatcagttataaatcacaatatttggccattttttgttgaaaacctgttaacaatttgcaaccaagtttaaaaattttccccggcggcgcctatcgaccgccggaccccaaaaactcttgtttaatgttcgtaataaaatttatattatgtgtataaaaaaaaaatttttacgtgataaagaatagtattaatcacttgttgcagagaatttcatatttaaaatgtaataaattttatattattaatttttgtttttaatgtatttgtcgaaaattttcaaaaaaagtctaaatagaggcgaaatgccaaaatatatgggtagagcacagagagaaaatctcgcggattcattatcatcagggaacggatttatatgtgctaaaaaacgccaaatatgtacatatatatgtgccaaaaaacccccaaaataggtgcaaaaaagcccaaaatatgtgccaaaaattgaaaaaaaaattgctcgaaaaataagtgaatttctcaaaagtctcattttttatccatttcgctagtataatgccaattaaaagcattataatgcgttttggcgtaattttttcacgctctcaaagatttactcatttttcggaatttttatcgcataaaattaaattttaccttaaaagtgaaaaacgacatgaaaagctacaaaaaaatgcaaaaaatagaaaaaatcgaacatttttggggacattttgccaagaatttgattgccaaaaaagaaacttttgtaaaaaaaatcaaaatttctcaaaaaatcgccaaaatatgtgccaaaaacgaccaaaagcccaaaatatgtttttatatgtgctaaaaactcgctctgattgaaaggaaaacaggtataaatgctattttttgagcttttcatgcgatagcatatgcgcaaaaaaaatatgtaaaaacatataaatccgttccctgattatcattatacaaattaaatttatttttcaaaattcggcatttcattttttgtttaaatcagttgcctttgtgctggtcagcgtttacaagaatggcacaaagatgtgccaagttttctcccattctgcccattttttcgctttggcctgctgtgtcttttaaattgcattcattttggtcggaaaatgccaaaaaaaaaacggtagctcgacttttaaaatggcggatttggtgagcaacggcgcggaggaggcctgagaatggcacacaattggatttgctcttcattttgtgcttttgggttgtggtgatggaaaaaggcacggcacaaaatggtcgtcggcagcgccgcgcccatcaaagaaaagtagcggaaatcgggagagcttttcacacaaaagagttggccggctggcgcttgccgccggcttaggccaatccggcacccgtgccctcctcgcccacaaatccaatttgaccctaatgcctccaccttttgtggcatcagccctaccccatcagtagcaacacacgaatgatcccctcttccctc

SEQ ID NO: 6069 - DNA, 4173 bp, Heterodera glycines
aaaaaaaattaattaatattttaaaaattaatctggtttccggacctttcgtactgctatcgatttcttatctggtgatgtcaaatattgtcagtaatctgttttcgtaaaattaaacattgcgcaagtgcattcatgacacacatcgttggcatttcacacatttcctgctttttatacgtgttttattatattagaaagaaagaagccgtaaaaataaatattcaaatcctctttatttaaaatgaaatacatttttattataataattaatactattcgttcttggtttgtcggctccaaagacacagctgctcgaaaggatgtctagcgccagaaccaaacactctttctttattttctataaaaaaaacaaacattcacgaatctaaatgctttggttttagcttcggcaataatgcctactaacggtacccgcgtcgagaacgcaccaaagctagggtaccaatggacccgaggagttctgtgatagttaaagggataaataatgtcccgccctatcacacgctacaccctcctctttaatgtagcgattaacttaccttaaataggtccattttaaactggttgagtatgttttcactatacaaacaaaaatttctaaactctgtaaaattacttatgaaattcaaaaaaatattctaaataaataaaattttctgttaataatcttgttttttagttttataagataattgtttcaaaaaccgactttattaaataaaacttttagttttttaaataatttgttgggatttataaaatttctctccaaactatattgttaattttaccatctttgttatcagccggtaatttgattttaatttgttgccacgaaccaacgcgtgataaggctacataagtttggccatgagaaaaacttggtcgagtccaatcaattcctattttttcgtatgttgcaccttgtccttttataaaagttgctgcaaaagctaattttactggaaattggtgcctttttagcggcacaggaaattcattttcggttatcaatgatattcggtgtatataaacttccgaaccatctttatcatcgccaagtattatacatctcaataaattatcttttaattctaaaacttgcaaaattgttccattacaaagtccgtcttcgatactaatattcctaagaagcattaccttacagttttgttttaatttcaatttatggaggggaaatcccggagcattgaacgaattcattatttcaggtgtaacgggaaaattgtgagttgtttcgacttcgtcaatacttagataagtaacatattctccgggaaaattttctaaagctaacgcattatggtgatcaactaaatcattataaggcgaaagtatcatacgattttttaattcattgaaattatgctttgcaaaaatgtctccataaatttcctttgttaaatttgaatcgtcagacaaaatacattctgagggtaactgaattaaatcacccaaagttccattgcctatatcaagcatttgttcagcaaatatttcatccttagcccgattattcactgttaatttcatttgttcaaatttgctccaaaaaatagattttcttattgtaagatcaataatttcacttcgtatagcaaatttttttatgggcagtgtttgtctaaaatcaccggctaatattatcgtttttccgccgaataaatgattacatttggttaattcacgtagtttttttttcaatagcatcaagtgcaaattttggtgtcattggcgcttcatcgataataaaaaaatcacttttaattatttcttctgctgcttttgtaccctgaacaacaccggaaacaacatttgcattaatgttaagagggaatttaaatctattatgtattgttcggcctttttttaataaaattgcggcaattccagaaaatgccatattgttaatttgttttttatgactgcgaactaaatgaaaaatagcatttaaaacaaacgatttccccgtaccaccagggccatcaatataaattaatttttgttttatttggccaagtattacttgttttactgagtcaaaaatgcatttttgttcggaattcattaaattatataaattatatgcagttttcttttcttcttcgtaatcaatattttcttcatcgtcattaatcgagtaatcttggggtaattttttaaaatccgctaaagatttgccttctcgaattaaatgtttattgatataggataatgccaatttataagcagcatttattgtattattaacgaaaaagtcctcagctaaattatttttaaattgctcccataaattttctgggtgttttggctcaccaaataccaatatgcttgcaaacaaatttcttaacgctgttggaattttgaaatgactcgcttcgtttaaacaatgtttccactcgtcatcatttttaattaaacctctcgccaaacatgcttgggcaaaagtattatatataataccattaaacgttttaaggtcttcaaaaccttttccagaaacatgaagcaaaagatatcgaagataatatttttcaccctctgttggattaacaggatacattctacctattgttttactaatttcaggattttttcgtaacaaccattttccttgttttgagttccaagtacaaaattttggcatttctgtatataaaatatccgacataccggggttttcattagtaaaatcaaaataagccattaatttacttttcttatctcttttttctattattgtttcgtcatcatcattttcatcaaaaaaaattatttgttcgttttctaagtgcactggcaatctttgaaccgaatgtgatttcgcttgtaaaggaaatttgaaaattttccaacatgcttcaacaggactaagatacctagcatctaaatagttcccagtttcatcataaaataattcttttacatttccgttttcagttgtcacacaacgcaaagttgcagcatcgtatcctttaaatatatatttataaatatattttactgctttaatatcagccactttttctacatttatgtgtgacttaaacctcttaagtaaataacgattgtatggtacaatgtcttgattagtcatcgacttgctcttccctgttttccaatccttttttaaaaaggttttaccatcatttggtcttttatataaaggataaccattttcattaatttcagttttttcgcgaaattgttttggaaatttttttgaacattttttctttttttgacaccaacacattgcattgggaaaatctggcccacatggaccgtgaaccattaatgcggtgactaagtcatataattctttatctatattttcattaggtacttctgctgaaataaattgatcaatgtcgtttgtatttttccatttattcgctgaatctaaagtcagtaacatatgcaagtgagggagacctcttttttgaaattctattgtataacaaaaacccgcaacttttccaaatattttaccatctataatttctcgaagaaattgagaaacttttaaatgaaagactcgcgctacaatatccggtctatcaaacgcttgttggccagaaatcatactttttaatatatcttcatccttaggattacatgtaaaagttaaaaataaatctgggcgcccaacttcattaactattgccattgcatccatgaagctttcatgcatgttccttggtccaccactaaaacttgaaggcaaaataatcttttttttaacttgtgcgccaacttcggttgctttagcatataaaaatttgtcaatttcactaactctttgcatatttctttttggtgtaatttaataaaattcaatcggtcccattcaattcgtgcagcttggtcaacacaccactgctgaaacaatttattgctataatgatgtggtaaaaatttgccgtcggttcggaaaaataatttgtatttagtgaaatcacataatgttatttttttattttctttatttttttaatccgtagtgccaaccaagataactaccggggataaaatatcgggtaacacatgggttcaaccattggactaagtggaaaaaatcgttttcaactttttacttcccttagcatgtacaactatatttgcagc

SEQ ID NO: 6070 - DNA, 3002 bp, Heterodera glycines
cgcgctacaatatcctggtctatcaaacgcttgttggccagaaatcatactttttaatatatattcatccttaggattacatgtaaaagttaaaaataaatctgggcgcccaacttcattaactattgccattgcatccatgaagctttcatgcatgttccttggtccaccactaaaacttgaaggcaaaataatcttttttttaacttgtgcgccaacttcggttgctttagcatataaaaatttatcaatttcactataagactctttgcatatttctttttggtgtaatttaataaaattcaatcggtcccattcaattcgtgcagcttggtcaacacaccactgctgaaacaatttattgctataatgatgtggtaaaaatttgccgtcggttcggaaaaataatttgtatttagtgaaatcacataatgttatttttttattttctttattttttaatccgtagtgccaaccaagataactaccgggataaaatatcgggtaacacatgggttcaaccattggactaagtggaaaaatcgtttcaactttttacttcccttagcatgtacaactatatttgcagctggaatatcgtcattagcgtctctccaaataatagcgcaaacctcgtttgatctaggtatattatatcgccttaaatcagttccttctcttatatcaaacaacatttgaacatcaggaatttcatcgccagttttttttgactcttctaatgcctcttcatagacatccttcatcatttcataagattttgaataaatataattttcacgtaaataattttctatataagcaattaatgcaacagtttgatcttttggatctccaccaggatctcgaaaaacatttaatcggtaatctattgcttgatctgtatctataaaatataactgtccatttgttggcaattcgttattatcaggttgcgcaattgtgttatatgaatggtaaacacttccttgtattttaaaaataggtatttttttatcaggaaactcaaatctcatacaacccaacgatgcacatgaaaatgaagaatttaaaattcgtatttttttaaaaaaattattgtggaattcgattattttggtgtaattgttagaatcgatttctggttgaaataaaactctcaattccattggatattcttgtatcatatcttctaaaatattcaattttccataattgcaacaatctaaaaattcattgttaccttttgttttgctttgctcttcaggaaaatgaatagcgggacaatgaatacacttaacattaaattccccgagtttataaaaaactacattcgatatatcaaaaacacctgcttttaaatataagccttggtttttaatcaattctctacgtgcttgcacaactgttaaattcaactctctctctaattttctctgttcttcattcatttgaaagcgggatattttgcgatttctatcgtattccttaattttttcatttgatatgctaggagagaaaaattcatcaggcaaatcatccaaatctataacttcttccatttgcaatcgtttccttttcaaacaacgtctttctgtacttttttctttgctttgtaattcaatcgaattatgtattgtttcagaccgcttttgtacggagctttgaaccgtttcaatcaattgaccgcttttttgaccgggagctttgaacccgtcattcgtgcgctgatcatttgaagtgcttggagcacaatcgtcagttattagcttttgttttttgcgcaccattatattgctaaaaatatttggataaattttgtttccctaaaaattgcgaatatggaacaaatatggacgaaaaagtgaaatatggaaaaatatggattatatggaaaatatggacaaaaaaaagttgtcctagaagtttcaaacatggcgaaatatggaaatatggattatatggaaaatatggacaaaaaaaagttgtcctagaagtttcaaacatagcgaaatatgggaaaaatataaataaaaagtgaaatatggaaaaatatggattatatggaaaatatggacaaaaaaaagttgtcctataagtttcaaacatggcgaaatatggaaaaatatggacgaaaaagtgaaatatagaaaatatggattatatagaacatatggacaaaaaaaagttgtcctagaagtttcaaacatggcgaaatatggaaaaaatatggacgaaaaagtgaaatatggaaaatatggattatatagaaaatatggacaaaaaaaagttgtcctagaagtttcaaaccaagctaaaaagactatttatatgcttattagcacgaaaaaagcatccagaaaaatatggaaatccatacaattacggtctctaaaaatgagcaataaaacacatacaaaaaaggaaaatttttttgctattagatcttctaaaaatatcaaaataaaggcgaaacgacaaaaaatcacctaagtacgggtcacacaataaaaaaatggtttatttgggtaaatttttcagattttttccctaaaaatggcgaaatatgggaaaaatatgaacgaaaaagtgaaatatggaaaatatggattataaagaacatatggacaaaaaaaagttgtcctagaagtttcaaacatggcgaaatatggaaatatggattatataaaaaatatggacaaaaaaaaagttgtcatagaagtttcaaacatggcgaaatatgggaaaaatatgaacgaaaaagtgaaatatggaaaaatatggattatatggaaaatatggacaaaaaaagttgtcctagaagtttcaaacacggcgaaatatggaaatatggattataaggaaaatatggaaacacaaatacaaaaaaggaaaaatttaccagagaattggattaaatatttgttcaaacatggcgaaatatggaaaaaatatggacgaaaaagtgaaatatggaaatatatggattatatggaaaatatgga

SEQ ID NO: 6071 - DNA, 4193 bp, Heterodera glycines
tgtacacgttctcgcacttttgcccaatcgcaaaacgccgtgaaaactttgctgtcccaggcctacaaggcgcaggagcccttgagaaaaacaaaagttcaaatttagtgggtgtaaatttttggcgttatgtatagcataaaaaattaaaaatgataacaaacgcagcgcaattggcccaggcaaaatattggaaaggtttgattggcttaggagttggcatacgctaaaaaaatattagatttttgcgaaataactcaagaaaattagaacaatttcttggtactttcctattttatgtcagccagtaatttcgaattcaaattttcattttgggtttcctaatgcacatacatatgtccttggaaccggaaacggttgggccccaccatgtttttggctataacttttttctttgtcatccaaatccaaaattcttggtatcattcgaaagcttaacatgtttagaagctatttctaaggtattgcttagcgattagacaattaccaaaaaatttatagcatgaaaatagcaaaaaaggcaaaaattaaaaaaaattttcttaaaaacttttgttatgttaaaaatctttgagtttttttgtaaggctaatagagagcatgtgaagagctttcgaatgataccaagaatgttgaaagtttgtataaaaatttaaatggagttaaaattgtttactccgtcagtgaaaagttgcgtaaatgtgtgaaaaatttcttaaatgaagtcccaggcctccccccccctccttttatccagccgtagagttattttctcattttgactcggttacgtcgagaatggaaagaaagtcttgggcagggaattcatagaaattaaaatttcttccttaaatgtacttcgttgcatttaaagccatcgcaagcgtagcatgtaggcttaaaagacggtggacaaaattttttcaatacgttcgtcgggcactttccattcggttcagcacaatctttgaacacaaacagagggtagccagttgctgtgaaagttttacaatgatgaataattaattaattatttcatatgtaaatatttaattttagattggaaaaatcgcaaaaaggtacttaattaatatggcaaagctccaaaatagtgattcctattgatgaatagtggcgttaaaacgaagaatttccgagctaaaaatgtgtttttcgtgcatttctcgtcgaaataaagccgcagaaaaagtagttaaaaagctaattttccctattaattaagtacaaaagatgcacaaaaccccaaataagtaacaaaaataggggtaatcctgaggaatgggaatttctaattaacttttttatttaaagttaaacattgatgaaatagattttcataaaaattttagcgaaatacaattcaaaagcgtaaaatcttttgagtaattatcgcaaaaactttgatttttttttactattttcataaaattttcccacctttatgagttcttcttcgattttcagccgaaaattttatgaaattgcctcggacccccctacgatttacgaacttgaccctatggttgtgcctctgataaagtagcattgaaatttataaaaatgtaaacaaattagtattccactcgtcaggatcagtcagctggggacaactcagccgaggaaactccgctgacagacaactcgtctaatggacaactcagctttacgagaatttacaaaattataaaaaattaaaaatcaatatttaaacaatgaaaaaaatcttttaaacaaagtaaataaactaaaaatatttttaataagttaaaaaaactattaatttttttaatttaacagtcgtatttcgggtgtcatgacaacttgtacacaggcaagcacacagacaactcgtacaaaggcaactgtacaatggcttaggctagggcgaagctttaggcttagaattgtttgggcctaggcttaagttattttaaaatttttttattgtatgagttgtccatcagctgagttatcctcggctgagttgtccagaagccgtattcccaattattcacctttgtcagtgcaagtgaacgcttggcatttgtatattctcttcgcgcacgttctcaagttcttctccatgtttctgttggtcagccatttcttaagctcggcgctcggcgtgtacaaccacgaatagtccatggacaatttgcagtcaatgtacgtttttatgagcagttcagtgttgttcgcgttgcacacggtgtcctcatcatagcaaaagtcacattttgtacgcaactttttcgactttaatttgcaaaattcgtccaattctgtatgactgcagttccctcgatctgtggcgcagccgttgatcacaaacacgtcgttgttatactcttcaaaaaaggaagtttaaatgtgcaataatttggattattatttttttttgttgatcagtagagaccggatttttaggtgctaaaaacactgaaataggtactaaaataggtgccaaaagtgcaaaattggtgctaaaaacgcccaaaataggttctaaaaagtggaaaaccccagtttcttatgcacaaaaattccaaaaagtgactaattttttttatcaatttcgcccaccaaaatagcaactagtcaagaaaataactaatatatattaattttctgaaattttggtcattttttcggagtatattttctctgaaatctttgggatcgattcttagtgagtgtattttttcgtttttattgcatttttctatgaaatttctgggaaaaggccaaaacaggtaataaaattcgtaaattacaaaataggtgctaacccccgttttaggtaatttttgtgctaaaaagtcgctctaaataaaaattgttcggagaaaatgtgcttttcatgcgtctctcatcaagtactctccgcaaaaaaaaaataggtaaaaccctaaaatccggtctctattgattgatcagtgttcatttaccatccatgcatcggtatgtctgacagccgaccttcgcctccatcgccttgccatggcactttatatccggcttatcctttgttattccccatttttcgatcacctttgcaaactctccgttgactttataaatcgtattgtcgaaagtgaatgcatgtttgcagactgcaaaattaaaacacatatttactgtatatgtaatttattttttatttattaaatttctcgggcagtctctccaatcaattctttttttaatttttaataaatcaaaatattgtaaaaccttgattagaaaaagaaatttgtttaaagaaatcagtaatttttcaaatttccatatttacttagcaatttattattcccactcagttggagctcaggacaacaaatcattttcagctcaactatgagtggctttgagcagttcatttcatttttagtaaatctcaaaaccgatgataatgaaagaactcagtttttattggtatgtttccacttgattataatgcggaaagacctttaagaaggatggcacggggtcgagaccgagccgggaattcccggtcttgccatgttccggtttttcccggttgcctggtctcgcttttagaaaatacaaggaaaatattactgataaaaatgagggtcttagcgaaaatacaaatttcaagtacactcacggtcaaaagtattgcaccaaaaattttttttcgaaaaattcgattttcttgccgtcgagaaaatcggtcatgactcaaccaacccgctttttggtgggacaaaagtaatgcaccaaaacatgtatgcacgaataactcactttttaatgataaaaatccgaaaaattttctgctaagctaacttttgatgctgatcaaaaaagtcttttacagaaacttgatcagatcactccttcatggtgatctggaaagtcaaaaatggcttgaaatcgggaaaattttcgaaaaaaattcctagggggttgggaaaatttttctagaaaatttaagtaagcctatcagatagaggacaaaattctctaccgaattgcctttgggatggtaggcctatggcctatacccgcagagcagcttagggtatcaaaattgactaccataaaaatgatcaattttctaccattttcccttgaaatacggtagaaatcagtcatttttgatttgccgaatgtttcacgaactg

SEQ ID NO: 6072 - DNA, 1951 bp, Heterodera glycines
gtgcatacatgttttggtgcattacttttgtcccaccaaaaagcgggttggttgagtcatgaccgattttctcgagggcaaagaaactaatcgggacaatttttgggtattaattagtgcactatttttaatgtttattttagcataaatttgacatttttcaccccattcctttttaagaaaatcgaatttttcgaaaaaaattttggtcaatacttttgaccgtgagtgtaaaaacttgagaaaatctgtcgatgaattaagcattttcatttatttattattttaaaacgtcgactcaaaccacaaaacaattaacattttttgcgacagattttgttacaaagcaacaaattaattatgtaattgaagcaaagaatgttcatttaaactaattaaattcagctgcccatccaacaaaatgacctgatgtgaatgggtcgtcattgagcagattgccaaattcgcaagtgcagttccattttgaagaagccatatatccaactttttcattcacatctttgttgtaaaagtcgcaatttgtgtcgtccggatagcatttcatttctaagaagctttcgtttggagctaaacaaaaataaaatgtataaactaacaaaggtctgctgacgggagacaatcaatttgaagaaacggcaaaattcaattccgaaaatttgacaccaattttttattttaaaaacatttatgaattataataatggagctccggcatttgcgcctatgtccaaaatcggattcaaagttgaattttgttcaagccctgacagccaaaacagcattaattaagaaaagcaaatgtcgggacacgattataataataattgaaaaaaacatattataagaaaattcaactctccataatggtggatcaattatttaatgcttaaccatttggcgctgccaaattaccatagtcatttttttctttgttgaccaaatccaataaactaggtatcattcgaaagatcttaacaacaagctctattggctttccaaatcacacaaagataaaccgacaaaaaaagttatgatgctttgaacttggcacagactaaaacgacccccacccggaaatgggcatatttagccaagcaatctctgtgaataataatctttttctgtcctattgtgcccaatttgtaagtgtattttcttttaccagcggagcacttgattttggtacaacgtttgtggttgggattagcacattctgtatgctcgaaatccttatcatggcctttttgaagtccgtgcgacccaacgacgcacttcaatgcttaaaattaagaaaaggcatatacaaaatgttattttatttaaaatacaaaaattacctccacaaaaaagggggaagaatgcgaggaggacgatgaaaattgcaagacggcggaagagggacattttgagggggttttgtttttaaatttaaattatctgtagaaaattattattattattattaactttattttttaataaagcaataataataataaatgaattccgaccagaattagcttaacatcgaatgctttttgatgatgatcaatgaaaataagaggagaatgaaagtgaatgaattggttgtcgagcgacggacgaccgaaccgattctgatgatttgatgattcattgtgaaagtgctgttttatgcataataattaaataatgtaaaagaataaaatttatcaaaaaataaagttattttatttttatttagttattattggaataaataattatagaaaatttaaaaaaacctgaaaaagtgaattaataaagtgaaaagttgaagaaaattaaaaagctaaaaagcttgaaaattataattcaaaaataaataaataaatctaagcgataaatacaaactttaattaatttttattaaaataaacattttaatataattatttcattaaataattca

SEQ ID NO: 6073 - DNA, 2212 bp, Heterodera glycines
  misc_feature (83)..(83): n is a, c, g, or t
tcgttccaatagctcaaagtttatttattttttcaaaagtcaaataaaattccataaataaaaaaattagctttttaaatttnaaaactttcagaaaaggactatagaactaactaccaagttattttaagtcatgttggttctgcaaaacaaacaaatgtggttacgaatggaagtatttaagaaaggtcccagcaggaacaaagcttacttgcctaatttattctatatttatatttaaatttatttaatttaatttttttctattaaaaatcaatattcaatgaatgccctccaacaaaaacaacttttttttgttcaagaaaagacaactttggatatgaaattttaatatttattaccttaatcagtgttatttttcaaattatttcttaatttcggtttgattcaatcttcagttgagtccattcgaatggctttgtgttccaaaaaatgccacactcgcgctgatcaaaaaaaactacaaaaaacttgcgatggccacacacccggacaaaaacaatcaatgcagcggcaaattgtttacggtttgggttactgtacaatttaatttgtaatttagcaaaaagaaggtaaagtttaattgaaaaattctttcagctcattaccaatgccaaagatgagcttcttggccgctccagaagtgcagtgcagcagaatggaggtgcgtattaaattctcgaaatttggaaagatttattaattatttaattaaaccactaatgtgttagcatatgaatttttaccaaatatttaacgtcaatgtaatattgtacaggagttccagcagcttgcgaaattctttgagattctcaacaatcgattgcttagatcgattcagaaaaatgctgctgacaatgagagcgctgcttgtggaacaacgggacagagtgagaagaatggaacagtcccagggggggggggggggggggtgcggagtacgataggggtcaacggtactgggatataatctaaaccaccaaatgaaatttttaaacaaaaagttacaatacaaggaaccagcatttttggccataacttttttgaaacttaacgagattatttcttaatgtcattcgatcacaataattaaaatagttggagaaaaggagagaatatattattcggtgagggatttgggaatggaagttcggggatgggttcgaggggaatatttccaaattcaacaccactttatgtttaaagtcaaatattaactgttcatttttataacagcagttttaagtcaagggtaatcaaagatggtatgatcagggatggcagatgtgaggctttagcctcattttgtgggtttttgataggtcaatgaggctttgaggctttttgtggttttttgagaaattttgaggctttttgtggttttttgagaaattttgaggctttttgtggttttttgagaaattttgaggcttttttggttttttgagaaaaactgcttatttctaaattgatcatggacaatcaaaaatataatatttgaacattttaaacgtgtttagaatacatgtaaaaatgaggctttttgacccaaaatgaggcttttttgcttgccaaatgaggcttttgaaaattttcatctgccatccctgaatcccgctactgtactttatataacacttgagaaaacatcgttagaaaaggatttatttaatcctcagtacgagtggtgtgttccaaaaaatgccacactcgcgctgatcaacaaaaactacaaaaaacttgcgatggccacacacccggacaaaaacaatcaatgcagcggcaaattgtttacggtaagtccgatcaaatgggtggcggttactagggcttcgtttttaggcgcaaattacgaaatatgcacctaaaaaggaagaaaaaaaccgtaaaatgggcattttgtccaactgtccgaattgtccgggagccttataaatgtgattgtagattcctcaaaccaagctgaaaatgaaatgcgttttcgtctatctatgcgtatcaaatgcgcagaattttaggcattctaaaaaacgaagccccatagattactgtacatacaataattaagaatttaaagctcattacgcatgccaaagaatggcttcttggtcgcccagacgcagcggcaggttgatggtcggttattaagcctaatcattttttaaactaggtttaaaatcatttttatcca

SEQ ID NO: 6074 - DNA, 2194 bp, Heterodera glycines
catttatttatttttgagcttttctctatgacaatgcaattggccgagtaattccaactttgtcaccgattatttaaccaaaaaataaaaaacttttctcctctctctgccgatttcgctgctttttctccccgccctttcttcgcccattctttcagtgaatgtctttcatcggacagtccatcaaccgcaaaacgacgaagtctgtgaaagcttttcaaatatattttcttaaatttgtttttttggatattttagccctgtgcttttgtgaatttttgaaatggcacctccaaagaatggcacacccaaagagaatcgctttatgcgaaggctaagaaaaatgctcaaagcggcgaaaaaactgtacagagattggcacatcaatcacttggcaccgattgggttcatcggcatttatatgtttgtcggtgccgtctttttttggctggccgaaaaaaacgccgagcttaacgaaatagccaaaaggtgaaacacgatggattttaacctaagaacctttctcgaattagaaaagaaatttattggtccattcgatcggagggaatttcgaacatcgaatcggtggtcggagtgaattggatgagcaaagagaggcgcacgcggctgtcccaattggtcgactctttgttctcgcagttggacgaattggccggcgcgggtgaggcgcagccccaatggaattttatggcggcgatgtgagtgcaaagtgccgtcgatatagcatttgcaaatgagtctcgacaggtacttttctggcactttgttcaccacgatcggatacggggacatcgcctgcgagacggccatcggccgaatcggcacaataatttattcggtgatcggtcagactaatcaacgattaattgcccaattaataaatgccttttgcttattttgccaattttcaggcattccgctgacattgatcactttgaacgaattgggtaaatttctgtacaaatgcatcaacgaaataatggccgtcgtttctaatcggtggaatgtgtgcattaaaccccttttattttgccggtgttttcggcgccatgccaaaattccgctggatcttccgcctacgccaatgtctccgtctctgagacaggcactcaattaaaagaaaattaaatattttggcaaatttaaatttaggcacaaaaggaatacgaacggaagacaacacatttcttcaaggatcagagaattgcgcaaaaggatctcatctttgactacgatttgaagtcaatgtccgaggacaaaaagttttccgagtcgagcgccgggggggacaatttgacgatggacgcggagaaaggcgcctttctgacggccgaaggtcaattgagggaaaacgaagccaaaacggcaattggatgattaaatagttgttcaaattcaatggcattttccgttgagttggctccaccaaaagggaacattcgcagcaacaattgggcattttgggcgacgatgcgccgcgaatgcacgtcctcgtcgccattttcttcaccgtttcgtggcttttcttttgcgccgcgctttttgcacacgtcgaagtgggaaaaataagaaagcaaatgcaataaatgtttaaaaattcaaaaataaagaattggacctatagcgaatcgctgtattttgtgtgcatttctctgctcaccgtcggacttggcgatgtgaaagtgtcgcacagagagtaaaaaaagacaatgccaatttaaataaaataaaatataatttaaaattaaaattgaaataataataataattgtcagatatatggtgctgttcttcgcttttatgatgatcggtctttcacttgtttcgatgtgtattaatgttattcaaaattcaattgaagacttttacaaaagacttctgatgcaaatgctcgaaaaaggttcaaaatcgctaattttggctctatttttttgaatttttcctatggcatttcgactttttcaaacttcacaggcgatccgaattccctgcgcaacaatcgtttggccaaatttttgttgccgtttctgagcaaagagaaaaaagcatttatgatgcatcaacttcaagaagaagcacaacggaacggcatggaaatgccaccgatttttgacaatttggaccaaattttgaaaaggtaacaatcgatggaaaagtgccgaaaacggcttca

SEQ ID NO: 6075 - DNA, 2371 bp, Heterodera glycines
  misc_feature (22)..(22): n is a, c, g, or t
  misc_feature (1262)..(1262): n is a, c, g, or t
  misc_feature (1574)..(1574): n is a, c, g, or t
gcatgcgatggattaaatgacntcattgttgttcataaatactgcttttccgattaaaaaatcagtcttttgtaatttaattgtttttggccttgccaattattattggccattttaatgtgacaaggttttacataatccttttgaaaaatccaaaaaattattaaaggtaaccctaaaaatcgactttttttttaaaaaagggataccaaaaattgattttaaaatgttaaaatgttattctaaggctcattagttcattttatggttggccggtgaaatggaaaataaaggggaacgaacattttaattgcagcggcaaaaaatgggagaaaaaaagggaggggacaaagcaaaatgcaaatgggggacaaaagatgggaaaacattttccaaatcggataaattggataaaaagcgagggaaagtgaaaatgatgaagaggatttgtctaatctgatcaaagatggcccgggagtgattctctccccatttcagtgcccttctgtccccaatctgtgctttctgttcggttgggccttccctgctgatgtcccttcccatttgtccactttcgtcgccaaaaaatggaccacaatattttttttcaaaaaatttttaaattatgggttacggattacggaaattaggctttttcatatccccataattacggatttagtccagaagccctattttcgacactttcattacgcaaatatcaataaaattgtggttttctatggatttcataatttaagtttggatcaatggacggaggacaaagccaatcaatcaaaaggcatttcattcatatcagcggggcttttcacgccaattgctgcttttccgcacatttttttgatgtttattcactttggcctttctttttcgcgaaatttcgtcgtcacaatgattcgcttccaattataaattccattttcatttgatttttcgtggctaattttaaagtaagccaataaaagatcaaatgaatttattttcaaaataaatttaaaataaaataattattttcgttgatgaatgccttgaagaaattgttaggcggtggagggaaaaagaatggcaaaagggaagaggagaagcaaagggacaacagcgaggacgaaggcgaacacatcgccacggacttcgacaaaacattcgaagaagcggccaaaaagacatcggcgacggtgccacagatcatcgaataccgtaaagcaatgactaattaagagttaattattaaatgaattatntaaagttaacccgtaatgaagcaacacttaacccccccccccccccggcacaggcggaagtccgtcgagaacgaaccgatcgaaaagtccgtcgccctatcagtgtcgaattaccacacagcagcaacagcccaagcagcaacagcatcccatcaaaaaagtgtccagtgccgttgcaaatcgcacgtcagagctttgtcgcgatttttgttttgaatttttattttagacccacgcgaattcgaaaaggttcggcacccggcgcctataaacttttgggcgatgcgaaaagcgcaacgccggagaaagatntaatgagacggaaaatgacagagtcgcagcaaaaacgagtgagaaaagggaaaatggggggggggattaaaaataaaattaataaattaacaggcaaaagacattgtggagtcattggattggataaagcctgccgaagagagtacaaatccaatcattgcgaagatggaatcaatgcaagtcaattaaaattgggggggtggcggagaaaggacacacgctaatcacggatcgactgctgatcagtttatgtatgcttcactgatcagctgatcgatgtgtgtttcgatgatcagctaaattggatgaactgctggtgccgatcgtacgcttttgtgctttagctgtcctcaagtgcatttgtgcgaaatgatttcgctgccccgtgccgatcaatgggccattgccgtaatcccccaaaggcaattgacaccgcttcctgtgccattggcagcaagcggaaagctgcacgtctctctcacgaacaatcgatgaaaaggactgtggaggaagaagccaaacgacaaaaataaagtaagccagggacggatacgatacgaccgggcgctaattgtagaggagctttgcgattgtattttattttttaaaaataatccatttaaattggcttttactgctccattcccccaagggatttcatttggcttgaaaacgcggcatttgccgagttttggcgatggaatggcattccccggcagtgattattaacatttattttgtttcaatctttgacatattatgtattctttctttatacatagtacgtacctttctga

SEQ ID NO: 6076 - DNA, 3776 bp, Heterodera glycines
  misc_feature (52)..(52): n is a, c, g, or t
tgtatctttctttatacatagtacgtacctttctgaccctcacatagattgntgaatattcggcaaaatgaaagaaaataacaaaaggaaatgcaccaatagaaaaaagttggaaaagaaaaatggcacaaaaatagcaaaaagaaaaaagaaaactaacgaaacactgtaaggaaagaaaaaagagacaaagtgtaagtgcacggaaagtgaggagagcgcagagaaagagaggagatttttaagacgaatacaattttttaaaaaaaattttgctggcgccttcggcatcattggaggcccataaaacccttaaaaatgatccacaaatgaattttttggataaattaaaaattttcaacaaaaatatcaggctttccccggcttgcctatcggcactgccttccccccagcccgcagaaaaaatattaattaatgcgaaaagttttaaccgaatttccattgccatttctcatcccccactttcccccccttttccgctttttgtgccatcattttccgtcattctcgtcctccatctctgctgctgacaattactgctgtttttggttctgctgctgtctctaaaccattctttttccttttcttctttctccgattcgttttcgtcctttgtttttgccttccgctgtaattcgggagaaaatcccacctaaattcggcatcattaattaccattaccatttgcatttggcaaaatgttcaccgctattttgatcggctgcactttctgttgcgttggccctattcgcagtgcgtctttaaacgacactttccgtgccgtcctccctttggtgccgcccgttgcttcttttccatctcccgccttcgtttttgttatgtgactgctgtccgtcgtcgattgagtggaggaaccttcggcggaagtgccgttggcggtggcacccgacttttggaagggaatggcagcgtaaacaacgggtagaacaaccaatccgtggaccaggcctaacaccacaacgagcagcacaactttgacgaacacctgaacaaacagtgaaattgctaagcaatacgaaaaccgggatgtcctccctacctgaaccatgtaagcgtggatcagtaccaaaatcatcaacgaaagcaccgtcgaaagcgcggcctgcagcatgggccaagcgatggaactgagcgcgtgccgaagccgttctcggctgtcctcaatctcgcctttgtaataatggaagctgatgtgagccacgaagtccacggacagtccaatggccatcaaactaaaaaatgtggggagatgaaacagagaatattcataaatagacgttgtggtcatggaaatggggtccaagtcgatgctccaataaaagagcagtccgaacacgcccaaattgatggacaaaacgcaggcggtgccgggcaaaatggtgctgatggaaggagtgaacatcaccaaaacgaaagtcatgcagagaagggcgaacgcaactgcaaaaagatggataaacaaaaagacattcgttacaataaggccgactcgccggtttgtattgtcaccgacggaatactgagcaattgatcagcgtacatactgtaaacaagagacagaacatgcgaaacgaccattggtactgtacctgaagtcctcgtatacggtaaggttcagctgggaataatcagcggctaattggcgccaccgttgcagcaacaccaaacggtcgctccaagcaacggcattttggaagccggtcgagaagaagaatttgttaatgcaggatgggcgttcgtttaagcaatcccttcgggggactcggaattagtcattgaaaagtcggcatttcccttttactctttggggcctaagctgacaaaatggctccaccggtgatactcgggaatggaaaagaagtcgtaaaggtatttgtagcggaagtcaatcgatccgcggttctgacaaaaaatggcaaatgaccgaatgaacacattccttggctcacttgcagtccgatgaatggcaagtacgtgttcagccacatttgcgtgctcgacgggcccacgctgccgttgctctgctcaaatcgctccaaaatgcgcataattttcggaatggccgacggtttgcgcaagtctcccggactgttcacaaaaacggccatctgtcgatggcatttcgtttataattgccaaatttttgagcaccgacctgtccaccctccttgaaaatgacattgttctgcaaacggaccaattcgagtagtggcgagtcatccaggaacagtttttccgacgttagtccaactttaatttgggcaactaaatacaaaaagaaagaatcatttgatcatttaattgtcagaatatttttaaattaattaccgccataagcggaaaacgcccaataaatgatcagagaaatggccaacagaatgcgagcggtccaactcatcacaaaatccacgtatcggtcgaccaaatccgagcccaaccgccacaaatttgttctcaattttcctacgttttcattcgctttgcctttgctgattgtgtgctaaacatttaaagctaatcttttttcaatgttgccacttttggcgaccttttcggcacgcgcttttatgcatggcaaatacgcatttcgctcgtccgcttcgcgttgggccccaataaccatcacagcagtgtaaaagaacaattggtacaaataagcataaagcacagccaccgaaatgaacaaacaaaaagtctaaaaagggaaagattggttaaattggcaaatgaattgccgagaaatgatttgtgggtaagcaatgccaagtgattggctaattgattggctaattgtcgccaatttcaaaacgtgcccgaatggcaggcgttggagtcgcaattccgatggtgaagctgagccaattggtcaacgaagtgattgtaaccgatgggccagccgagccgagcagatccgccacgcgttcgcgcaaatctttgctcgggtcggtgtgtgcccagcagtggaggaaaatgaaaacgtcatcgaacaccgatggccaaaatgagaaaagggaccaccaccaaaatgggcagaaattcgaagccgagctgaaagaggggagaagataaaaatggcaaaaggacggaagggaaagtgccaaaaatgacccaaaaaagggtgccgaaagaagcgccgacggaaaggatcggacagaaaacgccgaccaatgcttcccaaggtttgctccggatttggtcacgcttcagtgaagtgatcacctattgatcagatcgaaagtcaaatggcaaaagggagagaagcgaccgtaaagagaatgatcacggacagactgatcggcatcaacgggagcacctcaatgcctgaggagggagaaacgatcagaaaaacaatgatcggagggattggatgccaaataagcaaaacacccaaataagagaaggaacattagacagactgtcttttttttattaatctacgcttaattgtctttaattgtttgatttgtccttaaatatttcttaaattatcaatcgctgtccccgtttcccctaataactgtccttaaaagggcctttcatctgtactaattgccatttgacctgtcctccgcacctcctcggagactaaaccctccgaggtgacgtgcagcttcagcaacggatcgccgcgtgaattcattgcgaagttgtacacggaatgctcccactttttcatcaccgtttccattgtggaatttgggaaaatggcgtggaaattgatcgtgatcactttg

SEQ ID NO: 6077 - DNA, 2263 bp, Heterodera glycines
atcactttggcccccttgacaagatgtgagctgaacaagcgccgatcacctttggtttaatcaaaaagccaccgattgttcagttggacttgaaaaatgttgtgggccaagtaaatgcgatggccgaacacgtcgatggtcggaaaggttaacttaatgttgcccttgccgcggtgctgaacatcgcggaacaccgtcaggaaaatgttcaccgcgtcactcgtctcacattgggccccgcagaagtcgctgtacgcgtactgaacgccttcatgctcgacctgaatttctgatcagttgagtagcctttttgccgagaaatgtccgaaagtgatcagaggaatgaaaagcctttttagagatgggatgaaaagcggaacatcgcacctttagtttgtactggagaaaatcttccacttccaaagccttgtcaatatatcttaacggaaaagcattacaattgtgtcaattgttgcggtagtaaggtcagttttgatggccggttcagtctacaatttcttcgaaatgcgtttaaaatttgatggtactgaactgacaaacactgaactggccgtgctaattttgtgcctcggcctcagcaaatttccgccgtcggctgcttcaattgccaccaccacgtgaaataaccctccaagctccttgaaaaactcgcgcgccacaagaaattcgtgacgacttggcgaattgtcggcactcaaatcggacaaaaataaatgaatacaaatagagggattaaacaggcaaaagttgggggaagcaaatgccaaagcgaaaggggggggggtggcggaggggaagggcacctgaaatggtccctgacattgttcacttctttgaaattgacaacgcccgttgagagaacaatcgccacaatcactctgcattcaataatttatgtcaggttgaaggtttctccatttattaattaatgcttacttacgatatgattattgttgtccacggccaatgcgaaacgaaaaggccgagccgacgaaagccgcggtgcgttttttcttccgcccaatcggcaacggaaaagccaatcggcaaacagagaagacgacccattggcacaatggaagtgatcaatgactgactgatcactcactaaaaatgtgatagattaaagaaggcggaagagaaggtccgttacggagtcgatcaaattgaatggaaaatgggggatcgattaaagaggtgaaaatgagtgaccgatcaaattgaatgggaaaaaaagaataagaaatggataatggatcaaatagaacggaaaatgagtgaccaattaaaatgaatgtgaaaaaagaggaaggcgatcagattgaatgaaaatgagggatcgaccaattggtgggaactgaatgagttaatcaatcaaagagaatggaaaacaaataatcgatcaaataaatggaaattaatgtcgatcaaaatgattaatatacaacgattgattgatccacaaaataaaaattagggggggggatcatagtgcaaatgatgaagtacaacattaataaatgttggctttttcgatgaaaagtcaattgtggacaaaactcaaatgcgatgcgatattacagaaaactcatcgaggcattttgtccacccgtttataatcggagccaatttttgcgccattttggccctattcggggattgggggatataaacagcagataaagcacaaaatggcggggaggaatcgaggaaagaacaacgacaatcggaaggaaccggtcgcgggaaacacagcgaagacgaagacgacgaccaagaagaagaagcagaggatgatcaagaagagaggaagaagcagaggaagaagcagaggaagaagcagaggaggaggaggaggagaagcaacggctttgcggatggatagtctcaacagaacacccaaaaatccatccaaatcaaaacaatcaattcaatccttcccccaatgccctccgtcttggcgagtcaccccccccccgaccccatcccccctcaactcggcttcgcccccccgtcgtccatcatcggagcaatgctcgtaatcaccagcatcagcctcctggcttcttatggatttgtatataatggaacaaatgaagcgaaaagaagaaaatgggagaagcagagaaattggaaatatggcgtttcggagagtgaaatggacgaacgacggatgaccaaagaaacggcgaaaggcgaaattgggggggggggggaatggaatagaaagaggcaaacgaca

SEQ ID NO: 6078 - DNA, 5093 bp, Heterodera glycines
atccctgcttctgtcttctgtataccaatccgccttaatttggccgaaatgactgtggacatcgtcacgccgggcaccacccaaacagcgaccaggacaaggacgaggaggactgcttcacgccgtcgcgcgtcaacagcagcgcgttcggtgagccgtccctggcgctagtggtcggtcaactgcgtctaatgagacaactttaagaagccatcacatttttcggcacttttgctgttttgtaatcccctaccgatgcttgctgtttggtgaatcccgaaaagacagaaaaagtcttttccacgcgctattttcgtgtttctcttgagaattgtgcaaatagtgtgtgaaaatgaaattctctgtcgttctttttcgggacccccttaaacagcaaaagtgccgaaaaagatggcttctgaaagttttctcaagctcagttggcacccgcttcagtccctcttttttgctgcaactaattccgtgtctcattttacgccctccccgccgttgttcagagagctcgtcgacgacagcagggcgcctcaaccaacaacagacggaccgcgccagtgcgtaatcgaagcagcgcccgagcgcgtgtgagtgcagcggtgcgccgcgcgtcacgtcggcaggggaacaacaacgacggcgacgggaccaggacgaggaagaagcgcggctcggcaatgcgtcgtccgctcaagctcaaaccgctccgtggaaggccgaggggatcgcgcaaatcgagggcggcgccgcgcactgctggacaaaagcgtggccgtggacgtccgaggaccgtgaaaaaaggccgtgcccgacgggggaggagcgctgcccagcggcagacgacgacgactgcggatgcagcaaccaacactgacgcaaccggagcggcgactgtgacaacggacgcggcgaccactgcgactactccaccgacaacgacgaccgcggacggagcgacggtgaccaacgccaacgaacccggtgcgactacggcgaccaacactgaggcgcccgctgcgactactccagcgacaacgacgaccgcggacggagcgacggtgaccaacgccaacgaacccggtgcgactacggcgaccaacactgaggcgcccgctgcgactactccagcgacaacgacgaacgcggatggagcgacggtgaccaacgccaacgaacccggtgcgactacgacggctgcgacgaccaatactgaggcgaccgctgcgacgacaacgacggcgattgcggatggcgcggtggcgactaacactgacgcaaccggagcggcgactgcgacaacggatgcggcgaccaacactgaggcgcccgctgctgcgactgctccgatgacaacgacgacgaccgcggatggagcggcggcgactaacactgatgcaaccggagcggcgactactccgacgacgaatgcggcgaccaatactgaggcgcccgctgcgactactccagcgacaaccgcggatgtggcgttggattagcatcatggcacaacaacagaagaaggataagaaattgacatttatccgattgatcctttgaattgtacatatgtatttcgttgatgtgtgtgtatcatgtatcaatcaatatctgatcacttaaattgtatgtattggtgatatgcgtgtggatataaactaatcaaagtcttgtaaatgggaccaaaaatatgaaaaaaggcgtcaaattttgctagtaaatgtttttaaaaattgatttcttccgcttaataccaatagctctgtgtttctcatttttgcccaccgatcagtgatggatgagttagcctgaacttagagagagagagaggcctacagatccgcttttcctgtccggatcagctagagagaggacactgatcaaagctaacctgataatgtcattaaattaattttgatagaatctgaaaatcacggactccactaattacctctaaataacacctacagaaaaaaaagcgacaaaaacttccgttttccgagtataatatacacacaacacacagacataatacatacacattatgatgatacaaattacaatgatggatcagatcagtcagtgttattcttgctgttgctgctgttcctccgctggttcttcagggggaattgcgcgcatgaaattgaagcggcacacgggacagttggtgttgtatttgagccagcggtacaggcaccttgaggggagataatgataagcgttgcattaatccgaaataatgatgtcaaaattgggattctaggccttgaaaatccataaatcttcacccaaaaaaaaaaaaaattttttttttgacaaaaaaactgggttcaaggcaatttatgctaagaaaactcgacttttagaattgatcgtggaaccatggattaaaattgatcggaacggattttgaattcggcgaccagcaaacgcaaaacttccggtattttggccaggaaaactcgacttttagacttgttcgaactcggggtcccatgggttcgaaattgatcagaattagccccgcctccacctgcgatgaaattcgtgcacacagcccatggtcacacgcgtcatggagctcactttgcccagacacatcatgcacttctcccgtgcgatcgcattgcgtgtctgaaaaattggcaaattaaaaaagggtgccgaattgaattaattagtgtattaattgccccctctccccctcgcgcgtcactcacatgtccggctcgtccaattgcggcacgcgccttcttggcatttcgacgattgattttgatgctccgtgctcgcgctgctgatgcccttgtcctggccgttgttgctctgaccatcctgaaaaaagggcacaaaatttatttcattttaaaaaatgaaacaaaaaaaaactgacgggaattatttattgtataggaagacgattcgaccgatggaaagaaacaatgggtgaatgcaattgaatgaatgaatgcatatggtggggaattcatcgcttaaatacggagaaaatttcataaatttgtcagtcatttttcaaaaaagtataaattgcagaaatttttttcccctcctccccccgttcagcgaacgcgcgactaaaaaattgctgcatttccgctttcactcactttttttaattcggctttatccctaaattgaatttttgcaattaaattttagcgcttaatccctctctctctgttgctatcacaacacaattccaattcgtcaacagcttcttcttttccctcatcgacgagatgacttcttcaagatcggtgatcccctcccccccccccccattttcatgcgcttttccgccaccattcatttttccctttcctccccccgttcagcgaacgcgtcgcgcgacttccaatactgcttcaactgctgctgctggccgtggtcgaagccgttcaagaaatacggcgggtcgtcgttccgcgagcaacaggagtagggcggcatcgagcaacagggacagagggacgcgtcgtcgttcgtcacgcgccaggaacgcgtcgcgcagaggccaggacagaagcgggacgcgtcgttcgtcttccaccaggaaagcgtctcgcagaggccagggcagaagagagacgcgtcgttcgccatccgccaggaaaccgccgcgcagacgtcaggacagaagcggaacgcgtcctccgtcttccaccagcaaagcgtcgcgcagacggcaggacacagggacgcggcgttcgtcatccgccagcaggaatgcgtcgcgcagacgtcaggacagaggcgggacgcgtagttcggcatccgtcaggaaagcgtcgcgtagacatcgtcggcggattgtgccgcgcaaatcgaagccgaagaagcggtccaagtcgaccaagcggcgtggacgtggacgcccgcggaggtcaaggcgtggctacagacgcccaaaagatccgcatacgcccatagaatacggcggctctctgaggaacattcaactcccgactacttttgagacgttcgatgttctgccaccggagctgccgaatgaaacgctgcaaccactgggcgaaatcccgacttttggcatgctcgacctaaacatcttccttcctcctaggccaactgaacgtaattgtttggcaacttccaagtttaatgaggagccaccgacccttggaaaattttttgttttattttcaaatgtagagttacacgggaccgggacctggtcctgaaaaaagtgtgtcaactgagtaccaaggtcccgattttgaccgggaccgggaaattcccggttttcccagccaaaaaatcccgggttttcaagccgaaaattcccggtcccgtgcaactctattcaaaagtcatgaaaacatgttattttgggggagggtcgctgatcacgaatccggtcacctcttttcgacgcaattccgaaccacgtcctggcttttgaaaatgaactataaaaatcgggtccattattaaacaataattatcggctcctggcaaaagtgccatgtttttggggactattttttttgttacatcaacaaatatatgtatttgtgctgtttttcaaggtcctcctgctgcaacgaatggaacggcgggcgcgaatgtgacgacgacaacgacaccggcgacgacgaatgtcaacaacaatacggcacctgagaatgcggccgccgccagcagctcctcaagcagcgacagtgactgactgaatgacgcgtggtcggatgagccatgcatggtacaacaacaacaacaataacggcatggcatgaagaaaaatggcgatcggaatggacgagaattttgcagaggatactaattaaaaagcatggataattcgcctcattaaagaaatgttgtataatgaaattaagcccgtcaaatccaactgatttgtgtatgaatttccacactaatgcatgccatcatttgatgttactaataaatattgtgaattggttttccgctggggtttttagggtcgattatcagtggtaactaaggctgtataggagtgattttggcaaagctgtagaattgcggtcccgacagaaaataaacttaaaaattttatt

SEQ ID NO: 6079 - DNA, 909 bp, Heterodera glycines
agattttgtaaaatcactgattttatctttgatttttcatcaagtacttgatttttcaaaatttttaaaatcttctttacaagaatttgtggtgaaaaaatgttctaatcatgaatatgaactcagattttacaaaagccatcagtttgtctatgattttcatcaattttcacaaaagaataaactgctgccaagcgggctcgaaccccagaccccgtctcacatgacccgtaagggcttcgtaattaaatttcaaaaaatcgtaaaaaacaaaaaacaacttctccaaacattcaatagctcattcgaaagctctttttgagctctacaaattctgtatatgagttttttacgcccgattaatttttcttatttctatcgggaccgcaattctacacctttgtcgatatctgatattctatgatcctctcaatgtttacatcgatgaattttttgtggagctcgattctcttgtactaccgttttttcaaaataagaaaaaggctaaatctggatttaaccacaaaaaagacaaaaaattggcacattatacactttgaaaattgataacattaaaaaaatttccaacactcaaaaataaggacagtcttattgttagaagttagggtatttaaatttctgattcgggccatccaaccaatactaatcttggatttagttattacatttacaagccctgaatccagtgaaaatgtctcccattttcttaggtttttacaaaggccttttgccaccgcttgtcatcgaaacgccaaaacgtgcccttaaattcatggcttttgaccgctattggcgtgttctccgttcggatgcgcttcccacttggctggtgattgaatgtttggccatttatttgcgcttccattttcctctttttccctagcatta

SEQ ID NO: 6080 - DNA, 5043 bp, Heterodera glycines
caaaacaggaaaaaacctggattttcctggacaaaattttagaattgattttttcaagtgaccgatgttttttcaagttttcaaaaacagattaactaaatttaaaaacacattattattattaattagatatttttagatgcttctaagcaaataattaattttttcagacatttttttgatttttaaaataaatttcaaaaaatccaggttcaggcctggatccaggtctcgaggagcctggatttttcctggacctggattttcctggatttttgtccaggaaatcaaggtccaggtccaacatggaatccaggtccaggtccaggcttttttcaaaatgtcgatctctagttaatactagataaacttacaaataatatttaactcaaaaaaatagatgtgactaagtatttttgcatcctttttcgaatttaattcgctttttgtaacctaagttttttttgctcctatttttgggtttcaagtcctaatattgtgagaaaaatttgggaatatatgtaggaattggcgagagattgggaacggacagttagagaccggcgagatattggttgccattagcgcccatggcatattacccaaaatctccaaaattatatttaaataataaaatttcaaataattttcatagcgttgtattcaatttcttggccaccgaagggaacatactttggaaaccagcgggggaggtgacattaaaaaaaattattttaatatctattaatgattataaaattaatttattattaccaaaagaattcaattacctatttataattttttgtatgtcagcttcacatattattaaattgatatttaatataaaattaaaatagttaattatagtcgatacacaagaaaatttgggcgattcacaaaaaaaagggaaaattttaactttcctatgatttttatcaatatcgttttgtttttgtattccgaataataaataattaaatttaaataatgttatataaaattactgggctgtctaattttaatttttaaatatttatgaaaagttcagttccaaatcaaccaaaatgaaataatgaagcaaaattatagaaatgaaaaaaatagggataaaaatgctatgcctatgtctaagcaagccaaagcttttaagactaagctatgactaatgcttagaattaagtagttgaagtagtgtaagatttatcagtgcaaaaagcaggaattggtagcagtcttgcgccaaaataaaagcaatacaaattttttctgcctttttcgccaaaaaattactatttttgccattttggcctcaatttttcaaaaatatggtaaaatgggggttcgccggtgccgatatgcgcagccgggaaaatttttaactctttaatgctattttgttaactaaattgcttaaatttcaaaaaatttacggaataatatatatttttaaatttttaattaaatctccctgatcaaacgagctgaatagcctcacaattattaaatcgccggtttcaaattgttacatatgtatatcgatataaatataaaattagcagtaaacagaacctcattccaaaaatactttaaataaatttattataaaataatttttttaaatatttattctacttaaaaaatattcttttctttgctttgtttgattgtagtggcttgaaacacattttaaagttcctgctgcggaccggaaaaacggtgcaaaaaattgtttttatttttttaaaccaaaattcattcttttgtacaattatagcctaccgaattcagatgattataaaaagaaaattttcgcgaaatgttcgggttttcgacctcaaaatctgattttttgagcccggtgttcttttgaataatttttgatggccgtcatagctttaatttcaaaatggacgtattcacatgccatgtgaatgtagattagcaaaaaaacattcgtcttgatatgtgaaattaattcagccaaagctcctaattagaatatgaaaatggtgatgaatttattaagcctttttacattaaatattttgccaaattgtttaataattgctcattttgattttgctcactatcacagaagtgccttactgaattaatttcgtattttatgatttcattttctttagcttcacttttctcctctatgtatgaagagattgcgatcatatttatagtcaaaaatttaatcaatttattttgtattaaattcggttaaaattacacaaattcttttatttttcttatttcttttaaaaaagactccatccaaacaatcttaaacatttttcgtaagccgaatcaaatttaagaaactcatgtaaacttttcactcatattaattctcttattaatcttgcaaaaaatgtgcaattttagcaaaaaatcagctaataaacaagccaaattttacataattcccggctgtgtgttatcgctggatactaatagtcaaggttaggctttattttttatatgtttttatgtgaaaatgttttggcataataagcttttttcattcagagaatatataacgcgcaagatttagttgcacaatagtcggctaaccacaattatcattacaagcgcttggaattatatgtaataaaaattgcaaaattggatataaatatttttaaaaatgccgaaatatgctaaatatattcaaaaactcaaaaatatgtacctaatgtaaataatttttgattttttagaaaaaaatatattagaaaagcatgaaatagggcaagcgcaaaatgccacgaagttaccgaagatcttcgaataacattttgtgtgttttaaaaaatttgtttttataccactttttgaatgccattttatgggtacattttccaattttttgtatttttttaaggaatttctaaaaattcataaaacttcaaaatataaaaaataaaaatatttaataaaaattgcaaaattggggtatttttgatcatttaagaaaaatttccataaataatcttcaaaaatagccatattatttgaaataaatttggtttttaatttattatatattaaattaaatttttactttaacatttgcctatataaatgaaaaacaaaagaaaagtattatttataatattttcagttgaaaaaatacccttactaatcaaaaaagcattcaactaaatgaattgaaaatgggacatcaattataaaagctttaaataaaatttttgaaatcattcaattttttgtgcatttcatttagtgatttttccttcatttctgttcccaaatcccactctcaaagcaattcgttttactctcaaccgtctaacatggacaagtgggctgcacttgtgtaagttaattgggtgggggaggggttaattgcccctagaatgaggcaatcaaagcaaaacccgaaaaatactgatcaccaaaacggtttaaatgcgtttaattgatctaaattaaaacaaaaaaaacacgaaaatgagggtttttaatcggtgttaaatgggaaaccgatctagtcctaaacgaatcgagaaacacaggccaaatatagactatctgtccactttcagtctgttgatcgccctgatcaacgcgctggacagcgctgttgttcgacaacagcgcgccgccaacgcggacgcatcgaaaccggaaccgaacaacgaaaagccaggtaaattaaaatgaatttaataaaaaaaatttaatttattaatttgatttaggaaatgtggactcggacaaaggaaattcggacaaaagccagggagcgggtacggaaggaaagaacccggatgagccaaaggaaagccaggaagaggatgaaccaaatccgaagaagccaaaggaaagccaggaagtggaagaggatggaccaaatctggaggagccaaagaagccgggaacgcgggaagcggaaggaacctggaggaaaaaaggccaaggcggaggcggaaagaaaacgggtggaaagggagggaagaacgcgaaaaaaaggggaaagagagcgcccgatgagccggcaccaaagtcgccgaaaatgccggataaatttgacctaaaactgccaagtatgcataaaacactgatcgtcctggggtcagatccaatcttctgacatggcatgttcaggagtggttacatttgttgtctgcatttttttgtagtttttaaatgaaaggtgcaaaaaatatttaattttgtataatataagcaaaaagcaattatttcctatttaaataaagtataattttgtgcaaaattatacatgttttttacagcacttggagaccctcaatattataatagcagcagcatattattttgtagcggatttgacccaaaaatgccatcttagaacagaacaacctaatttttatttcgtcctatttttgttcaggaaatgtttggcattttcccccctttcgtctctctcgcaaaaaaagctaataaaaacttttaagaggaagacccatcgaagtcagctgacgtagtgaactatgtaccaaaaattgaacggcctgaggatgataagaaagttgaattcgacggaaagaatggaaagtgtaaagtggaggtgggcaaaaactatttaaatggtaaataaaattaaatgaacttttttgtgttatgaaaaatgagacttttttctaaattacttgtccatttggggacacaacaaaatgaaataaattttgaacaaaattggggggggggggcggtaaattggacgacaccaagcaaagttctcttctaaagaataaacccatgaattagattgaaaataatttgtgtagctaaatggattaatgaattaagatcacgcttatagaaatatatatgcatataataaaaatcttttacgcaaaacttaattttttgtttaattatttttaattaatttatttttatatcaaacaatggccaattttcggtggccaatttactgggagccaaatttggttggcgtaatatttaagcaggcaaaatttggtcagattatgacattttccatgcatttgtacatatcaa

SEQ ID NO: 6081 - DNA, 2361 bp, Heterodera glycines
aaaaaagttacgatgttttaaaaatgcttggtacgcagctggcgggacctgactccaacggaattaggcccggttctagaaaaaaatttggggagggctcggcggtgccgttaagcgcagccaagaaatttttttggaaattatgaaatatgtttaggaaattatgtaaaatatttaaaatattccctttttttcttgaaaattttttcatttcaccatatatatatatgggcctgattgaaatggtattggtaaaaagataatgtttaatttatttcaaataaaagtgttctttatttgaattactttttgattttctgatcatttggctgatttataaaacgcgaaatatgtgacgggatttataaaacgcattagcaccttatatgattatttttcaggtgtcattctacagtagaggtggctaccaattcgctgccaaaaagtacggtatcgaaaaagaaaaaccaacggaaaacttcaaaaacatggaagaaatcgacgaatacggcttcatgcacggtaagttcttcgcatttaaaaaaggtgctaggtcgtttcgtaaaaaatgtcaatcgaatgataacaaggtttttaaatttgattgtgtttaagaaaggttatttacgagttttctcgaaaaaactgtaaaattgacacttttacgaaatgataggtgaaaatttttaaaggaattttgggatccactagtgcccaaaactgctacaggggaaaatttttattttgtttacaaatttacagaatcccctatgcttacgcccttgtgttggatcatttcacattttgtttggagcttttaattttcaaaaagatttacccattttcgagtctaacttattcgaaaataaaaatcaaaagaatcaattttatgataatgattttttgttttacaaaaaaagggatttacctaaccacatttgcattttttttcgttttcagacatggtgttgctgctgtttgacggttgtgtcatttgtaatggcaaagaagtgcctaatgttacgctgtcactcctccaacatatgccacaggtaaaaaaatatgtttgcccctctttactactatttttacagggaccgttggtcgattcgtgtcaagaatatgttaaacggcccaggtaaaaaacaaataaacagaaaataaatatttgttgaatttgtttttagtaaagcactgattgtgccgatgaagcgagttcaacaagaatcccaaggcaactttgcatacgctgttttgctgatggaacggtacggtaactataaataaatgaatatatactactgtcaataaagaagaaataaaagatcggtaacggcgcacatttacaaatgaccgtattctgaggcatatgcatttattctaacttacggcctaatacgcacaaaaatgattttttaacttcttttgaaacttttcttattttttgtgtctttttgatgtttcatcctttttttcgtgcctttttttaaattcatttgttttgttctatttctggaacgtcaaaaaatgacaaaatcatacttgttttgcatcatagcactaatattttcaaaatgtttgccggcggcctgatcagcatcgccggctcatacaaattagtccttccccagtggtgggaaaagcaaaaaagatcgtatgattaactaaaaacataaaaattcacaaaaaatttcggaaaagaatctttttgaattttaaatggtagacaattttaacaaagattattgtattacaaagactatttctatcagtacgggtttaccaattggaaagaccattttgtgcttttaaaaatgccttttaaggggcgcgcttttttcaaaaataatagattttatgattgggttcattttttaagaaaattaggagtttggggcccggcggtgccgttaggcgccgccgtggaaaattttgagtttttcttagttttttaacagatttttgttcaaaaatgactaaaattttcatcaatctttaaatttaaatgacattatgccataaaattccaaaaatatcataaaatttaagaaatcagaacaaatttggtcactacctcaaaaccagaacatttctgataaatcagaacatatccgagccctgggttaaagtgaaaaattttagcctctgtcctgagaagaaacccgcgaccgacatcgataaccctgccaacaaattctatatgcaaatgctcaagtaagaaattaaaattattaaaatttaattaaattttcaaaatatttttaatgagtgactggcttatttcctgtttagatacagttaccgcgtggtgctggaagtgaaccacacctgcggcgaaggaggaaagaataaaacggtgct

SEQ ID NO: 6082 - DNA, 3312 bp, Heterodera glycines
cagcaggcatcacaaccggttgccgtcacttcgtcggcggcaaaaccgctgccccaacaacactttgtgcccccgccgccctccttttacacggccggcaaccgttcgtccaacgccgccgccgccgcactgcttggcgttgtgccagcgcctccgatgcttccgccgtcggtcggcggtggttggcccaccgcttacgcgacacagcagcaacagtcgatcaatgccgtcacttcgtcatcggcaaaactgctgccccagcagcctttttacgcggccggcaactattcgtccaaagccgccgccgcttcaatgtttggcgttatgccacgacctccgatgctttgcccgtggggcggcggctcagcggtgattggcccaccgttgcccgctgcttacgcggcacagcagcaacagccgatcgactccattccgtcatcgtcgtcatggaattttggccaacagcagcaataccaatttgcggcagatctatcacaacaacaccacaaagtaaaaaacttcggtttgagagaggaggtggtggatgggtagccccaatcaaagaatattttagatgtcgtccacttcatcaacggcagatttgcaccaaaagctgttcgttccgactgccgaagatctttctgacagcatgatatacccatttgatgtgacgcatttgttctgcagagaaaaaacttcggagattttggacccccaggttagcaaatacctaatcattaagagaggagggggtatatgggtagcaccactcaaggaatattaatattttagatggcgggccccacttcatcaacggcagctttgaacccaacgctgttcgttccgactgccaaagttttggaccccgaattggttagcaaataatcattaatttgaattagggaagttacttagacacacaggagggcattagttttgcatatccaaaatgaagcctcttaatttttgtgagtgaaattatggatgacttataaaactgtatcaaaattaaatggttgtggtactcatttggtggtgccgaagatgacccatattgatttgttcaacaaaataatggtcattttcgatttgcatctctttatatcatggaaatgttttctctaaattcgcttttttccttcccaatctccgctcttttcggttttagaatgtattaccctaaaatgattaggcttccgtctgaacttatttccgaattggcgagtgctcttccccttgacccccgctgggccgtcatccgtgtgtcttcggcctttgattttttcgtttatacaaaacagataatttataggaagataaatagccaggaatttaaatttgtcttacattattttaattgttcccacttttaggtggatgaagggcttaaaaaagcaaagcaacaagtttcgtcagttgccaatgctcagtccagtgacgaacaacgacgaaaactgctcacaggttggaaccatcgatgttattttgtatagcctaatagaggctttaccattttgtgttgttgactttatctggtaaaagtcggcatttgttttagaaatcgcggcgtttttcaaaaacaaaacttcagaggctgaagtgattttaagcaccgcagtgtcaacggatgtgaattcatttaaatgtgtgtgcacgcatctttacactcttttggggaaggaggaccaagcaaaagaagcattcacaaattgtaattttggttatggaaatttacatttagaataacaatttcagttcttcttgaattgtgtggagctttctctgtgccttcggtaaattgagtctttttgggcggcctaattttaatcggggcatggtcattcctgtttgtcttttccatttcaaatgaaatttgaaaaaatttatcattacctcatccgtattcaagatactgagcgctggcggtcatgagaacatttcaaaagctttacaaaaaagtttcgagcaagcggaaatctgttgctgcttttgcaaaaaaaatgtgcttttagccaacctctgttattgtagccttgcccaagaaaaatgtcatcaccaatttgagttaattggtttaaaagattaaatatcaaaaaaataaaataatttacatacaaattagctgtcctttcccgattagcttatatttcaatgttaagctgttgcaacaaattggtgcagaagacgaaacgcgatcaaaaaagaacgaacgaagggggcgaggacgacggtcaggcaaaaaagtggcgaattgagagcaagagggactgagtgttttctgagaaatgacacggaaagaaaaattataagtgtgtgtgtcacaaatatgtacatataaattccaacttattcccttttttattttcgcctctcatcccacaaaaaccatccataaaccccgggaaaatattaatttgttcttattgtgttcgggctttgccggtttccccccgtccccctccataaaatcgcctatacatacgttttttgtattcgttcggtcactctcttttctttttcaaaatgaatgtgtccacatttatcgctgctaatttattcacactgatcatacacaatatataaacaattttttgctttttgaaattattaaaatgaataaaaataaaacggaaattggcattttcctattcccaattatcatcggtgctcaattttctgcgtttcctctcccctatttgcttgcgcgtcttcgtccgcctctccatctccagcctcattctctgttcgtccgtctccagtctgagtttctgttcgcttttcctcctcctccttgccccatccgatgttggcacaatgtccttgtcaaagtgtttcattgcgcttccgaacagcacaaaggcggccttcttgtcgcgaatttccacaaagactgttggcagcagcaaaaagtcatctttcgccctaaagccaaaattcaattgaacccgaatgagtggaaagctggaagaaacaatccgaatttgcatccactcagttaatttagaacaccaaaggacctcaaaatgattaaaaagcaattttttctattcaaataaataaaaattcaaaaaagggacaaatgggttaatactgggggtttgttccccccctttttttggcaaaaatttcaaatttttaaaagtcacgtaaaacattttttctggggttttcggggtcgctgatcacgaatccggcatccatttcgcccaattccgaaccccccgaactcaaattcgaaccaaaagtccgaaaattaatttttcctccaaaatccaattattttcaccaaatctattcaaatgcacgaaatca

SEQ ID NO: 6083 - DNA, 3338 bp, Heterodera glycines
aaatggtttgaatgtgccgagtgttactatcaaacccctgccaattggataaaccgaagcaagtgctagcgaaaactcgacttattttcttttgcgtgatatggagacatttgtgccacggattaggaacaaacgaatagaattcacgctaaatttgaaaaattggattattcaattttgttggatacgggcgggattaatcgtaaagggtgggcaaagtggtggacccaggcgggaatcgaaccatcgccctctgttggtgtggtgataggctttccacccacaccagtgctcatcccattcgcccttcccttttatgaatcttttgcctccgctttttaagcatttttaactgtccgctggttagatccttgcaaaatataacgcccaaacaatttgttttttaaatttcagttgtattctcggagaatcgatcacagaatgaaaaatttcaaaaaccagtaaagcccccaagggagaaattaaaatgggaaaaatgcctgatttctcaggagcgaaatagcggactattgaatgttgagccgaaaagcatcccaaaagagtggagacaaacccatcggtaaagcgaaggcgtgcaacgcctcgcacactgtccgaattggtggacaacggctgaacgtccaaaaagcgggcgaagcgactgcgccgtgtggcaaaaacggaggggtagccaatgcgatagatggacctggaggcggtgtccacggaaacgacggcgacaattcgcgtgaaatatctgtgacgaaacgggggggagtaaaaatggaaaattaaagagaaaacgaaaatggactcactttttgatgccggcaaaaacgagggacgaaaaaaggatgaggccaatggagggggagatgggaatatgctgagaaatggacagcggaagagaagccagagaaaagatgaggaacaccaagttgaagcgcaaaatgaaccaaacgccgacaaagccacggtaacggtaaattggggtcctaaaaaggagggaaatggggaaagaacccaaaatcctggagcaaaatgaaagattgataacgaattagggatgggacttccaaaacaaattgaaaatgtaaaaaattctaattttcagtcatttaatttaatttggccccattttaaagtgccaccaaaccatgcattttcggctgtcgctttctctttcagtgccaattcgtcagccgtccattccatgggttggacagactcttcaacgagccggacattcttcgaatcagacgacagtggcatgccactcagaaagtgtgttggtcggttgggagttttgccgaaaagggacggaaggcaaaatgaaattcgatggacggaacgaaaggcattggccaagggaatggccgagacatttggaatgaacagctgtctagcacaaaaatgcatctgaagaatctgataatgtgaaatggattcgtattgtaaaatgcatgacttttatgtattttaagggtagttctagagaatacaaaatgagtagtgaactgaacccttttaaaatttaaatataagaaactttttactgacaatgaattactttttttaattatataaacataaagccagagtaaaaatttaaatttatttagtaggagaaaaagaacggattaatggatttgtaacttctgtagtgataacgatggtctgaattttaatggttagcgttacaagttgtaacactaaaaaaaattccaaatatgcattaaagtatatccacaaaagatggtggtttggaaaaaaccatattgtaatttaaaatgctcgaattgaataatttatgcaagagaaaatgcaaagcgctgaatagagaaaggctggcagtttactgctactatatttagaaaaatccgtaaaattttacgatttggaggcatgtgccgaaattgccagccctaccgatagaccaatcaaaaaatgattttccgttgcattaaaatgaagtagtcaaaaagaaaaacaggaagaaacaaatggaatagattaaaaaaaaagcaataacgttcgtacgaaaactgaaaagaatcgttgtgaaaatatttgaattttgggaaatttgaaaaagatgaatgataataatgagatttttcccatagaattgtttgagaaatttgaggaaggttcaaaaatataaaaaatcgaaaactcttcttcgctttgtccttttttgtccaacaatggcaaaatgtccaactcagttcaagtcgaaaaggtcgtccaccgaatcatcagcctaaaaaagataatagaaaaagtgaaaatgttttcttgcttcgacctgcacatcattctgttcttttgggagtccgttgttgtgtccattttgaaggtcattcggaggaggcggaggcgggggaggaggggggaagtcgaagttgggcacggaattcggcatttgtggaatgccagcgctgctgagcaaaattttacacaaaaaggttgaccatccgataactaaaacaaactctgcggtttgttcttgaactccccctccaccctcttaataaatggtagattaacagacgcgctccaaatttttgatgtcgtggccacgggcgcaaacgtccgtcgtgacgataattgggaattcgcccgttcggaagtcccacaccgccttctcgcgcgttggttgggcacgcctactaaaaaagcatttgcaatcagacaaagtgaagttcagcagagaatgagagaacgcacccactgattgtggtcgcagagaaccctcgagaggtcaaaaaattacacacaatttcggtatcgttgcgtgtgttgacgaaaaccatggtgctacgcagttttttggaacctgaaaacttggcgttttgttttgaacatgcactttttcaaaagtccacttactgtccaattgttcgttctgttccttctcgagttgcaacagtcggacgagtgtgtgccgtttcacggctttttcggcaaggacaaatgtttgtttgatgcgtttgttgggtgtgatttttcctttggagactaacacggggttggggcgcataaattcatcggcccatttcagcacatcttttgaaaaggtggcggagaaaaaaagagtctggcgcaactcagtctaaaggaggtggggacattgcaaatatcttggtaaaaaaacaaatattttgttatgaaataccgtaggccaatttggcatactgccaagtacacgcatatccaaaatgaaactttcgtccaacagtttgtcagcttcgtcaagaacgaacaccttcaaaaggtcgaacatgagctaaaaggaaagagtagacgaattatttcgaagaaacaagcaattttct

SEQ ID NO: 6084 - DNA, 991 bp, Heterodera glycines
tgctaattgatagaaatatttaaatttaattattatttttcatttagttgcagaatataaatcgtaaattacaattagctcaaatgtaattaatttttaactcgtcaattattcaagcagcagaattaattctcataataaactagaaggctgggttttcttaattttagtgctattttttctatcagggcttgaaaaacttaggtttcaatccgattttggacataggcgcaaatgtctggctggacacgatttggatgacatattttaatttttttgaatttattacaaaaatttacatttttctaatataataataaattaattatcccctttaattgctccgttcgtccgtttagttcaccaccgatgagccgtggcctttcttcctcacatttcacattcagtccgttttcggtttctgctcattggccatcaatgttgtgctcattttgtacgcgttttgtgccggcgactgttacaacccgcacacgtcaatgtggcgatccatggtaaaacagcagcagggaacggaccggctcagttcggccccgcacggttcggccctagcccagtttttgatctataactttttcctttgccaaccaaatccaacaatctcggtatcattcgaaagctcttcacatgctctattaactttacaaaaagcaaaaatattttcaagctttaaaaaatttatgaagaaaaaacttcaaaaatattgattatgttaatgaatatggtatgctaattgtatgaaagggcaaatatccatgtagcgtcttactaaagcgtatgtggaagtctgacagtgaattgtgaggccgtgttccctggtccaggtgaagaggatggtaataccacataaaaattcgtccattttttctttatttagcttcgcgctcttttacaagatcatcgtcccgaatccacatgtaatactgatcggaatgcccaatccaacgcaccaggtggtcttttgactcctttt

SEQ ID NO: 6085 - DNA, 3558 bp, Heterodera glycines
aatgtctgattgtgaccagcgactctgaaaacacacataagcatttttaaaagattttttacggaccaacctgatttgtattactttgtcacgcacacattcttgacaattgagagtttaataaaaaaaataatttccaaaattcttacagctaatccgatttcaggaaattgcgaaatttacactaaaaacaaaatttaatttaatcattgcaacagaagaatatttggtacttcgggttatgtcgccccccctcaaaaaaattccaaaattcgtaatttggggtttccaacttcgctgatcacgaatatgatatttattttaacatctgatgacttttaatcatagatttgacaaaatatctatgattttagaaaaataggcttagaatcacatttgaatattttacaaattaatttttgatatatcattttttgaaaaaatcgattttttagggataaatattttcaagctataaaaaaattatattaagaaaaaacttcaaaaatgttgatttttttagttttcatgttatatcttttttgataattgtcgaattgccaagcaatagcttagaaaaagcttctaaacacattaagctttcgaatgatagcaatatgttggatttggttggcaaagaaaaaagttatagccaaaaaatcggctggggccgaaccgtgcggggccgaactgaggtagaccggcagggaatggaaaaaatgcttagaattggatgggaaacgaacccatgcctgcaccccatttcgtagtggcaaattttattgaaaattccaataaatttcaaataccgtaattttaatttattgtgagtaattagctgatgaaattttcatctttcaacgttttgatgaaaaggcacgtcagcggattacacaattaaattgtcaatttgtccacctttttcagttggtcgttgacattttggccaccgccgggttcattttggacgcggaatcggcattgaaattgcgttggttttttgtacaataaaaaataattaattttaaaaaaatatattttctctctaaaataaataatttaaaaatgcaattcaatttttaaggcttttatattgtctcatttcttaattatgcttttccaaattcagaagaattgtccgccagtgcccttccgccctttgcttccgtcgatggttcgtcccaatttgtgccgcccgccaccaccaccaccaccgccgccccgttggcacttgagtcaagcacagttgagcagcagcaggcacagccaaacccattcaaagccgcaccaccgtactccgtgtacgacatcgccaacggcaactttacagtactcggctgcaccgcgcaacgaccgtacctttttctcacgctaatcgcacgccaatgggccgcactgttgatgctgttcatgggcctggaacgacttctgtttgtcctctacccgctgtggcttcgctccattcaaatgaagtgagaaaaaaatgatataaaaagcgatagcattttagggctcggatttatatatttatatatgtatattaaaaaaaattggaaatgttttatggaagcaaaagattttctaattttgattaaataaggaaaaaattttatataattaattcttttttttttacaaaattttttggcgaaaaatgttcattttgtcaacataaattaaggccctagcaatttggacaaaaaaccaaaatattcacaaaataagcaaggaaattttagggcttgacgctattttatatatgaaaatttcaaaaaagcaaaaactttttctgctttttatgattaggtcaagaaaaattgaaataatttaaaaattttacaaaatatttaacgaaaaattgtcaattttaacaacattaattcaggctctggtaatttaaacaaaaagataccattaattttgattttcattatttaactttatgataaggttattttataaattaaaacctaaaaatagtcacaacataaaaatgggaaattaaaattttcatttttgtgaattgactaattgcttcctgatcactttaagtagcttttagcttttggacatacatatatgtaatctttcaaatttatgatttatttttttattccaaatttaatttcattttaaattttataattttgcttacaaagtcaattaattaatttaatttgattaagtgtggccccacttaacgtgttcaccgttttctttgccctcttctccactggcattgcctacacaaatgccacttatgtggcggcctatgagcaaacgcacttttcgtgtgaagcgacttgggcattcggcgaagactatgggtaaaataaaggacaaaaaaaattggcgaaaaatgaaaaaaaccatttttgaattttattaaaattccaaatggggaaaggacacttttggtttgcaatttttttgtaaaaaataagtcgtgaaaaattctttctaggcttttcggggcctcaaattacgaatccgacatcacttttgaccagttcctaatctctaacttgactcgaaaaaagttgaaaatttccatttttaaaaattaaggtaggttagcgattcggaattggttgaattatatgtcagattcgtgatcagggattcggaaacattcggaatcacttttcttacagttagatatcatcttataaaatttgcaaaccaatccgattttactttttattttatttaattgggttttcattttctttttaattcattttaatttatttttctttttacttttaaatttattttagttgattttccttttttcctttttaaatgttttttaaatttatttggttgattttctttttaatttcttttaattatttcttttaatttattattttaatttggttttaattttgatttagttttatttatttttttcctttttatttttaaattatttactttttaatttttttaaaattcttattttagttggtttttctttggcattgtcatcgctccccaggccttcggctgtctgttctgcattattgcctatttcatggtccaccatgaacatgcactgagaaaatttgggggcaatcgcctgaaattagccagcgaaaagagaaaacttaggtttttttttgcaaataattatcaattttttacaaaaatttaatttcaggaaaatcaaatggcttctgatcacttcctcctcattcgtcgcttttccccaaatgcttttgctttttctccaattaattgctccacaagaaatgtttctgatcaaaatgctcatctcccaactgttcttggccaaatgtttcggcaacattttgatgtacaatcgagcgattgcttcaacacgatttgggttcattgaaatggtaattaacgcggttaccccacatttgcgccccggacatttgcgcaccagccatttgcgcctatgtccaaaatagggttctaacttactttttttcaatccaaaatggactaatctgctttaaacaagggattgaaaatgatttatgcgataatttggttgtcagcaaatttttgaaaaataataaattt

SEQ ID NO: 6086 - DNA, 4851 bp, Heterodera glycines
tttagcctattaaaatatttagaaatttttttattatcttttatattttttgaaaaatttccgatttccgacgtttttggggtcggaaatccgatttccgacacttccgaaaatttttggggcctcggaatgccatccctgataaggacctccggaccccctgttcctagttttttgaaaaattgcaccgcaaaaaagtggttttgaaaagaaaaaaatagtcagatttatgaaccgttaataatttgatttccgatcaactttttaccgtcggatccaatcgaaaaatcttagtcgacccatcagccccttttaatgcatcccgccagcccctaaaaatttatttttcagcattttttgatttttggaaattttttgaatttaattgaattttttcgaattttccaaaatcccgcaatcccgcacgggatcccgcaaattttaaatgcgggatttgcgggattgcgggatttgcgggattaatcccgcgggatcccgtcccgcaaaaaaatttgagttccagtcccgcagcgggatccgcaaatttgaaattaccggtctctaattaggaccatcgattttagtgagaatattatgaaagcaagttttttagcctttttaaaaattttccgcatttttatccaatttagcaaatttgtgggattttcttattttattaaatatttctgggtgtttttacaaaaaaaaacccggtctccctgtcaagttaaaagaaacgacctctaagataaatacggaggatcatcattcggcgctgcgcttccaatgaaaagtgccatgaagaaaatgagggctaataataatgggacggggaagaaaggcatttttgggaggcatttggccatgttttttttggcgtaaaattcaaaatgaaataaaaaaatgctgctaattgtccaagaattgtaaacattttcctttaataattgatgcttcttttatagggcaaagcttttggacggtccctttattttccaaccactaaatttgccaatttccgtaattacttttcatatgaaaatttccatttccgctacgttattaaaataatttaaacaaattattatgtttttggtgaaaatcaatttgtatttgtttttgtttttcagtgctttggttacgaatttttttaaactcggaacagaaattttccattttttattctaaaaaatttttcaaacaaataaattcaatgaaatatcgaattttaaattattaacaaaacggcaagataacaacaacttgctaattgttaatccaagaaaaaaaatatatagctttacaaaattctaaaatatgaagctaatgatttttcttttcaatcaattttaaaaatttgatgaaatttatgaatgttgatcaattaaaaaggaaacttgaataattttgaaaattatccactcatttttaaatggcgggttttcaaaaaatttggctttcaataaaaccattcacacatttttaaaagaattattgagaacaggaaggatccgtgagtgtttgtaggctgtaggcacttcagggaaagttttttttcgaaatttatttgcgatttgaagaaaaatttcagcaaaaattttcgaaaaaaggttatgtcattcatagttcttgcggctcgtcatcccagacatttgcgcctatgtcaaaaatcgggttcaaatctgagttttatcaatccctgataacctaaataacattaactaaatgataggaagtgattgtgtccgataatttaatcattagttcgtttttgaaaaaatcatcaattattcaaataacagaattaatgctcctaataaactagaagactatgttttcttaattttaatgtatttagctatcagggttgaaaaatgtaagtttgaaccgattttggacatagccgcaaatgtctggggcgcaaatgtggggtaacccccctttccggcactctcatctttctgccgtaaagttcgatcacaacctttgcaatccttttttgaaaaaaaaacctttttttatgggtacactttccaaaaaatttaatttttcacgagaaatttcgataaattcacaaaaatctccaaatttgtaaaataaaatatgtaagaaaaaaattgcgaaatttagaatttttttgagcatttaagaaaaatttccttaaaaaacctccaaacatgcaaaaaaaaaataggaaaaagtgctaaaaagtccaaaataggtaccagaaatgtaaatccaaactatgtaaatatgtataaaaacgcaaaatatgtaaaataaataaaagtccccatcttttgtgaatacaaaaaagaaaatgtttttccgactatttagaacatctagaatccaggaaaaatgtatttagataaaattggcatccctattaataagtaatttttaattaaaaaaaattaaaattaactttctgtttccaggctgagttttttatccgttggagagaaacagagaagagagaaatagcattgtgagggatagagaaatagagagattagagagagaagatcaaagcgaaaaaaaattaattacaaatttggtgtctatttataggcgtaaattttaatggaaagaaaatctctaatttttctcttaaaaataaaatgacatcgcacaatctttcgaatttttcttttctcacttttcaataaatttcacttgcaattgctttttccttgatacagatttttcttgtttcatttttcctaaatattcttttaaattttgcattttttcttcaaattttgcattttcctgttccatctttccaaatgtgtcctcccaattgtttctcaatttttcaatttgttcccatttttcttttttatcacttgctttcagctcaaattcgagcaaattccattcaaccgttttaaaaaatttcgggtttgcattattccaaactttgttttctttcaatttttcgaattgcattaataagacgggaacgatttgttgtatatctgtaagaattgatcatataattgaaattagacaaaattaattttttcccaattgacaacaaaaggcaaacccaaaacaaaaaagctcaaaaactgaattatcatatctttaccaattaaatttcgagactagaagcaaaaaatcattttaattcttgaaaaataaaaaaaatatataagaattcaatgtccgatgaatcagttgttgattcaataaagaagtttttttattggaaaaataagtgttaaagaaaatgtgttttaaattggaaggttgaacatgaaaaagttaaaaattttcgaattttttgaattttcggtatttttttaatttttgatcattttagtgttttttttttcgaaatttcatgtgataagagccttaaatagggacaaaaatctgaaaaatgtttataaaaataacaaaccaaatcaaaagtttttattaattgatgttttggtcgaattagtgcaaaatatgaaacaatacaaatccgctttacttatcacattatccaagatttaaaaaatcaaaattccattctaaagccaggcttatccctaattttgtaaagaatatataatctttttttcaatttcaattttattataataccattgtcaaaatcaaagtcaagttcaactgcttttgcgaagtttacaatgctttcgccaaaatattttcttatttctttgcttatgcttaaacattaaattaacgaattatgttgtttggatgaaatttccgttttatcaacatacgattgctataatagacgaatcgatttttttttttttttgaaaattagacaattcataaattaacgctaatatttcaaatgttggggatttttggatcagtaaaatacacgaatttggatttttgaaataaaaaaggtgtattttttgtttattttttttttgtatgcagttgtggtttttatcctgtttctctttactcaattttcagttgctaatagaataatgaatactatagactctaaaattatcatagaaaatttcttttttttttaaaaaaataagaaaaaaggcaaaaagaagaaaaaaaagaaggtaagaaaaaataaaaaaaatatcattaaaaaatctaaatgcaatcgtggaaaaaacctacgaacaaaaataactaataaaaaaaaggaattaaaaaaaccaaaaaaaagacaaaaaaatatatatataaaaaaatgtttactgtaattattttgtctacttttactacggtaactacaaaaccactgaccttttgtccgcgcacaattgctgctgcttctcagcaaagcgttcacgtgccatcgaaatggattcaatgccaaccaatggaaaatgctttgcgttaattgcattttccaataattgctcaacaaaaaatgacaaaatgcaaaagcaattttgaacatttattttgttttgttcagtcaaattgcactttgtcaaaaattgcaaaacaaattgaaaaattcggtactccgacgtctgatcggctgagctaatgtctccattgtcatcaattttgctaagaattttcgccattttgaacacttcaaacagtgttggtgaaaattttgacaatgcacataaaaagtggaaattttctgtaaaataaaaagggagttatctgacactaacgccatgcagcagacagatgccctccaaagtgtatacgcctcggacatttgcacctaagtccaaaatcggatttaaacttacattttttcattccctgataactagagaagaccggattttgcggcatatgccttttttgcgcactagtttcgacatattataaatataaataacacattttccacttggtttgaagcttctacgttgacttttatta

SEQ ID NO: 6087 - DNA, 2093 bp, Heterodera glycines
  misc_feature (39)..(39): n is a, c, g, or t
aattaatactaaaggcataaggctttatcatacgggttntaagcgagataattttataaaatagtccaaagtttcggaatggactgtgttataccttatattaattttttcctttttttaatgaaccatttttaaaaattaataaatttctagaaaatattgacaaaattaataatatttaaatttatttaaaaattaaattaattagttatgcttttacctttagcttctttctgttttatttcattttcattttcataattcacataataaggcagaagccaagtcggagaatttatttccagcaaattgttgtcccgaatttgaattttgtaatcaaaaaacctaaactagtaaagagtaaagaaaatcttgatcaatttttaataacatattttctgtttattcacatatttagaactttagagaaattaaataatttaaaaatttaaatgacactaggaaaaaagaacaaatttaaattcatctttttccatttgtgaataaaattatgtttttgtttttcttactcatatgacgcataacaattgttgttggcggagattaatgtgctcaaaaaaagtccgatttgctcaatttgagtacttaatcgaattgccaatgtaagaaacaatttgaaattgacccattgataattatctaatgtcattagtggcttatgtagctgaagcggttcctctgaagaaatattttgcaatgttttctcaaaatccatttccatccaacaaattcggtcaattggagtagaagttcaataattgaaaaacaaaatataataattgaaaaataaaattattattataaataatcccgattcgcacttgacaaaagtattttgtttagaaaatagggaaataatagcaaattatttttttcaatttgcaatttttaaaattgtccaaaaatgcataaattggtcgttttttgatgaaaaactgctaataaagtgccattttcgaccacagcccctataagcgcacttcatccccgttctctaaataatacaattaaatgcaaaatgctcacctctgactaattaatgtaattagtgcactgaatcgcttaactaaatgtacacccatcgaaagtgggaatgaaattagctgtcggtgttcatcataattcacattgtcattgtatttggtgacagtttcaaataaaatttgactgaattttattttttgcttttccgtatctttcaagaaattatgcattctgttctgttgttgacattctctttctacatttatatttacgtggcacgaaaggcgtgacggatttgggaagaatgaatcatttttttggggtgcctatggcagaataaataaataaaaattgacttaggacaggcacgataaaaaataatctgggggcaatccgaagacgccaatttcggttttcaataattatgtctgtgggcgaaaaaataatatttttttactagtctttgtcgaaaaaatgaacaattttataaataattgtttcaaaattttgcaaaattaaatctaattttatcgtcaggcgatgtcgggaatttttgcaatttgaacgaaattaaaaaaaaaatttatacgaaacaaaaaaatttttaaatttttgttattcggttataattagggatgccaattacataaaattagcagccctagttataatatcgcaataattttatgttttttttctcactgggacttcttgtcggcacaaattggttttctaactttgcctaaatccatattgtatttattttatattttattttaatattatttggcaggtctctctccaattttccagatttccgtttatctttcggtgaaaaaaatttaaatttaataattcgaaaaaacccattaaattctgaaaaaaatttccccccacgacatccggccacgccttctttgtgcaaccttttataatctcgaatgatttggcccaaaatattgaccagttcttccaatgcagagattttctcggcaaatgacaattttttgttaaatttttgcaaataattccgaattcttgcacaattctcttttggcttcaattgattctaaaaatttgccggaaaa

SEQ ID NO: 6088 - DNA, 6925 bp, Heterodera glycines
tgccttcacctttttgcaatgcccaatgtccgtcggcaacaatttcaggaaacatctttttgagatccttgataatcgttgctttgtctccatttttttcgatcgcattcaaatgcaatgaagaattgacttttttctttgatgttcggacagtcgtttggagaatggtgcaacttgccacaacgccagcaaactctttgagtttggctttgaatttagttccctttctgcgttggtttcatgggccgctgcttctgtttgaccgccatcaaatttcgcgatgccatcggccgttcttcaatgacttttgcttcagcgatggttgattggtacatttggaggtcttcgacaactccatcatactcgatcaagtcaccatccgctgcaagcttcgatagaattcgctttctcagctcggcatccttcgttgacttcagtgccgtcaaaagcatgaggcacgaaaatttctcgttgagcttgtcgaactgaaaatcacggaaaagccgcttatgtcggttgatgaaggggcgaaaattctcatcgtcgctttttgaggccctcaggcattcgtaacgatcaatccaaatggattgtggccggctgaaagcaaatttgagtcgctcctacgtttggttgaagtcaaaatcgatgacttttttcggcaggcacgacttgctgtattggctgaaagccgcttcgctcagtttcgtcatgataagtttgactttcgattgatctgcgagttgcggtgccgcacagtcgagagcgaaattgaagcgctccaaccaatccgaaatgcttctatcgtcggatggctcggaacagtcgatggttggaagagaaggcagagcatgcgcatttaaggcgggcgcagcattttgtggcggattcgccaacaattgctgaagtgccgctgtgagctgttgaattgcgtcgcccatattaaccacagctcgtggactttcccctcagctagagtactcgttttaagtgaagtgtcgttcaccacttattgttagcagcgccaagctactaatcaagtgggtgcgcgtggatgagctgaataagtatcgcctagatactataaacagcagcgcaaaaaatgctctgatttcaaaagaatccgcaagccacaaatcaaaattgttttggctgcacaaagttcgattttgtcgaggcgtcgccaattgttacgccccaaagtccgaagaggaataaaataatatttattcaaaagaaaaggacaagggcgaacagggtcaaatattgattgggaaaataagggaacaaaataaatgaatgaatggagaagaacgaactgagggaggacggggaggctatttatgcaaaagactgagtggtcaaagaagggatggggcataaaactaaatgggacggaatgccaacataataaataaatcaaataatcaggcccatcccgaacaccttcccctttaaaagactgtgttcttatcatccgggcgtatatcgttcaggcggacgccgatttcgcttgggtctttcgtgctgaacaatcggctgaccggcgcgttcttcgatgatttcgtttggctgctgtggctgatcgggacgcggagatggtggcgctatctcaataactcctccagctggttgtgccacaacatcgccaagttgttgattgacctgtgccaatggaagtccaaaggcatcattcaaaatgtcgaggggatcttcctcatcaacatcagaatgtcgaaccaaaagttggttcgcatggaatcgtccaactgatccgtcctgaaaagttacgtcgtacatcacaccttttttctgggtgatgtgcccgggtcgccaatcctgcgacagtcgatgtcgggcgtagaccatatcgtctaagtcgaacgatctcggcctcgcgccatggcgtcgattgaacttacgctccatttcttcatcgcggatgacgattggacgtttttttggtttcaaaaggtccaatgtcgatcggagtttcctctgcagaaacagttccgctgggcttttgcattcaggcaaagactcattcggcgtgacacggtatgtggctaaaaatgtgtccaacatttcggtgattccttccttctttaatttgcgacacgtccgtttgaatgtgtcaacgaaccgttcggcttgtccgtttgacatcggacaataaggtgccgaaaacaaatggtttatgccgttgagtcgggtgaattccttgaattccttcgacgaaaattgggtaccgttatcggtgaccaacgtttcaggcaatccatgccgtgcgcaaagatagcgcaatttaccaatctggcggctgaaccggtggaattcatctcgaatatttctggccacttggaatatgtgtctacaatgacgaggaacatcttcccaaagaatggtcccgcatagtccatgtgaacacgcttccatgggccatcggattttggccatgaatgaagggtagtctttactggtgcttttgcctccgaagcacatgtttggcaggaacggactatttcttcaatttgatcgtcaattccgggccagtagacatactgacgagcgagatttttcatgcgttttgtgcccgggtgtccgtgatgtaatcgttgtagcacttctttttgaagtgattttggaatcacgacccgttcggcatacatcaaacaatcattctcgattgacaacgcttctctccgtcggtgaaaagggacaatgtcctccgacatcgtctttttgtcgggccactgagtgcgcagaaatttcatcacctttttgagtgtgtcgtcctgctcaagcgattcgatcacattctcatttgttaatgggaaattctacagaacagaatttagggtcccaattgtagcactcgtagaaagtttggccaaaattatgtcgtcttctggcatcggagttttcgcaataagtcgggaaagcacatcggcttggccgaactccaatgtttgttggtactcaatttcaaaatcgtaccccagaagaatgattgcccagcgctgcaaccgattggcggtgcacgctttgattccctttttattgccaaaaatggacaataatggcttgtgatccgtctgtagaagaaaatgccttccaaaaagatatttgtgaaacttctgcacggcatacaccaaagccagtccctctttttcaatttgcgaataattcttttccgctggggacagggaatgtgaagcatgggcgactgctttcattgtgccgtcggaatagcggtgagaaatcactgctccgattccatgctctgatgcatctgcggacacgatgatttgttgcgatgggtcgtagtgagccaatagctgatcagattgcagaatctgaatgacctgatcaaaggccttctgacaatcggtggaccaactccagaccacatcttgcttaagcagattgtccaaaggttggcggatgaaacgcatgttcttctcgaactgctgataatggtttatcatcaccaaaaacgaacgaagtgtggacaaattggtcggcacaggcatctcagcgatcgcctgtattttggctgggtccggccttcttccatccttattaatgatgaagccaaggtacttaatttccattttgaagaaggagcacttctctggcttaattcggaacccaaacttggcaattcgcttgaagacctcttgaaggtgcttcttgtgttcttctggtgatcggcttaccacgatcacatcatccagatatgcaactgcgaatgcacaaccagccaacatcgaatccataattgactggaaaatgccgggggctgacttcaccccaaatggcaaacgttggtactgaaaatttcctctatgagtggcaattgtgcacaactctttagaattttcgtccaactcgacttgtagataagcatcccgaaagtcgatttgcgaaaaaattcggcctccattcaaagtggcgaagatgtcttcaggaagcggcaggggatgctgatgcaaaagcagtgcgctgtttaagccagtcgaaaagtcggcacagacgcgagttgaaccattggccttcttcacaaccacaatgggtgcggcccaatttgtgtgttcaaccggacggatgacattcatcgattgaagtcgctccaattctgcctcaacaacagatttggtgttgaatgggacgggacgcggtcggcagtaaattggagttgcattgggtttcagcgacaaatgtgccttcacctttttgcaatgcccaagtccgtcggcaacaatttcaggaaaaatctttttgagatccttgataatcgttgcttggtcaccattttctttttcgattgcattcaaatgcaatgaagaattgactttttgtcgaatgtcgtccaaaagtccgaaagcatccagcatttcaatccccaataaattcaatgatccacttttggacacataaaatgttccgtttttcgtggtgtctccaaatttgaacttcgcttcccctcttccgagaagagtgcacttggagccgtcgtgatatgctgcttgttcttggcatcggcgcaattgagattttccaatcagacagtgagtctcttcgttgatcactgtgacctcggcgccggaatcaagcacaaaaatcacttttcttccattcatttccacggtaatttcaatgagcctcgttggatggttcacaatgttcaccattacacctccgatccgaagagtgcaagctcttttcccttgaaatttgccgtttttgttccggttgagccactcatggtgcttctcgcattgtgcctccaaatgtccagctttgttgcactttcggcaaacagttttgatgcttggacattcgcttggagcatggtgaaacttgccacaacgccagcaaaccctttgagtttggttctgaacttggttccctttttgcgttggtttcatgggccgctgcttctgtttgaccgccatcaaatttcgcgatgccatcggccgttcttcaatgacttttgcttcagcgatggttgattggtacatttggaggtcttcgacaactccatcatactcgaccaggtcaccatccgctgcaagcttcgatagaattcgctttctcagctcggcatcgttcggtgacttcagtgccgtcaaaagcatgaggcacgaaaattgctcctcgttgagcttgtcgaactgaaaatcacgcaaaagccgcttatgtcggttgataaaagggcgaaaattctcatcgtcgctttttgaggccctcaggcattcgtaacgatcaatccaaatggattgtggccggctgaaagcaagtttgagtcgctcctccgtttggttgaagtcaaaatcgatgacttttttcggcaggcacgatttgctgtattggctgaaagccgcctcgctcagcttcgtcatgagaagtttgactttcgactgatctgcgagttgcggtgccgcacagtcgagagcgaaattgaagcgctccaaccaatccgaaatgcttctatcgtcggatggctcgaaacagtcgatggtcggaagagaaggcagagcatgcgcatttaaggcgggtgcggcattttgtggcggatttgctaaaaattgctgaagtgccgctgtgagctgttgaattgcgtcgcccatattaaccacagctcgtggactttcccctcagctagagagtactcgttttaagtgaagtgtcgttcaccacttattgttagcagcgccaagctactaatcaagtgggtgcgcgtggatgagctgaataagtatcgcctagatactataaacagcagcgcaaaaaatgctctgatttcaaaagaatccgcaagccacaaatcaaaattgttttggctgcacaaagttcgattttgtcgaggcgtcgccaattgttacgccccaaagtccgaagaggaataaaataatatttattcaaaagaaaaggacaagggcgaacagggtcaaatattgattgggaaaataagggaacaaaataaatgaatgaatggacaactaaatgggacggaatgccaacataataaataaatcaaataatcaggcccatcccgaacatttatcaaaaatgatttgtttttaatttttgctaaaataatttattattcagttttgatattgaattaattttttcaaattaatatcttagaaagttcattaattatataatgattaaactgttatttattacttttataaaataaaaaatttaattgaaagtgttattatttaaataaaaataaaaattataaacacataaaactattaaaatattttaattgttacttttttcaaatttcctttcattttgtttgttttgcattttattgtgtctattatttatattcacaatagttttaattagtatattaattgggaaaaaacagagaaaaatttttttacgtaaaattttaaatatatgtttgtattaatttttaatgtttataattattttaataaattatgggctagaatttacatctttattattcattaaagagaattcatagaattataatttgaaaaagagttttaagtattttttttttactaattaatactaaattactgtgtttcaactcttataacatgtgaagatttttattttcactttaattcttatataatttcacaaatcatttatttctcattaactatttaatctttaagtccatacttttgtattaccaaaatttttgttttaaaattagttatacaatcgagggttgtaatcccataatatgtacttgatcatgctgcaattcttgttgaatttagatttctataaatgaatttcactttttttttgttagtttttcaattttccaagtttatttaatttcaattcttaaaattcattcttttttaataaatgaatgtctttttaacggtttatttattattttataaacccaaaa

SEQ ID NO: 6089 - DNA, 1423 bp, Heterodera glycines
  misc_feature (1351)..(1351): n is a, c, g, or t
cctctagagtctttcaataaaaacaatttatttttttcattaaattactcatataaagctacgctgataaaggaagaaaaaaaagaaaaaactttaaaaaaaaaatgctttttctatatttaattctatgttcgattcataaattgttatgaattttaaattttcagataaattcagctgtttgatgggcaatctttacctaaaacggcgtattggcttcaacattgtacaatcatacattcccaccggtctaattgttattataagctgggtaattgaaaataataaaatattttacaatttttaaattaatttaaaaaatattttaaaatttaaataaatttgaaaggtctccttttggattgatcgccgtgctgtgccagcaagagttaccttatcatttacaactttgcttacaatgacgacattagtgcgtcaattttattatttattggaaattaattaaagatattaattaatttttataataccttttagggtaatggaatgcgatttgtacttccgcgtgtttcctatgccaaggcaattgattattggtttggcggtaattttattttaatttcccagtgtagcttattgcattttaaaataggaaactgaaatcttatgcttcaaaattaaggatttatctccatttattatttttttaattcgttttcgtgtgccaaaatctcttaatgtatatggggtctcaccccaaaacatgaactaaaatgggaaaataacttaaaaatcccaaatttaagggagcttaattttaatttggttacttttttcttttttgattccattcacaaatttcatcaaaacaaaatcataaaattttactctatttcaggtatctatttttgaagctgtgtattgtttctttgtgactcttatcatattttatgacctaaaaacaaagcataataaaaataaaaatatatatattgataaatatgtttttttaaatgataatgtttgacaatttttaaaattaataatttctataaatgctttctgtctaaaattactttacagcttgcatgttgttcgttttcatggcactcgtcgagttcgcattggtcaattcgtacatgcgccggtcggacaaatacgaaaaattggcacaacgcatccgacgccgaacatcagtggacatgttggcactttcgccaatcctttcatctgagctggcacatgaccatgaacaaatgttgaaaatgcgacgaaaaagcagtgcactggctcttcttaaaagtaagggaaaattaataagcaattaaaattacgttaattagatgtgccgtttttagaaattttttttgaaaactttttcattccctantaaatgatgaatttaaaaatttatgatttttgtgcccaattttactacgttctaaccaagcattttatgctc

SEQ ID NO: 6090 - DNA, 1724 bp, Heterodera glycines
tcctgaatggcggtggaatttccgataaaagtggccgccattttaatgccccgcgggggaatgtcgcaaacggccgtcttcacattgttcggtatccattcgacaaaataggcggagtttttgttctgcacattcagcatttgctcgtcgacctttagggaacgacaccataagaaagaagggcagcgaagcagaagcattccctcccagcggacctccttcatgctcatccgaccccggaaaatggccgccaccgtcagataacgcccgtggcgagggtcgcacgcggccatcatattctgtcatatgaaaaggactcaccaaagggcgagtccaaagttcaagcgaaccttggcatcgaacatttgctgggtaagttcggggacggacaatgcccggtactgctgactgccgcgggaagtgagcggggcgaagccgggcatgaagaagtggagccgggggaagggcaccatgctgaagcgagccaaacactgcacggaacagcacgcacccgcacacaaactttgtggccaattttcgcaggtcggcgttcagttggcccggaaaacggaggcaagtggtgaccccggacatggtgatgctgaccaagtggttcaggtcgccgtacgttggcgtggtcagtttcagagttcggaaacagatgtcataaagtgcttcgttgtcgatgcagaatgtctcgtccgtattctccaccaattggtgcactgacaaagtcgcgttgtacggttccactaccgtatccgacacttttggcgatgggacgaccgaatctttgccaagagggggtttagccagggaaagctcccctccccttgtgtacatgtggccatgattcggtccggatattcctcgcgaattttggagatcagcagcgttcccatgcccgagccagtgccaccgccaagcgaatgggtcatttggaagccctgcgaacgatcattgaccatctcctcgcccgcgaatgacttccgccaatcgcctaatcacctgaaggcagtcacaattctccgcctctttcctcaccacgtccaacacattgtccaccagttcggcgccttccgtgtagtgtcctttcgcccaattgttaccagcaccactttggcctgaaaaatgaagggaattcgaaaaagcattcagtggggagagggcggggtgggggggaagaacgccccgcaccgaagatgaagttgtccggccgaaaaagctgtccgaaaggcccggcccttacggagtccatcgtgcccggctccaaatcgaccagcaccgccctcggcacatattttcccccggtcgcttcgttgtaatacacattgatccgctccagctgaaggtccgagtctccgttgtaaattccgctcggctcaatgccatgttcgtccgaaatcacttcccaaaactgaatgaatgcaattgtgatcagatggacaaaggttcacttctgaaatgtttctttggcttgcttcgacctgcgcctttttaccttcgctccgatttgatttccgcattggcccgcttggatatgcacaatttcacgcatttcgaacgaaaatggtaccctaaagaaggctgctaaagggccacctattgcacagcctatggcactttttagcaaataaatgcagccaaaatatgcctatccccacccctccccctcccccccccctccccgggggggggggggagggtcacttaccccccccccc

SEQ ID NO: 6091 - DNA, 3510 bp, Heterodera glycines
  misc_feature (1878)..(1878): n is a, c, g, or t
ttttagataataaatcggacgaagacacaacgccaatcgaaggaaaaaaagagcggcacagtaaagaaatggacagttcagcaacagtcagtgaggagttgtccgcagcagaaagccgagataagcagcacaacagcagcagaagagcaaaacaccggcagcagcaagcagtacctgtagcacaacatccacgacaacaaaatcatttgccaccaaatatgggcaatggcagcagcaggctgaaaaagtgcttcagcaatgccggtgaaggtggtggttgtggaaacggcatgcccaattatcatcaaaccaccactacgccgggaatgatgaacggttcatattatggtaatgtgatgttcgcattacggtagcatttcgactccaactgtgatttggcttgtacttttagtcttgaaaactttttatttcgggtttttgttagctaagtcaatgtgctggttcgtttcgaaaatcggccattttaatattttcgacaaacatggcataacaattttgcattcttggtatcattcgatagccgagatttttctttattgctgaaaatttccaaaaatttgttaaccttcgaaaaatgtatgaaaataagaagtatattattgatgaaaattatgccaaaaatagctaaaatgccgtaatttacgaaaaacccggccagaaacgcactcgaaaaaccaaaaaattttgtgacgctttgcgaatgcttcctgtaaaaactttgtaacacgatcattcttcactatagccaagttgattatcattcatttagacaacatgaattggtcactgaatggaagaaaaggtttggaggacaattttgtgccagaaaagttgaagaaaagtggcggcatttcggtggcatttgccatggacgaattggtcaaaggcagaacattgaatggaactccatgtaagaaattccaattagcatacctattcgttttacaatattaatttttgcttttaaggtgattacttgtttccggattttaatgggaaaaaagatttgaagcaaaatgacaaattacacccagacaatgcgatcaaatacctggaggtgaagcagaattttttttttttgattttttctatgggtcggggtcattttggcgcaggccattttggcgcagacaagtttaaagattcataacttttttttaattcgaccaaataaaataatgttgatattaatcaataggtctaaatgttctttattagcctgcaaaatttcaaaaaattatattaggttttaaaaaagatatggcgcgctgcgccaaaatggccaggaaaatgcaattttttgaggttttttggccataacttttttgtttctcagctaaattttttgaaactttgcaggttaataggcactatcaagccacttaaaatcataccaagattatttaattttgctgtgaaatcaaaatgatatagagtcttgcgccaaaatggcctgcgccaaagtggccggttcccccccggggggggggggggggttaagttccccaaagtgttgcaaatttattgatttcatgtgcggtagaagaaatgcgaaggatgacggaatagtgcgaaggatgtgccaaaaggagaagaaaatgtggcagaatgtcacggcctttttcctccccttaaattcattgtgccattctccgaccttttgtccaatgctttctttcacatttttggcatattctcttaacatcgcctaagttggcatggaaacgtcaaaacgatggtaagacgaatttgaagcgccagagagagtgcaatttgtgacttattgcgcgttacaattggtcattttccgcctttccttttcacatttaaacggtaaaacaaattcattagccattntaaggaaattatcaaatcatttcggttattaagctcatctaattgcaattcatattaagtacattaattatcttctgttatttaagttattaattcatatattgtgacacattgaaataattgaaattttatttcttaaaatttatataaagacaaaagagccaaaatacagactcaggtaaatttaagtgaagagaagacggtgttttttctccaaagatttcaaaatgttcaacgccttcgagtcccgtcctcgaagaacactccgccatcgatggcacagtatttggggcagatgcccttttcgccggctcctccgggctgtccggcgttgccaggctgtccgggctgtccgtcgtttccgggctggccaggaggtccgggcggtcctttcgggccgggctgtccaggtcctccgggttgtccaggcgggccagcgtttccaggctgtcctggggctccagcttctccgggcggtccgggaggagcagggccagctgcttctgatgctgcaggctgtccgggttgaccggggcctccaggttggccgggccctccggggtttccaggtggtccgggaggtccaggaggtcctggctcggggtttccgccaccacttccgggctgccctggtgagccgggctggccgggcggtccgggagggccgggctggccgggttggccgccagggcacggtttgcacggaggctgaattgcgacattaactttagccaataatagcttaaagttaccggggtagcttgttcgcatggagcggaaacagatttcccgggttgtcctggtgatccgggtgctccggggtttccgggattgccggggcggtcccgggggacctgctgggcccgggcctccgcctgagcagcattcactgcacgagccacctcctcctcctccgccggacactgcgccgcctcctcctccgtatccgtccgcttgacgcgccgtacgatttcctcccaccacggggatgctcttcagttggttcacttccgaccaaatgtcctttgcagaacccttaagaggagaaacattaagaaattagtgaaaaattcaagaattggcgcacctgacaagcactcaattccctgtccatattctgagcgacattggacacgtaattttgaagcataggcaaagtgaagcaaacggacagcagcgaaatgatggagaaggacaccgtggagtaggccacgaagcggtaagctttgatcctggcttcgaagtccattttttgagacggttttcctctaaaacgacaaaaggctgaagtcagtgagtaaaaaaggaactttccgagagtaaaaataggttaataagactgggtttacttaatagggcataaatattaacaaaaagctccaaatgattctccgagggaaggaaaagagaaaagagaggcggacgaatgcgcaaagaaagcaaagcaagtcaatttgcagagaatgctcgctgatggaattgtgtggccaatctgctcgttttatatgcgttgtgctgttgcttgcggagaatactgaaaaatggccgcgggggagcgagtgatacactggcaaaagttgaacgatgagacgacgtggggccgcgcagggcggggggggggggggggggggg

SEQ ID NO: 6092 - DNA, 1971 bp, Heterodera glycines
  misc_feature (1935)..(1935): n is a, c, g, or t
  misc_feature (1945)..(1945): n is a, c, g, or t
  misc_feature (1955)..(1955): n is a, c, g, or t
  misc_feature (1964)..(1964): n is a, c, g, or t
tgttaaagaaacgcttaatttatgggaagggggaggaggtatttgagaagcggagcagtgtaaacaattggacttaatggggagggaggaaggaagggtaattactacaaattacaatgggcggcagaaacggttccgcctgcctttccatcttggaaatgtacagaacacaccgaacaaagtcaccgacactcaaattcagaagaagtcgagcaaattaagctcggtgagttggttacgacaggaggcttttggcattgccaaataaattaaaattaattttaaatggttaaataatccattccactcgtatcgtttctcgttttttctgctgaaattgcaaagtatcctccaaagtatgcccaaatgcttcttctcggatcagaggacgttttcgcacgagtgccatttcaacaaaacatcgaataagtcaagaaactctttttttggatttgcaaagaaaaattccgctcggctcggaatttgcagaatttgatgaagttgcaaatagtaacagtttgaatttcgcatcaattcgaacaaatcgttgctcaaaagtctgcgccgaatggtctcttggaaatgaatcccctccccgtggtcatttgctcccattcattcgtttatttatttatttttatttatttatttacgtgcgaattcccgcgcaatgtttcccccccccccccttttgagtggtctgagaaggcaaattagcaagaagaagcaaacgaacgaatgcgcgaataaatgaataaataaataccggtttttcgggaggaatggacgggcaaaagaaaacattaattaccaacggcggcgcactgattgtattatcacaatcgaagcacaacaaatggcggctctgctttatgctaatcctttaacggtttttgtccttttttttgcatattttcccatttattattcattagtcattttgtgcagtttccttttttgctttgttcataatatttattaattagcttccattggtttatttggtcacggtaatgcaaaggaaaaaccaaaaaacttttgatgagaagtcacagagtgtgttgtgacggagtttgagagatgctcccttcttaatgggaatgatcagccaaaagttgttcagtgatcacttttgaggataattagacggggcgggggacgaaatgccaaagaaaggcaaaatgccaaaggaaaagccatgccaaaggcaaacgcaaaactaagagcagaaaggaatggacaacacatgatgctaaacaatttatcattataaaataggaaaagtaaaaaagcaaaaggaaaggaattgggacgcatggccaaatgccaccaaaatgcaaattgtcttcattccatccgcttttccttcttcgcttaacgccttcgagtcccgtcctcgaagaacactccgccatcgatggcacagtatttggggcagatgcccttttcgccggctcctccgggctgtccggcgttgccaggctgtccgggctgtccgtcgtttccgggctggccaggaggtccgggcggtcctttcgggccgggctgtccaggtcctccgggttgtccaggcgggccagcgtttccaggctgtcctggggctccagcttctccgggcggtccgggaggagcagggccagctgcttctgatgctgcaggctgtccgggttgaccggggcctccaggttggccgggccctccggggtttccaggtggtccgggaggtccaggaggtcctggctccgggtttccgccagaatttccgggctgccctggtgagccgggctggccgggcggtccgggagggccgggctggccgggttggccgccagggcacggtttgcacggaggctgaattgcgacattaactttggtcaagaatagcttcaattaccgcggtaacttgttcgcatggagcggattgcgtttttccgnggttgtcctnggtgatccgnggtgctccnggggttt

SEQ ID NO: 6093 - DNA, 5323 bp, Heterodera glycines
ctgctcctgcagctcgaaataggcggccatgccccgctcgcggtagttacggccaaagtcaaacacgctgtagttgtttgtgtggaagccggccaaagtgatgaatctgtgagggacagagagaggggagcggggaacagttattgaaaaattgaaattgaaatttcaaatttaaattgcccggagaaaaaattcactgatatttgaagcccatggcgcccagctccttttggaacttctccatgtcgctgggccgaaggtgctgacgccagttgaaggagggcgagcagttgtaggagaacaacttgtcaggaaactaaaaaaaacaaacaaaaaaggggttatgcaaaataaatgggataatgggtcgaaatttacccggatagaggtctgattaagcctgatcggaaccgggatttgatggctattgatgcatgtaataattgaattttccgagactcgagaatttcaaaatttctcaagttcatttactattggttttggcaccttttccaaagagattttcaatgcttattaaaatgcaattagaaaaaaaaatggctcgaaagctttctgttttagcaaataaaatttgatttaattttaagcaagaaaagcttcgccataacctattccttaggaaaataaaaaaacgctaattccgagattaaaatccaaaattataacggaatgcccaatagacttttctcgagtcgaaagtgatttgtcaggctcaattagcagagtaaccagcagccagatcactcacttttccgatcattcgcttctccgatcactagtttttccattcactcgctttgagtttggctcacctccttgcgcacgccttctgcaaattcgcgtgccaccgacagtttcgggtacgatgtctccatccagatcagatcacaatggggcgcgtagaatttggcacggtcaatgcacgactgaatggcgttgtcgtcgcgcagacgaaaatagccctctgcggtgcgcccggcggcgtagtcaatgtacggatggtcacgctcatcaatgtccgtggtcaacagccgtgccgactcggcgtcagtgcgtgccacaatgatggttggcacaccgcaaacctgggagggaggagaggggattttgatttgtttgggactcgaatttctgaccctcaaaaattgggaggcaagtgcgtagccagacccttggcttcggggggggggggggctgaattcaaaaacccaatttttaggggtgtatttttatttttttttattcgattcttaggggtgtattttttgtttttctgaaatcccgaattaggtgggtgtgttttttgaaaatttcgagtaatttataatttttcttcttattctaactctttgtgcaatttgtaatttttttttttgtaaaattggctcatttgcataaaatacatatgctgaaccaacaatttggatgggaagagatggcgaggcggagggggggggggattaaaagatttgaacaaagaatggaggcttggccaatcttctctccgcacaaatctgctcgcaatcgtcattcggctgttccgttgctttctaccatcgatttaacaaattccaattaaatgaagcgttagaattgcctatgaattgcttaattttttctattttccaattttgttagatgaaacgtaaaaattccggtttgcaagacattcggaaatttttttaattcgtccgcaacaagttcagcagcatcatttaaatgttgtcaattcttttaaaaaccaagacgcgttccattgtaatttatctttttgtttttaatttttgatgaaaaatcttaataatttatgtcattaaacaattatttacttattatattaactattcttttcttaaagaatatgtttttcgttaatttttggaaaattttatatctaaaaaatatctcttttaaaaaacactccacccaatttacaaaattaattatcctcgtgtatatgaaaaataatttaaaaaaaaacaaacatcagcagccaagcgagcggcattcagatgacgaatgtgttgcgccgtagggatcaacacctgaaatgatcaaaagtcaaatgtgtaatgaccatgagtgaagtgatcagaccaagcaaagaaaattccgtaatcaattaaattagtgtttcccttatcatttgccttgttatttaattcgcacaaaaaaataggccgggaattaaatgctcatattacttagggtggaacataatttttgatacacaaattttttttattaaaaattttttttaatttcaacaaaacacaatcatgattcaaaatacccgccattattatcaataatatgttgccattattctggcaagagatcaataccaatggaaaagtatttagggagttagagttaagtaagaaaatggtcattttagaggtaggtatttttgatggctgatttaaagaaaaataaaagagatacagagccagagaaatagtgattaaatagagcaaagttaggactataagaacacaaaaatataaaattttaattacaaaaattgaattattggagagccgagactgaaagtggtctccaaaaacggcatttttcaagaccaccaagtaacataatgttttaaaagtggttttggaaattctgaatttaattaaacaagataaatcgggtatgttgagttcgaatatggtcttagatttggtctctgggatcgcaacaaacctgtacagctcgaacttcatgcatggagttggagcagtacaagctcaggttgaaaagataggtcccatttaagtccatattcggattctactggtctaaattgtatagaaaaactaagattttgttatatcagctttggttttttgaccataaaaaattcgagaaaattagtgggccaattttcaattttggcatggtcgggaaaaaaggcagaaaaatctatcaatcaaataaaaagtgaaacgatagtaagatataaaagaggacaccatgaagaacaaaataaaaaaagaatcatttaaataggcgcagaaataacggagttatgaatttttaaatattggaaaaaatttgggtatcaaaaattatgttccaccctaagtagttgcttaattatgcatgacccaagaggcgagaccaaaaaaataattggaattagaccgggaattaaaagatcattagctgcttaattaacatggcccaagagttgagaccaaaagaagcaattaggctcaggccgggaatcataaaatcattgacgccaaacgcataaaaattttctgatttcaggatcgcggccaaaaggttaattcaacaatctcggccaatatttaattgcaagtccctcccgctgctgctgatcacctttccgcccatgtggccgcacttcttctccgagcctagctggtcctcaaagtggacgcccgacacgcccgactcgatgtacgacttcatcagctcgaagcagttcaatgcaccgccgaagcccgcctccgcgtccgcaacaattggcgcgtaccagtcgcgctgtgccgtgtagtcctccgcctctacacactccacctgatcggcacgacgcagggcacggttgatgcgccgggccaactcgggccccgaattgcacgggtacagcgactggtccggatacatgtcgccaaccgtgttcgcatcggcggccacttgccagcctgcggtgcattatgaaactaattatcattaatggcaaaaaatgaatgtccttttgtcccccacaatttatccataatttttaaggcatcaattagaaattcaaaattttgacaattttttaaatttaaaaaatgctaaaaaaattgcaaatctaataaatattaaaagttcacaaaatagtaaatttttttgactcgtattttgaatataaaaattaaaaataaaatttgatttagttttaaatgaaaaaagcataaaaaatcggaaaattcatttttttaaattttgatataaaaaatgttggaacaattataaactctcataaaaatattaaattttaaattaattttttatttgaaaaagtattaaattaaataaaacttaggattttcttatttaaattaaaaaaatttagaaatcaaatttactttttacaaaatccaaccaaatattttatgggctcacccgataaatagatggcctttagcccagcacggaccatttgcaccgcttggtttcccgtcagcgcacccaacgcggcgatgtacggctcggtgtggagcaattgccaaagtttgttcgccccacgggtggccaatgtgtaactgatcaaccgaacggacggagttgatcaaatcagtcaaaatatcccccccccccccaaaaaacgcactcaatgtcgatggagccgcgaagtttgagcacatcctccacttcataattccgtttgatgcccttgtagcggccctttggtgccgttttgatcacctgaaaaagccaagaatggattaaaattgttggccaaaggtgaagccaactgctgggcaacaaaattgttatagatatgatcacattattcgtcacctcctttcattattctgatcattaaggtattttggtcaagctgggtcagagagtgcaaaatgatttgatatgatcgcttatcccgcaccccaaaaatactccaaagagaaatgggtcactttggatattctgatcgcattacaccgcatttcacatactgatcgctttagatattttgatcacactggatcaaagattgcaaaatgaactcagtttagcaaaatttcccaatttgtgttaaatattggcacaaaaacagatttgctttgctgactaattaattcggttaattattttgattacctggtagaagttctttgccatttgggttggtggttgtgtcatttgggcaacgaaaagtcaacagcagacgcaaaatttgattatgtgttttattattaattaattggattagatcgaaatggagaattaatggatggatgaaagccttaaattcgttggaaaatgaatgaataattaaataaataaaatggggacgacggaggacccccggggggaaatggggggggggagggggtgatgcaacaaaacaacgcattcgcattcattttgttatttccagccagccaaaagcagcagaaatgggggaatgaatgaattaaatgaatggacaaattggcggtgactgatcggtagggatagggacgatgatgcaagaaaaattgaacgaaaatgatgatgatgatgaaggtggtggttggtgatgaaagagatgctgattttttttctgatccaacccgctcta

SEQ ID NO: 6094 - DNA, 3813 bp, Heterodera glycines
  misc_feature (3756)..(3756): n is a, c, g, or t
ggttaaaaggcaaggagtggatggttcaggtggtgccgatcagggctgggcgaaacttcggcttcggcttcgaaaacttcgaaaacttcgggttatttgagcttcgaacttcgtgcttcggcttcggctattttacccgaagttttgggaaaaatacacccctaaagattgggtttccgaagtgaaaaatgcacccctaataattggcttttcctttggtaaattgatttattacttatatttttattaacttttcctattattcacatgtgtggtcaaggggtagtgctcttggttatattcattgcttttgctttggatcaagtcccctccaagtatatgttttccttttatttttcaaaattattccttttttagacggaaattcaatacaattaaaaattaaaatcgcaaaatgttttgatttttgaattcaatctattaacaaaacgcactaaaatttcaaaattttccccggcggcgcctatcggcacccccggcacccaaaagttatatttcatttttaaattgagtcaaaaccgtgaatactcaaaaattataaaaattttcaaaatatattgatcaaaaagttcattatattttttttatcgggtttgttggtctttagcagttttgtcaattgaatcaatttggtatctaaccgaaatttgtgatgaaaaatttttgaaattaaaaaaaattttgaaaaaaacttcggcttcggcttcaaaacttcgaaaaccgggttttttgagcttcgagcttcggacttcgccttcgaataaaaattgggcttcgccttcggcttcgagtgttaagccgagcttcgcccagcctggtgccgataggagccgccggaattttttttatataatttgtcaaataattattttaacatttttatcaaaaaggataaatcgatttatttaaattttatttaaaattccttacttttcatgagattcatttctgaaacattttcttgtaataattttgttgagtagaggggtcaagcggtgcctataggcgccgcttggaaaaatttgagtgaaaaatgtaacagctttccctaaaaaaaatgatcaatatagccactaagctacaaaatgatcacttttctgctggtttttgattaaatttaaaaaattaaaaatttgaaaacatccttattttacttactaataaaaaataataattttattatgtgtggggatcgaactaatttgtaagacaaaaacaagtgaaagactggaggtttaaccgcttgactatattaatatagtttattattttttctcaactaaattttcctcttaaccaattaaaaaaaatattttctcacagcccactcccccattcttaccaatgtaaaaaatctcgtgttgaatgatctccatcaacgaagagtttggccaaaattctctatatcgacttttttgggaatttttcaaaaaataaacccttaaaaaccgaaaattttttaacttttagtaagaaatttttgaaaaaaatttatttatataaattcatgtatttggcattttttagtgtatacaacttcgaaccctacttatcatttttaacagaagttttgaagcaatattttatttaaaatagaatctatatttttaaataaattaattttttttaatttgggctcgtaggcttggtaaatgtccagcccgatgcgaccataggaagtattagaattagcaaaaaaaatctgtattctaattttgggaaagaatgtattaacaatatagatcacgatcaaagcggatgccatgaaaagccacacaacgcacgaactgccatctttttatacagatgagcagttacttgcgtacatagacctaaaatttggtaatttaagcagttgtagagcacaaataaaatactttttaaggtggaataggtaatgaaattgctcatcatggaaatgtgcaaggtggaataggagatatgcaatcgattcgatctgccgcatacacatacgtaagttaccactaaataagttttctaaatagcttaaaattaataaaatttattcattaaaatttatatcgttgcgtctttctatcgcaaaatacttgtaatttagcctctcggaatttggaatttcttaaaaacaataataaaccgagggatcataaagagagttaagcaccctattattaaaatttttcaagattaaataggcaaattttttgaaaattttacaaagttttcttatatatctatttaaatttccaaaaatataactcaaaaatggaaaaagtattcgctttttggcaaaaaaccactataatttctgctttccgccccagcgttgctaattttacaaaaataaaattggataaaaaattattttcacccatagagcaaaaaaagctctttggatgccctccccgaaatttttttctggatacggcctctcgaatcgggcgtcgcacgaatcgtcaaccacacaaaaatttaaaattttgagttttaattcttaatttaatcttatttactttgttcaacttaattctaacagtatcctatcattaaattaaattcataattatcaatttcttaggtgatgaagcagatattcgcatttaaccaaattcgactgttggctcttccgtctgtagttagcgccgacgttgagagccaaatgcaaaaaatcattaccgaaagaaaatgtgctgtggttgctcgacttcaaaaaccagaaatcaaagcgaaaacagtgcaggtaataattggtttaatttggatgtgtctaaaaattatttcataaactgaggatgctctcaaaaatgtgatagccacgcggcaccgtttagaaacctttaatttatacataaagcggtgctagtgcacttcacaaaaaatactgatttgggcgctccacatatgcccaaagcggggcgcatcaaaaagtgcaaatttgggcagttaacaaattcaattctgggcgcttcaaaaaatgcaaaaaacaaaatctgatttttaatgttttttaccaatttttaaattatcaatatgtctaaatttgattgaattgatgcttaaatacccattctttctaaaagttttgctggatttcgaataaaaaataattaaattttactgataattaaatcattagtcagattactgttaatttttaaatattgattaattacgaatggactaaaatcaaaaaataccgatgaatggaaaattatctgtaaatgtatctgtttcatctctacgtggaatttcttgggccaaggtctatgctaaagctttatttttgaaaatttataggctccatgaaacttcaagatttaaaaaattctaagtaatcggttaatgatttttttttaatgtgcagtaatatttgattatttttttattcgaaatccaataaaaattaaaaaaaaaaatatgatgcctttaaaaggttctgtaaatgtccattttcccattattgtcgagtcggttcaaaaacctttttcaaaagccataatatatgctttgctaaaaaacatttcctaaatattaattaatttttacttttcttgattaagttgaaagaaatgttattgaaaaaaagaaaacagcaagaaggtggcgaagtaattttttctgcagttgaactaaaatcgtatgtttaatttgattattaaaaaaggtttaagctttacattttaaatttttgatttaagaatccttcaagaaattgacataacgaaaaccactgatcaagactcgtcacagggngtcaaactttattaatataaagtattttcattaaatcacagggtgcgaattaccatg

SEQ ID NO: 6095 - DNA, 2969 bp, Heterodera glycines
caggtgacccataaaattgaggaaagcgctagccgtcgttcggcacccggcgacaccatccaccagcactacgcactgaacttgacgaatggcacgttcatcgactcgtccttctcgcgcaccaaagtatgaacgagataccatagtaaggagtagaccatttcgccctaccatgaaagaatttttataaaaaaataaaaaatagaaatttttctagtgattttcccaggtttatggcgaactacttttctaaaaaaattaaaaacgtatttttctgattttcaaagagaaatccttgtttttcgtacctaaaagaagtttttaacttcttttcaaaaattatatgcaaacaaataacaatttcaaaagaccaataaatccatttccaccctatcagcaccaccggcttcttttgatcccaagtgcactaaaaaaaattatgatttgcttatttcctacccaaaattgttaaaatcgataataggaggtgaaaatataatatttaaatttattttttatcgaattaattgtataaataactgtttggaagcaatttcgcaaaatgttcttatttttttacccatcttattttttggcccttgatgttcttatttgaaaaatttcagatcacatccctctgatttatccccctcccttccactacatttaagccgttcatttttcgtcttcaccacggcgaagtgatcgccggaatggacaatgccatggcctcaatgtgcgagggcgaacgtcgtcatgtagtgatcccagccgcattgggtgggaacccacgtttaaaaccaagggtccccggcacaaagctcatgaaaatttctggcttctttctccctgtttatttatactgtttctcctttgttataaaattgatttttttttattttctaattaggctatggcgacaagggccatgacaatatcccaggcggcgccagtcccaactttgacattgtgctacacaaactaatcaggccgagagcaggcgaactttgataagcaggacggacaaatgataacatggcacagagggaatcgtcaattaattaattattattaatttatcaatttatttccaaattaaaatgattgcttttacctacatttgatgatgtttttcaaatctccttttaatttctttatatatttcttttgatgcttaaatacccattctttctaaaagttttgctggatttcgaataaaaaataattaaattttactgataattaaatcattagtcagattactgttaatttttaaatattgattaattacgaatggactaaaatcaaaaaataccgatgaatggaaaattatctgtaaatgtatctgtttcatctctacgtggaatttcttgggccaaggtctatgctaaagctttatttttgaaaatttataggctccatgaaacttcaagatttaaaaaattctaagtaatcggttaatgattttttttaatgtgcagtaatatttgattatttttttattcgaaatccaataaaaatttaaaaaaaaaatatgatgcctttaaaaggttctgtaaatgtccattttcccattattgtcgagtcggttcaaaaacctttttcaaaagccataatatatgctttgctaaaaaacatttcctaaatattaattaatttttacttttcttgattaagttgaaagaaatgttattgaaaaaaagaaaacagcaagaaggtggcgaagtaattttttctgcagttgaactaaaatcgtatgttaaatttgattattaaaaaaggtttaagctttacattttaaatttttgatttaagaatccttcaagaaattgacataacgaaaaccactgatcaagactcgtcacaaggggtcaaactttattatataaagttattttcattaaatcacagggtgcgaattaccatgaagaaataacctatgcgtttggactcagcgacaattatcaggtcacgtttcagatcaaacatgtgaagttgtggtaatgcttctcgttctttccgtcaacctgtcaagcgaaagcaaataaaatattgtaaaattgggtagcgccgatgcatatattgaaattcattaaaaatccaattattaaatttgtccatcaaaattttggcgaaacaatataagccctgaattttacacattttcctgtggcggtatcaattttaacaattgcaaaatctgatgctcgacgttcatttttattttcctaactctttattaattctattttcttctctctcactctcttgctttctctctctctcctctcacttctttctcgttgatctcagtctttctctttctctttgtttttattttgtttcggcataatatttcggattgagcacgagaaacggcagcagcctcatgttgaaggagaaaagaccaagaaaaaggatggttgttccgaggcgattgtgcatcaggaaattacatcactcactggagtggtaatgcattctgttaagaaattgtaggttcaagatttttttgctactttaccaacttttcacggtccaattaagctgaaatttttaccgaacataaccgccccataaatattgagatccacgcaaaaaaatttgcatcaaaagttatactggcgtatattttttcaattttttcttgccctataaaaagttatatgttcaatttttgaacctataatttattacagcaaatgtatttaaaaatttagcagtcaggcaacataaaaacagtcgaacctcgttttcaaaatattcccttgacctcaggaaaacacgtaaataaataattatgatattccatgtaaatacacggtgaaaagtttagaaattttaagaaaaatcttttggacacacatccactattccatattatatcctcagtcaggatttatagctctgattattaaccactctattcaattaattattaaattaaaattccgtccatagcagctgac

SEQ ID NO: 6096 - DNA, 1043 bp, Heterodera glycines
ctttcagaaccgctcaatgaattgaggcgaaatgatgccattggacatggacaaaaagccaacaaaaggcattcgataggatctaaaatttttcacaaagatgaaaaagaaaagttggtgtgattgcgtatgcctcccgaacgctaaattcttcggagcgcaattactcgcagattgaaaaagaagcgagggcaatcattttcggagtcgacaaattcaagcagtacttgtacggtcgaaagttcgtacttcaaactgaccacgagccactaaaagagatttttgggccaaaaggagagctcccgattgtggcggcaaaacgacttcatcgatggtcactgacattgatgaacttcgactttgaagttgtgtactgctctacaaagaatttggcaatgcagacggtctgtcgcgattggcgtgtccggaagagaaaaccatcgactgtgttggactggaagttcagcaagttcaagccgaaatcccatcgcaaaagaagtcaaaaaggatgaaattcttcgaaaagtgaaagaattcatcgaaaaaggatggccacaaaaagtcgaagaaggactaaaaagttttaatgtcatccgaaatgagttcgccttaatggaaggggcgccggatgagcggaaagtgccattgcatccgtgggaatcaccggaaagactgtggcaacgaatacacaccgatttctgcggaccattttggggatcaatgtgctgatcagcatgtatgccaaaagtaaatggctttaagtggtcagaatgcgaacaacaacggtattggccacgattgaggcgctaaggattgtcatcgaatggagccgctgagagatttgttcaaactttcaagcagggaatgaacaagctccaaaaggaggggatgaagcaagaaattgcattgtctcaatttctcctgaaatacggtgtcacaccgcacgcagcaacagaattggcgccttcggaaatcctcttcggccgcaggcttcgaactttgttggatttagtaaaaccaaccgcggcgaatgattttgaaga

SEQ ID NO: 6097 - DNA, 2651 bp, Heterodera glycines
aattcggacaattcgagttcagaaagtgaggacaattcggactcagaggatgaagtgccgatcgatctgatggacgacgaacatctgccagcaccgccggaggaacagcatcaactggagcagccacaacagcaggctaatgctgaacctcgtcgttcaacgcggaagcgcaagaggccgaagatcttcgatccctcggcctgatcacggcttcaagaaggagggacgaatgtggtgttgagagaccaatcaataagtggagtgaactttgttcactcctttcccttaggcactgttcctccccacatataagcgatgctttccttccctccctcgttcattctgtcatttatttctcccattgcaattctcttcgccttgaccattttattattatatttgtgtttcaaataaatatttgttttattcatatctgttgttctcggacacaacacatttcatttaaaaatcagttaaatattgatatatttttcagaaaaaaaacccattgtaacttctcctttgttaaataaatatatttgatcaaaaatcagttaaatattgacatatttaatatatcttttttcaaaaaatatcatttacccctttgctttatccaaacatatgaattaatatgatcaatagaataaaaatatttcattcaataagtaaccgcccaagaaatcactcacactccaaaaataatagagaaggcttatatatatattggaatttgcttctaggctttattcatttagacatacatacatttagcagtttgcaaatagtattttttgaattctaaataaatctaataaaaaatagaaattcatttacattttttagcaattttaaaaatttcattaatggagaaattggcaccgcaaaattattgtctagccgattcaacagcatcatctttggcaaaagctgcccaaatggaattggacttcatccaaagcgttttgttgggcccacagcgaggaaatttgacggcaattgaatgtttattggcacaaaactttagcaaacagtcatcaatgatgccaaattatggcacggaacgtaaaaatgcaaaagtaccaaaattagaaatggaaaaggctggtggtggtgatgaagccaaattggacaatggaagcgagaccgatcaaagtgatcagaagcaaaagagaaaaggggtgggacgaccgaaaaggcatccgagtgaatgcaaagtgtgcgggaggaagagcttttactgttattacagtgtccgatgttgtgaaagtgagtgatggaaaaagaattaaataacgaaatcccgataatcatgtgggatccccaaaaaaagccacgtgatagccgggatcgggaaatgcctggactccgtcttgggatccctcccgatggttttccaaaatctttgggattgatcggaatttggtcgggaacccgactcgggatccctctgacaccagtggccggtctctagtgtgaacaggagttcggcggaagtacagcactttttgccgaaaagaaaactgaaaatggaaacatttttcaatggaccgaaaatggccatccctaatttgaaatgaaaattgttcagcagattctcttttaaattcattaatatataatatttacaaatttgtataaattaaggctgcaagcaattctttcgtcgtattgttgccaagcgaacattgttcaactgttttggagcgaaaaattgtcaaattggaaaaggttgataaagagaaaaaaactaattagcccaaaacattggaatatttatttaaaaagtattaatattttttcagatggcattcgatgccgcggctgtcgcctggacaaatgccttttggccggcatggacccgacaatggtcattgcaatgcaacaggaaggaatggcccaatatttggacagattggaattgcgaaaaaggagtgctttgttgtgaaagaattgcagagaagggaataatttgtttttgtgaccaaaattatgctaaaaaatttttattttattgtattgagaatttagaatatttttgtgattaggtctccaattatatgtaggaatccatatatgtttttatcctagactgtgagagacaaaaaaaaacaacatatttttagcttggttggaagcttttaggatgaatatctatatccatatttttcatatttcgcattatgtccataatttatattttcatatattatgcccaaaagttggtgagatcgtgtcaaaaataagtcaaagagttgaaaaattcgctttttagcttctttttttaataaaaatctttaaatttaacctttattattatttttcttaaaaatgaatacctatttagccatttttgaaagttttactttatatttagcgattctaaagatattttcaaaatttaccccttcaatttattaagtcaacccagaaacgaataaaatggtcatttaggaatttaattcgtatttcgtcacgcacattcgcaacatcggacaccgtaataacaaacagtagaggctcttcctcccacacactttgcattcacttggattccttttcggtcgtcccaccccttttttctttggcgtctgatcactttgatcggtctcgcttccattgtccaatttggcttcatcaccaccaccagc

SEQ ID NO: 6098 - DNA, 1554 bp, Heterodera glycines
  misc_feature (80)..(81): n is a, c, g, or t
ggaaaaacaagcactggtagaatgggggtctgagtgcaaaattagtgagaaaatggagtaaaagaaaaaattagaaatanntaattaaatatattcggtaaagtagcaagaccaactgtgcaaatgacctagtggttagtctccttcacttcccctttttctttcccctggttcaatccctctacagaaagtaaattatttttaattttctttttctatactcatgtgtttcctatcgacaaaatatgattcctcacagtttttaattgatacatattttatcattttttaaagaagatccgtacaaattgagcctagtaatctcaaaaaccagcctttttttgttgaaatttgttaacaaatcacactcaaattttcaaaattttccccggcggcgcctatcggtaccgccggacccctttcttcctcaaaaattttttgaaaaagcgcgccgaaaaaattgatgtgaaaagcaactattaatttataataatattcaatcatttaatccaaaaaatgattaattgtttgaaataattaaagaaatttgtttgaaaattttcattaatttaattagctttaacttttgggttttataaaaaaaataataattttatattattttcactttaaaaaaataattaaaatttgaattttttattatttttttatttttttgaattttttgaatttttaaaattttccggttggtcccggttcccggtcccgaagaaaaatcgaggtcccagtcccggcttctcaggtcccggcaagtcccggtcccggttttgcccaaaatttccggtcccgtggcactctactttatagaccaagaaaattatatgtataactgtattccaaggatatttaatttattcaattttttaaatttaaatttcgtttttttcagagtgattggtaagacattttttggaggaccgtcaagaaagtaaaatttcaaaatttattgatcgaacataaattaaattctttacaatttatttattcaggaatgtgtgctttggtgtgatgacttcgacgaaaattcttcttttttaagacaagctgagaaattattgagtaattatttgggttgtaagttatatgcatttaaattttttgtttttttggtagacatttttagtgcatataattaaatctgtgaggttttcgagaatatatgcatatttgccatcttaaacttttttgaagacatttttggcaaatttcggtaaaaaatttttttaagaggactggaataaaagagaaaaatgcacctactcccactccctaaacatcgatttttgaaaattttcaaaaatatacccctgtttcatgggaaaatttctggcaaattttgttttatagagcatacaacttacattccttgtaattatttaaaaatggcaaattttgaagaaaaaaaaaagttttttcatgtaagagtaccatcattctggcattaaattttgtctttaattagcaaaatttgaataaatttcttcaaaaaaggtcataattttttttcaaatttgcagtttcaagaaatgatat

SEQ ID NO: 6099 - DNA, 1684 bp, Heterodera glycines
  misc_feature (6)..(6): n is a, c, g, or t
  misc_feature (19)..(19): n is a, c, g, or t
gatttntgggcgaaataanttcgcgtcaaacaaacacattttttattgcatttttttgtcaaagaatttctgtttacatgaaatatcgaaaaatgctaaaaatttttacaatattgacaaaactccaaaatattgaaataaatattttttttcaaaacccccaaaaattttgttttattgaccaatattgacgttcaaatgaaaaaattcaagcgcataaatccgtttttgagcttctttcttcaacgcatataaacaaaaaaaaattgaatatatatgttaattccatccctattaattatcttagaatcagccattaagaatacctatatcgaaaatgaaccatttcattttatcaacgtaactccttgaactctatgcccgtgggattgatttcttgcctgaaaaatggcaactcattatcgataataatggctggtgttttaaacgtatttgaattttttaaatttttaaatagatttttttgctaaatttaaaaagaaattttgttttttttttgcgcaaattaaaattcaaataataataattattatatttgacaaattctgcagataaaatattttttacattttattttcacatgtatgaagaaaatcaaatacatcaataatcgatcatatgcattgtttcatgcaattgtattcttctgatggcactcgaatatctgccatattattatacaaattcatattatagtttttataattctatatttaatattaaaataataaaaatattcgtaaattcactttctcgaaccaatttatacattactctaattaattgtcgtgaattagcttaacattctctaatttagttgagaaaaattgttaaatggtgttttctattcttttggcattctgtcttgcggtaccaatccacttcgtggatgccaagtgcgcgtcggatgtcgtggagggaaacaaattgctttcaaaccgtaaaaccataatgaaaaacccacctaaagaaatcggaaagaatgatgatacggaaattaaacagtttgtgcgagatctgttggatcattacaacatggtaggtaaagtactgttcgtggatcagagccaggcaatcgattacagtgtgattgaagcgatactgtacaaaagtgaccagacaaaggtgatcagagaagatttttgggctaaaattgaccacttttttttacaatatgtatagttcaaattagggttgctacccaacttttggagatacaaaagtccgggatcaaaatttcgcgatggctggaagaaaattgaaaaaatgcaaaccaataatgatcattctagataagtgatttgtcaaaatccaattcaaatatcgaagaaattgtcaatgggattggaaagatcacgttgacaaagtttgataaaaaaggaaaaaatggtaaaaagttaaattttttgtatatctaataataaaaaaatcagattcttcggtgaagccaactctaatggataaatttgaaattttgaaatggattgaccaactcgacaaacctatggctgatttaataagaaaattgcacaaatcagtcaacgaattaagtgcttcaattaatgaaggtgtatttaaaaaaataattttatttatttatttatttagattctttggaccaaaatgcaaaaattcaaaattttaataagtttgattaaagaaa

SEQ ID NO: 6100 - DNA, 1266 bp, Heterodera glycines
ggctgactcaagaaacgtcaatttcaatcctcccaaactccttgattaatccttcggccggtttttcctgcttttctccggttttctgattaaaatctcttatgttaatccttccattccgaaccgttcatcagttttcccaacatttcaatcgaccttcgttagcagctgatttttacgtcaatgcttttcgatttgcatttgtttgccccccctcccactctctctttctctctctctgctgctgtatcatcatccgttccttccccctccctcccttccccatttccccttttcatccttttccttccatttactaaacacaactcctctcctcttcctctgctcttcccctcccctcccctctccccctcctcccgctctctcctccactttcgcctcccctcctccacttttcccatcgtcacaatcattctccaacattcattctccgtttatgcctatgcttttccgtcactgatttctccccccccccttttccttcgctttcattttgccattttgatggccatttctccgcccgaccttggcattttgccctctgccgctgtcccagtcgttgtcgaatgccatcctcggcgttgtctgagctgtcgcgcgccccctccgctggtctcccccagtgccactccctcctcctccacaatttcttccacaacttcctcctcttccgccctgtcgcctcccctttctgccattccgcgccctcttcaccctcttccctttttgtgctgcccatctcaatttaatgtgaggacaatttcgacacgaaccgatgagaggaacgaagaggaagaagaagaagaagaggaagtgatgggcaagaggaaggggaagcgaggggccaacatgagacagcgatttggcattttatggacgatgatgctcactggaagggaaggaggagaagcgggtgcggacaaacgcccggggggggggacaccccggtcagctgatcgggactcttctcgctcttctgctgttctaattactttcctccggcgggggggggggagaaatgccatggaaatttgcctatgctccgttcgcttccctttgaagcaggctctccccacctctccgacgattgttccgaattgaatctgctaaaactgagccgttccgctgctaccaacgcctcccaatgggtgtcggccatccgtcaggcgctaatgcccgtcacgccgcagtcgagcggcgcgccgtccgttggcactccgacgcggcacgaaaagaccgactcat

SEQ ID NO: 6101 - DNA, 4411 bp, Heterodera glycines
acgattcgttacccatccgagcgacgaccaaagatgaaggaatacgaaaggaccaatggcattgtgccggtgtacagcagctgagctgatccctctgctgctattctcactctcttctcggccacaatcaatttttctctcccgctttctttctctctctccctctcttcccctctctctctcttttctctctcttttctctctctctctcttttctctctctctctcttttctttcttctctctttctctctctctctctctctctctcttctctttggcccctttctgcactctttttcctgtttcttcacttttttagtccttttaaacatatctctgatctaaccaatcaatcaatcattacgatgttaatttttgtttcgttttaagcctgccctttcatatttccctctctctctctttctctctctcttttctctctctctctctccctctctctctccctaatccggttcacttttaaaatacgaattttgttttcttcttggctttatttcgattgaatgcatttttggatttttgccctttcccatttttatttcttttgtttcatttaatttttgttgttttcgtgaataaataattaataatacaacatattgatgaaaatatattttataataataataatttgttggtaaaatgagtcaaataatcgaatggaccaaaaagaaacagctgaccatcctcagaaaggggaaagcccgcctttccctgtccaaatgatcggaagaagccaacgggagcggcaaaggcagagaaagcgatcagaactagaaaaatgggggagagagagagagagaaaggggaaatgagggtaaaggaaaagagaaagaggaaaaagaatggaagagagataagagaaaaaagaaaaagagggggagagagagggaaacaacaaaataaagaaaaaagaatgtgaaatgaagtgagaaagaggccaaattggagaggaaggagaaaggagcagaagatgaacgaatatccgaaacagagaaagtgggggggggggggggtgactcagacaacggtgctctcgcctctctcattcaatcatttcaccaacggacggatcgacgagaagagaccgactgactcaatgctgccattcccctccccctaaacaaaggcaaaagccaaacagatcaacaaataaacacgtcagattagggtcgattcggaatggcacaatatgtgccgtggtattacaaacgctcaccgcccattttttgtggcgtttgtgtgcccgtttatttgggcgtttggtccgttcgtaagttcatcgttgtgcttggctttctgctctttctgatcggcgttctgctactgctcggtcttctgctcatttgcgtggccatcgaatgttccgctgcgtttgtcccccttcttttcttcgtttatttgtttttcttttcagtgccggtgctttacttccgttcgccttagtgcttatcattgctgggctactacttttgcactgcggatgggctgctcatcttttggacgttggcgagggaatgccgtacgggtgagtgccgaagtcatacgaaattttggatgagtgccgaatttctgcggcattcccccgtggatatctttccattatttaagtgaatattcgacgacaaaaacggtgagcacttcgaccagaacgaaaaggacggcgccgaagggggaggaggagccggtgttcgaagagatcgaaggcaaacagccgccgcccgagatcaagcagggattttggcaattcgatgagcgcgaggcgtggcaaacggtggccaatccgtacccgataaagtggactaatcttcacggaccttcgctttgactgttttgtgtgttcagttacacgctgaagccggtgattgaacgccaaccgtacgtgccataaccatgggaaagcaatgaaaatgccattctctgtgccaattttggacaatcccatcgaatgccactgaattttcattaaatttttctttctctgttgccattctcttatgtgtcaaaatagagattaaaagtcaaaaattgctcaaaaaagtgtggtaaattttcttcttctggaatatattttaattatattaaagtgtaaaatgtgacaaataaatgacaattggattaagtgcaaaacaaaacaaaaacacagaccaaatttagacttttcctgtccttatatgcaattcaattcttcgaatttagcaggtaaggggcccttctgcgcagttcctcaattcctcccttaaaacgttacgcttttttgttaatcaaatccccctaatctttctctgtcctctctctctttctctctgtctctctctctgctctcttttctctttctctctctctctgtctctctctctcccctctcttttctatctctctctctctctgctgctcacattgaataactttgcccgcgtgtcttgcacttggccaagtgccaaaagtgccaacgatgcttcgtcagcggtgtttcccattacgattgtttggtagccacgcgaatagccaatttgttgcagctctgaaaggccagccaaatagcaattttatggtgggtaagtcatcaaaatgcatttgcaattaactaattaattgcccacttcgtataattttgatgggtggtgccagaaacccgtcctggacgagttcatcggcagggaacggctttgaaccgggcaaccgattccgttggggacctaacggatggaagagggacaaatgaccaatcccgagggaaaccgaccgaacggctgaggcccaattaagccaaaaaattcgttgcgtggccgaacgtccaaaaaattgaactaaaatggcaaaaagaaaaaatggacaaagtttaaacgcattcggattcttcacccaattgagtctgctcaaaatacagaatccgtccgactcggccgtggtcagttgctcgaaagtgacgatcagttcgggtcggaagtgcgccttccaattgcccaactgaacgtggtgccgtgccattccattgttttcggttgggttgggttcccccccccccccccggtttggagtgattatgaatggatttgccggaaatatcctttttcctgcccgtctgtccttccccattccctccccattttcacacctccgtttccacttccgcgtcatttaccggaaggtcagccttgcgccacgcgtcgagtccgccgtcgaggacgaacacttcctcatgtccgtaagtcttttgaaacggagagtcaatccgttagcatttgccatcattccctttgcattatgtccctaccctcaacaaaaaccacactcgcgcggcatgcaaaagtccgcccagcggttctcgcgcgtaaatgacgagtcggtctccgctgtcgatgcccaacctttgcatgtactgctcgaatttgtccggagggtacagcgcctgtcgctcattccttgacaattttcttttttcttaaaagaagagtctcccgctgaggtgacggaccaactggggaaagtggcgatgttcacgttgaaaggcaccgcgccggggatgtgtgaccgcgcgtactgacgacttttctgaacattccttccgttagcgtggcattccctcctttctttgcattgccttttcctccatcagtttgtcccaattggcataatattccgcgtagaattgcacgtggtccgtcgtcccagggtccgtctcgtaactcgcgtcgatcactttcacattttggcccgactgaagcgggcacgggagaagccgattaatgctgagaagctgaaactgacctttatccattcatacaattgttctacgtacaccaagaaattggaatttggctgattgatcggagaagggactgacaaaaggggggaggggggaggacgaaattgttgcgattgggaggcggtgatcggctgacaattgccaaacgacggattggaggagaggggcgggtcgaacaaaggcgcggccgtgccggcggaggcggtggggaacagcgccggttgggagggagctaaacgggagagggacatcattaagaggcgaccgctttgtatcagacgtagcgaagggaataagtcattggcttgagaaggggcgcccgatcggctgccgatcaaagcgttgagaaggatgccgagggacgcgccttccccggcgggcacgaccaaagttatgttttgcactaataattttgcggaacgcattgcttccatcagcgccgctaccgcgtcgccagaaagcggctcatccgctgcgagtggcaccgagggcatttccgaagcaatgtcttccttaaaagattggcaaactttgaaagcatgccaattgacttgctatcacatcttgtttctcttccgcgtccttctcttgagccatttgtgcctctttcgctttctct

SEQ ID NO: 6102 - DNA, 2051 bp, Heterodera glycines
  misc_feature (48)..(48): n is a, c, g, or t
  misc_feature (169)..(169): n is a, c, g, or t
aaaatggctgtcagtcagtgaatttaggataagcgctcacccttttcncagcgtttgtcgcaaatgggcactgatttggacgacccatttgcgcaggacggacgccacgcgatgcaacggcacagacaccggcggagaatgttcacgctgttgttgttgttgttgtggngaggaaggatggggaacagcaaaaggcgaaatcattgagcaactcattgaacatctgtgaaaaaaacaattaaattcattaaatatgatggaaaactttcagagaacgagaaaaaaaaagaagcgaatgataaataggcaataaaaaaataaaaaaatttacacttactttcccttcgtcagtgttagcattaacggccatcacaatttcgggtgattgcagccattcaacgagactcttcagcagctgaggatcggatgttgtgttggtcaaatcggctattttggtgaactgatcactgaaatcgattaaaaaagaaagtaaataaatttgcaaattgctcgattatttgtcttacaaatggcagatggagagaaaatgacgaaatttgttcaatgtgaactaaaattcagaaaaaatggtaattaaaatataaattttaattgaatgcctcggctggaccaatgccgaaattgtcaagttcgtccagcatttggttcagtacgcaaatttgcgttaaatggcgattcagaatggcatccaacacatcgaacagtcggttttcaccgctaattagggcaccagcggatgatgatgattgttgtgatgccaatgccatggaaggatggtgagaaacggcagtagtagcagcagaggcatttgcacccgaagaagcaagcagttgtcgttgatttatgactgaaaatttgaaaaacttattatattttaaaacaaaaaatgattaaaaaataaaataaaaaagaatttttgaaaaatttaaaagttcagtttttaagagaagagcgggactgggcttcattatcaaaattatgtttttaaaatttttcaaataaaaaatatgcaaaaaaatagggagaaaaagaaattccactttttttttgttcttgtatcgacaggtttctcaaattttaggacacttccaaagattcatagaaaattgaatggaaaaaaacactccgaggaatgtcttacgaacattgttggatgtaacggccaacatggcttggcccaagttcgacgcgcaatgcgcagaacacttcttgcggctgcaggagaccgactcgctttagaatctcggccatcgcgttacccctccgctgttgaacatcagtgatcagttcgttcaacctggatttagtgcaaattaagagaaaacagtgcccattttaaaatgtgccattcacaccaaaaaagccaattcgccggctgaatggtgtccacgtagcggaacagcagctcatccacggcattcatcagcttttcggaagggcatgcggaggcaattttgagcagccacaacaatttggcgacagaagtgcgcgccttttgcgcaccgaccatcgaaatgtgctccaaagtggacgccatggcctgcacaccggtgctcagtgctgaactctcagagctaaagtggtgaattttgaaattttttaattgcattgttaataatttatcataaattttaaaatctgctaggaaaatttttcaaaaatttattttatttttaaattttaattcaaatagcaacgtcttaaaattaaccaaaactcattgaaaaaaagtgaagtaaactcactggttagccaggtaaagattgcccagaaaattggcccaatgcttccacacggaagcgaatgacgatggcatggccgtgtcgctcagctcgagttgtgcagctgcagagaaggcacggcccgcctcgtcgcgtctgaaacgggcaaaaatcttaaatttttgttttttattttatcttttctacttttccatccgagccataaaatgccctttgttggtcatcagacgtgcaatttggtcgcgcttcatggattgggaaggaaagtgccttcgatggtctccaatg

SEQ ID NO: 6103 - DNA, 4962 bp, Heterodera glycines
  misc_feature (102)..(102): n is a, c, g, or t
ttgttggtcaaccccccccgggggcagcagcggaagcgttgtcgtaaaagcgcagcaaactgttgaagaactgcagacgccagttgaacaggtccgaccagnccgagttttggtcgacggtggtcagagggcgatttctgaaatccattaaaaaacggattttttaaaaaatttttacgatttatttatttattattcagtgtatctccacctccacgtcttcatcaggtgtttgacggcgttgttcagtgagtggttgctgtttgtgctggctggagtcccgttgttgctgttaccgctccaattcgtcaacagtggcaaattcgaatacagcaaattggccgactcggaaatttcgtggagcaaatgtgaattctgaaatgaatgttttgatgggaaagttgcgactcattgtcagccaatccaacagtaatcccatttttaaatagcaccaattaccgacgactacattttgaaacttggtcgggatcccgaatgtagagtaatttttaaatggataggaattggaaaaaagatttatgtgcaaatcccacgttgagaatgttgatgtgaacatgcgacacaattgagggcagtcgacgccattcactaatcagtgccctgtacaaatcgatcagttggcgttcgattgtctccttgttcagccgaaaattggtcacctaaacggatgcaaatgcataatttaatgggtgaatggcttgtgaaaactacaaacattaagcatcagttgaagcattgttgatcgcacggcagtctgtgggctcgaaatggcatccacttgggcaaagcgatcccttaaaaatggatggaatgtaaaatttattaaactgtgttaaaaacaaaaggattgcttttagttacaaaaatgcattaatatgtttttgacatatttaaaaaataataaagtgcccacttcagctggttccaatcgtgaaggtgccaagccgactccatcgccagggcggcatccgaaatctcttccgacttggcaaaatggtccaacgaagcccaatcgttcaactgcacacatgaactgaaaatttacaacttaccctcttacataaataattaggggtctcctaatttttactttaattcaaattcctcgctaatgatatgatcgatagaaatgggttgtgagcattgctcacctggtccagcattcttcccatgccctttgttccgtctgtagagcggtggaaagtccgctgatggcatccgacgacagcgtttttgacaggcggtcattcagttgtgccaccaatttttcggccatttcacgcgcacgaacgaattcaccctgggcagaaaaacaaatacgtattggtcaatgaaaagcaataattccaagaaatatatgaattgatcgaaccacctgctgaaacaacgcaaagcatttggcagttctgtcaaagaatgaacgcctcttccacaacgcactgaactggtccaattcgtccaattggcggtagagtttagccaaacagtctagcacttcctggaaaagcaacaaaaataataatttggttgttctaataattggaaataaagtccagggtgatggggaacgcgccaatttttcgctggccggctccgaggtgttcagcagaattgggtcggcaaccgaaaaacgaatatccctggccaatcgttctaattgtgtcactgcgacgtgccaacagttaaaggtggagccaagatagctaaacaatgggaagtctcatttgatatgccaaacaaatggcaactgaacaacaacctgagcatgaacggctccaatttaatgggtggagagcaaagaacaaacgcctccatgaaacaggtgaccacggcacggggggagtccctctggcacaaatggacagcggacgaaaggaacggaccggcaacactttcaatctgtgctcgctcttccggagaaaaggtggtccacagagagcagaaaagcttaaacaaaaacgagttaattgtaaaataattgtaggaggatagtatgtagattagacctcaacaaacgttttcctacaaaatgccaggtcggtgtgtaaaatgtcgaccaaatttgaaataagttgggccacggtaagttgagtggccagtgaaagaaggctaaaaatgaaaaagtttagtaattaaattgtaaaaaatttggattcggttttccatttttttccggaaatgaatttccaaattttcccgaaaacgtatttaatattctaaaacctgatttgcatgtcgagcattgtcgtcctgttgctgttctgcggtgaattcctgttggccgtcgccgcctccagcagcgattcttcgccaccgcttggcactgacaacgatggaggtgcctggggtggagatgtgccatcaatgttgtccgccggtgcggaaaggcgcagtgaagcaatcttggcatggattgttgtgccctccgtcgctgcaccaccatcgcggacttggtccagctgcttcgtcgggctgtcccccaaccgctcggcaacagcttgtccatgtacttctccaacttgttgtcgctgctggagttgtaccctttcgattgtgtcggaatctgcagcagcaacaatctgtgccaatgtgttgtccagcgtagcgcattgcttcaactccaccaaacggtggtgctgctgctgctgttgtttgtcgtcgtcgacagcatgttcggacaacaacagcaaatgcacaacatgggccaaccaatcgtagcgacccatttgttgccaattctcgtccgtcaatatgtgcaacaatcgctgtacggtgccattcgggaaacgcctttcgaacacggcaaaaaacctatcagatatatgcaaaatcaatttataatcctataaggtcagcgttctttccggacctgtttctgagttccgggttcgggctggccagtccccagtggaacacgggctcaagtttattcagtgtggcgtcgccttcggacagtaacaggcgttcttgctcgtatagttgaaccacaacattcaggaaatgccgttgcagttcattgttggcgtacagtcgttgttccatcgcgccgtacagcttgacaagcacgagtgcaccctgactttgttgtgactggtggtggtactgttgctgctgcgacggctgcccgtcttggtgttgttgtgcaagtgcgatttcgcttgtcacaatttcttgcgccactttgatgatgttttccactattttgtccaccgttcccttctcgatcagcgggaggagcacaagttgaatgacgttatgttgagattcggcgctggaaaaagcaacgaaaagggtttaattaaaacaaaatatttgttttaaaaagtagtatcatatatcgaaaaatatggtagaaaaaatgtataggaaatatgggagagaaactcaccttaagaattttgttcgagtgcacagcatttctatacagatggacagcagatcactgatcagcttttgcgcctgatcaagtgcaccggttgtgcccacattggacatgatgtgttcccggacgagtctggaaaaaataaccaaaaaattacaccattaaataaaaatttgtcgaattttttttacgaaatttctttaaattttttttaaagattttatcttgaaatttttctaagtttgaaaaaaattggggggggggggggggagaagaactgctccccccccaaaaacgtacctctgcagcaggttaataaacggcatcaggcacaccgcctccaaataactgggctgtgccgagtgcatcagccgcaacagagtgatggtggtcatcggtggagaggcgttgttcaatgagccggcatacttcgcgaacgagtcctggatgacccgggcgatgtggtggttgagcatgtccaactcgtccaacccgttagccgaacatttggtcttctccaacagtttactcagcacattgtaagtgctgcgcagaatttgctgcaaaaaatgggaatttaatcaaagaacaggaatttctttaaaaattttgaaaaaaatgctaaaaattttgaatttttaaaaaaattttttgtagaaaactaaaaattttcgttttttaaaatttggacatgttcagggcagggatacgctgtttttagaaaataaaaagtttaaattttataaaaaaatttccgtgcgtttttgctactgtcacctgtgagttggtgtagctgatgcacgaaatcatcgcgcgttggaggggccggaaaatgtcgagcaccattttgggcattagatgatgcgtgacgttggtgagcacgtccagtgtgatctgcacttggctcagctggtggttgatcgcctgctcattgcccgtgccgaactgctccgtgttgggcagttgaagctgtttttcaatgctgaatttgatcagaattttccatgcccgtgggtttcgaattttttttttgtactttcaaatgtttgaaaattttataaaaaatattagtttcatacattgtcgtccttagcgtggcaacctcgccgaacacagccggcttcagtgcgcttctcaaaagaagtacggctcggcgattgatgtgttccatgcctgtgttgctggtactgctcgagccagagtactgacaatgagataaatcaacatatgttttccattgataaaacacctaaatgttttcacccactcatcacctgatcaacaaaggtggcaattcggaacagaaaagtgacgacggaatcgatgaaatgtttgtccattggcttgtgaatgtccgctgctatgccactcgtcgacgactgttgctgattgtgtgctgttgttgttattgaagagcttgactccgaaacgaaggaggaggcgcgttcatccgactgtcgatgtggggactatgattttcagagaaaaataaatttttgtttaacaaaagttttgtcttgtctagttattttctatatctcaaggaattttgaagaatg

SEQ ID NO: 6104 - DNA, 7428 bp, Heterodera glycines
ccggtctctagtgggcttaaatgtacatatattgtgggaaccggcctctttggcgcaggccattttggcgcaagactatatatcattaagatttcacagcaaaattagataatctcggtatgattttaagaggcatgatactgcctattagagtcgggggcgtttggacctcagattttgggcccccacgtttggaccaccgtttttggaccctcgtatttgggcctcagggtcgtttcgtccccagcgtcgtttacgccccaagtacagaaaaatgtaaaatcacagtaaaagcaacttattaaatatcagcataaaaatgtaatataaacattatcatacttcatggtctcattaacatcgacggctttacgggtcgaatgttggacgaccttcggttgtccatttacatcgtaagaaaccattgttgattcggagaaaacaacagaattcggatcactaattgcatggttatgcatattttgctgaaataatttaacaaattaataactaaaataaaactattttttaaaattggaccatttgctgcatcattccgccgaaaaggccaaatcctccaaacggactcatcatcgtatcaggaccaaagtgatgctgtggaggctgctgacgacgaagagcttggttttgacgattcagaccatcggtgagcataggatggttggggaacggggggcccatcattccgaagccgttcagcatgtcccacgcatcgcccaacatcgaattcatcatgttgtccatctgtctcatttgttggtgcatttgacttaatgaaaatcaaaggttagttaattaagtactgattgtgcttatttgaattttttgtctgtcttactcaaatgggtttctgaaggggtctcctccgccaccaaacattttgacgagaaattgttacgttcaaattccaaagtaaaattactgttaatttaacgatgaaatgctaaaaagaaataatagaaatattagaaaaaagtatgtacatacaataacattgtgactgatttaaattaggcaatttaaaattaatttaggcacttggattttctttctttttagcaaagaaggaaacatttttcttcccttctctatctccctcaacgcagagagatttgcccctcattcgagaagattccatcctaagccaacaacatttttgtccacatgcaattgctgcttttttcctttctctgacagacaaaaactcacacgttctttcgttttatctctttctctcgtttgcgagattcgtaaaaatgaaaacgaaaaagaaagagaaacacagcagcagcagaaaattgcaaatgctcaagtgttgtataatttctccctttaattcgtatgagtgaatttagttccacattaaaatcccttaaaatcaaaaaattggtcgaatcgtttgaataaaattagttaggtacctaatttgatgtaaaatcgaaaattatcacgtacgatacgcgattaaatcagagctgcgatatctgagtatttttactcattttgtggtcttttagagggtcaaagaggatttttttgaaaaatgaggatttgcgtatttttgtggtcttttgagaaatttgagtatttttgtggtcttttgacaaaaaagtgacaaaaatgcatgatttttttttatttggcaaaatgttcgaactttttcttcaaatcttaaacattttttcgaaaaatcctcagtcaaaatcattttttttgacaaaatttttaacaaatcgcgctcaaaattccaaattttttccggcagcgcctatcggcactgccggaccccctcccccaatgttcccaaaaagttttttgaaaaaccgcgccacaaaaagagcaatttaaaagcaaaaaatttaacagatgcacagtgaaagcattggcccaactgaagtgcaacttcgatttttcgtgctcagacttccataataaaatgcttataaatgacaagaaattgatgacattgattgtttcaaacgaaaaatatgactcttaattgattttatttgcatttttttatggtttaaaaaatgaggatttttcatgccaaatgaggattttttgaggtattttagtggcaaatgagtattttttatgtctgaaatgaggactttcaaaattttgagatcgcaacctgacttacaactcatattaggccaactcgtactgctccaatgttttcggcaacgcctttcggcactgccggaaccctcctttcaggagaaatttaaaaaaatactttgcaaaaatttttcaagcaattcgtttaatgtgtataaatttttggttttttggtgtaaatcttttaaaaaacagtgccaaaattcgtcaccaaaaatttccctcttatttttaacttaactcaaaaacgtgaaagagaatttataaaattttcaactttgaaaacccatatggatttaatttcgataatcgaacatttttctaattatattgcttcggggaaaagtgacaattttttgggttttgttccaagtcttgggcaattctcagtctcgaacataacgaaaatttagacatgttcgtgcaacatgggctcaacattgcaccaaataagtagtataaggtcccaggggccggggtccagacccctgtccctgcttaaaaaaacacccatttttgcttttcatgattttgccccatgtgccggggtccaaatccatgagaggattaattaattaaattaattcatccagaggcagagggactcgaacccaagaggtctaagccaaagcactaccactgggtcaacgatacagttatccgaaaaaggataattagcaattatatatatatatataatttaaaatcgattaaataattcaccaatgggagggggattcgaacccaagaggtcaaatccaacgcacaaccaattgaccgaggaacataatcatccgaaaaaggatatttgtcagttatgtagtaaaaaaagtgtcgcaagagtcaaaaatggacgggagaggggatgcaggcgacattctcccttttgcctatataaagggatatttgtaagcaaaaaaagcacaaataaaaatttttttaaatgttcaacgcaccgtttacattaattttatccggcgctacgggaagtggaaaaactcaatggctattgaaacttttaaaacattacagtatgctaatcgcaccgcctcctgtaaaaatactctattgttattccgagatgaacgattctgtgatcgggttaatgaaacaaggaattgagacacataatggggtaccgacccaaacgttggttcaaagtatgcccaaacccttacttttaatcctggacgacctgatgttgagtgtaaataacgattttttggatttattgttcacccgaggctcccataactgggatgtaagtgtgatttttgtaacacaaagtctctacggacgcaatattcgtaccgcaagagccaacagccattatttggttttaacccggaatccttctggtcaacttcaggtcagaacggtgggctctcaattgtttccgaagaggctaaactattttatggaggcatacaacgatgcaaccagcgaaccattcagctatctggttataaatatgcatcctaatgcgtccgagtctgaacgtttaacaactaaaatcttcccggatgaacagcgtgaggtgtacctaccaattgaataaagaaagggtataaaaggttgagaaaatctgtaattttcactacaaatgtatgaattcagtccatatataagtgaaaacgcagaattttttaaaaaaatcgcctccacgaaatcggaaaaaaagaaaaacatccttctgcgagacgcaacagccgaacaaatattaggacttgttgaaatttgtgcaaacatattaaaattcaatttcagcctaagcagaagccaaaggaaacggttggccgaatacgcggactattatcgtgcaattgcacgctcgcgtagcgaaaagactgcgagaaaaaggctacaacagggaagtggtatagcattaggggcaatattagtgcctattcttggcgcactagctcaacacctggtcgagaaaattacgacctaacaggcgggagctaccaatgaaatatacaaaaaagatggttatggtgccagagagtgagtatttggccctcattaatctactgaaaggaaacagcgccgtatctcctcctctagccgacccgttacagggcgagaaaacgctgcttgatgtacagattcaaaagaatttggctgatccaaaaacgaacgcagaaataaaaatgaagcgtcactcatggttgtacaaacgtagacaccaactaaaagatattattgagaacaaacctcaaaaagtaattgttgagagtggctcagttacagcaccaaacgttgcgccgtatatgggcattcagaaacaacaaacaccgtcgcatgcgagcacaccacaccgcaactcggcttcaattcaatcaattggtgcagtaagtaagagcaacactgatgtagaagaggacacggacttttcaactgcttctgatcagtttgagcctgctgctgatgctgctactacttcgtcaaggaaaacgccgcaccaaaagacgccaaccgtttctttaaggaccagcccgaaaaatttcccaaaaatgatgggcattatcgggaaggatcacaaaaaattcggtgtcaatgcaagcagcggagaaattttgactaatttcaataaacccgtttcaggctctcatttcaccgaatcgttaaagcatttgacaggtcagcgcgaagatgtgcccagaggacatcgcttcttcattcaacgcatctcaaaagacccggaaatgatgaaactgcttcaaaaaataccacaaaggggggaaggccggcggcgcagcacagtgaagaaaatgggaaagaaaaaattagtgcttgtcaatatgatgaattcatcgtctataaaaaccccaggattacaccgaacggaaccaaaacgcaaatttaaacctgaattatgggcaagactatagcaccaaagcagccgactgtggataaattattggaacaaatttattacgatttacgctcaccggccagctatgctggtatgctaaaagtttgggaggaggccaagagaagagatcctcgaatttccttacacaatgtctatgaatttcttcatcgccaacgcacttacacattgtttaagccacggagaaacaaatttcctaggctcaaaacggtgccgagtggcctgcatacagattggcaatgtgacctgtgcattatggatacgttaagggcgcataatgacggttaccgctacattttggtttgtatcgatgtgcttagtagaaaaatttttaccgcagagtcggagtcgaagaaaagcgaacacatgattgaagcatttgaaaaggtgttcaaaaaagccggtgtgctgcctaacaaactatacagtgatgcaggtttggagttccaagcaaaacggatgattgaatactggaagcaaaaggacataatcaaacacataatgtacagtcctagcctgcatgcgggtgtggttgaacgggcgaatcgaacactcaaggagcgcttatacaaatattttagcgaaaataacactctaaggtggttaggggtgatagataaaatcgcaaataatgtgaacagtactacaaatcgtaccattggtacaaatccagcttctgtaacctttaagaatgctccgacgttaagaaaacgcctatataaagaacacactgatgacaaggaaatcaaaataaacacaaaattcaaatttggtgatattgtaagaattagcaaagagaaaggccaattttcaaaaggttactatcccaattttaccgacgaactttttagggtccaacgtgtaaacaacacaaacccgcactcgtacagaatacgtgatttgaacggagaagacataaagggaattttctacgatcaagaacttgtaaagacaacggaaaacggtacccatcgcgcagaagtgctaaaatcgcgtacactaaacggagtcaaagaacatttcgtccgttgggttggcttgtctgacaaatacaacagctgggtccgtgactcagacctagtgaaacgtcgagcatttgaataaagctaaataatggaagatttttacattgtacttccctcgaacacacctggtccaggaaatactgcttcaaattttacggttagacttccgcacactttagagcttgactccaaatggtccgtcgcattatcggcattaatctatccatattcattcccatcgatcagtgtggacgaggatgactctatctctgtcaaactggttaatcctaactacagagaagatgccggaaattctgacgaggaatcgcaaaagtttatcaatttatcagtgaagattccaaatgtacaattccaaagttacaaagtttacaaaaaacactgaatcagataatccagaatgcttacgctacaaagtttggcggctcatcatcattaaatgatcccccctgggacccgtccctggcctccaccacaggtaaaggggggggggggggcggaggacccggccttcatctcgagaaacttatcgcttagtctcttttcttgaccatcgcttttgattctcggaaacagataaataaaacgcaaataaattacaatgtcttattgtttttcattcatttacttctttcatattgcataaattatgatcgaaatttcattgcttttcctttttttcatttttcgcttcttccgccgtcgtaaattttcccttatttttctccgttaatcgtttcattgacagttgggcggcattcaaatccaaagtcggcacatttagttctgcctcgagagtcactttcagttccgttttgtgcgtcttctgctgttcgcctgactttgccaatctttttcgcatgaattggctcgcatttaagtccaaagtaggcactttcgaagtgccttccgggctcaccgcaatttccaaatttggcattttttcatttaggggtgacgtaatcgctccactccaaatcccatcccccctcggcgacggaaaaatttcgtgcattttttcctccgtccgattgctccgggcgattcgttcgtcccactgtttttgctctttgtctttcaatttgctaaactcctcacaaaatgatttccacgatggaaatttcagatcgattaaacattcgcataaactttcaatcgctttcaccaatttatcacaattttctgtgccgactttttggtcagacagtcgcttcaccaaaaagggcattcgttcagcccaaattgcgagtgtattggccagaaagaggtttttcttctgcacttcctccaccctccgcctcaaccgttcccaaagggcgtgttctttctctttccgttcctccg

SEQ ID NO: 6105 - DNA, 7192 bp, Heterodera glycines
cagaagttttggcccaaaatcccgtagtttgaacccgtgtgccttcttctaattccgtcaaattaacgcttgatcgatttggtggggaaaaaacgctgattattttcttccccatacaaaaagacatcaatggccataatttctgaggtgaatttattttggatcacttccctaaattattccacagcagctcgaagggacaatttgacttactgatggtcccagttttggaggagaagtcatttgcttcaaatcaattgtttttacccgagttcctaatagagattgtttgttccaattaaacgaaatttgtgtgatattgttagggtccagtgtaatcgtcgtcacataacttggtgtactttggaagactaattgatccgattataagcataaattttttcggtccaatagctcatttcgttcgcccaaaatggccggttgtaccagtgcccacagtatggggtgtgagatgaacacaaaccccaaaactgagctttcaattggcgatggaccagctggcggtggtgaggtatccgcaactattttctcaatttccattagactagccaatttttcagaatccgtcagttccaagttttcaaacagatttaaaaaattgtcagaattttcgctgtctgctttttccactaattcatttccatttccaaccgcactttctgtttcttgcccgcaggcgaaggaattaagattattacttgaattaatttttgctgatatctaagaaggggaagacgatacataaatgtgcaggatgaaaaaaaaatgaagatgaatggctatgaagagaagaatttattgaccgatcggtgcgaagagggcggggcaatgaacttaacacgtatttaaactaaggggctaatgttagcattattgaatacaagagacaatactttgggagagagaacaagaaacaacggacccaagaagatgtcaaccaatgataattttaaatttgacgattttgaaaattatgaacataaataagagaatatattttgttaaatatttgggattattattaatttttattctctttaaaaaaaattattagtattattattatttttttttttttaacaaaaaaatttgtgcaaatattatttccttttacgacttggcattgagaaggagagttgtgggatgcaccacaaatgattaatgtgtctaggcaaggggatgggcgtattttggtcattccaaagaaggctcagcttggttgttattcccctcaatactgctctcttattttatttatttattttttggcaagaggagcgttagcgttctgtcgtgggcagaagcggtgagatgatttcaaaaaatcatgtctcgatattttagaaaaggaaaagaaaaaagaaaaaaaaatttttattgagtattctctttttatattatttcccgccctcaggctgggttcttttatcttgttattgattatagatattgttaactattttacatttattttttatttattcatatatatatatttttaaatttatatatattttttatttttatttttaccttttttttttactactcatttatgctgataatttctttttgtggtaccgactcattttgtgtaagaaaaatgctctttgaagcctattggcattgtcattattttatggcaaattataacggagcgctagtgctctgtggggcaaaaggcaagggggcgctagcgctctgtggggcaaaatgcaagggggcgctagtgctctgtggggcaaaaggcaagggggcgctagcgctctgtggggcaaaaggcaagggggcgctagcgctctgtggggcaaaaggcaagggggcgctagcgctctgtggggcagtatgtttggaacaaaatacattgtgttattttagttcgaagttttaaatatcaacataatggtcgatatttcaccattgcaatttcaatatcgtcacgaagttctgactattagtgttgctgatttgacgaataattttaatgaatgaatgaatgggtccaaactctcggcttcgcccttcgtctctccaatccgaacttccacggccaagctgtgcattgcaataatgaacagcggtccaccttcatctcagatggatggcatgggaaatcggagaaaagcaaccaggggtcattccggtttggggacgagatgtaaaagcatgatgagaagagagaaagaatgggccagagaaagtgtgaggaaaccgacgcattttaagaattttgaattgggggaaagaaaggccattaacagttcggaataaaaggaaaattaatgataattttaaatagaaatggacaaaagagagagagtgagaaagagagaatcaaaacaaaaagaaatttgcagaacgtgagggaggggaatgaagaaagaaggaggtccaagcgcggctgccgtccatggctgaaggcgacagcttggccttctttcatctgcgcgcaccagaagtttgagctttgccacgagtgcgttcccgagtgccaccttgaggaagataaggttgatatctgttctccgccccccttgactcaccggagttgttgtaccacacatttttaccgtacttgctgtataaatgctctgaccgtaccgcaccgccgttggccgagatcagctgaccgtctctgtcgtaatagttgtcggggttgttgaactgctcgaagtcgaagtactccgggccgaccactgtcgtttccgttgtcgcttggtccaggtagagcgccgccatgtctccgtccggttgagcagcagcaaatcgccaatgatgatcattccatggctggcgcgagagatggcgacgtccacccgcgcggcatcagcccagaaaggctgagagtcggctccactgtcgaggacggagcatgttgtgacgacgacggcaagtgacgactcgtggccctgtgtcgcgtccgccgtggtcactaaaatgtcgggaatttcttgctgggccaccaaccgttcgatttccaatgcttgcgcggcgtagaaacagatgcagcggatgagtgtgccggggaaggcccgcgccaaacgccacagtgctctcatcgccgtgtctgtttgtccaggattggccgaagaagtggacacttcgtcgcgttgcgcaggcgtgctctgatggactaaaacgagggggactccctttttcggcaatttgaatgccgtttggttggtcatcagtgcccgctcggagtcgtcgcgtcctggtgtcaacagctcgccgtgcggtttgtaaaagccggcctccgtgcaacggacgagagctgaatgtgagcgaaaacagaccgacaaagttgtgacgtccgtcccttgtgcaacatccaggttctggatgaccgtgtccatgccgaagtcctcgcggattgcgatcggcagggagggcaaatggacacgaagttggcggcgatcaccggtgatcagcaccttggttaggcaggggagttggcttaccaagttgaggatctggacgtatggcgcctgtccagcttcatcgatgatcaaatgcgtcgtttccccaaacagtgccggcaattgctcacagaaggacaaagtggcgaagcacaggcggcgatttttgtgctcctgcacaattttggcaactgccatttcctgggccaggcgtgggttccgctcgcaggcgtccaggtaccgctccaccttgacgcggtcttggtccttctgtaggagttcctgaaagtcctgtgcctccaccgcggtggcgagcaggtggggggaaatccgctcaacttccttggcatatctcaacttacctgtgccggagaacaaggcaagcatcggctccacgtggtttccggcggccagtgcgtcctgcatctccagcaccagcttgacgacggcgacattcggcggggccagcgccaacacacgtgccgtgggatccgtggccaggacagtggccacgatcgatgccgcgctgaacgtcttgccggtgccgggcccggcctgttggaagaccaggcgcggcacctcgtcgagcatacacagcgcggtgtcgatctgtccctctttcaattttgaaagagccccaaaagtcattaatgggttattggcctttgggctttccggttttaccggtcggcccaataaaattgacataattcggcccaccttttcttttccttcgtccgtcgccactttcgagcagtcattggaccgcagtgtgaacattcgctcctgtagggctctgacggacgtctgagggatgagttcaacgcatccgtcgagttctccacaacgcatctgatcaaattcgtcctgcgcatcctggtccttcgctgcctggtaggaaaggatgactttggcatcaatttcgtatcctacacacaacgcccttttatcgatgctcagcacatacccatgcgcacaaggctttgccttggctgccggattgactttgcaacccaccgccaaatcgatctcccagattttgcacaattcggtgagctcctcaatgctcggcaccggcatgacgaattggatgacaacgcttcgggttgagatctcattgatgacgaccggctcgacgaacagagtgtgcttccgcagatcagccttcacatcgaacgactgcgctgcgacagccgccgccatgaccttctcacccagctggaccttcgcccagctcagttcggcactgaaagggaactcatagcccattggctcaggctcaacgccagcaatgacgttttcgtgatgaacgagcagttcatcgccttttttttaccaaaatcagacggcaaaacatacgcaaactgctgtgaatacagcacccatggcggactgttgatctgccgaagttgaagacggacaacggagcggtagcggatgtcggtatccgtgaaatcggccgggaagtggcgacggtaggcgcgcatcacgcagctcagctcaggtgctgacaccatggccactttgacgtgtcggtcacgggctctttgcacatcgaccaaaatgccgacggcctgagtggggatgcgctggcgcaattggctcacgtccgttgccgtggcttggtaattcagccgtccggttgcttcatacagccaatctccgcgctcttcccatcctgtttcgctcttcgtccactcacacttatgtaagcggaacaaatcgccgatttcgatcggctgggcgttgtcgaagaggctaaaagggacaaagaccaattccgggaaatcccagaaaagtttcatccgtgccgcgatcacaccgtcgcttctcacttgggcgaccagatagggtttccccttatcttccttttcaactgctttatttcccgccctcaggctggggttcaattgcaaattgtcaaatccaccttctcctagcagttcactttcactgccctcactttcttcttcctcttccattccaccacttttcaccttttctttacccatttcatcctttttccctttttctccactcatttcatccacttccattatttccacttccttggtgccctcggcactttccattggcaccgtgtcgggttggaccgacttgagtcccagcggatcactccgatccgccagtaccggcaccgtgagtggctcatttccactcgcattcaccattttttcaagcccgcaggcaagggttttggagacagaagagttggggcgatttgaaggaataggtttttgcatctaaacaaatgaaaaactgaaaaaaaaaaaaataaataaataaaaattgaaaaaaagaaaatggaaaatggaaaaaatgaaaaaataaggagcggaggaaaaatgagaatgaaggcaagaaatggcttttctgaaggatgagccggccttaaataacgacgggtccgagtggacgatgggcgttacagcaaaatgcaatttgtttttcaaatgttacaacagcggcgagctaatgggggaaaaaggcaaaaacgttttctcccgagcgacaggggagattcatcgccgcaaaaagctaatgtcgcgacggggaaaagcaaaaaacgggagaggggacgggagatgaattgctttccgtcggctgccatatttggcacggagagaaaaaaatgggggggcactgcaaaactttggtcatatggaattaattaaaaacgcagtcaaaagcggggaaattgcaattttgaaaagaaatttcaaacattaatttcaattgaattgggttcaattgaccacaaatatgcgcgaattacacaaaaggaaatgccggcaatagtaaaaatgatgccgccaattgtccaagcatttttcgagaaaaatgaggaccaactttgagggacaatttttggctttaggtgtacacaagtccaacccaaagttgcatttctctcttcggttggaaaaattaaattagtcggctggcatggatgggcacaaaaatggtcacaaatttctttatccactgaaattcctttaatttgcttttcttggggggactctacaatttgggcgttcgaactcaatatcagcaaaattataagcaattttttgcaagaaattcttttgtccggcccgcaggcatgggaaatgagtaaagaaagatttttggtttttggcattttaatctgaattttgcgtttggtctaaaaaaagaaatattcaggaattattcggaatgaattttggtctctggagacgatgattgccaaaaataaggggcggtgcaaaatgtgacattagcaaacaccggcacattgataatttgtgcaaagggagaaaaagtcagggaaaatggtgcaagagaaaaaaaggaattctttggccttgaaggggggaaaaaaaaaggaattggatgtgcaaaaagaacggcgccttccaccaaaatcccatgggagatgaatggcaacaaaaagaaaattgccttaaaaaccgaaaaaggaaacaaatgggccaaagaatgccaattcgaaccgaaaagggaagtaatggagttttttttttttgttaaatcaattcatctgcgttttggtgattgttgcaagtccattgcagcacataggtaacggtatgatagtcgaaattgttcattttggagccattgatgaatgttttcatgttcatcagcgccaaatatttttaagttcgttcctacataaatctgctcagtccaccaatcgcgaattccatcactcgaagttgccattccat

SEQ ID NO: 6106 - DNA, 2556 bp, Heterodera glycines
  misc_feature (22)..(22): n is a, c, g, or t
  misc_feature (107)..(107): n is a, c, g, or t
cgatgggtttggaaataaaatntaaagggaaataaacgaataaataatttgaattatttgtgtttttaaaaatatgaatttcgcattttactaacataattgcattntaaggataaggaatttaaaataatgtaaaattaaattattattatttttatcctggcaatcctgaagaatgggcgtaaatttttcatttaaaaattcctaatagacaaaaataaaaggacatttaaaattgtcttaattttaacgagagtaggttgagagcagtcgcacaaattagaacaaaagggtaagcactgacaatgagaaaatgtttgggcatttatttaccttttgtgcaccgcaccgcttcggaaaaggtgcaacaatttacctgatgattaatgctaattaatagcggtaatcaatcaccattaagatttggaatggaattaaaatgaaataccatagaattttattaaagtagttgacaaatctcgtaccaatttcgaaactccagttggaatttctaatcacctatgcttcacgaaaatttcagccaattaatcacacattatgaatatacacacaataaatgattggcagagaaacaaataaaaaacaaaacaaaaataaattaaaaacggtaaatggaatgaaaatttagtttaaaatcaaaagcttagaaatttaatttaaatttttgtagcacaattgatcattgacagtattccagcaaaagaagtgcagcgagatttattgaatgaaatgaacgaatgcaaaaaattaattgggacgatagaaaaactttgaattactgtaaatttgtcgtttggcgagcactgtaaacatttcaaacttaatttacttgacttattttattcaaaaagcaaatgcgatttttatgacataaatgaaacgttaagaaataattttttttatcataatattttttgtgtttgcctattaaaaatggtcaatttatcaaatcatcccaaataaacccaatggaacgaattgttgtaaaataattatgctttaaactagagatcggaattttgagaaaatgcggatcaggatcgggattacggactaggcacacatacggattacggacttacggactaaaaatccggaaaattcgtagtccgtataaatccgtatccaggaaaaatacggatccgtatacggatacggaattttttaaaaattttttcatattcgataaaaactgatttataaaaatacaaattttgaatatttaaagctaaaagatttataataaatttattataaattctaggcaaaaaattcaaagaatactcaaaaattttttcttacacgacaatttattgcttttcacaccacttttttgcggcgcgctttttcaaaaaactttttaggagccggcggtgcctataggcgccgccgggaaaatttttaaaaatttaattttaatttgataacagactttcaccaaaaaagagcaaacttgcgatttttaaccatttcatgaatttcgttgacaaattttcataaaaaaatatctataattttgaaaaatttacaaaaacaagttcgtaaaaaatttaagaaatagaaaaacgaaattcatttcttaaaaaaaattacaaattggaaaaaaaatgaaatagaatttcgtaaaagttcaactaatgcaattcaataacgtaaggattttgagttttttgcacaaagattttgcttttttccaattttttcgatttttgccaaaaattttacgaaatagacccgccaattccaaagtattggcgaattgactgcacaaaatttaaaaatataatccatttcactttaaaaaagccaaaaaaaaatccctaatccgtatgaagaattgtacggatcaggatcgggattacggactaggcacccatacggatttacggattaaaaatccgtaaaatcccggagtacggatccgtaaaaatccgtatacggatcccgtccgtatccgatctctacttttaagcaatgttatatcaaaaaatttttcatttgatgcttttttgactaacgtcgtagcggcataaataatgctttaatgaattttattttcttaaaaaattcatttcgaaaaataaattagagtacaaaatttaataataaatatcactctgatcgttaagtctaataaaaaataatataaaaaatacaaaatatacaattatctccaaaaataataggaataaattaaatgcaaataattatttctttttttctaattactgccattaccttctaatcattttttcaatttatgttcttttttttataccaaaactgataattattttggtgacataagttaaataaatgaaaataatcaattaatagcaaaaaagggtaaacaaacgatcagaattgatcagaggggatggattttccataaaacgccattaaaggagttttgttttttctggttaagaactttatcaagaagatttaaaaacaaaaaaatcctaggtcggtttttcggataaatttcaaatagaaaagtcgaaaaagaaaaaacggtgctgaatcgatataaaa

SEQ ID NO: 6107 - DNA, 3922 bp, Heterodera glycines
aattttgctttaattttcttcagcgatttataattaatgtctttgttgcatttgatttccttcagacgggcaagctcatggcccaaccattcgccaagctgttcagctgaaacattgctgaacaatgccaacgtgatttgccggggacggcatttgccgtccaaatagtcaattacgcctttggccgacatccgaacggtcgggtcaatgtccaacatgttctgtaggcagggaaaaacaaaacataaacaagtccttaaaaaaagaactgctggtccttatttaaaggacaattaaggttgttcacgactggtaaaaaaataattttaaaatatttaattagatttaaacggggtaaaaagatttggtataatcagcaatgtcttgaaaaaaaacttcgaaatcagaacttggggctcaaaaattagatttttcagtcaaacccaaaattttgttattttaaaatttatacaatcgaaatttttaaaaaattccaaaattcggcaaatttttcaaacatattttcattttttttacatattttaagaatttcgcaaaattaccggaatttttatggaaaaataaattttttttttgaaaatgtacccctactaccaaaatttttaatactaaaatatgattctaagcccatttaggccatttttatggcattttgtgcctatttcaccctttactagaaattttttccaaagaaaccatttttttaaaaattttttttacatattgtggctttttgtacatgttttgggatttttttttacattttatgtacatatttttcacatccctatttatttgcttttgctatattagaatctattagcatttgtacaaattgtctgtgacaaattgggagtatggcatcattcattattgagtggttgtgccaataatgctttcaatatccaaacaaattgtgtaatttaattccaattttcccgcgctcttaccaccaaaaggtaggcaatgtctggcattccgtatttgttgccccacatgtcgagaatgttgatgaccactcccgaataccgtagccaccaatcttcagagcctggcttaaaagccccttctagaagacccagtttaatgatcatcatttgttgttgttgttcattaagtgtgccatcatatagtcgggcaaaccgacacaattcgccaattcgtttcactttgttttcgatatttggctgaaaattttgtaaattcaaatcaagataaatttatccaagatcaaaaaacggttggaatcgatttgaaacggcccaaaacgatgagaaaaatgctaattttcgggaactggacaaaattttgctggccgaaattttgcctggacaaaaaatcgctaaaaaatttttcaaaagttttttccattgatatttgtcatttgaaaaattttctaagatttttttctgaaaatttctaaatttctaatttttttttaaattcgtcggcgaattatgtcccgtcgaaattttgtggtgcaccctaattatctcatgaaaatggcaagcgcaccctaattcatattttatgcttttggcatcgattccgctcgtttttgaactaatttgagtttcggagtgagctgatgagggaactgataaataaagatgcaaaacaacgaaaactagcaaaatgggcgccaaaatgcacaaaaaaacccaaaaatgttaaaataggtaaaaattaattaacaaattttcggcgaaatattttaaatatccattttctcgaaaatatggtaagtttaaattaaaaatttgacgaaaaaaatagagtaataaaaattatatttttaagttgggaagggaggattttttgcttttccttacaagtaattttgaaattagtaagctaaaatagttaatttttctcggttttcgaaattagaaaccaaaatgaactcagaaatttggagtcacagtcaaatactacacatcccaggacttgaccaagtttaaagcgaccagcttttaattatgccattagtgtgagttttgaattgttaatgccttaccctaaagtccgccatattaattggcatcgaatttgatgaccaagaaccgttcaggaaattgatgagcacaatctcataaattgtaattgctgctgaccaaatgtccatttttgttgttaccttaattttggtattaatttttatttttaaatatttattttttactttttttacgcgtttcccttgcggcgtttttgatttcgtttccgtagggactttccaaattttctttttaatatttgcataaatgcctgttgatgatgatgatgctttcattgaaggttgttcaagaattctttgctaaattttgaaaaaataaaataatttaaatgtgaaaataataaagcgccgcccgctaacttctaaaagctctggagaggtataatcaggggtaattactggtggttgatcagtttcacccactccattttcaacaaatgcactgccttaattaaaatataaatttaaaaaataataataatcgaagaatggtgactaatagatagggatgcgatttttaggcacaaaaatcgcgaaataggcacctaaaaaggcataaaaaatcgcaaaataggcattaaataggcacaaaaatcctcgaataggcactaaaataggcaaaaaattatttttattatattaacgtttttaggtagtaaatcacgtaaaaattaatcaaaagacttacttttgcttatattccaattgttttaaagttttttcgaataaagacaaatttttagccaaaaatttttatcatgaaaaaatattaaattcggtgatcaattttttgaaatttttttttcaattcttagcggtgtattttttgaattttttttttgggtcatttcttagtggtgggtttttcgtttttattgcatttttgttaaggatttttcaaaaatcctaaaataggcacattaggcacaaaaactccaaaatgccaaagttaggcattataaaagtcatcctaggcaccccaaaccaagcggaaaatgcgtttttcgtgcttatttgtgcgtattaaatggctcccggtaaattggacactggaaaattggacaccagaaaattggacactaaaatactggacaccaatggaaaattagacaccggaaaattggacactattgtacataaaataaataagttaaaaataaataaacaaaaattttaattgaaatatataatgttattattatttgtagcatcagcagcagaacgccatcatacattcataacgaaaaaagttttcattttgatcgggttcccattttttgcgtatttttggcacattgaacaaccatcgccaattttctacattttttggcatcttaatcaatcatcgcctaatttcgtacacttttttccacatttgatcaatcatcgtgcctatttaatgtttgattcactctaaatgccttaatccatttatccacaccaattatttttcaagctaattcctgtgtttattttttaaaagaggaatttggtgtccagttttccagtgtccaattttcctttggtgtccaattttctggtgtccaatttaccggtccccgtattaaattgcgcaaaaattttaggcatttgcctaaaaatcgcatccctactaacagagcccggatttttatgtcctaaaaatcttgaaatatgtaataaaatatatgctaaacaatgatgaatatacataaaaatcccataaaaattttcttctttatttttcaaatacatttgcagatgtttggggtaaaatggtcctattttttgataaacttattttgtacattgaaagctatgtatcagttgaataagtttcagcagggaacttcaaaatccaatgacgaattaatgaaaaacttcaatttggcatttttcgtcatt

SEQ ID NO: 6108 - DNA, 1359 bp, Heterodera glycines
aataataattatatattgaatgagaatattattgatgaataatatgataattcgattgaaaggtatttaattgtgaatgattatatagatgtaatagataatttatttatgtttataatatttatataattaataatgtaggggagcttttggtgataatgaattttgatggtaacacatttgcttttgggcggcaggctttggctgtttgacggcataacttcgcccgcataataaccgacaaaaatctaaaaatttatttcaatttttaatatttaattgttattattattacaaatgctttaagagaaaaaaaagcattggctctatatggaccagggatgacacggaattccgatttccgaaaaatttgaccctcggaattccgatttccgaaaaatttttggagcctcggaatgtcatccctgctaacctgggcaattccccgcaaattattatttaaaaacaataaattagaagaagaaaaaacggtgctggactcaaaaacgatcaaatggaaatttttttgacaaaaatttaattcatgacatcgctcaagagtaaccgaacatttaattcttgataatattcgatagcttaagtgtactctattagcctgctaaatttcaaaaaaaaattcgttaactttggaaaaaagttatggccagaggaactcaaaaaaaaacaacaacaacaacaacaagtttttagtacatttttgttcataactttttgcaaaattaacgaaattttttcggaatttggcaggattaatggagaacatttagggctatcgatgatatcaattttaaaatatgattgctttttagtaaagttataagcaaacattttttatttgcgctttaatgatcataatcataaaaaaaatcatctttgaccccttgagatcagcaaaatgatgatgataatcagcagagttggctccctgatcataacacttttcggaattgttcgaaatgaatgtcacattcgtgatcagcgaccccaaaaatgccataataaggtattttgtacgaacaactttttttaaattttattttctcaatatgccgaattttccttttacaatttttttgttcaaaaattttatatttttaaaaaaatataaaatttttacttgtcctgagcctcctgaatttattctttcagttattgcgattttcacttgcaatacctcctcagattcggttgttcttcttttgtatttgattgttttcatttcgctaatttggaaatttcggcactttttcttttccgaatttacaatttccatttgaaaatataaagaaatggaaaatatgattaggtttaattgagcaaacattattttctaaaagg

SEQ ID NO: 6109 - DNA, 1813 bp, Heterodera glycines
gattaaaatgatcaaaaaaagcaaatgagaaagagggaggaagagagtgatcagacaaaaatagaaacggagggaaggagaagtgatcagccaataggcccgaaaagtcgggggtattaagagataatcactttcagattcgttacgaaccctacgtcaaagtggagccggatgagcttagcgtaatgcaaaatctttggaaaccgtaaatttgctcctcaattaggcattggctcaccgacgacttgtcgccaccgttgacacaattgaacatttttgcgcactgatggaccttcataacatcaaagatagggttggtctgagggggacaacgaggggacctaattaagggcaattagggggtggtgaaataataattttctggccactattttccatttcttagctggcgttggtaaaggcggcgttcgctccgctgactttgttctgtgccgtctcttccaccgcacgggtgagtttttcgtcttcctaaattccttttccatttttttagcattttgtgccattttccgcgttatttcatttttcttgacttccccccccccctttctcttaggtcacccgtaaccgtgacattctttgcctctgcaatttcggctacgtcccgcgcggtgcccacctcagttacgccgagccatagttgttaattgcctcaaatggtttaaaaatggcatccattttcagtcatttttccaatcgattggtggacagagcgctggacgaattggtggagccgttcagaacgttcaacttcaaagagcaggaaattgtgctgatgaaggcaattgttgcgctgaatccatgttagagagcgatgaaaaaagcaattaattattttgctaattactcattaagacctgcccaatttgtcggcagaagccgcagaacaagtggccgacttcagagaccgagttcaggtgcaacaaattacttaaaaacagccaaacaatttgtcaatttgaacaggaaactctgtacaacgtggtgagagaaagtcacccgaaggaagtggcttcttcccgatttggcaatttgcttcttttcctccccaatattatggtaattatgccaatgttcatccgatgcctaatgggcttaataattgttcagttgatcagctcaataatgacggagaatctccagtttatccaatccttcggccacaaggaaatcggcccattgttaagcgaacttttggaggaggacaatgacgaaacggacggagtgggcacgggcggtggtgaagagagctatgggacggggggaatctccagcgaagaggtgggcacaaatgaaatgagcggggaaagagtggagggggggggcagggaagagtgccgacgacctcaagaaactccggcaagcggaaaactaactcaaaatggggggggggggggagtagagtctttttttcaaaataaacttttcaaaccccttttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattct

SEQ ID NO: 6110 - DNA, 4835 bp, Heterodera glycines
  misc_feature (4755)..(4755): n is a, c, g, or t
tttgcgtcgctgcgattggcttgccaaattgttttctgcaaattaattctgctcgatggtcaaaagtccggctgtgataaaattttaattgtttgggtcaaattttgaaaatttcctggactgttggggcccggcggtactgataaacatggccatggaattgttatgaaaatttgtcaagaatggtctgaatttcttctttctctccctttttcaccccgttatttcccaaacaatgccatttctctcacacctgtccatggcatattccctggcagcggcgaaacaactttcggccgcgccgagcgccccccaactgatgccaagccgcgcactgttcaaacagccgaacggcccactgagtccctgggcaccgggcagcaaattcgcttccggaaccggcacttcgtcctaattccattttattttggttcattttgttaaagattcgtcgtgacaacaaccgaccatcacaatttgccctgtgatcgaagtccgaagcgaaagtttgccctcaattttgggtgtacttagtcctttggcgccacgttcgatgataaaaccctgaataatggaaaaatgccaactggacagtgacaatggccaactttgacggcatttccatgctttggacttcgggcccacacaatgaacaggtcggccaccggagcgttgctgatccacgacttagagccgctcagcctttttgggttcggttggcattgcgtttggcctctcaatgggccgtgtccacctgtacaactgttgctgctcgtcccactccgccttcgtctccatccccgccgggttcgacccgtggtcgggctcagtaagtccgaaggcaccgatcaattcaccgctcgccaatttgggcagaaatttttccttctgagcctcggaaccttaacaaagcgttcagtttgggcgtctggtggaccctttgccaatgtttgccataagtgacgatcggaccgatgaccaaactcgtctggacgctcacaatcgaccggtagccactgtccacacgttccaactcacgcgccaacagaccgtagccgacgaaggaagtgccggcacaaccgtaaccctatagccgaatgaagcccgaattggcatttttatggacacttagcgggcgaatgccaaaaaaattaaagacagcgaaggctcactttgtaaggcgcgccgagaaaacccatccgaccgagttcgggcagaagagaagggtcgaactctggaggaaagggaaaagccagtgaaaaaagagtcagtagcaaaagtaggatttgatttaaggcatttatttggaattgtactactgaaaataacccatcgattatgggttttaatttccccttaaatttcatccaatttttctgccgatttcccctttgaccacttctacccactctcttcgcggaatgcctgcgtgacccgcggctgcaacttttcctggcagtacgcgtgcgcttggtccctcagagtgcgctcttcctccgtcaattggctgtccaagtcaaacgcatcgaagcaattgaaatttgagtcgacacaattgttgtttttggaggctaaaagggatttgtgtcctcaatttgtttagcaatgacaactaattaattaattaattgattgtttattgcttgccttgcattgcgtataattctgatggagttgagtatttgcgatgttggcacactcttttggcaacttttgaaaagatttgtctttgcagcaaccgatgcgtttgagtgagagccctttccattttttgggattgattaattaggcaattgaaatgaaacacataataatcattttgaaagaataagcaaagcgaagcgggcggagagaaaggaaggaaaaaaggtcaaatgactccattttgtgctcttttattttcgctattttcaaaaaatgagacccgaaaagcacgagaacaatggaaaacgaactgatcagacagacagaagaaaggagaacctactgtcaatcacaagtccttaaaaaatgcttaaagggggacaaaagaaacgatcactccacggaaagggaaggcatttgactttattgagcaaatcgtcaatttgcccttgtagatagaaaagagaagccattgggagtggggctgacaagaaaatggagaaaatgatcataatcatttgattgtgttggggtcttcgccttcgtttcctcctctctctctctctttactcgcacattctcaaggccattttcaatatcagagggggggggggccgaaggacaaatggcaattcacacgacggtcgaagaccgagacgattgaggtgatcaaaaaggggagggaaatgaatcagttaatgcaacaatcccttgacgactatctttacaatgatcgaatttacagcgttcttcccacgccccccccccaccgaacccactcaaaattcagtcatttgcaaatacacaaatggtgtaataaaagcgtaaaatgatagcaaaaaacggctctcatcagtgaattttatctgtccaaagtggccagcaaaacatactttaaaaaatagaattaatccaactttttgtaacaaatcgacggacgaaatgagtcaatgttccatttaacacagcaaaatggtaaatcagaatgatgaagtgaataaataacaataatacgtaggggaaaaaacaaatgctttaatttttaaagatattatttgtgccgcacgcgctcaacggaaaccaaaaatttgccggtttggtcgcagacgaagccgatggggccaatttcgcagtcagcgcaagccaagaaacgtcggccacggaaggcgtttgtgaaaccaactgaaaataggagagggtatcaatgttaccctccccttaaagcatttttgctaaaggctaattgccctcccccatttttctgcaccgttctcgaattgcatcatgtccgtcagtgtccaccattggctgtgttccgttgtctgtactgcttcgtctcctccttcgtctgccctttttttctgacgcggcaatggcaacgcaatgcgcggaccgtcggcggaagacaaaaaattcgcagaaagaggacgcaaaatgacggaaggacaatggggacacaaaacgggacgaatgttacggccatcggcggtaacttccttaaatattaagccatcgggaaatggcaaataagtgccattgtaggcttatttgttgttagccacctcttctctgctaaactccgtctgctgctgtcccttctccgttccgattttctccgccgatgtttctgaagaagtcatttttggtcttcaatcgccgctgaaggtcctcgatcagttcgcgctgctcttcctcactccgatcgatgtcctcaatttgtccaacgttttcgcgcagcgatcgcaacgaattggtcacctgcaaaatcgcaaaatgaaaataattaaccgaatcggatatggacggacctgattgatccgaccgaaaagctcaggttgggccttgtcagtgctttcgagaatgttttggacagctctgttcaactgtagaaggtttttcaaagagtgaacgaccgaagaacaatcaaacggagtcggctgattttggggggtgttgctgctcatgcaattaacacgaaaccaacaacgaaaacaaacgtattgaacgagtattttcaacaataaaatacaaattgtatgtaaaaccaatttaatggatatgtatttaaatggtttaacgaatggcatttattgttagaggtaggcaaatgtaaatatgaaatcaaagagagtattgagcgtttttaaacgacgatcgatgtccaattgttggagtttggcttcttcagttggccgtcccccctcccatctgtacgtgttcattttcctcctcctcttccttcgctgcttctgttgctgttgtactctgttgcattagccatgccattttttgcggcgccatcgatggcaaagtatctgccattcggtccctcgcctcttccatctccgccgagccggccaagtccgagtcgccgtcgaccatgtccgaaacgtgggccaacagtcggcaaaagtccgctggcgcatcggcgtagacgtgatggccggcacgggtgacaatcttggcaaaatataaaataaaacctacaaatcggcattgtccaaatcacctgaacatccacataggcctcttgtctcctgtattgaatttcataggccgggcccgggtcctaaacaaatgtcaatgatgacaaaactattttattattcgcgattggtttaccatccacgattttccaccccaaatgaaagtgaccggcacagatggacttatcccaccgaaactaaaaacattttgaattgggaaatgtttgagtgaacccaaaaaccgaccgattaatcatcggtcgcttagcccacccaaaattcttggacattgttccaaatgcaatttcgcctaaattttgtcacatataagcctatttgtttgtgcccacactgacccgtgggttccatcgcattgcattggtaaatgtattcgtaaatggcgtccgggtcctggtgagcatagcgaatcccaaggtcggaacgcaattttttcaccagccgagcgcctttaaagttttttgattgtttctaattttcacgtggaaattaaccaaaaggcccagccgcacgcaaagtggccaaagggttgaacagagagagcaatctgccgaagacacgcatccaaattgggatgtgcaactgaccaagggagggaatggcaaanagcaaaagagggagggaattaaagagggtctttttaattagccaatattcgtcgttagagaatcaaacccgaaaacggga

SEQ ID NO: 6111 - DNA, 1309 bp, Heterodera glycines
taatcatctgatcaatgcccatggcactgcgccaatcctcaattgactgcacaaattcgagttcggcaagcgttgggtcggtgctgaactgaggccgacttgaacgaccaaaacctatggaaaggaaatgaaagtgattagagaacaaattgttagaaattaaaatattattgtaaatggatttctcatttcattgctatgaatgggagataatttccctgcctaaaatgtcgaatgcgtggaccgttctcttccggcaaagatcgtcaagggacgccgcccaaacaccaacgccggcggcaaagccatggagcagcacaaagggacacggactttggggatggtcagaggacggtttaatggtcagcgtatgcactgaactgttccaaagacgaaccttaggacggaaaattgtgaattatgattattaaattcaaattccaaaaggaataaaaaatagaaaattcaaaaataatttcccgacacaaaataaagggtaatcacagtaattgatttggtgctgatgtgtgtccgaactctgctgagtaaacggcgttccgcgtccgcaagtctgaccaacgaagactgaccccaacggaaccacgaactgcaaagggtcaccaattattaatagaggagcattactatgtttatattgactcaaaattccaagtgccttttttttgctttcggcctttaaatgtcaaattgaaggtgccatgggcgaaaaaacagcaaacaatgaccaatttcgcagtatttgataaaaatttaagggtaattgtcgtccgacggtgccgataagcgccgccaaaaaatttagccatttaaattcatttaaaaaacctaaatatattttttttacaaaaataattctaagaaattcgtaatatggaagcacttaacagaattccgtccccctcctgtccaacaatgagacgagcctcctgctccagtgcctggttcaccaccatcgccggcggctcctgcttcttttcttcagcagcagatcccatcgatccgctgttactggcaaccattttggaccgatggattaacctttaatccccaaaataaaattattgataattaattacttaattgcgaattaaaattatcaaagtctgaggctgtgtaaatttagtgactgctgattgtctgttattattcattttataatgcactgttacacaacacacttttggcggttaacgacggaccaacagataacacgcggattgattgtttattgttttatcattctctttttatcacatcttttggctattttctagttaaaaatgcggtg

SEQ ID NO: 6112 - DNA, 8201 bp, Heterodera glycines
  misc_feature (8139)..(8139): n is a, c, g, or t
ccaataaaatgactcctaaaacgtcaggtatgtgattggtgacgcaaaattaaaataccttttcgagctcctctcggaaatattcagtgaacggacccattctaaaaatctttccatacatatagccagtaaatcaaaaattaaaataaaaaatgatcaaaaagtttattagaagtttaaaacataatcaattttttattaaaaacgtgtaaatatttttttaaaaacaaatgggaacgatcgaaattcttccaaagctttctcattctcagaaatgcttttggtgcatatatcctttagcgaagggacgcctatgttgagaagtttccacgcttcttgcatttcactgaaactattaatttattacaccttaaacccgaaacctaccggtcgacaatgctaaagaagccatctacaattaggctgaccggcgaaactagccattcacgaatactgaacaaatttacaatcgttttggaccgtagtttaacacggtacagagggcttagatagaactgcaacttattataaagatgttcaccttctcgaaaaaagtaaatggtaactgatacgtcgtcaatatatacaacaccgttaagatatagattataactccctatagtgtccttaacattacaacaacacattcgtacatttctttcataaatcagaaacgaaaaaacataaaataaccccaaacgatcgacccattccatataggggtaggcatcctcagtgtcaatataaactcctaaaaaattgttttccaatttggctaggcgctttttcaggctttctctatttccttccaaggttcctaaatagtaagattagaaataatggataaattatctataccttcctaaattcgttttgaaaatattttaacagggtatccgacatttaatacccgaataatgaatttaaaaaatatacgctatttaagataaatttcaagaaaaatctcagtagttttccgggtaaatagcccattagcacgaggaaataacaaaaaaaacaatacaaagatttatttggtgtatttatttattagtcttcaaaatttttcgtctaagtttcttcgccttatcctctatttgttgtctggtctactttttttcgaattctacaaaccaattttgtctaaatttccgacgctcatcgtaaacacgtatcacctcctcccataatttgtcttttgacatgctgtttaaataaaaattaaggaatacatgagaaaaatattttttatgaaaaaacaatttgtaaatgaaaaagagttgttctaaatatttaatcaaattatcgcaaaaataataccctcacacataggaaaattatcagaattataaaagctaaataaataaaaaccccaaatgttgttatcatatatttttcactattctgagctgcctcatattctccatcaagcgtataattgttgcaaagatacataaaacctggtattttatattgatttcgaaacattaaggtagaaagtaaaacgacacattgatttaagtaacgacaaaaagataatgtttattttactcaaaaatatccaaaaggcagtacgtttaaattggcatcaataatgcccttcttctgtatcggtttatagtctttcttaacctcacgattaatgattaaactgtcccggccgggccttaataaaagaaatttaattcagaaatttttttaacactacctaaaactgtccgggtatgtaaatttgaaattagctccgtctctatattttaaaatcattttcttaaaagtttcataatcaaatattattacgatccaaagttatcccgcgtattttggttttataccaaatttctccagtttcccgtcttttaatttcaatgcatactgtttaggaccacccgaaacatactcaataatatcggaatccgcatattctctagtcatttccccaaaaaattttccttctttaagaggacatgagttcggagggtgggcaataactaatgaatctgaacaaaataaaaatcaactaaatttgtatttttacataccggtatcgcaataaaaaagacgacagcccggcgtattaaataccctttccatatttttatataaaactaaacgtgcagcactagttgtcctaaaaataaaataaaacaccgtataatttacagtctcaccatagtgagggatgcgcactatgcccccagaccaactatgcaccgtttatcccggatggagtttgggagggaatggggaaaagccaaggcgcctttgaccaagccccgaacccccaaacgactcattgactgttaaagatgtctttattcattcgttgttggatttatacgaagcgagaaatcggaataataattgaagtctgttccatcattactgactgactgatcactggggaaggaaaaatgcgaagagaatgggcggagaaacattacaatgagaaaaggaaaaacgtgtgaaaatggataaatgtgattgaattgataatggccaataaggaataattaaatgagggaaatgcgtcgaataatacttacaacttcccccttcccttaggatcgtccccgatccttaaatgaaaaatgaagtgaaagtgaatgaatggaccaaactctcggattcgcccttcgtctctccaatccgaacttccacggccaagctgcgcattacaataatgagcagcggtccaccttcatctcagatggatggcatgggaaatcggagaaaagcaaccaggggtcattccggtttggggacgagatgtaaaagcatgatgagagaagagagagagaatgggtcagagaaagtgtgaggaaaccgacgcatttttaagaaatttgaattgggggaaagaaaggccattaatagttcggaaataaagacaaaatgaatgataattttaaaagaaatggatgacgagagagagtgagaaagagagagtcaaaacaaaaggaaaatggtaaaacgtgaggggaattgaatgaagagggaagcaggtccatgcgcagttgccgtccatggctgaagtcgtacagcttggctttcattcgtctgcgcgcaccaaaagttgaggctttgccacgagtgcgttcccgagtgccaccttgaggatgagatcagctgtccgtccttgtcgtaatagttgtcggggttgttgaactgctcgaagtcgaagtattccgggccgaccactgtcgtttccgttgtcgcttggtccaggtagcgccgccatgtctccgtccggttgagcagcagcaaatcgccgatgatgatcattccatggctggcgcgggagatggcgacatccacccgtgcggcatcagcccagaaaggctgagagtcggctccactgtcgaagacggagcatgttgtgacgacgacggcaagtgacgactcgtggccctgtgtcgcgtccgctgtcgtcactaaaatgtccgggatttcttgttgggccaccaaccgttcgatctccagggcttgggcggcgtagaagcaaatgcagcggatgagtttgccggggaaggcccgcgccaaacgccagagggctctcatcgctgtgtcggtttggcccggattggccgaagaggtggagacttcgtcgcgttgcgcgggcgtgttctgatggactaaaatgagggggactccctttttcggcaatttgaatgccgtttggtcggtcatgagcgcccgctcggagtcgtcgcgtcctggtgtcaactgcccgccgtgcggtttgtaaaaaccggcctccgtacagcggacgagagcagagtgtgagcgaaaacagaccgacaatgttgtgacgtccgtccctcgcgccacatccaggttctggatgaccgtgtccatgccgaagtcctcacggattgcgatcggcagggagggcaatccccaaacagtgccggaagttgctcacagaaggacaaggtggcgaagcacaagcggcgatttttgtgctcctgcacaattttcgccactgccatttcctgggccaggcgtgggttccgctcgcaggcgtccaggtaccgctccaccttgacgcgttcttgatccttctgcaggagttcctgaaagtcctgtgcctccaccgcggtggcgagcaggtgggggggaaatccgctcaacttccttggcatatctcaacttacctgtcccggagaacaaggcaagcattggttccacgtggtttccggcggccagggcatcctgcatctccagcaccagcttgacgacggcgacgttcggtggggccagcgccaacacacgtgccgtgggatccgtggccaggaccgtggccacgatcgacgccgcgctgaacgtcttgccggtgccgggcccggcctgttggaagaccaggcgcggcacctcgtcgagcatgcacagcgcggtgtcgatctgtctctctttcaattttgaaagagcaccaaaagtcattaatgggttattggcctttgggctttccggttttaccggtcggcccaataaaatcgacatgattcggcccacctttgcctcgtccttcgccactttcgagcagtcattggaccgcagcgtgaacatccgttcctgcagggccctgacggacgtctgcgggatgagttcaacgcatccgtcgagttcgccggtgcgcagctgatcgaattcctcctgggcatcctgctccttcgctgcctgataggaaaggatcacttttacatcgatctcgtatcctacacagaatgcccgcttttcgatgcttagcacatacccatgcgcacaaggctttgccttggctgccggattgactttgcaacccaccgccaaatcgacctcccagattttgcacaattcggtgagctcttcgatgctcggcaccggcatgacgaactggatgatcacgcttcttgtcgagatctcattgatgacgaccggttcgacgaacagagtgtgcttccgcagatcagccttcacatcgaacgactgcgctgcgacagccgccgccatgaccttctcacccagctggaccttcgcccagctcagttcggcactgaaagggaactcatagcccattggctcaggctcaacgccagcaatgacgtttgcgtgatgaacgagcagttcatcgcccctttttttaccaaaatcagatggcaaaacatacgcaaactgctgtgaatacagcacccatggcggactgttgatctgccgaagttgaagacgaacaacggagcggtagcggatgtcgttatccgtgaaatcggccgggaagtggcgacggtaggcgcgcatcacgcagctcagctcaggtgctgacaccatggccactttgacgtgtcggtcacgggctctttgcacatcgaccaaaatgccgacggccagagtggggatgcgctggcgcaattggctcacgtccgttgccgtagcttggtagttcagccgtccggttgcttcatacagccaatctccgcgctcttcccatcctgtttcgctcttcgtccactcacacttatgtaagcggaacaaatcgccgatttcgatcggctgggcgttgtcgaagaggctaaaagggacaaagaccaattctgggaaatcccagaaaagtttcatccgtgccgcgatcacaccgtcgcttctcacttgggcgaccagataggatttccccttatcttccttttcaactgctttatttcccgccctcaggctggggtttagttgcaaattgccaaatccaccgtctcctagcagttcaccctcactgccctcactttcttcctcctcttcaattccaccacttttcaccttttctttacccatttctccctttttccctttttctccgctcatttcatcgacttccatcacttccatttcttttgtgccagccttggcactttccattggcaccgggtcgggttgaaccgacttgagccccagcggatcactccgatccgccagcaccggcaccgtgagtggctcaattccactcgcattcaccattttttcaagcccgcaggcaagggttttggagacagaagagttggggcgatttgaaggaataggtttttgcatctaaacaaatgaaaaactgaaaaataaaaataaaaattgaaaaaagaaaatggaaaatggaaaaaatgaaaaataaggagcggaggaaaaatgagaatgaaggcaagaatggcttttctgacggatgagccggccttaataacgagggatccgagtggacgatgggcgggcgttacagcaaaaatgcaatttattttttcaaatgttacaacagcggcgagctaatggggaaaaaaggcaaaaacctttcctcccgaacggcaggggagagtcatcgccgcaaaaagctaatgtcgcgacgggagagcaaaaaaatgggggaggggacgggagatgaattgctttccgtcggctgccatgtttggcacgaagaaaaaaaaatggcaggacaaatgcaaaactttggacatatggaattaattaaagacgcagtcaaaagcggggaaattgcaaatttaaagaaaagaaaattcaaacattaatttcaattgaatcgggttcaattgaccacaaatatgcgcgaattacacaaaaggaaatgccggcaagagtaaaaatgatgccgccaattgtccaagcattttccgaaaaaaatgaggaccaactttgagggacaatttttggcttaaggtgtccacaagtccatcccaaagttgtattcctttcttcggttggaaatattaaattagtcggctggcatggatgggcacaaaaatggtcacaaatttctttatccactgaaattcctttaatttgcttttcttgaggggactctacaatttgggcgttcgaactcaatatcagcaaaattataagcaatcttttgcaagaaattcttttgtccggcccgcaggcatgggaaatgagtaaagaaagatttttggtttttggcattttaatctgaattttgcggttggtctaaaaaaataaatatttcaggaattattcggaatgaattttggtctctggagacgatgattgccaaaattaagggccggtgcaaaatgtgacattagcaaacaccggcacattgataatttgtgcaaagggagaaaaagtcagggaaaatggtgcaagagaaaaaaaggaattctttggccttgaaggggggaaaaaaaaggaattggatgtgcaaaaagaacggcgccttccaccaaaatcccatgggagatgaatggcaacaaaaagaaaattgccttaaaaaccgaaaaaggaaacaaatgggccaaagaatgccaattcgaaccgaaaagggaagtaatggagttttttttttttttaaatcaattcatctgcgttttggtgattgttgcaagtccatggcggcacataggtaacggtatgatagtcgaaccaattcaacgaaatttgtgtgaaatgtggccagttattgttagggtcaagtgtaattgtcgtcacataacttggtgtactttggaagactaattgatccgattctaagcttagattttttcggtccaatagctcatttcgttcgcccaaaatgtccggttgtaccagtgcccacagtatggggtgtgagatgaacacaacccccaaaactgagctttcaattggcgatggaccagttggcggcggtgaggtgtccgcaaatattttctcaatgtcccttagactggctagtttttcagaatccatcaattccagattttcaaacaaattcatgaaattaacagaattttcgtcatcctctctttttattaactcatttccatttccggccatattttctgtttcttgcccgcgggcgaaggagttaaaagaattgttggaattaatttttgttaaatcttaagagagaaggaagacaagaatattcgtaaaatgagcaaggtgaaaaacagaaaatgaatggctatggagagaaagatttattgaccgatgggtgcgagaaggcggggcaatgtacaagcgcctgctttaaactaaggggctgatgttagcataaatgagtacaagaggtaacgtaagagagacatgcagtgtgacaaaagaaaaaaattaaataataagagaaaattaaattgatcgaatgttgacaagatatatagttttgattanattgaacgaatttcctgacaaaatatgtacacaaaaggaaaccaaaatttaaatgccaaaag

SEQ ID NO: 6113 - DNA, 2490 bp, Heterodera glycines
aaaatttttttcaattaatttaatcccaaaaatgtcttcccagcccattagcactaatggcttttggtcagaggcgtcatatccccccccccccccaaagtgctaatgcctaaagcattcacaaattaccgaaaaaggaggcaatttttgaagagagtttattaagaaaatcgagagggaaaaatgaaaataaaaaaaaattctttttaaatttgtcatacaatttaaatgcagctattaattaaggtttttgaacattcttcagttttacaaattcacaaaattatttaaaaatatcatttcggaaaaaataacaatatttaaattattattgaatttttatttcctgaattttatggtttgactggagcaattataaaagcaaaaaaataattaaaaaataaattttataattaaaaaaaataaataaatttagcatcacactgaagaagccgatgacatgttggtgttgaacgaacttcatcgacgcgacggactgatcggagaagaagcggaggaggaagaggatgaagacgaaggaggaggaggagacgttgatcagtctgcggatgagatcgaatttgggcatgtcgcggcacggagattagcggcgaaagcaaaaaacgcggcaatgatcaaagggtgggtgtgggctattcggctgatcgatatttattgattgattggtgagtgatcggtcaagctaatgattggttgattaattgactggttgatatctgttcacattcgctggatgatgagctgatcacgatttatccaaatctcagtttttgttcccatttcagaaggtctgtgttcaacacaaacagacggaggagcacattgaacggaacgaacgcattaagcggtgaatttccgactaattaaaatttaattttaccgatttttcaattttttgagactccgatgaggtggacagcgaagtggaaggccgagtgttggccatcaattttggccgcaaggaataccgcgagttggagcaggtggccaaaccgggcgggggcatggcatttggaattgaagggcggcatggcaatcggagtcttttatccgatcacaaacaattggcttagcttcctgatcagtgattgcacaaataaaataaccacccaatatcaattagttttgctaactgatcttgaagaaatttatttctgtccaattttgaaattaaattttcaaaaaaatggggacttacatcgaaccttagccgaggggtaattaattatcagggttcttctgggttcgtatttacgatttgcgactcggtaaatttctcgagttttcgcttcacgatcccgactcctgtgttcatttcccggggtcatttttcctcaaaattctcgggtaaacgaatttaccgcaatgcccacgtaattttcggggacggagacggtcccaaaaaaatcgggggcctcagagttttggggaaacgcataatttttccatttttatagcttcatttcgagggccaaactggcgaagtgtggcgagtggtgaaaaagcatttgggaaatgaagcgtaaatatattttttggaaatttttttaccattaaaaactaaattttagcctcataaaatacatttacgcttaccgacaagctcaggtaaaaaaacggaaattaaaaaaaattaattgaattaaataagtttaataagtttaattaaagagccgattgacatcggcattcagtgccatcgaagcaaatgacatgcgcaaaatgaaaagtttggtggacgatgagattgtacagtcgcgcgactcaaggggtacggtaatgtaacaaacagacaaatatactgtattattaaaagcaattaaaaaaaaaatttgatttcaattttcaatttaaattcaggcctgacacctttgcatgtcgctgttttaaaggtgaaaaatcattcgaactgctcggcaacgagaattgattgatcattaccaaagtttacagaaaaactcgatgtttcttcgaatcgataccgagactttttaatttaaaaatttgtaaaagaaaaagtgtaaaaaaaaaatttaaaaaaaaaattctcggagtttttttaggaaaactaaaaaaattcaaaaaaaatgcaaaaatctttgtaaaaaatgaaaaaatattttttaaagcccaaaatccacaaaaaatattattgtcaattacatactttttaagatttccctaagcaatcatttatttttaaaatatttgtttgcttttaaaacaaatttcaaaaaatccagttttccaggccttgacaagcctggattttttctggacctgggttttcatgaatgtttgtccagaaaatccaggtccaggttacaaaatgtcgagccttgtcacaattaattaattacctaattgcttcaggaacggcaccaaatggtcgaatatattggccaaacgtttgctgacttcatcaacataggtgaccatgtaaaaaaagaagaagacattatgccaaca

SEQ ID NO: 6114 - DNA, 1522 bp, Heterodera glycines
cccgggtaggaaaaaattgaattcaaatttaaaaaatataatttttttttaaataggatgaatttttaaatttttactaaaaaaaattggttggcttaaaattgatacgatcaaataagcggttataaaaagattttttaaattaaatttaaaatttaaaataaaaatattaaaaacttaaattttgaaactttttttgctaatttaaacctaaagaaatttacttagaaattgttaatttttcatttacacatacataaattaacattatttttgatctagtgacgagaaaaaacatagtaacttaatcagattatgaaaaacactcaaatcccaaaaatgtaaaattttttttaatataaataagaatttatttaaaaattcaaaaagacacaaaagaaaattaattggtaaaacataaatggtaaaggaagtaaaatttaaagccttaatttttcaaatattccattaaaattcaaaaaataataattggcctagaaaaaaaaagaattaaaaataaattatgcaaatttcactcatttcattacggaaggattatttgccaatgtctgtcatccgtcgtcgtccggaagcaaattttaatgatttcattttacggcacatttttttcctctggtgtcaaaacaattcgcgcacttttacacctcattagcggcttcgtcggccaccactgccctcggcagtgggtaattagcgctcttttatttcgcgccgtttcttttttttggtctgtcaatccgctgacggcggcacgacctttgttcaagaaatgcttgtgaaaaattatgtagttaaatgttcacactcccaaaaaatgtacaaattttggttgaacacaatgccaaaaagtgcgcgaattcgaaacggtgccgcgtcggccatccaattgttgcatgccgcgcgcgcgttcagctcgcaacccgactcgccaacctctgtcctcaccttttcggatgaagcctttttggtacaacatacacacttcattctcattcattcatttaataattggtgcaaaaaaagaacggcttaaccgttaaatgtactactgtataattcattggggttgggattcttactgtaactgtttttctcatactcacaatcaacaacaatttcgagattgggtttttatggcataatggcgatatatctcgtaaattttggaaattatgtagaggaaagtgccaccagaaaatgcgtcgaggaacactgtaatagcgaattctgtccgtgctaccgtaactcatttttcaaaaaattctgattcgattgacacattttccggacacggaggcaaattgcgtccccctcccgccccgcgccgacagattaaaattgaagatttttaattaatttttttaaattcaaaaatatattttttgaaatttttcgggggaaatgatacggggggtaggggtaaccagcgggggggggggatgagtctcgggattattaactccctattgtacgagcggtgtcaatcacactattagggctt

SEQ ID NO: 6115 - DNA, 3545 bp, Heterodera glycines
cccccccccctttctctagggcatacagtagtacctgggttagactttctactgtgttacggtaagatttttcaaatttgaggacggcaaagtgaagcgaagtgacacgcgagaagaagccgatgtttatgaggaggaggaggccaagtggggggaagagaaagattttttgcaactgtcaaccaacggacattttgaagaaatgggtaatggcgttttgatgaaatgggtagataatttgtagaaataggtaatggcactttgaagaaatgggtaatggcattttgatgaaatgggtagataatttgtagaaataggtaatggcactttgaagaaatgggtaatggcattttgatgaaatgggtagataatttgtagaaataggtaaaggcactttgaagaaatgggtaatggcattttgaagaaatgggtagataatttgtagaaataggtaaaggcactttgaagaaatgggtaatggcattttgaagaaatgggtagggatggcattttgaacaaatgggtagggcattttgaagaaatggatcaattgaacaaatgggtagggttggcattttgaagaaatgggtgcccaaatgggtacggaattttgatgggtagggccgggggtaggaaactgtcgtaaatttaaaatttggaatttgttggcttaggaaagcccaacaaagtcaagaacatcccctgttttatggttttaaaatttaaataataaataaactcttttacatttggcgtattgtcattcaggtttcaatgcaaaatttgtgaatttaatattttctaaccaaatttaaattatttttttatatcaaaatttaatttaaaataaaacttaaaataatttttaaaatttttatcttaatttatcaattttattaattaatttggaaatttattaccgaaatttacaaaaaataatatttaaaattttctttcaattttttttttctcgccacagatgcgccttcggacgagcaggtgaagcgatggctgaccattggcgaagtgtcacagcttgaacaaattgtgctcgacggacgtgcccatcttttggccgacaaaacgtcaaccaatttggcatccgccgaatttttgcagggggttcggaaaattcgaggaaattttctttttccaatttcgtaatttttttctaggtatcccaataccaatccaaaattgatgccatccacaagggtaagtgccatgtgaaattcagtgatgtcgccggcattttaacctatttttcaaaaaaatttaaaaattgtatttccaagtaaccccctgggttttcaattttctgacgacccatggctgttcgtggcttcgaattttttttttttatcattttctgccaattttttcacatatcctctcacaaaaacaaaattcctaaggaaatactccaaaattatttcactcgattaccatacgatacccgtgagtaattaattaattacatgtcctcattaccgtatccagctgttgaggagggcgatgttcgccgtgtcaaatcgttgattgaccgcaattcgttggcaaccgcccgggacacacatggtcaggcaaaagaaaatcaagattttatattttatatatttctatccccctaggaatttaaatttttaaaaattctcaaatttcaggggcttaatggctaaattttagactggcatatattttgcgggaattttcaaaaaagcctaattttcaccaaaattcaggcatgacccctctgcacaaggcgctcctttacggtcagacaaatacggtatttgtatagaacaaaaaatgcaaaaaaaaaaaaaaaaaaaaattgaaacggtttttcattattttttgtaggtgcgctttctgttggcgaaatatgcgcactgtgtcaacgaagctgatcatgttataattttggataataatttattaagaaataaactaatataaattaatttttatttttaattaaattcatattaaagttatttacaaagaatttttgtcctgaatttatttaattattttaaaatatatctatttattaattaaaaaattaaacaaaattaatttacgaaaaaacaatatttaattaattaattgattagttgtaatctaattatacatattataaaggaatattcaaattttaggccggtcgtactgcgcttcattacgcagcagctgatgcaaatggggagcatatgattaaagtaaaaaatattttaaatgaaaattgaaaattttaattggaaaaaatatcgaaaacttaaataattaaaaataaattttaattaaattcaaaaaataaatataaaaaataataataattgttaggtgcttcaaaaggccgggggagatgcattcattgaggaccgatatgggcacacgccatttttctaccgaacgcacggcaaaaggctgaacattcgaacactgaaagacaatgcggtgagatcaaaggaatgaaaatgataaaaaggacgggggacgagtgatcggagtgatcaattggagtaacgaacaatcgataattttttgtaggggaggtgagtattttgtaataaatgatcgaactgatcaaagggattaatcaaattggaaaaggtgaacagattgatcaaagggagtaagcgagttcgaatgatcggacaaataagaaggataagaggaattaagcaattgtaaaaagtgatcagagtgacgaaaggaataggcaaattgttgcgagtttgaaaagtgattggactgagaagcaggttaatagggatttagcaaattgttgcgagtttgaaaaggggccggattgatcaggcgctagcaaaatgattaaactgatcagagggatagggttttaaaaaaaaattgatttactcatctggttccaaaaaagaatcaaagctccaaaggtgatcaaccatctgatcgccggccaattgaaccgcactctgttgcaagacttggaggaggacatcaccgattgggtacacacgggcaacatcggcaagctggaggagctggtgctgaacgggtacgccgacctgttgcttggccgaaaccatcaagtgaaccaataattatcataacagatcaattaatcaattaaggcatcaattaatcaattatttgcccatcaaaaaaccaattagtaatcaattggagcgtcaatcaattagcccaaattatcggcatcattaatttataattagtccataaaaagtcaattagtaatcaattggaacattaatcaattagccccaaattacaagcaattaggcatcatttaatttttcaggttgaggatgccgaggccatcagtttcttggaagtgttgccacaataccaggccaaaatacacgccatccacaaggccattgagcagggcaatctcagagcagtcaaactgttgactgaccgcaaaaagttggcattgtgccgtgacggccggggattggtcagttctagagaatactcttcgactgaccctgctgatcagctccccgtaattctgtctgattttttttccagttggcaaa

SEQ ID NO: 6116 - DNA, 7263 bp, Heterodera glycines
agttgcctcgtgaccagcaatcaatggaaatttgacattcgggtctttcccactgcacacctaaaattaaaaagtataattaaatttttattaattatataattaatttttttaattaagaaaaaatcatttttgtcaaaggaaattgaaatattttaatttaaaaactgttattaggaatataaaatttcgttctaatttttacggtattgtgaaaattaaaaaggaatttttgcattttagttaaatttttctttttaaaaatgtcacttttttgcattttatttttacctaattagaaccaatgacgtgtttattaaaatacatatttcaactgatttatataaataaaattattacaaaaatatcagtatggcatatgccagtgaagagaatctaaaaataaaaatatttaatttttttattaaaatgtgttttttttcaaatgtcccttacctttacgcgcacttcaccttcttttggcggactcacttcaatttgttcaataactaatggcttatttggctcccatgcaacggcggcacgacaacaaattacctggccaatattttcatatttaacaaaaataaataaaaatatagaataaatattttattaaaccttaaaattaaattaaataatataactaaattataaattaaactttaatcaaataaattacctttccttcagtttccatgaacaacagagctgggaaaaaattatttgctttattgtaaaaattacaacgaacagaaaagttaaaaaagttttgtttctataaatatattttataatgctgatttctgttaaaacattatgataatttaaaaaagtggactggtttaaatatattctaaaaatttatttattcgtaatttaaattcaaatatttattattgttcatttttcaacacagaaatgtaattggattaaatattatattcttctttttgtccttttaaacaaaacaattgatgctataatccaattcaaaaaatcctataatttaatttgtgagtgcctttaacaaacataaaaaaacaaaataatcaacttaaagagaaaaaaaattccgtcataaaattacattaaaaagatttatttgtgtaaaatataaattaaatgtttcgtttatatcaaaaaacaaactttaattacaaacaaaatataattgatggacgaaaagaagacttaaatatataaaagtcgatattattttgaagccacttttgtttttaaacgaagcgacaaataaaagttgatcaaatttctaaagtgttcgaatgagcaattgtcccgtgttgaatgattgatatatttgtgtggatcaatagaacatttttattaaagccttcacttttcataaaaattttggaaaatatgaaaaaaagtattgtaaaagttatttaaaatcatcaaacataatttaaaaaaattgtttaggttaaaataaaaataatgtgacttttgaattttttttaataaaatacgtctcacatgaaagaatttcatttaaaaattttatcaattgatgtgttaatccattcattaatttaaattattatttctccaatagatttttcgatcattaataaataattataacgattttaatcaaagtaaattttaatggaacttcctgtattaaattatctttttgaactttaagtagtcagtcaattcataatcaattttgtaaaatctttattaaatgcttcataaaatcttaaacatttataaagcatcaaaaattaaacattttctattttattattttataaattgacggatgctaaatctttattaacgtgaataaatgaattaatatgaatatctaatcactttattacacaaattagatatttttgagaatatatatatgatgagtcaatgaatgtttggatgacattttcttgatattggtagtaacatttaacagaatgacatttttgttcccatacacacaaattttttcttaacctttttcatcttttaaggccaatgcaaatgaaatttgctatgcacaattacaatattcctttaatttatttattaataatttcaaatatgaattaattatttggaagtatctcggaattgatattagtttagcagtcattcataatttgtcagatcttgtttttaggtcaagggcaaaaaaggaaaattaaagcaaataccatcgcagattcaagagtcaatcaaaagtgtaattattcaattcgtaaatttttttaacctaacaaattgcatgtcttaatatccatcttttttgaataaatttgtatatgggatttaaaaaaatgatttataaaataataataattatagatttttgtttcattaatgttcacgaagaatttctttttgtcagtgcttattttgttggtgcttataggtgtgaagaatgtgagtctgttataaataataattatttcattcaacattaattaataccaccttaaacagtgtgccgcatatggaagccgtaaagcgtcggcatttgtgccggaaaagggctttctcgcttttgagctcattaagcacagaagcaacgatgcggcaaccgactcacaaaaagcgccttacacagttagcaatgatccatgcggaattaagctgggcccaacttttagagtaatttataactaattaattgaccatttaccttgataatttaccaattgcggctttatcttctttaaatgattaatatatatttgatttaggttgaacatgggcatgaggtgatggtcttgcacggaccgggtcagtttagtctggccggtttagtctggtcgttttagtctggccgttttaggctggccagtttagtcagagggtcggttttagtctggcaagctgtttttgcccataactcttaaaatgtttttttttgtcaattataaacaaggaaaaacttaaaatatctatgtttagctacaatataaatgaatatcccaattagaaaataaaaacaaagcgaaaccttcagtttggcaccgcctttttatagcttcaggcaaagtaaaccctaatttttttcacgttttttctccatagaaggcttcaacgggcttttgcttgtttatatccaactgttttccgcttcatcaacacaattcgatatgagaaaagtcaattgatgcagacatcgcacgatgcatcgctggtgaagtccctcctcaaaaaacgcgaaaatatcgtgccgttgatacgaattcttcgactcttacagggttacaataccatcaactaaaacggccagactaaaccgacccccaccgggtcttgcaccaatggccatttatggcttatgtgtcgatcgcctgtaccgtcaatggccacaagcggacaatacagtactgtggaggactacggcagcacattgtaccgacgtcaatgtaacactgtttgttgagaacaaatgcgccgaaacaaatcaatttcttatggatctacgtttgcgttataaaccggaagaaatgtatggcagtttcagtaaagttttaaaacttgaattattaaattattctgataaagcgaaaaatacacgccaaagaatcgagtttttttgggaattaattaaatacaccttaaaaatcgaaaaattttgaaatttttgtaagaaattttgaaaaaaaattgttgatataaaaaatgtaattttgtttagcatttaaaaaaaatcgaaattgcatatacaaattttgaaaatcaagttttttgaaattgtctaaaaaagcttatgcatttttttttgatggttaaagccatttttttgcagtttttaaggcatattttactgcatatttgggtattgttcgggttttcagggcattttgaggggttttattttatattttatgcacatatttggcactttttagggcatagaacttaaccctaattatcaccttttccttcatttaggcatgaagtcatgcacgattttgtgttgccagtcaaagcatccgagatgcaagtgaccgttgggagcaaagacataacaaaagggactgttcacgaggtggcacggataaaacgacacgaattctacagactgacttcatcagcaaatgacattactttattagaagtacagttttaaatttttaaaaattaatgaatttaaatgaattttatttgtttagctaaaagatgttttggaatttggcccacaaattaacagaatttgtcttccaaataaataaccacggagtggaacgacagcaacaatcatcggctggggaaagacaaaactaagtaaatttggattatttttttctaaatattttgtttaaaaaagaatgctctaaaatttttctgcctaaaatttttattttcttagacaatatgtcggcacacgcggagctgatcgattcgaagatattacgacaggatttggtccatttgtctccggtgtgtccacaaggatttttctgtcagtttagtgccatccataagacgtctcatgtaagctatttatttgttttataaaatattctataaaatacatattctcgaagacttttttagcatttctttaattttcgtatatattacttttgaattttttaattgaaagcttgttttaatagtaaataataacccatgttttttcatcacaaatcaatgattttatacagtaaccaaaagaaatcaaaatattatttataaccaaaaaaagtagaattaaatttatttttgtttgagggagacagcggttcaccattgttacgcgaaattgggggcagtttgtatgcaattggaattgtacggggccatgagtcgaagaaaagtaagtgcggaaattgatttaaattgaaatttttattgacaaatttttaattatccttcaaatccaatataaattctcaaatatggaaagcatatcttaactgtgatattttagatttgttcgcaaaaatcagcccatattgtgattggttgaaagaaaaaagccgtggagaagtccgttgcagctgaatattgaatgttttttgctgtgaatatgaagatgcaagacgaacagtccggaaaaccaacattcatatttttcagcgctaaaatcataaaaaaacttgtgtcgtaaaaattcttatattttatgaaataaagactgcatccgactgaaatttaaattaattaaccgtatttaataatttatatattttttacccatcttgcgccttttttaactgataagcgtatttttccactataaatggtgcgtctttgagctgaaaagccattagaaaagcgtcatattagaacgcttccaaatggtcaaaatttattttgtcattaaaatttgaatcagaattggtgtttgtgctgatgatcaaatcacaaatttcgtttcaattaattactcgaattcatgttcatttggtagtaattcatttttaatttgttttcaattaaattgccgtcttaaagcttaatctgttggttcattaattgcttcatttaatattccatcacaaaatttaatctaataattttctcgaaatcaaattttatttgttacgccatcaacataataaaaaagtgcaatcagatgccgaaccaatttggatgaaaaacatttgcgaagcttcgatcagtgatcacctagtcatataaattcactaatttcattttttcatttacaaataaattgcttttttttaatttttaaatttaaaacgagctggctaaaattatttgctttaatttttgaaattgaaaaaaacacataattgttaaaaaaacaaaactttgtttcaaataaaaatatttttgtaatgttgattttaaaataatgataatttaaaaaattgggtcgctttaaatatagaaaaggggcttcattattaaaactagagtgcagcggtcctccgaggtcccggttcccgggttttgaaaatctcaggtcccggtcccggtagggcaaccgggaaccgggaaaaacaagcactggtaataatgggggtttgagaaaaaaattagtgatgcaaattggagttagaggaaaaaatataaaaataataattaatatattcttttaaagtaacactgccaatcgaatcttcttgattttctacttctttcccatggttcaatccctctacagaaattaaaatattttgatatgggtttgctattgacaaaatatgactcctcgtagttttttttaatgcaccatttttaattgtagcaattaaaagcagtttctcacggacctccgtttgttgtactttttactgatcaaaccttcaatggttctccaatcgctgcttggtttggccatgcaattgctggaattaggcaaataatcttatgaacataaagctgcaaaaataaataaaaaggcgttttgctctgtttcaattgtagaggaaatacattaatttattagaattgctgaaaatttaaatgaaaattattaatttaatacaaaaaaatatataaagctcaaaaaatgccaaaacagacaaaaaataaccattagacaaaaagaatatagacgaaatcccaaggcaagattctgtggattttgatgtgggtcgaagagaatttcccttccacctttgagggaattttgttattgaaaattttttttgatattaatgaaatttaaattatttttcttagattaaaattcgaaattttagttccaaatgaatattttatggctgcaaatgagtgattactaaaatttgatttggcaaggcttaattaaattttctcagtaattcagtaattagctttcctatctcattaaaaaaaaattttttgttcataataactcatttaggtgaggcccggtttatatatatatatatattttttttttaacttttgatagatttttagcccatataacacaaaccgagttggaccacagacagcagcaatatggacacataagcagtacaaatcgaaatttttgaacctaaatccggaggtggtcccggatttcggaaattcgtatttttcggggctgtaatttttatgagccactgaattctggaaatacagacaaaattttgtaaatttttaaaaatgaattaatgtatttgttatttaataaaatgaataatttaatcaactacaataatttcatcagtgtgaccgaaatgtgacggcaatttgaaaaaaagtgatgaacagaaattcagaaatttttaaaattaataacacagcatatctctaaatagatgtatgcattgtctaaacaaaatttgtaatttaaaaattcgtatttttatgaat

SEQ ID NO: 6117 - DNA, 4738 bp, Heterodera glycines
tgcttggccgaggctttctttcccgagaataattcacctgcagcatatgaagggcaaagttttattgtgagaaaattggtggactgattgattttttgtggaaaagccaccaattagtgcaacaataagcagcagcggaagataattggaaagttcgtccacaacttcaatttgttcctccgatgggctccgatcccccggccgcggtcacttcctttccctccgccggttcggcaacctttccgtcgcttcacaatgcccgccacaattgcatctccacgtgccactacccttgtcattctgccggtgcctttttgggtgttcttttgtgtctaaataccaaaccgttcagtgccctcctcctccttttcctcctcctcccatccgcccgtttccaacgggtgccattctctttgctcctcaaattctgtccagacgcaggcccaaacggagtttcaacgcattcaagcagcttctctgcgatcgacgcacgaccaaatggtacgaatgaattggaaatcgccggggaagtccttcttttcagagggcgtgtattagcattgatttgttagtcgcgtgccaaagggaagtgaactttttgcgaatgatcgacaggtgagggacaaattggacggggggggggggaaatcgcagggaaaaaacgaacaaatcgaacggacggaggaaacttttcactaaggaaagcgccggtgctttacgaaaaagtcgttgtggagaatgccatccgacgatatgagatgtgttggttgccggcacaagtgagacggagcaaatcacttgctaattaaggggagaggccattgattaatgggattttattgaattgcgagggtttccccacaaattatggaaaagccaaagagaaaaaatgacaaaaaagtgaaaataataaggcacaaatccaattcaggctgcaaagccaaatctgcacaacattccgccgttggatgtgagaatttgaagagtttgtgaaaatgaatgactttcccttaaggtccattggatttggcacacccacgtccgttgcttttcctaatgattcaaatttgctgcgctttcagatgctttccccaacgcattaccgcgaagattgtttggccatctgtgggacagtggtcgaccacaaattgctaaatgcggacgaaatccagcagagatatgagcaggtgactggcaatttgtgccaatttccgctgccattttctcttcgtccccttggctttctcctctctcaattcgttggtgtctttggcttcggcatttgcccccccccccgccttcgatttgttcgtctgctcatcccctctttcctgctcagtcggtgtcctcgtggagcgaattctgtccggaagaaccgtacgactttctgcaaagtaacgaccgcgtccgcgagcagtaccaacaaaaaagcaaatacaacttggcggaagcggtgcaacgacagcgcaacttcaactaccaagtgggtggtgcggtgtttgttggtcgccgtccaaactccgtcccttggcacaggtgtctttgccccatttcaccgccccgcgctttctgaccgatgccatcgatcgctacatcaaattcctgcagctgaagcagacatacgccgaccattttctgacgccatgttacgacttcgacttggtgtggcacactcaccaagtgcacccgttggactaccacagagactggtcggactttgcttgttttgccaacatcgctaaatccaaatttagcgtggccattttcggggcggtgcttaaacacgacggtgagtcactcggaagtcaccaaagtacaattactgtgaaaagattccgtcaacgaccgatccaaaggcagcaaattgttgaaaggtaaaagaacgagcgaaggaatgatgagagaagaaaagcatttaaaggcgaaacgatgacgaaaaaggcatggaacacgcacttcaaagagagcttttggagacgcggatgcatgtacaggtggggacggagagaagaagcgaatccaatgcaaatgagagagagagagagacccatttgctaatgggactcggctaattgaatttgatccacagaggacacgtggcaccggcttttttggggtttgagtcccaagacaatgcggtaaaaacaaagggttaaccttttgttgaatgacacccattaagacgattacatatgggcacattcacattccttcgatagcactgaaagagattccggtgcagagagagcaacttcggatgaagctcaattacggaggtgagcaaaaaggaatttgtgaagagtgattattaattggggggggggggtaattaattaatgggcgcaccgaagggaaactgaaaaagaaatggcaccctcaggcaagaagatcatcactttcaacgccgacttgtgcgacaagccggtcagagatgcgtttgcggttgcgttagcttttccttggcaggtcactcgttcctccttttccctcgtttggcaaccgaatgccaccgccaattcggcgtcgcccaccgacgcccatccgccccagcagcagaacgggtgctcgtccggctcttcctccgccacttcctccggctcttccgcttcttccgtccccctcacttccatcgtcaaatttcccttcgagcgcaaaacaccggtgccttttgctcttcaatttgctctatttcgaagcatttcagcacgaccttctcatctcgttggacctgtggaatcgaactttgatacacaagcgtgacgtcgtccgacttttggtttgatcacccaaaagcccaaaacattggttggtctttcttttcatagggccgtcttccgctcgaacggttattgccctcggaaaatacgaagccccagcagcgagtggtccaagcttatttagaaagtgttaacagtgccatcgccacagaaggcgaatttcgagctcgggtgaacgtgactgccaggcaagtcgaacgtcgcctggggcatttaattccctcgccaattccccgagacaattcgcccgcccgctcaaattgtcacagggaaaaacggcacttagtacttagtttatatataataagcgaaagcctctccctcccttaagcgtctcgctgaatcgggagcttgagttgttggccggtgattacgtcgagcagagtttgcagcccgactcgcgactttgggccctttgccaaagcgcggcacttaacagaagccaattgcatccgggcgtccatgtttttacggccattcacacgtcaattgggggagggttgggaacggacaaaacgaaacgcaattggctatttcagactcgtggatgtgagagacggcaccaaatatttcgcacaaattgtgcactcggcgccactgcttctgtccatgatcctcatttttggcacggaacaaagtcagctgtttgtcactaggcttaaactggcgatcgatttaggactgctgagcatggctcatctgatcggagccgactctttgccctccaaggaacagttggactccaatttggtttggtctcccaacactcggcgaagggcacttctcacggcctttcctattagcaatttcttcctcatttgtcttcgcccgatgagcgagtgcttctggtgctgaaccgggagggcgacttcggcatccttaaaggacggtggcacggcttcgtgcgacgacagacgggcgacaaacgcagaaaagtcggggaattgcggtgggggcgaacgaaatccgaaacttaggggaaaagcggaagtgcgggcgtactcaacgtggagctgttcaacctgctcaagtcggccaaggagagaaccttttgactgtttccccattcagaaacaccgtgcagaaattccaagtcccaaattcggacggtaagcattggaatttcggaatttgctaattgcccttttaaggctccactctctttacaatcgggggtttcgtttgcttgtgaagcgtcccaaactgctcaattttcagatgcccaagcgcgccttaacggacgccgaatggtttttctgtttctttgaccatcaaatttttaattctctaaagcattgtcgcaccactcaaacttcggaatatttgagttgcattttcggcatcggcactctgttcattctttgcaacccggacaaagttcgagctcggtctgagtcaacgacacctgtcagccatcaagtaaaagggctgaatcagtaaaacgaaacccaggcctaaattaagtgtcagaaatggccgatgacattggcgtgtggttacggtaatttttatggactttttgaattggcgttcccgaaggcaaagctacgccgaggaacgaatccgcgttttaagagtcaccaaaccgaacgaaggaatcattgacccaaaaccttaatacctttgaggccgtcccgtgccgtcaaatcgaattttggctgcgcaacgctaccaacaaaacttcacttcagccgaagttgcccctatgcttttgatgatgaatgccatgactgacggcactttctccggctgtgacggggccgcaagttgcggtagtgtcacagatattgccaattgttgacatgaaccccttgaacttcttgaaccgaccaaaaccaattccctttaatagtcttcggcaaatgtctttcgctagaggctcccccccccccccctatagctcattgtcagatttattggatgacactgaagctgaagcaacgtaaacaatgatttatcca

SEQ ID NO: 6118 - DNA, 1685 bp, Heterodera glycines
ataaacaaacattaggatgcacatctatttcctttatcatctaagccttgaaacctcccaagaaggaagtcaccaaattcttgagtttttcgtcagtcgcggttgtgagttggccttcttctcggatgacctaaagagagagagtatttccctgggaatactttattagaataccttcagcaattcctgctcatgcgctcgaatgtgcgcaaggaattcacgctcgaagcgcgtgatttgagacgggtcgattttgtccaaatgtcccttcacgccggcgtagataaccgccacttgctcctcaatcgccatcggcacgtactgaccctgcttgagcagctcagtaagacgaactcctcggttcaacaactgctgcgtggaggcatccaagtcggatccgaactgggcaaaggctgccacttcgcggtattgagcaagctcgagcttcatcgaaccggcgacctaatcattcatttgtactataaataaaaaaatagtcgagaaataacctgcttcatcgactttgtctgtgctgcggaacccacacgtgacacggaaagcccaacgttaatcgcaggacgaactcccttgtagaacaactcggtttcaaggaagatttggccatcggtgatggagataacgtttgtaggaatgtaggcggacacatcccctgcctgtgtctcaatgatcggcagagcggtcattgagccgccgccatgagtctcattcattttggccgcacgttcgagcagacgcgagtggaggtagaagacatcacctttatacagatcgataccatcaacgtaccaacagaataatacctgggtaagcttcacgaccgggtggacggcgcaacagcagagacatttgacggtaagcgaccgcttgtttggagagatcgtcgtagataatcaacgcgtgtttgccgttatcgcgaaaaaactcgcccatggcggcgccagaatagggggccaaaaactgcagcggcgcagcatccgaagcagtggcggaaacgatgattgtgtacctttcatttaatacatatatttaattacgatgaaaagcaacttcattgcgtccgtgtcagtgagtcgtttcacaatttgtgccaccgtcgatcgcttctggccaatggcaacgtaaatgcagtacaatttcttcttttcttctgtgcttgagttgaaacgcttttgattgattatggtgtcgatggcaatggcagttttccttaatttcacgtaaaaccgagtgaatgtgtggataccactaacccagtctgacggtctccgatgatcaattcacgctgtccacggccaatgggcactaatgagtctaccgcctttacccccgtcaacattggctctcgcacaccaacacgcggaatgattcccggcgctttgacttcaacacgagagcgtttgctgacattgattggaccttttccgtcgatgggattgcccaacgcgtcaacgacacgtccaagcaaagcctcgccaacgccgacatcgacaattgaacctgttcgctttaccacgtcaccttccttgatcactttatcatttccaaagacgaccacaccaacgttgtcagtttccaaattaagtgccattccctaaaaaaaacaatgataaacaactaatgctctaattgtaagattcttgacctattcaactttttaattgaaa

SEQ ID NO: 6119 - DNA, 1355 bp, Heterodera glycines
caaaagcatttcgtaaaatgtttagtttttctcggaaacaattggtgtaaaaccgaatattcagaatatgagttcgaaaagaagtcaagagaattggcgaataaaagcagtactaacaaatgtcaacaaaccttcattccagagtcaaactcaaccatttcttctgcctgaatgttcttaagcccataaacacgtgcgattccatctccaattgaaagaactcttccagtttcctccaaattgatttgtgacgcctgtccaagaattttctcctccaaaatcctggaaacttcagcacttgacgcagacaaacgagccgaagttgagaaagcagtctgaagaaaggaaaatagctgaataaatattaacagacaaccaacctttggagatttgttcaagatagactggaaaagtttttttgagagcattgttgatcagagaatatatccgtaacgactaaaaatatatatataaacatagtaaatttcgagaaaagattaaattagattaatgtaattctcattttggctttattttactttaggcatccaatcaatgaccactctcagtttcttaggttataattttcttacttggtcaatgcctacaattttggtatcaaacgaaagcttaaaagcctcggaaatttacaattacaagggaagagcaaatattgacattaagaaaaaaaaattaaatgagaaaaattcagctttttctgagtatacataaatgtgtaattttttgtctgttgactttgatccagaatagttatatatataaactcagggctcccaactctgctgatttaggtagaagcattttgctgatttcaagggggtaaaagctgcttttttatttgatatgcgtttgccgatttttggaaaaaattctcaaaggtggccatttttatgtacagtatgccagggctgccagatgaaaaatattacgacgagcttttttttcaaaaaatggaaaaattttaaaatttgagtgcaatttgttaaatgttttcaccaaaaatgacaaatttttgcgattgggcctatttttaatgtcatcgtcatacgtcaggtgcaagtcggctcttatgcaaaggtctttgagagtcactaatgttctaaaaaaaaggagcgtactttgtctgggattaaaatagacaaattgttcaactgcagaaatacccccattgtgtgctcttttaatgctcaaaagatgaaaccgatcaatatactttatttatttttttgaaattcctccatatggcatatggtgcccaaacttgatgttgccgttcaaaaaattttgggactgaatcgttaatggataaatgttttttgtaactcatctaagtt

SEQ ID NO: 6120 - DNA, 1443 bp, Heterodera glycines
  misc_feature (1284)..(1284): n is a, c, g, or t
  misc_feature (1333)..(1333): n is a, c, g, or t
  misc_feature (1367)..(1368): n is a, c, g, or t
ccggcggtgccgataggcgccgccgaaaagattttctaaagttttaattagttttattaagaaaattgttcaaaatttcataaattttcaaccttttcccccttcgttgttgaattaagtttttaaatttttacaacgctcggagtccccaattccccgaattagtgtcggggggtcgaggggcaaaaagtcgggggccgggaacctcggggggcgacatgtcggaggtcggggcggggaataggcccaaaaatgtcggggatcggggtcggggaccggggagctcgaggtcggggcttaaccctaattctacatatatgtaaacaaattatgtgtcatgcgtcggaggcgttctttcccttccctcccctcccctcctccggcggtgtccgttccggaaccatgggttgcactaacggaatgaaatcgttccggaaacggtgaaggctgatcagtgatcggaatggaaaatgactaatcggagtgtgaggagagtgagtgagcagcagcaggtgagtgagtgttgatgatgggacaaggggggagagtgttttgccgtcccccgttccatttgccttttgtccaaagaaagcgtcgctttttagcgattgaaaaaatagtacatgggaagagagaagacatacaaaaaaggaaatagtggtggaaaaagaaaatttaaaaaaaccaaattgaattaagggagtaattctacataaagatggtggcattttggagatgtgaaatgagagggtccggcggcagtgccgaaacttcggcttcgaaaacttcggggttttttgggcttcgtacttcgagcttcgtgtaattaattacccgaagcttcgacgaaaaagagcccaaagatggatgggctcaagaaccaagaacgtcaatctttaaaaatttttttgctgagaatctgttaacaagtcgaactaatttcatttcctcgggcgcctatcggcatcgccggactcctcctgttcgatgaaaattttacttaaaagtggatcacaaaaaatttatcacgcaattcattcaatgtattttaaatttttaatctaaaaaggtataaaattggcaatttttggtgtgaatcttttaagaaatagggccactacttctaattttcccctcgacggcgcctatcggtacccctaccccccccggctatgcccttgggttcgaagtgtttgtggttggtttggtaaggcatggaacaaagtgttggtggcactcactcacgcgttgaacctacgcatttgtaaccaatcgctcaccggncgatccccaaaaaacatcttattccctaattacacactaatgacattanaggcaaaacaggcactcgtaaatcgctttagggnngcggagaagtgtttgcgcactcattttcactgtgctccgtccgtccgtgcacacaacacacaaatctctcctcca

SEQ ID NO: 6121 - DNA, 4304 bp, Heterodera glycines
  misc_feature (21)..(21): n is a, c, g, or t
  misc_feature (28)..(29): n is a, c, g, or t
tctgttacaagtcgaactaantttcatnnttcctcgggcccctcaaaggcatcgccggactcctcctgttcgatgaaaattttactttttatcacgcaattcattcaatgtattttaaatttttaatctaaaaaggtataaaattggcaatttttggtgtgaatcttttaaggaatagggccactatttctaattttcccctcgacggcgcctatcggtacccctccacccggctgtgcccttgggttcgaagtgcttgtggttggtttggtaaggcatggaacaaagtgttggtggcactcactcacgcgttgaacctacgcatttgtaaccaatcgctcaccggccgatccccaaaaaacatcttattccctaattgcacactaatgacattaaaggcaaaaacaggcactcgtaaatcgctttagggggcggagaagtgtttgcgcactcattttcactgtgcctccgtccgtccgtgcacaacaacacacaaatctctcctccaacccatcaacgacgaagcagcaaaaaagaaaaaacgaaatattttggcaaacattggcccacccgccaaaaagtttttggagcgtaaaaatattattcgcgtcaatgcgatcagcagaagcgtaatttgtgttaaattggaaatttattgagggaaaatgagaaaaaaaaaatggaaaaaaagaatttaaattaaaaatatataaaccgaaaaaagttaaataattggttagacaaattcttttgggaaatgaatgaatggatgagtccctaattatttaaaaatgggtggcatattctcgcgcacaaacggttcacttagcagttaaataaattggaggtcattcgttggatggtttgacgtcgacaatcaaaaagcaaagaataaataaaatttgcaaaaatctaatgttggaattaaagttactaaatatgtaataagttaaaagcgtgagcaaaaagaaaaatttaaaaaaatcttaaaggaaattgagtaagaaaataaaaatattaaaaatatggaaaatttcataaaaaagcaattaaaacacaaggaaaaattagaaataagcaactcctctctgaaaaaaaagctcaacatcatcagaaagcaagaacgatctctgctgctgaaaaagtgaacaacgacagtcagtggagaagcaattgagaacaaatattgtaaaagcggatcataaatgaatgaatgaatgaattgagaggggtgagaagcattggtcggtggaagcgaattggaattggttgaatgcttttgaattggcgccattttccattgttattctgtggtcaaatcgtcaacaaactgatcagacaatgtgagagggggagggatagagagagagagagagagagacaaaaagagagagagaggggagggaggagagagagagagagacgggagagaagagaattctagcaaaatattgaacctaatggcattttattaacagatttagaccaaaaaatattaaattttaatgacctttttccataagaccataaaaagttaataaatcacagtttaatatcaaatttctccgctggtaaatgccaaaatgaaaaacacaattttatggcgttaataaagcggtcattttcaatcaaataaataaatcaacagtaaaattggaccatacgaaagggtgagcaaatgattcgattcgctcttctccaattaacggacccttctcaaacaatcgttgcaataaaatgttaattaaaaaggcataaaatggcggcgcaaatgaaaagaaaaaggcgattggtgaaaaataatagcgcaatatttgtactttataagaattcacgcgaaaagtcctcctctggcgagaaaaaggaaaaaactatgccaatttgtcctaccggtaaattgtgccattttgcccggtcgaaactcctccggatccttaagccgaacgcgaacccggcgagggtcaaacgcggaaatgagtaacggttcggtgtccatgcgacgaccgtttagaaacacttccaacgcgtagtcggcaacctcaaaaaggatttggtgaataaataattatgtaaatattgtattgtattgtattacaaaaattaaaaataaattttgaaataaattttttaaaaattgacaggaaaattttagtttaaaattggaatttttcctttaaatttcaatttacaataaattatttcggtccaacaaattaggtaaaatggtcaattaaatgaaaaaatataaagcaaattagtaaatgacaatattttaattgccaaaaccccaaataaatgcgtcctttatttattgctaaaattcaattggctctcacccttggcaaagtgtactcgcaatgaatggtgccgggcccgcgctcggcaatttgtgcttccacaggacgtccagagacacattcgacaattcgaacgacaacatttgaggaccgaaaaacaaaaaaattaaatgtaaaataaaacaaaattaacaccgcaaacgctgatttgaatggatggaaaaatgggccaattcattgacagccgcacggttaaggccagggccgaccaactcagtgatgctaaaaaatgaaaacaattaataataataaagcaattaacagttttcaattattaaaaaatattggtaattaatagggcttccttttttaggcaaatgcctaaaatttttgcacatttaatacgtgtagataagcaagaaaaacgcgttttccgcttggtttggggtgtctacgatgacttttataatgcctatttttgcctatatcgggtttattgtgcataaagtgcctattttggggtttttgaaaaaatccataagaaaaatgcaataaaaacgaaaaacacacccctaagaaatgaccgaaaaaaatttgagaaaatacacccttaagaattgaaaaaattttcaaaaaaaatgatcccaaaatttaatatatttttttcttaaaaagaatttttggtttaaaattttgtccttatttaataatttcatttacaattgaaatatttaaaattttacttgtcttaataccaaaaaagcgttaataaaaaaaattttttgcctgtttttgtgcctatttaatgcctattttgcgatttttttatgcctttttaggtgcctatttcgcgattttttgtgcctaaaaaaggaagcccgagtaattaatgaaaagattttatttgcacaaactataaaataattaaaatttatttgaacaaatatttattaaaactttgatatggccatttttctcaaatttccagtaaaagaaaaataaatgaaaactgcggaataaataaaatattttaattgccaaggtcccaaaatatgataaaatcaaaaaattataatattggtaattgattaaactgctatttaataatcaaaattaaaaaaaaaacgcgaaacaggtttgaaaaatgtgcttttgtgtttctcccatcaaaacaatgcttcaaagttttgaaagcttaaaacccgcactctatgataatgacaaataaaaagaaaagcaataaaattaaaaataattaatttaaaaatctaaattgaccaataattaatattcccctcacatgtcttcgccatttccgttgacaaattcctccgcgactccgtctctcccgttcagcgcgcccccagctgcacgctgttcatgccggcgtaacgctgcaagattgcgtgccacatgctcttcgtggtccgatgacagtgcaggcgaacttgcaggaccgactgcccccgaaaattggatgtgccagggcgagtcgcgcacgtgttcgccgttgaaactgcgaaattcaattttaagttggcaagaaataatcaaatcaccgcatttccactgtgtgtttggtctcgtggacgggcgtaaattcggccaaaaaattccttaaaacaaaatgtttaattgaaaaaatgattataaaataatagattctaattagttgtgggtttttcggcaccttgggcttgtctcacgcacgcggcacgcgactcgcccgccattgatcacaatttccaaattgcccgagccagccgcagttgcatcaactatttaaacaaaggaattttataaatttaaaataaaaatatttctaaaaataaatatgtttaatggataatcccaattcttctcattttgctgactttcaaaagtgtgtggcctatgcaagttccgcgcttcaataaattgtggcattcgtcgcacagtgacctaataaaaataaaaatttacaatttaattaaaattaaaattcatttaccaaagtcggggtcccca

SEQ ID NO: 6122 - DNA, 1027 bp, Heterodera glycines
catttaaaaatataatcaattggaattcttttttaatattgtttttatttcctattgatttacccgcttcaattggcttccattcaacgcgcactgtcccgtccgcttcctgcggcacaatgcgtgccattctgcgctttccacttggccctacaccaccgaacacggcacaaaatattattttaatacacaacaaaagtggttagaattaacattttgcttagggagaggacttcatatttacaagattgaattgatatttaatgacagtgcaaattatttccttttatttgaatttttcaaagaaattggaagccatggtaattgatgcgtaataatcaaaaggattaatgggaaatactttcatttttaataaattattgcctgtaattgagcatgaaatttggcgtgcactgtaaatggcgggtgaatggacaaaaaattcggccggacggtcgacggcagccaaccgcaactgttcaccatagacggagatggcacttgagtcggcaatgtccagcagaaagggggaacctgaccatttaatggcaaattatacggacaaaagaaatttaattaaagtcaattttgaagaaaaaaagttcctgaagcaaattaagaaaataaaaataataaaaaaagtttataaatcaatttgcatagccttaattagtgttaattatgttcaattaacgatacccttgacaggttggctgttgaatgtgaccaacactttgtattggccaggaccttgtggtgtaaatctaggcgaaactcaatttcattatgttttatgtcttttgaaccctcacctaactcttcgaacattggagccttttggctcttcgcgaacagaggcggggattgagcgagagttccacaggacggacaccggaaaaagaatttatttattttaaatgtttcaatttaaataaatttaataattaaatcgcttaaaaataatgtctttatatgtataatggagtaaaattagaaagtttatcaaatttcatggtgtaatttctaa

SEQ ID NO: 6123 - DNA, 2427 bp, Heterodera glycines
  misc_feature (134)..(134): n is a, c, g, or t
tgatcagattgtatgtgtaggagtactggtttatcattgcgatgatttgcgcggtagtcgcacttggtcagcactgacacaacaccggaaatgccatgcacccgtttccgtcgacggtttggttcagctgttgnccgaactgattctgactgagttgcaatgccacatcgtccagctccggtttctaaattataattgcacttaattacaattataaattgaaaatatttataatgggctcaaattgcccttttttgttcctcccttcgcctatttccatgaattttcggcaaaagtgccgatggtactttttgacagatattttttatcataaaaatgtttgcgcttattcaatttcttgatttcaccgtgcatgatgaagaaccatcgtttgcctgttcaccaccactatttccagtgtcgccgttctttctgcagctcgtgccgttgttttgcaacaattgatcgtacccctgccacaacagtacgctgatcgcgtgcacacatgccgcgagacgagcccgtgcttggcgctgctgcgtttgcccattcgtttggttcaacgccgtgcgaatggaattgaggtaattagtgtactcttggctctgttgttgttgattttgctgatcagcagcattgtctccattttggttagaattggaggaagctgaatagtccgaattgtgttgctcctccaaataatttgtgccgccgcccccattttgggacgaggaatagtcaatttgaaccgatgatgacacggatgagtaattgtaatttgactttgatgaagaaatggagccggagttggggctgatcaacggttgctgtggaattgcattgtttccacccgtgccattgctgctggagtcataattatttgaactgttatcataggaccccgatgcgtaatttgtgacgtcgctcgtgttcatgttggaagagtagatgatctcggaacccgaactgatcaccgtctgttgaccatcaactgattgatcagcaccagcatcgccaccagtgatcatatcgtcgccatacggtattgtctcctcactgtcatcgtcactttccttcgatggctgggacccagattgctgttgttgtgccgagcttgaggcggacgccgttcctgtcccagcgctatttgaccaactcccgctaccgtaaccaccgctggagtagctgccgtatccgccactaccgtattgctgctgctgttgctgttgttgtacagcgggttgttcagcattttcttgcgtttcgtcctcatccgattgtgagacactgctgtgctggtggttcaatgccaagtttatcgaaagagaggtgtccgactgttccgcggattccgacttgtcgccccaaccgaacaaagcatcgacggacagcgaattttggagggtcaacaaagagaagagcagcaaaattggaggtgaaaatggccaggatagggaggagaaggtggagaaggcgaacatgacggggaattggagagaattttgttgggaaataaatgaatggaaaaattgaattaactgtcgacaaatggcaaagctttgccttttaagccaaaacttagagagagaaaagttttgaaagatatttccaatctttgtttagctttaataaccaatgattaattaattcgtgacttgctgaagcgtaatgcatgcgttttgacagtttcacttctatttcggtctatattcaaattgattaccttttcgcttcaaactacgtggaacaaaattttcaaatgatttcaaacttttatgcagctgtcaaagctgaagaagttaactctatttttggttcgcttcacgtttcaatttgaatctgcgaccactccatcaataattgtttccaaattggttaaaaattaattaattaattttaataaaataagaaaataacaattggttgttaattttttatttaatttttatttcacataatctttaaaatgacaatttggcggtaatatttcgggttttctatctgtcgtgccttacaaatgagtagggatgatatttatagttttttcactattttttcctgagctccctatggcctgaaaagcacgaaaatctcggttgttgttgttaagctagttttcgagttattagtgagcaacacttcatgacattgacatttgtgtcgacggatcgctgtgaaaaaatagggttaggtgtggaaaaaaattcatagaggctggaaatttttttttaccgtaaaatgacattttcagcctaaaatctgtttagagatctaacccaaaaatccaattttcatctgcggcaaaattaatgttttagccaattttgcctaaaaattttatctttcataaaacaaattttttaagtgatctaaatgaacttgaaataaagcttcaaattcattttaagattttctgttacgttaatt

SEQ ID NO: 6124 - DNA, 1607 bp, Heterodera glycines
  misc_feature (31)..(31): n is a, c, g, or t
tttttaattcaactgacacgtaaacagattntgctccaaaatagtcattttcaataattttaatgaaaaatttgccaacaaagtgccaatagaaatttttcaaaaataacatccttaaaatcttaaaacccattatatagttggaaataatggcaaaaaaacggatagagtggcaaaaagatggtatgcaaaattgataattttcttaatcattaacctgacggagccagaagacacctccaggcccaaaatcgtataaatttttttgagaattttacaaaaaaaaaattataaaattttcattttattttatttttagtatagttgccatatttattaagaatatagttttttatattaaatgtttaattataataatattattttcttaattaaattgattttattgacaattggatttattgctacacatattccattgtaacattctgatttcctttccttcacatcctcatttacattttttaacatttttatatataataataaaataaaaaattccaaaattatccaatgaaaattttatttgtgctctttttgtattttgccattttgacgatttttttccaccgcttttccgctgctaacgagacaaatgagcatatttcaacagcagttgatgctgatgcagaaattgagaagctgtcaaaaaagcacgtcacttttgccgatccgatcgaaactgaaatcaaaggacgtgtgacattggcggaactgatcaaaaaggaacgggacggggaaagcacagcactgatcagccaagagggaccatcagcagcagatgatgctgatcaactgatcaaaaaggatgaacggataagagagaaacaatggctaattaagggaagtgaaatggaaaatgcagcagaaaaaagggacgaaaaagcaattgctgaacaggtcgagaagactcataatagcctatcattaacacaggaggaatcagccgacctgctcaaaacagaacgtaagccaatgatcaatggaagtttagcagaaaatcccaaccccaataatggcacaatatttgctgatgtgattgaggaaatggaagcgaaaagggcacttaagcgcaacgcattagtaaaactgatcgaaatggagcaaaagggggtacatcagacggatccggcaccaatgccaaaagcggaggatggcattcgtgaatcatcaacaacagatgtagctgatcggattgtagaggagcagaagaaagcggcagatggaccgaaggcaccgatcgcaaagcaaacgctggccgaactgttagaaatggaaagaagcagtcaagaagaggcaatttgatcaattgttgatttgaagtgatttgatcatctttttcttctattgtaattcttgttgaaataatcccgaaagttctttttctcgaccatgccccatcaaaaaaggatattattgatttatactaaaactaaaaatttatttttttgtaaaaaaatttcgcaaaacttctacttgaattttaaaaatgcgctgcgaaaaattgtccgaaaggcaaaaaaaggtcgcaaatttctgactttcaataaaacctattttggagtctaaatctgatttgtgaaaaa

SEQ ID NO: 6125 - DNA, 2958 bp, Heterodera glycines
  misc_feature (17)..(17): n is a, c, g, or t
  misc_feature (23)..(23): n is a, c, g, or t
  misc_feature (70)..(70): n is a, c, g, or t
attaaaaggaaagcttnagaganaagcggattcaattataaaatgtttaagaatatgcatattacgtttntcataaaagggcatttgcattgtgcgtttgtttatttattaaattttgatttgattattcaagtttgaggcaaaaattatgggattttatttattgaaaaaattaaatggaaaaacttaaaaaatttagaataaaagtaggaatttaaacaatgacgaaacatttaattccattctcgcagttgaagcaaaagttgcatttaggacaaaaacaaatatttaaaattaattaaatgatacaataataattcaattaaattgtattttcttacttccgcctcgctcggctggtcgtccaactccaccacttcagtcggctcatttttgacacttttttgtccaattttggccacccatttgtttcggataacgtcgtccacaaaaataatgtccgacgcattgtttccgtccgtttggtcagcagctgaaaattggtaaaatgacagcgatttttatgatgaaaattgccacagaacgaaaagaaaatagcaggggatgaagccaaccacaaatccaaggccaaaaattagatagatttatggaacggacaaaatttagtgaaataaaaaaaagataatttttatccgtgttttttaaaatcctcagcatcggagacaaaaaagcagcaggaatttgtagccgttttcggcaaaaaatgactaattttggtcaattgggttcaaattttcaaaaaatatcgtaaactgggggtctatggggtgccgttagacgccgccggaaaatttttttttggaaattttaatgctattttgttaagaaattgcttaaaattttcgaaaaatttgcccatttttaaaaatattccgattaaaaagaaccaaattaggagaaaagattttgaccgacactaataattggcactttttaaaatatttatttttatttaataattcgattttctcttcccctccccacctttttgcacaacttctggcacattttccttatcttccacaacaattattgtcctgttggtgttggttcggaaatcgtcttccattgccattcggttcaaaaattctttacattccgccaaattttgctccaatttttggcacttttgccgcaacagaagaacattgtcctgaaaatgaatgaacgtttcctttggttaaattaggtgatgttttatttacgccaatcattttaaggtaaaaaatttaagccctttttgtttattagacgaaattgaggagcacagaaaaggaagacgaagttccatttttatgcttttcctgtggtcggggcgagtaattataaaatgataaatcagtgattcaagagactcaaaatcagaccccatttttgccactttctgttttagtgccggtcccaccgggacacaattggacttttttgaattttcgacgaaaacatgggaagcgaagatcggtgtctgcccaggatcaatcctaattttccaaaatgatttttttttttttgaaatgctgcctgtgattcgtccaacgactgtttcatggccttcattttgccgttttccttctccaatttgtcatttcgttgtgccaattcctcgctgctcttcaccaaatctcttccaatttgtaacaatttgaagcaaagttcgttttgcactttcattgtgttgccaatggactgcacaatttgcgcaaagtttggcacggaaacagcggaacaatgggagaagccatcagaagaagaggaagacgagggagaagcagcaatcagctgacaaatgaaggaaattgggggaaactttttgaattttactttttcaaaaaatttaaagattttttttaaaaaatggaacaagaaatcggcgtattaccgaacattcgacccaaatttgaaaattttagagggatcaaaaagtattactttaattaaatctgttttattcaggaaaatcttctaagaaataataaagggaatattaaattctaataaaattttgcagattttgagtcatttaagaaaaaatcagcggaaggaagaggtcaggcggagctgacagtcgcaatcggagaagaatttgggattttgaatagtttttaacagattttgcaccaaaatttgtggatcttagtctatttttaaaatagaaaaacatgttaattatttttttaaactgtcaaattagtggtaattaaatgtcacttcaaaaaatcgcttatgtatttgctgggacctcataaaggcaggaactcccggcctggtcctacctgacccattcaactgagaatatgaaaaatattttaattttctgctaaatatgaaaattaaatccagtaaaaaatgtctctgctcacaaaacgcacttttgccgtcgtcgcctccttttgctgtgccgtagtcagcgtttcgtcaatttgttttgccaaaagttgcagctcacattcaatggcaacggcgccgttcggaaaagcatcagccgaagaagccatttcaatacaaatgaaaaaatatataaaaagaaaagcaacataatattaataataaaatttaaaaattgtgcttcgcttcgtttttccgctgtctgggaaagttgggaaaattgtaaaatgaaaaatgaagggaagagaagaagaaaagcaatcgaatggaaggggaagggattgagcggtgggagggagggagggaggagaggtcaattggacgagtgatgagcaaagcggaggagtggaggatagcagggagatgacgttcgatttgtggggagttggggcgggggttggccggggaatgttgcgatgtgtccatcccgattacatcggccaaccatgaggggcctaattacggacgcgtaagagggtcccctggaacttaattcccctattaacactggatagtgggacctcacggctttattaaatgtaccaaccagat

SEQ ID NO: 6126 - DNA, 2110 bp, Heterodera glycines
aaataaaattggtgactaacttaactaaaaagtaatattcattattaatcaaaggatttaattggcagccaatttcagcaattgtccatttccgtcaaaaagttctcttttccgaatcggcgtggagagcattctaaaaatgaattaaaacgaaagaattttagtttttgaattaattaattaattaataataataccatcattatttggccaagaatggcgtactctttctcgaaaccatgaggaaaatcagtacgaatttggagcttttcagcagaaaatagcattttgttgacgctgttttggagcagaaacatacaaaatgattggaagtctgaataaatattcaaaattaataaaattaaacattaaataaaatattaaataaaacctgcggcattttgaaagtgccgtccaattggcattggtcagccaatgttttgttccgactgtgccattcctcaagcggataagtttggaaagccaacaaatgaatgacacttcccaaaaaccaagcgatgtccgattcgtcggagtcaagtctcatttgcttaaaataatttttaaaattcttttaaaaattgcgcaatttttggcaccgaaatttgctgtggactcattgtgatcaatttgctcattgtcaattcactttgactacaaatttggcactcgtcaatgaaagtgatgcgaatgtttccgcccattccgttggaatcgttcgattctttttcgacacgaaagttttccaaggttagggggtacggtagttcagtggccgaagttttgatacaatgaaaattcatttcattttgcatccgtagcaaaaccctcgcacagaagaagaaaatttttgctcgtcagaaataatttgctgcacagaattaacagaaactttccgttggctttccaatttttttggaaatgctaaaaaaagtaaaaaaaaatgccaaaaattgctaaaaattgctaaacttttttaaaaaaaaatttaaaaccgaaaaaatcaagtagttgacaaaaaatattagataaaaatcaatgattttcaaaatctgagctcagattcgtgatcagctcatttttaagcatagaaaaaatatccgacaaatttttaacattttttcgtcgcgacaccaattcttaatattgccaaaaagggcgcaaaaaacatgcatacatttaaaaattcataaaaaaaaaacttttttgctttattttgaagaaaggagctcaaagagcatttctgtattgaaattttcgattctgaagtcactatgcgtcattaaaaatcagacttttacgcttctcacaaaaataagtaaaaaattttggcgttatgtcactattttattaactagatttttcatcactaaaagtcgcgcggccctagtaattaaaaatctgttgaaaaataatccccccgtctccattaaaagccctgtctccaattatgcccccctttctgaagaggttgaaaaataatcccccggggccttaattagagaatatacggtagcccaattatttttctcttttaaacataataaaattgtacaaaattttaattattttcacaaacataatacatatgccaatgattagaagatgcaaaattgcacattttcttggaagaagtgattgagcaaaagtgtccatttgttgcctttaaaatgataaaattttaaaaatgtttacagcctttttttatattaaattcttttagaaaaacctgccaattttaataaataaaagatttaacgttttaagcagggatgggatccgtccttgaatggcaaggacgtccttgaaattgggccctctttcatgaaaataaaaaatgtccttgtatgcaaggacgtccttgaaaatgagcatttcaaaaaaggaaaaaataatcaaaggaaatttggtaattttataacatatttggatattaaattatggcattatgtcaattttttttgctcatagttcagaattattgtttattattattattaatatggtattaggaatctttcgtgatacccatttttatttcagaatgttttcaaataagcgcaaatgttctttcaatcccgattggaaaagcaatataatttgtaaaaag

SEQ ID NO: 6127 - DNA, 1468 bp, Heterodera glycines
  misc_feature (448)..(448): n is a, c, g, or t
  misc_feature (476)..(476): n is a, c, g, or t
  misc_feature (503)..(503): n is a, c, g, or t
taaatccatttgatttatttaatgtatttgctagaaaaacataatattgcataagcattcactgagaacgcatataaaagtatttcataaacccaaatttaacaaaaaataattcaatttttaaacttaaatcaaataaataattatatatttttaaattttattgcattttttaattttttattgcattgttaaataacataactaaattttttatagtttaattattatgtgaatgctttatgatttatttttaaaagtacaaagatgctatttgataaaagcatttttttaaataaattatttttgtatttgtttcttctttaaaattttgtttttcaagggaaaataagtgccaatgttataaatttaggtgtgtaaaatgacaaaattttatccaaaaaatgataaaattaagcaaattcagtatttagataaataattttanaaggtaaagtaaatcgtcgctacgattnaaaaagtttatgaaaactaatggtatntttttaatttcagacaattttttttacacaattataataacccgggtataaaatattattttagcacaattaaaataaattaagtcacttttgtattaatattaaaataaaactaatgtatattcgatcaaatctttatttatttttttttttcgttttatttagaacataaattatattttttgctttaacagttttcttttcttaaaaataattttgtttctgtggatgattttcaatttaataattcatgcacgcaatttacttttttttttgtttatgtatgctatgctagcataatgagtttgtaaagctttttgaatgatctgatttaaattttttgatttctttgccaccatagctccaaaaagtgatcaattgattgttttttgatattatttccttaattatgtaattattctgatattgtttttccctcatttttgtagctgtttttgttggtttttgactttatataaaaatcattcaaatggcctagcatgagtaccaacggaaactcataccaaaaaaggttttcttcatttaataatttttgtgaaaatgaaatattgtttttagtgatatttctgtccttcatattaaattatttttcaggctttaatttctacggtcgtactttatgattatgcattaaataattttttgttatgtaaaaaaatttattttttagataaattaatagaaatatttcttttgaaatctttaaaataataaaatttacatttgttaaaatcttcttgattttttactccttgttttgggttgcggttgaacatttattctcggtttaatccattaatttatttataaaaatcagtattttcggtattttcatttaattacttttaattacatggttaaatagtcaattttaaataaaaaatttcatttgtaaatatgtttaataaaagttattttttaaattatgggtaaatggattttta

SEQ ID NO: 6128 - DNA, 2353 bp, Heterodera glycines
  misc_feature (2307)..(2308): n is a, c, g, or t
agtaattcggctggagtggttccggtgtccatagccacgtaatttatgtggttatttatcgcttcgcacgcttttttaactagtattggtttgatcaaaaaacaattatgattttttagatgaataattctcatattattatatttacttaatcattttatcaccaataattttattcttttagtttttaaccagtgttttttataaaaatagaaaatattctaaatatatatagtaaattttttattattttacattttattttaaattttaattatgatcgttaaagttctggattttttatgcttatttattttaaaaaaatgttttggatttaaagataaaattaaaaattatttagattttaataacggtgattagatttttaaataatttttattcataatcatcattttaatgtaatttcaaatttctaaattaatttttttataacttgtttcatcaaactgactttattttaatttatattgctttcattttgaattgaaaatgaaataattcatttttattagacatttttttaaatagcccaaggaggacttttaatggacattttctaaatatcgtatattttttccattaaattttgttaaaaaaactatcttttcaaacccagtagaaacaattaacaacaaaaattagcagttaatgtgaatgacattggccaattccgtgctgagacgatgcgaaaaaaacgcattgtgggcgatgcgaaagaactcagttattgataaattaaataaattaattaaataattcaattcacaaaatcacggcgccgtccgggtaaccctaatgtacggcgggacgcaagtcattttcaatttttcgcatcagttctcatcaattttctatatttctagtagacacaaccggacgccattgaaaccattttgtagagctcatcgagctgtacaaaaaagccgctggtatcggcacgcttagcttgggttggccatcgacagggttgggggcgaggctgagggtcctccggcagttgtgcccaacccatgacgggctccaagtgaatggatcaagaacctgacccggcctgggagatagccattaaaaaaatgaacaaaaacttgttcttaaacgggccggtccgggttccggatcaagcactttttgtgccccgaaagtggcgcgatcggcttccgaaaatgaccaatcaatcactgagtttttttcgcatcgacctagcactggccaattcgtagtatcccatcctttctccgatcaataattgtcttctcttccaccctcactcgtaacccatacattttgattttatttcaaccgttgcaaatacatggatataaggttaaggtcggacaaactccctttccagggacggatatactcttttccaaggacaaaggggtaaatcaccttaaattcgaggacatttaaatttgatcataaacaatagaaatgattaaattatattcaaattgtttatgtttttcgcatgaatcttataggcgtcgccgggaaaaaatacagttttcttgaaatcttaattttcttccgtttttacaaaacttttaattttgtttcgaaaaagaatatgccatcatttaatttcttttttaattttaatttaaacttaagtgtataaatgtataataattccgcaataaagattgttttattttatatcttactaaatttaattatgcatagttatttaattataggcattgtttatcggatgctagctacaatcgtatagccacttccgagaacgtagaagccaacgcttatttagctttttttaatttattttcaattagcaaatgtaaatccatttaatttatttaatgtaattgccagaaaagcataatattgcataagccttcactgagaacgcatagaataattacataaattttaacaaataatattgcacttttacactttaatcaaataaataatgcagtttcttcttgaaagttttatttctttttcctaatgaacctttggatattttttaaattttttttcgtcttatataaggatacgctttttagttgctaaaaaatgtcaaattagttagttcttaggttccaaaaaaccaaaattgtattttttattttaacatatttgattcttgaatatatctgtcaaaatatatttttaaattttatgaaatcggatcgaatttttttatatagatatttacgaaaacttgctttaaatgtaaaaaacaatttgtgaaacaaattgaattaaagaaatctttaatatagtctatttgtaaaatttaagtaacaaatttaattnngtgcatgtataagctgaattagttgagtattaaataaatttttaa

SEQ ID NO: 6129 - DNA, 2511 bp, Heterodera glycines
aaaaaaaatattaaaagtcgatttatctttaaaaaactcatttaattacatgttttattgcccatttttgtgaatgttgaaaattcaaacaataaattgtatttcctttcttaaaagcaattatttattcaatagcgcacttcgttaagtccaaacgaggccacaacaagcttgtttatcaaggttttgtctattagcatcatcttacgcacaatgatgcgagctattggttttgcgagctgaagaagacggccacaaactgtccagggcgcgcaatttaccgtgatggaattgtcactgtttctgccgcacacaaagatcacgcaccgtcagccataaatgtacaggttcaaaacgtacggtcgaatatgcgggcaaataacacgcgtgacgctccgcgcacggtggtaaatgaatgcctggcgggtgctagcaatgaagtaattgctaatttgccgaaaatcgcaacattggagcaggcaattagtagaaagcgtaagaggcaggggtccagttgaacataccgcacacacttgccgatgttttctttcccgaagaacttcgctacacccgaacgcatttggcagaaaattatgttcttgccgacaccggagcagaagaccaacaaagaattattctttttggctctgcgacggatgttgaacgcctcacacgatgtgacacttggcttgccgacggaagtttccgctgcgcgccggaaattatttttcaggtttcgagaatattttttcagagaatatatagcaaaaatggttattaagtcggggatgggttggaaaaaaatgcatttcgagcgaaaattcacaccgcatttctgcacggctgttggtttcacctgtcacgtgctcattggcggtcagttgtgtcacgttttaatgacctggcagaaaggttcattcagcggtttggagacactcaacagcaccaggattttcttgaaaacacttggatggttgtcagcgtcgcactccgtcatttttgctcgatttttggaattgcaaagacattactgaactccatttgccgaaggacaacaaatggcgtggaaagctggcatgcccgactgcagaagacttttgcctctccacatctcacctttttcacttttatagaagatttaatcttttaatttcgaaatgattttgcaaaaactttttattttaaaggattactgaacgaaaatgttcgagcaaatgcaatttgcgttaaattggaaagtggtgaatctattccattgtatacgcgcattgagtatcgtcaggcaaatgatcgtctgctcaacattttgcgccgttacaacgaatatttgccggacgattacaatttaattattgtacgaaacgccaaattgaaactttgtacgaaactccattgtacgaactgcccattgtacgaactgaatattgtacgaactgcctattgtacgaacagcattgtacgaactgcctttgtacgaactgcaaattgtacgactgcctattgtacgaacagcattgtacgaactgcctttgtacgaactgcccaatgtacgaactgccatgaccccgaatttaagacggctagttttaatttattttatgactaattttacaagtttttttaaattaattggtttatgcgttttaagaatctgattactaaatgttagaaatataaaatactctgttttatagtatttccattattataagccatattaaatttcatattcggcatgatgaaatattcgattttagtgtatgtttttagagagtaagaaacatgttttctaaatttatcattttttaaaattaatttctcttgagaccgtgccatcatcttgcagatttttcctgtgcattttataattcataatatatctaatgaaaataataaaagtaatataataaaaaaatatgatcaattactgttgaagtaagagtggaatatccaaatttggcttctgatttggatttaaataatgtcatactgttcaaaattgtgtatttaaattataaaattaaagaaattcgttaaatttatatattaaatttttttctttaacaataaaaataaaattgagaataatatttatgattttttcctatatttataaaaaacattttcggtgcaaatgagattaaaaaacaattaaaaataactagcatgttttcgtgctaaaaaggaaagaaaaatttgttgcaattttttacttccaacatacctacgaaaaagaattaattaattgaaaatctatagttaaatggtaatgaaaaaaaaatatttcttatgataattcaagcgaatctttagtataatcttagatatatttaagctttctgaagagaaaatttatctattttttattacaactttgttattgattaaaataatagattagtaaaattcattcacatttgaaaaatgaaactaaatatttgtaataacgccgcaagttattgacaaacactatcacacctagaaaagagcttaaattaaaaatatatattt

SEQ ID NO: 6130 - DNA, 3482 bp, Heterodera glycines
  misc_feature (58)..(58): n is a, c, g, or t
ccgtttttgacaaaaaatattttttaaaaaatatttgcggcgtatttttttgcaaaanaattaagatgaatttttgtttatttcgctaaaaatttcgggactcgaatcatctgaacgaaacgcggttcgagaaacaagagacaaaattggcacagacacaaaagacaaattttctttagccataattctcgagtagcactaaattggaccaaataaattcaaaaaagaatatcaaaaaataattttaggccggcgcgccatttagacaaacaaaaaattaaaacaattgaattaacagaatttttaaactttactgtaggaaccaataatgtgctgatccaccacacattcacttggttgctcaacaaacgcatattaatacatttaccttcattttttggaattttgtgccattaatggcatccgtcgcgctttttatgtgccgacccatttccggcacactttttttatgtgtccccaaaatgcaaacaaaaagtcgctttttgaaagagtgccgcatcggcacaccgcggcgatcataaacaaaaaaaattttcagttttttggtcccattttgccccaatattaccgttatttcaccactttgacttcacatcgactccttgcggcgccatcgccaaaaaaaaaatattttgggggtttgatagattttggcatatattttgacgctttttaaaaaaatgattttttaaataactttttacacttcaattctggcaaaaatccataagttttcaaatttttctgttcgctcttattagcacctgtcgattgttgaaattaaaaataattgcacaattgagtcaaacttaatatttaattttttatcttaccaatgccaaaagccccaaaatccaactttttctttaactcgacattttttttgatttttttctacttttttggattttttttttttgcgttttttactttttcgagccgggccgacgtgattagagacaggatttttagttgctaaaatgccgaaaggttactaagctaaaatgatgaaataatttgctgaaaaatttattttataaaaattaattaattaacaacggtttttggttttactgaatttacacttttatatccgcttattattcgaagtttggagaatgggatgggcttaatgcccacttctcaatttccttgcaatctttttaaatttcgagaaatctcaattcattgccttgtttttttttgaaatagcctctctaaaaagctggttttcctttaatattcaagaaaatcataagggtttttcaatgaaaatctcgatttttcctcttggaattcatcgttttcttagaaaaattcaaaaattccctcttggtttaaaatgaaaatctcctttttcctctctcgaccttctcttccgaccctccaaccatattcttttctcccctcttccacgcttattcatcatcatattcatctcctgaaagcgccgtcctaattcgctgatttccatacataatccctccccccaatttccatgcccattttccatccaaatacactctgtgctccagggctgtttgttgtgtgtgttgtcgtcgctagcgacgacgacgtggcgaccgtccgccgacgaatggttgggggagtgatcgacgtggatttagcccccctcgcccgccccggaggggaggaaaaggacaaaatgattagtcggatgatgggctgctggcggggggagaattgatggaagaatgaatatttgtacatattgttgttttagatgttggatgaggatgaatgatgatgaagaatgaatgtgaattggtcgggtggggggagggattgttgagggcagggagaaaaagcccctctccaaacagtccaaacagtcagccgtctccaataaatggtggcaattcattcattcaaaatcatttgctcattcatttttgtcattcactcaacaagtccatggcgcagaactgttggcttttttgttggaaatcggcgacaacacattcaacaattgatcagcaggatgagagtgacttcttctgctgatcagaaaaggcttttgggcttataaggattttctgattaaagcccgatcagtctcgatgtcaaattagtttctgagtttgagcaggttttcattttcatcatttcatctttcctgtccgacatgggcttggattatccttatctcgattattggttcttgagataaatcttgggccatggacttggttttcagagctttgggtcgattaaccaatcatgtctccctcatcagacaaaggattggattatcccgagtcttgagccctaagtttgggtcaccatcatgaaagggtttgaacattcctgaacatcatcaattcaaaagcctctaatcctagcatcatcagctatgtgccctgatgattccggcactttggtctgtgatcataatttagctactattcgtaaatcccgagcatttatatgggtcagattaattcccgaaccccattttcaatttatccatgggaacaatgcccattattattattcagttcacaataaactcaacaacaaaattttttgcttttcataggcatactgtgtcctgttatttatagtcgaatgtgaaccctatttgtaaaaaatgggaaccaattaaaagtgcctaattgtttttcgcgtagcccattaataaaacaagcaattagtagtacacacgggctgcgagggatatgggcgagggatggaatttgaagcacttttaagatcggattatttctaatcaaaaatttatctagaaaataaaaatatccttttttcgctactgattttttactttcaatttaaatttattttcccaatgaaagttttttcctaaacaaaaattcgtaatttttccattttttatttttaaacaaatttatttataaattgctcatctcatttttgatcatcattttagttttgttttaattacttgctgctggttcattttgtagttaataaaagcttaactgtcaaaacattaaaagtaattaaaaaaagattaacaaattatttgaatgcaattttttttgcatatccactcgtacgaaaacggcggtacgaaaacgtcctggccccgaagcgggtcagttccgtctggggccggttccgtctcgggccagttccgtctcgccagttccgtcttagtagtaaaagagccggttccgtctcaaatatttttggacccaaattgtaatttcaacttttagagagtggagagagaaattttcttcaattttgggaatatgattacttttattggtaaatatgttttttcagtaattattagagaccggacttttaggcaccaaaaattttttaaaataggcacctaaaataggcacgaaaaaggtgagaaaaggtataaaaaaatggacaaaaaggacaaaaaaggcacgaaaaatttggaaaaaggcagcaaaaaagaaacctttttttagacaacattt

SEQ ID NO: 6131 - DNA, 1788 bp, Heterodera glycines
aattaaaaaatattttaaaagtaatttttaaataacagatttttaaatgttattatttaacccaacaatgtgctatttcaccaccacattcacaggttgctcaacaaaaacgcatagtctcacataattcattcctttattcttgggcatcttgtgccattaatggcatccgtcccgctttttgtgtgccgccccatttccggcacacttttttttgtgtgtccccaaactgccaacaaaaaggcgctttttgaaagaatgccgcatcggcacaccgcggcaaaatattttttcagttttttggtccccaatttttccgcaatttttaccgttctacggaaggtcatgctgaggaaagccatggcaaaatgggtggcaaagatttagattttggcaatggcattggtgaagaatggcacagtacgaataccatttttaatgaaaacccggtaatttttggtgaaagcccggaaactttcatctgtcgttagaaaagacaaaataagcataagttgtttattttgcatttttaattagttaaacactcatcaaaataaaaacaaaaacaaaaaacggaagtcatataaaaataatgttggccggaaacaataaaacatttgttggcatttgttttcacatgttttttttctattatataaggacaaatttttttatttcttttatagataaaatatacagaataaaattcccaataattctcaagagaatgtttggtaaacacagtaagcaattattgttcggtatgcttaccgtaatggttactgtaatgctcaatgtaagctcaatgaataatgacgatgataacaacaacaactatcatccttattactactacaataattatggttatggtaacgacagtaattttcctggaaataataattggtataacgcaaacgcatacactgataactggtatagcgtaaatgatggtgatgatgacacgagtggttacggtagtactacaagtggaaactacggttttgagacgaacagttacagtagcagtacactgggtggcaattacgattacggtaacagtagtgagtcatcatcagcaccagcgttgacaaaaaagaaaaaagaattgcagcaaatattcagaggaaacgttcaaatccgagaaactgacagtgatggtttagtgagttatcggccggccaaaaagaacgaagtggtaatcaaatttaataaataaataatgcaaaatataaaaggtttcaaattcagcttaaattatactaatattttattttaaaaaattcaaaatgcatataattttttcttttagtgttttgaagtttattgcggcactagtaatccaactgacggcatttttactgatcactatggcaattttgaagaaactttgcataaggaacaaattaaagcgctgaaaaaaatgcaaatttggaattaatattggattctacaaacaagaagtacttaagtgcgaagtgtcaaagcaaaaaatttaaaaataattataaaattaaaaataaaaattcgaagccaatgcgaaagtgatggaaattattttacggtaattaccgaattagcgtaagaaattttattaaaaggaaatcattaatttatttaggttgatttctattcaaagccaagatatgccttaattaatgtgctgaagcaaaacaaattgcgaaggaatttgactttgccattcacaaatatcgcatttatagggacaattttcaaagtgagtgtttgaaaataattaaatttaattaaaatatattttaaatataa

SEQ ID NO: 6132 - DNA, 1721 bp, Heterodera glycines
  misc_feature (37)..(37): n is a, c, g, or t
  misc_feature (42)..(42): n is a, c, g, or t
aaagacaaaaagcaaaagcagccgcacgtttttgatntaatntaaaaaataccaaaggaaaatgatactgtaggaaattcaaaataaaaatctgattttttcatactgtttttcgttaaattttggaaatctgtattgaaattacaaatggggatttaattcatggataaagttatattctttttattgtaatttttaaaatttgttcataaatttgtttacaaataaagagttctacctcacaaaaatatggatttgttttatacaatttaatacgaaaaatatttagtttttttgttattttctgtcgctctttaatttttaaagattaaatttaattttaaattaaaattaaaagaaaaaatgggggctactaaaaaccattaaaaaatttaatgttctctattatcctgaaaattaaggaagattatgaataattttttttcaaattttaaaaacttggaggcattccgacaactaggaactgaataagaaagtcactttttcaaatttcatgaaatatcctattatattttcccatctataaaaaatgggggtttaattttttatatatcttatataatttaatacaaaaaattgagttttaagttttgcttgttattttattttgcttttcatttttaagtttaaattaaaaaaagttgttactaaaagcgacaaaaaaagatgggggctcagtccgcatcattggcctacggaaacggcactttgttcgctgcacttggaggtttgtgtcccgggtttgcgagcctccatccgtccagactgatccggccagagctggctggatcagccccgtgcgctatttgcccggcgcacccatccgtcgactttccccatttttaccccaagggaaatgtgtcagtcctcctcgggcacacgccacccctcaggggtggtgtggcgtgcggatttgtattgggttgattgtttgtttgtttagcgtgtgtgtggttgctgtttagcggggacccccggcagtgcaactgaccgtgcgtacggcctccgcccgctccgtcatttccttcactcgtctaccccgagcggtggcccatcactgaccaaaactgagcccacgagtgcgtccgcttgctcattcttcttttatatgatgaaagcaattagtgaaatattttttggatgggttcatatggaagagagagatttatagtgacaaatagacactctcgcactgctactcttgtttcttttccgttctctgctatttgttcactatctatacagcccgctctgctacaattcattaattagtaagcaaaaacgaggtacccaattttgattggcaataggaagaaatttatcaattaaattaaatataaaatgggtcatttataatatgagcgaatgtcaaattgagtcccctccaatttggggctcaccgaaaagggccaatcccggtgttcagatcagcaccaaatttttcgctcagctcagatcattcctgcaaattttagtcgaaattttgccggtttattccaggggtgcaatcgaaaatttttcaaaatcagaacatcgggctcaaaaaatcagatttttgggtcaaaaatcagaacattttgcaaaattgcttcaaatcagttatttttataatttatttaatcaaaaatgtattaaaaattatatttttcgcctccgattatcatccttaaaaattttggtgaggaaattagcaaactgaa

SEQ ID NO: 6133 - DNA, 1397 bp, Heterodera glycines
  misc_feature (1288)..(1288): n is a, c, g, or t
atcaataaatgtttatttaaatattgttttatttaacctctttgattttagagtttttagaaatagattatggtatatttattcattttaattattttatgtattactgttcgggtggtcaaccccgagagatgaaagtttgcatttattttccctttgcatttgtctctttcttttcctcttattttccccactctctaattgttgtgtcttcctttattaatgtaagacactattgatttattttgtccaatgcatgtccattcccctcattcattcagttgctttttatgcacttatttctcttcgcctaaatttttgttctcctccaatttatttattccgcctccgacttcgcccatttttatttaaaattgtttaatttatttgttcatcaaataaacattttattgtgtcggcttgaagaccgaacaattggcgacgcccgtcttaaaaaagaagctcaacgtcggaatattttggcaatttcggacagattccgaattgctattcatcaattcttcaaaaaagcaatagacccaataagggtgagcttccgccaggcgcggtttattcatcataaaaaaaccaagatacccaggtggttgcggtttccgccaggtgcggtttactcaacaaagacaaggaaattcaccgaaaattgatcaacaaaaattgcgcaaaatccgacaatcgatcagctagtgaaaatgctggcggatcaacaaaaaatggtgcaggaccaatcacagcaaattgctcaattgattgcgatccgacaaaacgcaccaaatgcggcggcacagcccaatcaaggagcaaattcagtgccaatattgccggacatttcaccattcgagccaacggacgacaagagccgaatttcggaatggattgagcgattcaaattcgcgttggattgcacagcaccaacggcggacgacgaagtcaaggttaaatgcctgatgaataagctgagcgaatcggcattcagtgaatacagcagatcagttctgccgtcgtctgttacagatttcagttttaaagtgacgaccgaaaagcttgagaagctatttgccaaggctcagtccatattcatcgaccgctacgagtgtttaaaagcggtgagaggagaaggcgaacaattcaggcagttcataaatcggcacagaaaattgctgaccgattttaaattcgatgagctgacaaaagagcaatttaattgcctcatgttattgatggcactcaaagcgcccaacgaagctgcattgcgacagcgaattctgancaaattgtcagcagatggcgccaacatcagctatgatggagtggtggaagacttaatcagcttcaatccacaatttcagaagcaaaggcaatcgaagcgacaagttctt

SEQ ID NO: 6134 - DNA, 5048 bp, Heterodera glycines
atcagtttccaatccccatttcagaagcaaaggcaatcgaagcgacaagttcttggaggccagtgaattcgattcgacaaaattcaaagccaaacatttcaacgaacaaatacgtcaggaaagtccaaagccaaataatttgccgaacaaattcaaagaaaggaccaacactgaggcaactacaatatgttggcgatgtggcttcggcgtgcatcgacctgacgaatgccgttacaaaacgagcaaatgccgcaagtgtgagtttgtcggccatttggacaaacaatgcgagcgtgtccaagagtggcgcaaacgccaaaatgccaaaaagaaaggcaacagccgcgttggccaccttcgtattggaatgaccacgcatgccgtcaattccatttcgctgctaaaaacagcggttctgttcaacaagaagccagttgaattccatctcgacacggggtcggacattgtcgtcattgatcaattaacgcacgaatatgttggacgaccaccgatcgaaaaatgcaacgaaattggcaaggctttcgacggcacaaaaatttcctttattggaaaaggattcggtacattcaaatttggtaaaattgaagtggagcaaacattttttgttgccaaagcaggctcactaaatttgttgagctgcaaaatgatggacttatttgggcttttagacgaattaaagctgaagatcagcaatcctgcagtaaatgcatgccacgcgaatggcaaaaaggctgaaaatttaatcccgaatgaagcaacgcagattgctgggacagaagtcgaaattcaaggcctggaaaaggcatttcacgaaattttcagtgaggaattgggccattgcctaaaggagaaggctcatcttgccctaaaagatgacgcaaggccagtctatcgcaaagcccgaccagtaccctacaattcgttagaggtggttgagagcgaactgagccggttggaaaagatgaacgtcatcaacaaagtcgaacatttggagtgggccgcacctattttgattgttaaaaaggctgacggatccgcccgactttgcattgattactctacgggcctaaacgatgcccttctcgactgccaatacccacttccaataccggaagacatttttgcgacgctaaatggaggcaaaattttctcacaaattgatttgcgagacgcctatttccaagtcgaattggacgaaaattctaaaaatttgtgtgggctggcaacccacaagggcaattaccggatggaaagattaccgttcggtgtaaaatcagcccccgccatatttcaatcaattatggataaaatgttggcaggattggaatttgccaccgcctatttggacgacattataatcgtcagcaaaagcattccggaacacaccaatcacttaaaagaagtttttggtcgaattcaggcatacggattccgcgtcaaattggcgaaatgcaaatttttccgtgatcaaatcaaatatctcggacagattatcgataaaaacggacgccgaccggatccagcaaaaatctatgcaattagtcaaatgcctgcaccaaacgacattccatctctccgatcattccttggtatggtaaatcattaccaacaatacgtcaaaaacatgcggttcatccgaaaaccgctcgacgatttgcttaaaaaggaaattgattggagttggagtgaaggatgcgaaaatgcgtttcgaaaaattaaggaaattttggcatcagatttgctgctaacacattacgatccaaaaatggagatcattgttgcagctgacgcttccgaattgggcatcggagcggtcatttatcacaaatttcaggacggaaacatcaaagcaattgcccatgcttcaaaatcactcgcccctgcggaaaaaaattattcgcagattgaaaaagagggcttggcgttaatttttgcagtacaaaaattccataaaatgatttatggacggcatttcactctgcaaactgaccataaaccccttgtcagtatttttggcagcaaaaagggaattcggcagtgcagtgccaatcgtcttcttcgctggtccttaatccttttggcctacgattttacgatcgaatacatcaacacaaaggattttggcccagccgatgcgctctcgcgcctaatcgccaaaggaaatgagaccgaagacgagaaaatcatcgccatgatcaatgccgaaacggattttgaaacaaattttggccaaacaatttcaaaattgccattaaaattttcggacctagtcgctgcttctgagcgcgatgaaaatattattcaagtccaaaaatttgtcaaaaaatggctggccaaatgaaaaggccatggacaaagaaaatcaaattgtccgtgatttatgtcgaagaaaggaagaactttcaaccgaaaagggatgccttatgtatggagaaagagtggtaatcccgaaagtcttccactccaaaattctaaaattgctgcacaaaggacatcccggaatgaagaggatgaagcagctggcacgccaatatgtgttctggccaaaaatcgatcaggacattgaagattttgtccgtgaatgtgtgccatgtcaggctgctgcaaaagcgccaattaagacaaatttacagtcatggccaaaaacatcaggcccgtggcaacgcgtgcacctggattttgccggaccgtttttcgggaagcactttctgattgtggtcgactctttttcgaaataccccgaggtattcgaaatgtcaacaatttcaacggcaatgacaattgaaaagctaagatatttggcttcacggcacggaattccagaaacattggtttctgacaacggcacacaattcaagagcacggaattcgccaaatttacagcggccaatggaatcaaccatttattctcggctccatataatcccatgtccaatggacaagcggagagatttgttgacacgtttaaacgtgccttcagaaaattaaaaggggagggaatgtcatcagtgaaagaaataattgagacatttttggtcacatatcggaccacccccaatgattcgttgccggactcgaaaagtccagccgaaatgctcctgggacggaagccacgaacaactttggacctgctgaagccgcctccaattcagccgatcgaacgtgatcaggcaatggagaagaaattcaatcgccgatttggcacgcgtcctcaaattttcgcttcaaaggacgcagtttgggcccgacatcgcctttcacaaaattggaaagccggaacgatctgtgggtgttccggtgtcatttacaatgtccgatttgaagatggatccagcggtcgctatcatgcgaatcagctgaggttccgaaaggcgacccaaattgtcgaggacccattgaacattttgaatgaggaatttaatttgccagttcaaatggcaccaatggttaatggacaccaaaatgggcaggtcctagagaataggcctgacccgatcaatgctgaagatcaagtggaggaaccaccgatctgagaagagcagcaggacgtcattcaagctgtccgatcaccgacgccccaagctgttcgaccgccgacgccacaacgccgctaccctgatcgccgacggcaaccacctgtgcggtattcgccccgttagatcatttaaaaggggaggtgttcgggtggtcaaccccgagagatgaaagaacacatttgcattatttccctttgcatttgtatttttcttttcctctccattttccccactctctaattgttgtgtcttcctttattaatgtaagacactattgatttattttgtccaatgcatgtccattcccctcattcattcagttgctttttttgcacttatttcacttcgcctaaatatttgttctcctccattatttattcgcgcctccgacttcgcccatttttattttaaattgttttaatttatttgttctacaaataaacattttattgagtcggttcaaagaccgaacacaaaacaaggttgaattacggatcgggaaaaagccggagccgccggaatagggtgggaggaaaagcaatggcaccgttggtgaaataaaagagcacggcagaaattataaaattaatatttcaaaagtgatgcataatgagttgaaagtaatataaataaaataagttaatttattaataaaaaaaatagattattttaaacataaatattttgaataaatagtttgttattcatttccttttttcataaaaattattatcataataatatcaattaaagaaataattacaattattgttctttattgtaaataaaaaaaaataatttctattgttcatcaattaaaaaaatgtaaacaaaataataattgtttcaaaattatttatttattttttacattaatctgttaaatgtcggaatgaagagatgccagcgagaataagtacaaaaataaatagaaaattaatttgaaaattattgtcgattaggcaattatttaggcacccatttttcgaggttatgtaaagttctattaaataaaaaaatttaaaaaatattaatatattagtgatcgatgaaaagttttaaaaatcggctcccattttccattattacttaatcgtgagattcaatgtgccgttgatcagtttttaaggcattcattcaggcaaaaatattctcgatgatgaagaactaaattaaaagttcataaaaaaggtttgctaaaaactgccaaaagagtttgttttgaggttcaaaaaaccccaaaaatagttgctaaaaacgttcaaatttaggggtgtaaaatgataaaattaatccaaaaagcaagaaaattaaaccaaatcagtagtataacaatataatttttaaatttttgaatctgtcatttttccaaaaaaacttttgggaacaggaggtccgacggtgccgataggcgccgccgggaaaattttttgtaatttttaatgcgatttgttaacggattttgtccaaaaatgcccaatttttgcgatt

SEQ ID NO: 6135 - DNA, 1573 bp, Heterodera glycines
agcattgttttgtagctcttgtccaatattttgtgacatattggattgggtgtgaccgtgtttggcaactgcaaccaattccgcttgaagatgatccggaattgggtgcttatggacgagtggacgcatggattcgaaatcgaattcaaaacaatggattacaggggaggtctgcaagtttcccacaggaaatgtggaatatgagtgaaaggtgaaagtggaaatagaattttaagagacaaataacagcatcgaggggtggcatcgctctttcaatagccaattccgcttctttcatccgccattaagttattttgtcaaaaaaatgaaagaagaagacagacactggaatttgattgtgcaagatacaacaataacccacaaaatggaatgcgtggcaggggaatggcaaggaaaaacatttacgtacagcaggaccaagcaattcgcgccattttcttggatcgtcataacagaccttttttggcctatttacgtgcaatcgcttaacgaataccggaaccaaattgaatttgattgagatatttttaggaaataatcccggttccgtggtgactagaaaatatttttaaaaatttaaatttactgtcggattgtccacttctgtcggattgtccgggagccgttataggtagtgatcaaatttttttacatctccaagagaacttgggcctcctttaacaattgtacaacctagtaaaaacatagtaaaattacactcagtttttttattatatatacgttagaatgataaggcaactcatctcaaaaactaatttgagaagaacggctaagcgcgcggggctgaaattttgcaccaaggggtaactcgagacggggcatctgggaaaactataggttttttggtccgaggcccaactgagtaccagcggcttataaaccgactttgccgacagtctcactgttacgaaattttttgcttttgccttcagcgcttagtggaccccaaaagcgaaatgccccaactatggcctacaactttgccagcaaaagttttttgatcagaccaaaggcctggtctggaaaaatggcagatcgaggcctactcattttggacacttcagtaccagctgaatgccgcgccagggtttgctcggagcgggtagtcgccagcggactttttgtagagctttcaaagggctatcgaaccatgtttaaaaatttcgaaaattttcaaaaattttcgagctaggcctaaaaaacgattttttggtttttgaattttatgattttttaacgaattttcccagaaaaacggagaccactttcaagcaaccgtttttcgagctctatcgattggtatttttttcggaaaaatttcgatttttttccggaaatagaaaatttttttggcctgagcgggacatttgagtcccgggcccataactcgtcgggggttggttttagcgaaagattgccttagagcaaaattgtagagcttttgatgctctatcgaatggtgtaggaaaggtcgagaaaatttcaaaaattttcgagccaggccccctagaaattttcggaaatttttttt

SEQ ID NO: 6136 - DNA, 3810 bp, Heterodera glycines
  misc_feature (1714)..(1714): n is a, c, g, or t
  misc_feature (1737)..(1737): n is a, c, g, or t
agcaaaaacgcacacatgtactggccaataatcctaaattatttttgtaacttgtatttatgaaataattaaaagaaaaataaactggcaattctcggtcataaattgtctcccttcaagaagctctatggcgaactaaataggaaattgaattcataattttgcatttaaacttgatttaaagtaacagcaaaaaccttttcgaaagccgtccaattattctccaaaaattctcctgtcgccttcatggcctcttctatagccctgtccaccgctcttttctgccctgtccttcgatgacctctcctcaccaactaaatcaaactaatgcatatgcataaaaaagcataaccaatttttgaaataatttttgcctttcgacataatccaaaatcagaatacaattgatcaaagttctgatcaaacggtaatgataaagaatggggggtaccatagtctaatttattattttcgagtaaaaacgcgaatcttggggtttcggagatttttgactttgccaagtctgatttttcgtgtcaagtgtttgttcaacgaaaacaatacaaaatgctaaaagcaggcaatttggtctgtccgcaagagggcattgagatataacggaaaatatttacgaattgttttccattttttagaattaaaaatttcttaggcaaattctttttttgtttccctttttgcttaaaaaggcgacaaaaggattaatgcgtttcaatcttcaacagaaatgataaacctccttggccgttagacgggcatcctccatatcgtcggcatgcccagtgctttcgtccaaaagcttctcctccaccgccctaccggccatagtggccacaatacggcctttaattcctttactgagcagtcagcattcctcttcctggtgctatttgtgacaccgtcccgcccttctcgactactgatggttgaagagataaagagttcgggaatgtcccgattcttgatgataacaattgaatgtgccgcttcatggccggccaccaacgcctgggttgttcttccagtgataagcgattcttcaataccattatagaagttgcgccatctatttctctggcctttcgacgcccttgagttccttaccatgctttaaattcaaccgtaattggggttttaggtgatcaatttgcagtcgaaaaaagtcattttccttcaaaatccgagaaaaccaagacggtatcaatttattttcgtgatcagtgacctcgataatcccaatatgaatttttttttaattttgtgaggaggaggaggaggtagcaaaacacggaagtacctaatatccatcaaccatcaccctgcgcaaaaatgacaagctaattggtacgaaatcacaattattcagaattttagattggacataaattttgacaaaaaaaaacggatacaaacaaatacatgtaccaaaaaatgcaaatgatcagaggaaaatgacacaattgtataaaaacgtgccttatatacacacccaaagcaattggtatttgcattgtcaaaaacatttgttgcgatggaaacatgttttcatgatttttgaaaacaaaattattttttcaaaaaaatggctgaggaatttgtctataaaagggcgagaatttggcatttccaatcatttcaatcgttccctttattctaatttgctattcttctatccacttcttcgactacaacaacnccatttcaagtgcacaacagcgntggacgcatgacggattcattggtggagctcagcccgggagcgctcgtctccggccgttggactgtcatcaagaagcttggagctggcgcgttcggtgccgtctacttgtgccaagaccaagatgggattacaaagggagcactgaaaaccgagccaatcaacgcgccattcccacttctcgcgctggaggtagagtttgagtttgaggggggaacacagaaaatttggtgtaatttttgtttccctttatttcaggccatcgtgttgcgcagctttgacacacttcgagcgagcagtggaaagcatttttgccgttgcatggaccttggacgcgaccaacagctggatgctgcttctggacgtacgctggagttcaacttcattgtgtgagctttgacagggccggatgtgtggagtacataaatctttgtccccccattttcagcatgtccctggttggccgtccattcgacaagcttttgcaagaatccggcgactgcttcagccccggcactgccatcggcgccgcactccaactgctcaaagcactccaggccctgcacgaagttggctatcttcaccgtgacatcaaaccagcaaattttgccatcggactgccggagacgaacgagcagcggcttctctacctcctcgacttcggcatgtcgcgcaaatacctcaaagacgacgtgaggagtttcactgctgctttttgtttttgaatttttcaaaatctgtatcccccgcattttcagggcactatacgacgccagcgggcctcagcaaactttcgtggaacaccaatctacgcgccgatctccgcgcacatcaaacgcgactacagccgtggggatgacatcgaatcatggttctatgtgctcatcaaattctacaaaggcgccgtcccctggaagttcatcaaggacatcaacgaggtgagtttttgcagcgccaccaggatttaatgatgattaattaattttaatggtcccccatttttcagattggccagtacaaatgtcgccgcctgaaggacgagccggccaaagtgcgaaaagaggccctcgaggagctgaccggaggatgtccgcccgagttcaacaaaatcttagcgcacattgtgagttttctccgtctcattttttcctcttaatgctttgcatttttcaggatggtttggagccggaagaccgccccgactacgaaatgatcgagaagacactgcgcggctgcctcaagaagttggacgtccgggagcatccatacgactgggaggtcggacgacagaacgtgccactccaacaacggcaggcgagcagcgaccaggagaagaagaagaagggcggttcgtcgcacaagaagagcggttcgtcggataagaagagcgcttcatcgcacaagaagaagaagagcaactcagcggaggacaagaagaagagccaagcgccgcagaagaagaggaagagcaactcggaggaagaaaagaagaagaagagccaagcgccgcagaagaagaggaagagcaactcggaagagaggaagaagccgtccaagaagaagtgagcgcagcgggaacggcacggcaccattctgatcaccaattgctcaccattgtgcttatatatatatatatattttttttttttgtgagcggcggagcccatttgatccccaattgctcatcattgtacatattttgtgagtggccccatttgatccccaattgctcatcattgtacatattttgtgagtggccccatttgatcaccaattgctcatcattgtacatacatattccagtgatcaaaattgcctgtatgtacacataattatttgctcaccaatgttgtaatcatttccatgtgcaataaaactgatttgatgtgattacaaattgtgtcttagtttgattacatcaaaaattaaaatggaaaattaagcttttgagcaatactttgaatttgatggaatgtttttaacaaagtgccataagttaaaagcggtcaaaatttggcgcaaattgcgcatttttataggaaatagcaattgtagtccatccttttcctgctccc

SEQ ID NO: 6137 - DNA, 2221 bp, Heterodera glycines
tttaacattgtaatctccctaccggaaaatgcttttgctacttaaaaattgtaattacattaccgcgaaatgcattttcgtatttaacaattgtaatttccctaccggaaaatgcttttgatatttaacaattgtaatttccctaccggaaaatgcattttgtatttaacaattgtaatttccctaccggaaaatgcttttgacatttaacaattgtaatttccctaccggaaaatgcattttgtatttaacaattgtaatctccctaccggaaaatgcattttcgtatttaacaattgtaatttcattaccgcgaaatgcattttcgtatttaacaattgtaatttcactaccggaaaatgtttttgatatttaaaaattgtaatttcattaccgcgaaatgcattttcgtatttaacaattgtaatttcattaccggaaaatgcttttgatatttaacaattgtaatttccctaccggaaaatgcttttgatatttaaaaattgtaatttccctaccggaaaatgcttttgatatttaacaattgtaatttccctaccggaaaatgcttttgatatttaaaaattgtaatttcattaccgtaaaatgcttttgatatttaacaattgtaatttccctaccagaaaatgcattttgtatttaacaattgtaatttcccgtagtcctgcctcaggggtatacggtagggggaaatggatggcaccatcgtgttccccgtgcccgattacccactgtggacccatccctggcccgatcagtgcactgatcaggtctgggatgggaaattactgatcataaatttggtcaatttggccactttttcacaaactcactacaattgactaatgtgtaaaaagtcggcaaattgaccaaatttatgatcagtaaattttcattgtaatttcaaatctctagacatatgtggtactcagaacttatgagacacatttatgataataacattatataggacacactatcctattttcctaatactgccccgatatgctggaaatggatagtgtgtctccttaacattgaattagataaatgtgtcttgggcggcgcgaattcagtgttgaaaagtgaaaatttacgattttcgactttttgttcgaatccgggtccggggttcaaaattggtcgaaatgaatgtcatattcgtgatcagcggccccgaaaacccccggaaatgtattttcatgactttttttaaaaattttcaaaaaggcccacttttacagtagcgcctaatgttttatcgcggattatgtatggactggttgaccgatggagccccgagaccagcgtgaccgagacttctgcgcgattttacgggattcccgctcctggtcccgttatttgcccagcgggattccaggtcctgctcccgcaaaattttaaactcgcccgtaaattgttatttaccagggtctatagtagtatgcttaaatgtacattttgtggttgcctgtattcaatgtttgcacatttattaccaggtttattacacacattgaacaatgaatacgcaaacactgtacatacacacaaataacgaatatgaagcagcacattaatggatattatacatacatacatattttgatcacattaggaaggtcgctctgatcacatggaatatgtacaaaatatggggaacgaacttcacacaaacaacagcaagcagtaggggggactgatcggaagggagaggtcgtcgtgcaccgtcgtcgttctcatcgctggctattcgtccgcttgggtcgtctccgctgtgctctgttctccggcgttagcggctggctcggcagcgtccttcttcccgtgcttgtccttcttggaacggcggttgctgtcgtcgctcttcccctcctttgatttgtgtttgtccttgcgcttctcctccttcttgtccgccgcagctgcgccgtcgcctttcttgtccttcttctttgccttctcctccgcgtcgccgccggtcgtggcttcttccttcttgggcgcttctttgtcgtcttcgctcttcggtttctccatgtacgtcttcgcgaagcactgaaaatttgaaaatttgtttgagatgtaaattttggagcgaacaacaacaaaaaaaaacttaccattcccgccccgaaggctgcagcgccgaccttaaagggagaagtcattgtgttgttgttgggcgctactgaagtcg

SEQ ID NO: 6138 - DNA, 848 bp, Heterodera glycines
ttaacaattgtaatttccctaccagaaaatgcattttgtatttaacaattgtaatttccctaccggaaaatgcttttgatatttaacaattgtaatttccctaccagaaaatgcattttgtatttaacaattgtaatttccctacctgaaaatgcattttgtatttaacaattgtaatttcattaccggaaaatgcatttttgtatttaacaattgtaatttcattaccggaaaatgtttttgatatttaacaattgtaatttccctaccagaaaatgcattttgtatttaacaattgtaatttccctaccggaaaatgcttttgatatttaaaaattgtaatttccctaccggaaaatgcttttgatatttaaaaattgtaatttccctacctgaaaatgcattttgtatttaacaattgtaatttcattaccggaaaatgcattttgtatttaacaattgtaatttcattaccggaaaatgcatttttgtatttaacaattgtaatttcattaccggaaaatgtttctgatatttaacaattgtaatttccctaccagaaaatgcattttgtatttaacaattgtaatttccctaccggaaaatgcttttgatatttaaaaattgtaatttccctacctgaaaatgcattttgtatttaacaattgtaatttcattaccggaaaatgcatttttgtatttaacaattgtaatttcattaccggaaaatgtttctgatatttaacaattgtaatttccctaccagaaaaggcattttgtatttaacaattgtaatttccctacccttaaagggttttgatatttaaaaattgtaatttccctacctg

SEQ ID NO: 6139 - DNA, 4705 bp, Heterodera glycines
tttttttttttttaattttctcgggggggaaacgatgcgggggggaactgattcgggggggaaacggcgggggggaaacggctgggggggaaacggcggggggggggaaacggcggggggggaaacgagccgccccggtttagattagaattacggtaaatttagggattcaaattcaaaacttttgagcttggcatttcgttgttaaatcttaatctttaattatcttaatgaattggatcggctgatatattcgatgtaacaatacaaaattaaggctaagaaaaaagataaagatttacgcaacagaaacaaattcacacattttcactttctattaagcaccagctctgagtttttatttaatttcccacaattttgaaattaaacaacaatgtccgactctgaactgatggatacgctggaaggtggtctaaatcctgatgatgaattaaacgacacagttggtgatcccgactccatggaagaagatgaggagcaggaagagcgagagcaggatggggcggatgaagatccgatgctggagagcacttcaggacaaggtcgaaaatttagttaaatgcgaaaatagttttaacactttttaaattaaagcggacgatttgtctaagaagtcaagaaagttcgctggagggaaaaagaaaggtcgcaaagggaagcgaagcgcccgatcgggcgggtcgcgcgagcaacttcccgacgcgtacacgcattccagcacggaattgtgcacaatgttgagtatgacaaatgcggaatttgaatactctgaagacgacttcaaaaacatcacttccggaaagacggtcaatagtcgatttcaccagacacttcaggagttgaaccccaaggcaagctgggcacgtttgcaatgtgtgatgactgccaagtacaatgagtaccaggtgtacagcaacaaacttgaaagagatttcaattaattgttgcagaaaatgttggccgatcaaggaagacaaatgccgaaaaaggtgccatcgcgttcatccgccgttggcaacgccggcggcgcaactcccaaagaatcaatggcaagctcttcaccatcctttgtcaagcatcttccatctgggagttctgcaacaatagctgagaaagtggcgcctttgaaaattcggttgtccgcccgcaaaaaacgtcgtaacgatgactcggaagaagacagtgagaaaattaccgagaaaattttcaagattttacttttagtgaattctgatcaagagttcgagtctttgttgaaggagcacgaaagacaattggacgaacaagacaaagagaaggaggaaaagaagcaggcgagagtggcggccaagaaagccagagatacgacgaaacagcagcagaaagtgaagagacgcaaggaggaaggcggcgaggaagcggagggcgaattacaggtaattggcatggattagtagaggtgggactgcaaacatcgtacaaatgcaatttgatattaattttgcgtattcgtaaattactttttccaaataaggaaaatcaaaaatcccatacaatatgtcatttttcttcagcaagagcatcaagattactgcgaagtgtgccaacaaggcggtgaaattattctctgcgacacttgccctcgtgcttaccatttggtgtgctttgatcccgatttggaagagccgccggagggcttttggtcgtgtccccattgtgaacagaacggagtgccaaagaccgccgacggaggcgacgcaaacgctgcgccggggaacatggagaagtgcagagtgtgcaatgtgaggaaaatgaaaggccattgtatccatagattaaaatcttccctctcttaggagcatgatttcttgttgatatgttcacgttgtccaagttcataccacgcattttgtctatcaccaccactaacggaattgccaaatgaacacgaggattggacctgtcctcgttgtcaagtattgcctggggatggggaaattataatattgagtaggcatgggtcagaacttgaatggaaggggaggctagtcggaaagcacacaaaatttgagatcaaattttagaccaaagagccgaaaaatcggccggaaaaaattctgtcgtggcggtggatcgagtacaaatacccggaacaagtctctgaagaggacgcactcaaagaaggcgaacagcctgcaaacattgaggacgaagcgcgacgagttcgactgtttttgcaccctcaaaaagaaatgaagccacgcagagaacgcgaattttttatcaagtggaaatatatgagctattggcactgtgaatgggtgccagagcttgtgctcgagttgtactttacgcaaacactccgaatgtattggcgcaaaatggtgcaagaatattcgaacctaaaaaattaatttgttgtttttaggacccagaagttcccccggaagtcgatgatgggtccaacgaggacatgaagacgggcaaaattgacgacagagaaaaagtgatacgccatggacttattggaattgagacacaaccatttaaatttaggaggatgacccgcacaatttagaacagaaattctacagatacggcataaaacccgaatggatgcaggtgaaaggaatcatttgaatgtgaacaaattgaaaggaattttaaggtccaccgagttatcagccacgtttattatgagaagaatttatttgactatttggtgaaatggcgcgagttggtttatgaccaggccacttgggaacgcgatgactttgacattcccggcttggaggaagccattttcaaatattggatgcacaggtgccaattgcagtttatgcaacaaaaaacgatgtttagggagagaatgagcggcgaagcgatgccaaaatacattttgaagaaactgaacaaaaaacgggccgagcagggatttgtcacattcgaagaagatgagaaaaaaaggaaaaagcgtgagggcaaagcaaccattgacgtaatgatttggaagccgggaaacagccatcgcattaccaattcagataaaaaagaagtacgatgttcaacccgactttgtcagtgagacgggcggaacattgcacccctaccaattggagggcatcaattggctacggcactgttgggccaacggaatcgacgcgattttggcggacgaaatgggactgggcaaaacaattcaggtgccgaagggtagcggaaagacagcaattaaaatgccatatttagtcacttgagttcatttattcattggtcaaagaggggcattcgaaaggcccttttctaattgcggcgcctctttcgacgctgatcaattgggagagagaggctgagttttgggcacccgacctttacgttgtcacttatattggggacaaggaaagtcgatcggtcgtacggtgagtattcccttttcttaaaatgattgttttcatgtttcactttcagtgagcacgaattttctttcatcgaaggcgccactcgcggagggccaaaggcaagtcggttgcgcaccgaccagggcatcaaattccacgtgatgcttacttcgtatgaggtgccaatgtttgcttacggtgtttttctgttttgcaacaacagttaatcctttcagttggttagcattgacaaggccattctttccagcattgactgggctgtcctggtggtcgacgaagcgcatcgtctcaaaaacaatcagtcgctgttcttccgcacgttgcgcgagttcaacatcggctaccgtctgttattgacggggactccactccaaaacaacttggaggagctgttccatttgctcaattttttgagccccgaccgcttttagtaatatcataaatatactcatttggattaatgcttaaattgtcgaaaatttgtgtatttaagtgacttggaagacttcaccagagaatttgcagaaatttcgaaggaggaccaaatccaacgtttgcacacacttctcggcccacatatgttacgtcgattaaaatccgatgttttggttggcatgccgtcaaagagtgagctcattgttcgtgtggagctgagtccaatgcaaaagtttaacactttttgggatttttattaattatcttttaaggaaatattatcgacacattttgaccaaaaatttcgaagctttgagtgtgaaaaatggccgttcacaaatgtcactcttgaacataatcatggaactgaaaaagtgtgccaaccatccctttctgttcgccaaggcgagcatggaagcgcaaaaacgtccaaatggtgcttatgatggcgaatcactgatcaaaagtgccggcaaatttgttttgctccaaaaaatgttaaaacgactgaaagagcaggaccatcgtgtcctcattttctcgcaaatgaccaaaatggtattcccttatacaaattaattatagtaagaacttaattttagttggacattctcgaggatttgttggactttcttggttacaaatttgaacggatcgacggttccattaccggccaaagtcgacaagatgcaatcgaccgattcaatggtcagaattttttcattaccagcatctaacattggaatttagcgcctggtgcccaacaatttgtctttctgttgtctacaagggccggtggacttggaattaatttggctaccgcagacaccgttatcatttatgactctgat

SEQ ID NO: 6140 - DNA, 2295 bp, Heterodera glycines
  misc_feature (37)..(37): n is a, c, g, or t
  misc_feature (135)..(135): n is a, c, g, or t
  misc_feature (159)..(159): n is a, c, g, or t
atgatttatcgtttcgttactcggaattctgtgaggnagcgtattacatcagtggcaaagaaaaaaatgatggtaatcagtgcggggcatttttcaatggaattagattatatattcattcaatgtcagctcacncatcttgtgttcgcgctggcatgnggcagaagggcccttccatgtccaagacggagttggacgatgtcctccgttggggcactgaagaattgttcaaggaggaagaagcgaacgagctgggcaaatcaagcgaacacaacatcgtgtgggatgatcgggccgttgacgcactgctggagaggggggcagaggaagaaggggacacggaagccaacgaacgcaaagactgggccaacgagtacctgagttcgttcaaggttagtaagacaaattttttttgtgactatcacttttaggttgcaacttataccaccaccaaagaggaggaacaagaggaggaggaggacatggaagtgttgaaggaggaagtgcaggagacggacccggactattgggaaaagctattacggcaccatttcgaacaagaacaggaggtagagcggatgaatttgggcaagggcaagcgtgtgcgcaaacaagtgaactatgccacggaggcattgcaacaggactggcatgccgggactccgggacaggtttagaattgatttattcagctaccagacaaatttaaccgaacctaataaactttgtaggaccaagactattccgattcctattctggtgcctcagaccatgatggttctggcagcaacgaagacgagtttgactctgcgcgtgaggaacggcgccgtaagcgagagagagacagcgagaaactgccgccactgttggcacgagttaacggacagctggaagttgttcaacattcaatgaacacatttcttgattccgccttgcttaaggtgctcggtttcaacccgcggcaaagacgcgcctttttcaacgccgtaatgcgctggggaatgccaccccacgacgcgtaccaatgccaatggcttgtccgtgacttgaagggcaaatccgagcgggcttttaaggcgtacacttcgttgttcatgcgtcatctgtgcgaaccgggagcggattcacaagtaaaacggatgtaacaatctgataatgctttacatgaaggaatgcttcaacgacggagtcccccgcgaaggcatcaatcgagtgcaagtgttgacacgaattggcataatgtcattgatccggaagaaagtgcaggaatttgaagcaatcaacggagaatggtcaatgccggaggtaaatcattctttttaactaaacaaaattggcaggatcagttgtaattgtatagctgtatttaattttcttgaggttcaaatgcgaatgttggccgccgccgaagcggcgcatgtggcgaaagagcgtgagaaggaagaacgacttcatcagaagaaggaaagagaacacacggaacgcgaccaaactccgacagtccaaaacacagaagttgaggagaaagtatgcttgggtgggattgaccaatgtaaagccaattgaatcggtcattttgtgtggacaatgccaaattcgaagtggtcgttatgaagcatttttcacaggaccaaaagactggtggcaatcaagaagtggaaatgattgacgcagcaacagaattaaccgggtcagaaacggatcgaccctcatcgaaagtaggggaagagaaggacaaagaggagacgtcggaagagaagcaacaactcgaggaaacggcggaggagcctctccatcagcaacaacagccgcacagagagccaaggccattattcaaattcaacattgccgacggagggttcactgagctgcactcactttgggtcaacgaagaacgagttgctgtgcctggcaatgaatacgaaatttggcaccgtcggcacgattattggctgatgtgcggcatcgtaacgtaagcggatttatttgttcaaattgcgccttgttgttagctattttattgaattccttattttatatgcagtcatggctacagtcgttacaatgaaattcaaaatgatcctcgcttcgcaattgtcaacgaacctttcaaatcagaacagggaaagggcaactttatggagatcaaaaataaattcatccaacgtcgatacaaggtaaaagggcaaaaatattcataaattcattgcctaaattgtaagagcccttttaatttattattttagctattggaacaagcactgataatcgaagaacaattgcgtcgggcggcct

SEQ ID NO: 6141 - DNA, 3373 bp, Heterodera glycines
aatttttcgaaaatttaccactcaattcggaaaatttacggttcatcatctttagccattttacgtccatcatcttcacgattttttttcgcgtgtgttttatccacagagaagctcaaaaaatcgcattttctcaccactcttcttcatctcaattaaagggttttaattcaaataaaaaaataatttcggacttaggcaggtaaaaaatatttcgtacttatcgtgatttttagaaatattttcgtcttttttaaaatttaatttttacaaaaaggacttcaatatcgtttttttttcttcgcccaaaattttttcaagggaacggaattttaggtgctaaaaattcgcgaataggtactaaatagttgctaaaaactctcgctctaaagaataaatttaaaaatttagataatcaatacgtttcacagacgtggttaaataatcgcagccgatccacgtgaagcagggaacttttctcacggatcgacgtaggcgtaagtttaaaattaaaaattataatacgatcagctcaatttaacttttataataaatttttataattttctttttttcaaaaacttaagcaaattttcggcacttttctcgtcggtcgcccaaattttgcactttttttcgtcggttgacatagcaccttttcttgcaatcatgggactcaattcattagcataacaatcatcggaattcaatctcaccgattcttctgcatctcaatcgccaagaatcaacccaccagaattccaatcactggattcaattatccggcattccaatcattgggactcaatccaccatcattccaatcgcctccaatcgaccagcattccaatcactggcactaaacccaccagcattccaatcactgggactcaattctctggcattccaatcactgggactcaattctccggcattccaatcacttggactcaatccacaagcattcaaatcactggaactcaacctcagcaaatttcttcagcattttaacttttttgtgtgcctttgggtgttgaatcgatgggaggcacggccgcttcgcggcttcgcacctttttcttgcaatcatgggactcaattcattagcattacaatcatcggaactcaatctcaccgattcttttacatgcatctcaatcgccgggactcaacccaccagaattccattcactggattcaattatccgcatttcaatcattggaactcaatcctctatcattccaatcgccaggatccaatcgaccagcattccaatcactgggactcaattctccggtattctaatcactgggactcaacccacatgcatttcaatcactgggactcaatccaccagcattcaaatatattataatgaacttctgattttacacacaaaataaaaaatttcctggcatactaacataaccatcggacaaaattctctttaatttcttataaataaggtttaaaaaaatctgcagaaatattttacgtgagaacaaacattttctccgtgaaaaacttatattccgcctaatttccgatagaatgacttttattaatatttttttaggtattttcgcataaaaatagcacatattttggcgattttaaacataaaacattttatggcaaaaataattaaaaatagggaaaaatttgaattacgcgcttggtacttggaagcaagaaatgcatttttaaaattcgatatgtttggataactgaaacttgaagattaataaaataaaaatatccttgatttattaaagataggtaccaaaagctaaggacgcttattttttgaatatataataatattattttaaaaattgttcatatagtgcgaagtaaactaattatttatttagttttaatacctttcataatgtactaatttgttagaataaatttgaatttttgacaaattgcaaaaataacaataaactaactttaaggttggacaacacgacgcaccgaaatatgaaaccgttccaaaacttatggaagattttgtgcgcgatgttaaccaccatctgcatagaatggatgcgcctgaattggctgcgagagctcatttcgagctggtaataaatttaattaattaaaatttataattattgaaatttggagaaatgaaaaaagaagaaattatttttttattaaattaaatgaataatggcctaaaaggcagaaattccctactttctccttgaccgcaaccgtcagtgaatcaaaatttttagatcaacgatatactgtagaaataataattttaatgagaataaatccgcaataacaaaaagtgttcgtttttaaaattttcaaaattctattaatgttttcgaatattgaaaacaaaatatcaaattctgaactcattttttattaaagaaaattattttcgaaatataacattactgatgcattttctactggccaatttaattactattttcaacagttttatttgctttttccacataggtaaatttattttttaaactaattagaatccaaaaatcatttttggtgcaaaatttcttacaatttcatgaaaacccaaactttcccagtggagtgcccgtcggcaccgctagattacttactgcttattttgttttatttgcacaaaatatcctgaaattggcttcttgttataaattctgttagcacattgcttttaaccaaaaaaaaagttttacaaaatctaaaatggctttttttggctatttttcatgttttttattttttaaaatttttttggtgatatttatggcttttttaattttttatttacttatttgacgtttgtatatttcgtgactttaacccctctcgtagatatttttatttcctaatttaatttaggcctatatacatccgtatatggatggaaatgggcgcgtttgcaggctagtggcaaactggattttgtcaaagggccgattccgaatgttcgagcttccggagattgcccgagacgaatataacgcaggccttgatttggccgtacgtggaagacgtgaagggcacgcgacgggccttgatgcgaacatcaatcgaagtggcgagcatgattggccccgaccctttatactattaatatattttcacgtgcagaatgcacagcaagaaaatgttacatttgattagttgcattaaatttaatttgttattcttattcactgcttattaaaaattattgaacacgaagcaattttaagagattcgaataataattagagaccggattttgaagtaaatgcctttttaaaaaaatatttacactcaaagatgttgagaaactaaaaaatgatttcactattgtgcggtgaattcttgagttctcagtacccgtccttcaac

SEQ ID NO: 6142 - DNA, 2784 bp, Heterodera glycines
gcgataaaaatataaaaaattgctaaaaatatcgaatttatttttgcacgattttatttcttgaattaggtgatgtgctgtgggcaccccgaatgcgactgaaccaaaaaagcaacggaggacacaagaaaatgtttgaaagaaaaaacagagaaaatgaaagaaagatatatggattatggttgatgattagggttgtaaattatatggattaacatattttttctgcgcatatgctatgaagaaaggggcttaaaaatagcatttctgcgttaaaattttttgatttggtgaaggtttttagtccatataaatccatattttggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttcttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgtgcttttttagtccatatttaatgtccatatttcgcgttttttagtccatataatttacaaccctattgatgatcaagacaaattcagctaaatttggataattattaattttttttttgcgattttaagtatccaaaaatcccaccctaattattattattattgtttttatctttattaattagtaaaaaaaattccaaaaaacaaaataaatttacatcgcttttgacaaatatctaaaacatgtatgctaccaaattatgccaagtaactttcatttaaaaaataattaaaatttacatagttacagcctgggaaagttttgacaaacgacaacttttggcagcatacttaaggattttaaaaataatatattaaaaagagtgaagtctataaaaacaaaaattttctaaatatgcaaaacgcaaaattagcttagcgaattttaattatgtttggtatgtaaagtttttaattaattatatcactcaattaaccatttttaggaaaaatgccaaaactgtgacaaaaagaaaatagggacgaatagggctcctatttttagtttttacctagttttttctctgagctccttatggcctgaaatgcacgtatacaggaattattttaaaatttatgttttaataaaactattaaattgattttgacaactattaattaaaggtggatcagctttggaacggtgtggtcaaataatgaacatccatgaaagtaccacaagaatgaaaattgatgaacaaaacgatttaatttgctaaaaacttccaaaataataagtttaggtctaaaaaaccccaaaaatagttgctaaaaaatgccaaaataataagtttaggtctaaaaaaccccaaaaatagttgctaaaaaatgccaaatctgtattgagataaataatttttaaaatcaaatattaacaaagtacataaataaatttggttatgaattttgagaaatttatcatttcttgagggtgtattttttgaaaaattttttgtgtcactttcttagggaggatatttttgataataagatttgggtaaaacgccaaaatagtttttttcaattttttttagtttttaagtgctaaaaataaaaaattagaaaatagttgctaataactcgaaaagtagcttaacaacaacaacaaccgaaaaaacatgtttttcgtgcattttagaccacagggagttcacgaaaaaaatgaaaaaactataaatcgtatccctactaattacatttttagagcaaacacacgaatgccgtgctcaatgattatgccgggatggtgataagtgcgtgtgcgcaaagcaatttggtcggtttttctggtctttggaagcggaaatattttctgcgctacttccattgaaattttgttggagactgagcgggtaggggttagtgatgttcgagaccgataatttcccgagactcgagaccgagaccgagacttgaccccgagaccgagactcgaccccgagaccctagaccgataccgaaaaccccgagaccgagacccaaaaacccgagactcgagacttttttcaaaaaattttcctattcgcttaaaatttgtttaaaaattttttttgactctattcttaactaatgtttgtttttttttattttgattcaatttggtaaaatatttatcattccagaaacaccccaaacaaaaaataaaattttttattcacttaaaaatcaataaaataattttttcaaatagaaaaattatgaatcaaaattaaagtgcaaaaaaaccccgagaccgagacccaaaaaacccgagactcgagacttttttcaaaaaattttcctattcgcttaaaaatcgtttaaaaattttttttgactctattcttaactaatgtttgtttttttattttgattcaatttggtaaaatatttatcattccagaaacaccccaaacaaaaaat

SEQ ID NO: 6143 - DNA, 4093 bp, Heterodera glycines
accgtgcgctgagcccgttgtgtacaactccctccactcgctcctcctgccttcgacgaatcgtttatcgatgcgcagcacaaccccccccccccccgcgcatgtcattaattgatatttgtctgcactaaataaattaatttaatttgttttgcttattttaatttgttttttcatatttaaattgttttttccgtttttattttaccaatttctgatttaaatttcctggtgacacaaacataagctcaccctccccaaccattatcaatattttaatcggcggcgcggcgtaagtctgttagcattgtcaaccattcatacaaatgacctccctccccctggtcgcatttttcgcgacgttcggtatctcccacctcaaatttattatttttaatttgtttcaaactttctatttttcattcacatttattaactctgcaatttaaattaaattttattttacaaattcaaaatttcccactatttttaatttccattttctaatgtatttaatttttattttccatttaattttaattggttttcaatccgttccaatttatttattatttttaatttatttccaatttaattactaatttattttattttcaatttaatttcaattttaatttttttcattccattccaatttatttattatttttaatttatttccaatttaattcctgttttattttatttttattttcaatttaatttcatttttaatttttttcattccattccaatttatttattatttttaatttatttcaattttaattcctagtttatttttattttcaatttaatttcatttttaatttttttcattccattccaatttatttattatttttaatttatttcaattttaattcctagtttatttttattttcaatttaatttaatttttaattttttcattccattccaatttatttattatttttaatttatttccaatttaattcctgttttattttatttttattttcaatttaatttcatttttaattttttcattccattccaatttatttattatttttaatttatttccaattttaattcctagtttattttatttttattttccatttaatttcatttttaatttttttcattccattccaatctatttattattattaatttatttccaatttttaatttccattttctatatttatttatttctacaattcaattaaaatttaatttccaatttaaatttaaaaattttttaaaatttctccttatttacaatttctaatttccattttctctatttatttatttccacaattacattaaaattaatttctttaaaaatttttaaaaattaatcgaccatttttaatttattacgcaacaataatacaatacagctcacgaattgtttattttaatcatgttatcataaattttcttatatttccttttgaatgccccacaacccttcacccatcgaggtaggggaagtggggcattgtccgtcgccatttggccactgtcgcgtaacattttcttcaactgttcaacctccagtcccacatctgccgattccgaattcccttttttgcacacatcctcccgaccttcagtcccgtcctccaccatctcccccggggcagagcccatctcttttttcgcttcctctgttgtttccgccccatcagtttcttccccgacctctgcttttccttcattcgtgccctcagtcccggcatttatcgggagctgttgctgcaattcttcctccgctcccttcttttcgtcctctttcttttcctccttttgctccttttctcccgcggccgtagccattcccgagacttttctcttccgctgtcccgtctttttcatcttttcctctttcttccgctctctgtactctttgccttctcgatatcgctgccaataatcatttatggcctcttcacagttctgaatggggggtgggggatgaagaaaaaggatttagaaaatcagataccaaatccccgacaggtatccaatcgttggggtccttgggaaacccaacccactttaccaggtagtgttggtggccgttgacgcgcttttggccacatattctttcgacctcgaattcgtggtcagaagaatacgcagccgaaaccgcgtcttctaccatctccactacctggtcgtgcgggttgggacccaattccggcacttcgtcgacatcgggaccaaaggggacggtgtctgttggcaaagagttggctggagaaagagactcgtcgtcaggatagacgggcagttcgaaagattgttcaagttccattttttgataatgggaagggtagagagagctacttaaataggagcaactcataggagttttttgtccgatcacaaacattattcgtctctcagggcacctagcgcaacgttctcatatgaaaagagcaacagttttttgctctccgtcgctcgtttttgtccgaaacacccccaggcgcttgtacactgctcatgttttttgaacacagaagtttttgtcacatacccacgacaaaatgtacaaaggcagagattgtcgtgggtagaggaaccagtcacacccgttttttgcacatcgcccgcgggccgacgtcgcgcaaaatgcacattattttttgcttgtcatttattttggcatttaattgtcttttaacgaatcttttcaaaatatttttcaatttcctttttttttgctttcttccctttaaagtcccaaacccatgagcttgaggatccgattcgtggcttaagttgtcgtcaccctcgggaggggtaggccgggtgtatggcgttacctgccaacaccaggcagcggcttaggagggattgggaggcttacgttgcttcccacccgcagatagataggccgggtgtatggctttaactgccaacaccgggcaggggctgagggattggtggcttaagttgccaccactgtggattgataggccgggtgcatggctttagttgccaacatccggcaggggatggggatggattggtggctattttgtgtggcttatgttgccggcacgggagggggattgacgctggtataatgttagtcgatgcactatgtggaccaatattattcgtgagcatttattatattttaatgtgttcccaaaattctgtgaaaaaacatttaccaacttattccaaccctcccctcctcttccccattgttccaactcaacgaaaaatttatttatcagcgattaatgtcaaataccatccccaatcatagttaatcttaacactttcaatcccatgcaaacatcattcaccaaagccctcctccagaacttccaaccactgtcttcccgaccccagcaacaaactgaaaatgaaaaaaagtcattctgtcgatttgaaccaagaaattttctggcctcaaaaaacgagccgtcattgtgccgacgctcaaagtggccttccttgtagccatcccatgtgcgctctaaccgcaaatcccttaagcggcgctcctcaccggctcgcttttcctcctccaatatttgcgcccaatactccgggttttcacgctgtagtctcttcctttggatcagattttcctccttctctcgccaatcgttggcaacgagcggttcgttccatgctggaaaccgcgtccaccccgtgcctgttcgccggacaaactgctgttgctgctgctgttgttgttgttggtgttgttgctgttgatgctgctgctgttgctgctgctgttgcacatgccactcgtccgtccacggcgcatagagcacaacaccatccctccgttcctctccgatccattcacctgccgagttgctgacgggaagagttacgtccattttgctcgaatgatgatcacaacaactttcaaccgctttaaataaccgcacaaacgacacgtcaaaaccaaaaaatactaccaaggacaagtttttacacaaatctactgctcatttgactaataaccttctcatttcggtttttgattgacatctcctgcaaattattccttttttcgtcacttttctccccacaaatgcacaaccacaagttttttgc

SEQ ID NO: 6144 - DNA, 975 bp, Heterodera glycines
gattgataggccgggtgcatggctttagttgccaacatccggcaggggatggggatggattggtggctatttgtgtggcttatgttgccggcacgggaggggggattgacgctggtataatgttagtcgatgcactatgtggaccaatattattcgtgagcatttattatattttaatgtgttcccaaaattctgtgaaaaaacatttaccaacttattccaaccctcccctcctcttccccattgttccaactcaacgaaaaatttatttatcagcgattaatgtcaaataccatccccaatcatagttaatcttaacactttcaatcccatgccaacatcattcaccaaagccctcctccagaacttccaaccactgtcttcccgaccccagcaacaaactgaaaatgaaaaaaagtcattctgtcgatttgaaccaagaaattttctggcctcaaaaaacgagccgtcattgtgccgacgctcgaagtggccttccttgtagccatcccatgtgtgctccaaccgcaaatcccttaagcggcgctcctcaccggctcgcttttcctcctccaatattcgcgcccaatacaccgggttttcacgctgtagtcgcttcctttggatcagattttcctccttctctcgccaatcgttggcaacgagcggttcgttccatgctggaaaccgcgtccaccccgtgcctgttcgccggacaagctgttgttgctgctgctgcacctcgttttgctgttgttgttgttggtgttgttgatgttgttgttgctgcacatgccacacgtccgtccacggcgcgtagagcacaacactgccatccccccgttcctcaccgatccattcaccaactgagttgctgacgggaagagttacgtccatttgctcgaatgacgatcacaataactttctaccgtcttaaatagccccacaaacggcaaaccgaaaccaaaatgctca

SEQ ID NO: 6145 - DNA, 3036 bp, Heterodera glycines
  misc_feature (40)..(40): n is a, c, g, or t
  misc_feature (66)..(66): n is a, c, g, or t
  misc_feature (124)..(124): n is a, c, g, or t
  misc_feature (166)..(166): n is a, c, g, or t
ttggccaagacaacaattggatggggagaccaattgaccnccgctcacccccacattaatgagaanacagaatgcatttgttaataaatttttgttgattgatcgtttatgtaaagggtgaganaattccctgattcctaaaaatttaagtgacagaattaagttntaggaaaatgttaaacgacacagaaattaatcagaaagaaaataacgaaaaaataattggattggctttgattttagtcatttatttgttttcgtttttgtgtttctgtgccgttatcgttagagaatgccaccgtgtcttttttagctaacaatgccgctgccccctgagctattgtttgaaatagttgaagcccttccctcctcaaaattgtctacagtcttcttgagcaatcgtctcttgtcgtcgtgggctcaaaaacgtctcagagggactttcaattcgctgatgtcacagaaacaagaatggaaaaatctgttaaaaatatctcgtttggtttttgaaagtcacaacggattaaatgtgcaataattggtttttagtttttagtggttttatatccgttttattgttaattcttaatgcgtttttaattagtttttcagcacaaatgtcagaatttctcattttccttttgggtttctcctttgcaatgcttctcatgttgtgtttgctggtttcgctggtgctctttgttctttgtgcagcatggtattattggacaaaagaagaagaaccagaagaatttgatgattttccagaatacccaccgccttattaatgaaataaattttttgttgaaatgtgtcatgaaaaaacttggtttaagccatgtacattttttctgctttaaaatttccatttgaaatatctaagcttttaactctaataatgttcaactcatccttttttgctgatgtcaaagaactagggcgtattccaacaccaaagggaaaatttagtgagaagaaaaatgaaactcaatttatgaaaatatttaggtatattttatgcacttgagttcgctaagctttatcaaacggttggacgtgaaatttctcgtgataaattccgacatatcatgaaaacagggaaaaaacaacatgaattagcattggttttgatggaaaaggctgggataaatacacaggagaaaacttttgggcttaaacacctcgaatttgtgcaaaacttttgggacaaagaattcccagatatatttcgtatcgttgcgtttgatatggtaaacgaacatttcctaaacttcgtgtgattgttttatttagaaaaccggacttagaccgattttcaaagggaagggagtaagaaaaaacgaagtttgtgtgataagagtgggcgaacattgggatggtttaaaatctgttactcaatttttcgccgtcaaaaatttttgtgtaagctgtgaggtgacattttggaccaaagaccgtcaccgaatggaatgtagggagcgctgcaaaaagtgttgccggatggtggttcgggttcccctgtttggatgtttgtgaggcgatacactgtggagaatgcaatcggaatttctacaacaatgattgtttcgagtctcacaaaaagacagcttgtagggagtacaagaaatgcaacaaatgtggggaaacatatcaaacacgatcaaaacacacgtgcggggagaaattctgtagaatttgcaaagtctatcatccgggtcggcaatgtttcattaaaaaaatcaaactccgacagcagaaagcataccgtattgtggcttatgacctcgagacgacggttgaagggggcgaacacaaaccaaatcttgttagtgccgcgcatacttgtagtgtttgtgtgggagaagagagggaatgcgaaatttgtaatggtccgcggatgatcacttggtctgtagcagatgggtttgaaccgatgagcgaatttgttgattggattttgggatttaaacgatttgaaacggttgcttttgctcattatggtggaaggttcgactcgcattttgtgttaaaagagctgactgaaagaggggtcgaaaccgagttgatgatggcagacctgaagatttatcaaatgaaagcgcgtggtgtgtattttcgggatttctggctgctcagccaaaacaagttggcagatcttccaaagactttgggttttaaaaccttagcaaagttgtacttccctcataagtacaacaaaaatgtgaactttggaaaaaaattgacacacctaccaccccttgaagattattgtccggacaatatgaaggaggaggaatgtgctaaattggtaaaatggcacaatgaaaattatagaatggaatttgagctaggttagagaaaatctgttttccttttaaaattgaattttaggagagcagctcaaggtttattgcgaaaatgacgtcgaaattttgatggaggcaattttgaaattccggcaattgtttttggagattactgatgggatggatgtgttgaaggacagtgtaacaattgcgggggttgtgatgagaatttttcgaacaaaatttttgagagaaaatcatctcccaattattccggaaggcggttatgagagagccgagaatcagagcaaaattgccgtgaagtattttgaatggttggctcaaagcaaaagagtgagacttagacacgcatgcaatgggggtgaagtggaaatcgggggattaaaagtggattgtatcattggagctgagaaaaaaataattgaatttcaggtaggcagaatttccttccctattttattttttgctaaagggatgtgcgtttcatggatgtccaaaatgttttttgccctggaccataggacccaatgggcgttgtatggaagtaaatttccgacgaactgagacacgaatggagtttttgagggaaaaatgtaaaaacttctcggtggaggaagtttgggtgtgccaatttcaaattttattgattgttgaacaaatttacgggtggggggtgaaagagaactgaaaaaaaatagggcgatgaaga

SEQ ID NO: 6146 - DNA, 1346 bp, Heterodera glycines
taattaaattttattttattatgactcctaacctattttgataatttattttattttttatatattaatttgtgtgcaagtatttcctttaattttaaaattttttccaatattccatcaatttttgccattgacagtgaacaaaagacatatcattttttgttatcccttctggcttagtttattgaattaaactgaaattctcgattaatccaattagattttgttttggattttcactgaatgaaaaaacctcataagggtcttttatacatggaaccaaattttcaaccataatgaagcaaaccccgaatatagttaataaagttaactcaaacggataggtttcaaaaaaattctttgaaattttttgggccggcaattaacgggcctaattaaattttattttattatgactcctaattattttgataatttattttattttttatatattaatttgtgtgcaagtatttcctttaattttaaaattttttccaatattccatcaatttttgccattgacagtgaacaaaagacatatcattttttgttatcccttctggcttagtttattgaattaaactgaaattctcgattaatccaattggattttgttttggattttcactgaatgaaaaaacctcataagggtcttttatacatggaaccaaattttcaaccataatgaaacaaaacccgaatatagttaataaggttaactcaaacggataggtttcaaaaaaattctttgaaattttttgggccggcaattaacgggcctaattaaattttattttattatgactcctaattattttgataatttattttattttttatatattaatttgtgtgcaagtatttcctttaattttaaaattttttccaatattccatcaatttttgccattgacagtgaacaaaagacatatcattttttgttatcccttctggcttagtttattgaattaaactgaaattctcgattaatccaattggattttgttttggattttcactgaatgaaaaaacctcataagggtcttttatacatggaaccaaattttcaaccataatgaagcaaaacccgaatatagttaataaggttaactcaaacggataggtttcaaaaaaattctttgaaattttttgggccggcaattaacgggcctaattaaattttattttattatgactcctaattattttgataatttattttattttttatatattaatttgtgtgcaagtatttcctttaattttaaaattttatccgaatattccatcaattttttgcccattgacagtgaacaaaagacatatcatttttttgtatccct

SEQ ID NO: 6147 - DNA, 2766 bp, Heterodera glycines
cctccaccaccaactctaacatttcatactcgaaaattcaaccaggaccgtactccacagcggggtttaaccccaaaattgccttgtctgttctgtaacgatccttcccatttttcttcgaaatgtttcgaatttcccgactcaaaaagccgttcggaacgtcttaaaattctgaaaaggtgcttcaagtgccttaaagagggccatttctccactcagtgtcctcacccgtcaacgtgctcattatgcaagggacctcaccctagagctctgtgttcctctcagccagtgcattcgaattcaactatgtatactcattcctcctattcgtatcagaacccaactcaaattgtccaaagccaacacccggattccgatcattgtcaaacgaatttaccatttcatcagcccgccctactcactaaccctaacccacgttttgcccaaccatacactgtcagtgcaacccccgttttacatcaatcgaattcggaagcagcccaaaatttttctcaatctgaacccactgatcaatccaatgaattaaatccttcttttcaaactaacacttccctaggtcttaataactcattaggtgatcaaccaattctccttaaatgtactcgtgtgacattttttaaccccgacaatcctactatggcaaaacaaggaattttgatgatggacgatgccagtactaacacctatatctcctccgttgaggccatttctcttaaattgtcaatgacacctactcttcttcgtttaggtgtttttaattcacccgaaactaaactcacccagtcattcattactaaatttggactccgccttttaaatggaaaatccttaattgtctccgctcataccgttaagaccctaacccaacccactcattttgtacctttctctaccgatgttttgacctgtcccgaaattttaagagactgtgaaactgttcttcctgttattcttttggggagtgattgttattacgaaattgagcctgtcataacccaacgcttaccctccggctatcacttagtacaaacactacttggacccattgttgccgggaagggacgtaaaattttaacaaattcaaccgatttttcttaccaaattactaacttttcctcacaatctgaagtcacttcgcccattgactacttttcattagaaaacatcggtgtcgatgatctaactaattacccttctgacgacgaaattcttgaaaaatttaaatctgagattgattttgtggacaatcgttaccaagtcatgtttccatttctttgtcctccacatacattatctattccctcaaattttggtctctgttatggacgattacggtcagtacttaatactgtctccaaaaaacacccctttctcgaaaaatacaacgaaatattttccgagcagttaaaactcggcattatagagaaggtggataaccctagtaaattttctcaccctttacattatttaccccatcatgccgtcattaatgagcagaaaggaaaattacggattgtttacgacgggtccgctaaaatcggacccggactcgctctaaataattgtctccaccctggccccgtcattttgccacaattaattggactgttaattcgatttcgatttccacaaatcgcaattattgctgacatagaaaaggcgttcctccaaatttccattcaccctcagcaccgtgattgtacacgatttttatggcttaaggactcaagccaacccctttcccaacaaaatatacaaattttccgattcggtagagtaccatttggactatcatgttccccgtttctgttagctgctacaattcagcatcatttatccctatccccttcgccactttctaacgaaatactgaataacatttatgtcgataatattttactcaatgcctccacctcctcagaaggccaatccaaatgttctgacgccatttctctttttcaatgcgcttccctaaatcttagagaatttaccagcaattcacccgagactctcgctcatctttcccatgatcaaaagttgaccggtccaaatcaaaaatttttaggcattaaatgggtcactgacactgattccttaatttattgcctttctccacccccgcccaattttttattaacaaagcgctctgttttggcctttgtttcctcgttttatgacccaacaggactcatttcacctgttttactttcacacaaattattcctccagtctttgtggcatgaaaaaataggatgggatgacattttaccaaaaaattgtgaagaaagttggtcaaaattgtttacccattggagcccaaattcagaaatttcgattccccgtttcatatctttcttgaatgttaaagacaacaaacactatcaattgcactgtttttctgatgcctctaacaatgccatgtctgttactgtattcatgcgcatcagccattgttcacaagaaaatgccaagtcacaccttatatttagtaaaaccaaaataaaaccattacccaaacgttctcccgcacttctcaccataccaagattggaattaattgctgctttactgggtacccgagcccttaaatttgtcttttcccagctaagtgaatttgacttagacccaatccttaatttgtgggttgattcatctgctgtaattgggtggctccattcgccccctgagcgtgacatttttgtcaaaaatcgcatatcccccattcattccacaaaaaattgattg

SEQ ID NO: 6148 - DNA, 3441 bp, Heterodera glycines
tactaaattccaattggcatttgaggaccccttcagcggcctggaagtgtgggcattatgaaagacttatttctctgattaagtaccatctcagaagaactctatcagctggtacaattccccgttcattaaaatttgaggaactttcgacccttttatttgaaattgaaagcattataaacagtcgcccaatttgtttcgattctgctaaccctgctgactctcgccccctcagacctattgactttatacgccctcttaacaaatattcagaacaattcccactaaatatgcaaaattccgatcccgaaatagctaattcctcgaccattcaatcgatgtcaaatttgtggaattccctttctcaaatttctaaaaaatttatgtcatcctgggctagtgaatatttactttcgcttagagagcgtcataaaaaattatcttcctcaaatccacgatggccccatataggtgaacccgttcttgtttataatgaggtgttacctcgctctgtttggtccctcgccactgttcaaaaggttaattttaccccttcaaattttcctgacactgcgcaaattaaatttttatcgggacatatttccacacgctctgttcaccaccttttcccgttagaagcctccgaattttgctcaaattctgcggaaaataatagcggaaatgaccgttctcacattcccgatcatacaatcattcccacgattgttgatcacaaggcaaatacccgtgagaaaataaaattcaattgggccaatcatccgcctacccgagaaaatctttcacacgcattgcgcccagtaaactcggatcacaaaaggatgtgggctcgaattccgcccacaaaggaaaatctcgatattttaaatgatttcaatctgtaaacatttttaaactatgccctccgatcgggcagtgagaaattatttgtaattttgttaagcattcatcccatatttaagcatcaaatcaccctattgttaatcattctcaacctttgccttcaattaaaaaccaatgggaaacatctttgctctcgagttagcctaccaccaacacccacctgaacaaccctcacacccattttgggtttatcttgctattttgttcgttggcctaattgcttgcgcctttttggtgattgccttcctcttgtttcggaaatttgcatcccgtttcttgttcaatagaaccccgaacacccagccacttgaacccgaacgtgcccattccccctcagctatccctaccgtttacgtagtttttgtattcgcatttatcatttccctgcccattattagtgcccaacccaaagggggctcattaaaaggaatcgttaaacccgtggctaaagggtccttgcccattcttggaacgtccgctctttatttcgggattgatgccctatttggtaaagccgaaagcgaagccagcctccaccccgtccttacattattcgctttgcttggcttaattgtcactatcttgcttcttctgttcattaaattttttgtcgtccttcgcaatcgttttcgcgcccctccctcaccaaacaattcggaagcattgaatgccctgccccctggttcaattgaacttgaagaaatccgaaccgttttgaacgacttggttagtcgtgccgacccccctcgtactttccgttctaacccccctcacgcgtaaacacagaatttagatgaaaaagagaaagggtgctaaattacaattgtccgctttgaatagtattcgttcttatttaaatattgaccaaattcccgaaattaactcctcttcacattccacaaccccaggtgattcagaaaacgaaatggaagcctccctgagtctctcatccacaccccttaatcccataatcgtttcctcgttgcctcctgacactcttggccttaccactaattctggcactccgaattccccgccaatttgcaccgaaccaacccctgtcaccgacatttccccatcaaattgtgaccacctcccttgctctgataattgcccaccaccttgcactaatcttgccaaacacaccgaacattctccacaaattgacaccgacatcaacgacgcctcgagtatgccaaaatgtccagcctctccgactttcgtcgtgttggtcgatgactcggcacacccctctgtcaatattggaccacccgaacaaatggcgaacacacccactcctgtcagtccaccggttgtttcactttctaacccaattcaggtcattaccggggtggtaggacataccaaggggaaacaaattcacacttttaaacccaagtgtcaaatcacacaatcacacccttctcgcacgcccactgttcactctaaactcggacacgcatcattggccacacacatgcacaatcacacttcccaaacaccggcacgcggacaaccgatgatggtcaaccgaacgcgaatcatggactcaggacgaatcgaacagctgtcttccgttaaagaatggaaggaatttgccaaactcggaaagcccgtgccgttgaaccaaattcgtttcacaacccccccttgtcccattcctccttttttggccgtctcatccaacagcccaaatggtgccaccaataccctgcccgggagtgtcgcgaactgcgaacaatttccctaatttggtctgtgtccgtgtcccccttgctcccaccccattgccacaatacttggtcactctccctacacattttcccatgcaccacaatcattgaatcggccgatcctcgagatttcccacggcgataaaattttctcatttttcccgtttcacatatccgccggatggactcccccttgtcgatcactttttttccttcacttcgaaaaaaccacacaacaattggaaaaatgtgctccccctgcctttgattggtcccctcttaccaagcgtcagaaataaagtgaaaaagcattcgattggcaatttggttggacttaattattccgattcgttaatttgggcaattaaaatttacgaatcgcgacacaacggccgggaaacttccctttccactgaaactgttctaatttccatatccgattcaaatgtctgcacccttccgcgcgtccctagcgctcgcttacgccgatgcccaaaatttgcttactaaccaaacccaatttcctgttcccgcccgtccccagggccaatccgatttcgcttacaaccaaactttggaatcaatcctgcttgatctccgcgatgttgaaaccgatgtccacgagtccatctcacaattgtccactaaccacgaccgctggatggccttacgaactaacatgaccggagctgaacgcactctggacaaccctgcctacgacgattttgttgctaatactccctatcataactgcttacaagaattgcgccaattcgccaaagccctt

SEQ ID NO: 6149 - DNA, 1237 bp, Heterodera glycines
tgctcattttaaatcggaaaattaggatttattaaggcttattttatttatttaattaatttgtttttcaacaaaaaacaaaatctattaatgccctaattaaataaagttcataaaaagccaataaaaatatttatttttggcagattttataaagccatcaatttggacttaagattggtttaaagaaaattttggaatggtcaaaatttaaaaaataacaaccacataaaagaaaagtgacattgcattaatttaataaaatcgggcattccccataatttttttgtcaaaattttaccattcatttccctttccacagtgatgaccatcaaatcggagcagttgcacggcaacttttcgtcgccaacctcaacccatcatcaccagcagaggcggggcgggggcgtacaggcgtcgatggccgagcagcggacaccgacgacgacaatgggcgaggacggcgccagggacaggggcggcacggacaacgccagtggaaacggcacgtcccgctcgcggctgatgttcgacccgctcagcgaattggtaataatgaatggacagagtaaatctctggtaatattttgttgcatatattagcaatgccatacttggcaccacattaaaaaaagaggtggcattttacaatgtatgcgatttagctaaagccgagacggactcggagagcgaatgtattttctccggagccttttttgcttttttccctctataaaatgggggttttaaaagaaatggggacataaataacaattaaagctgatttcaatagtgcatttgttaagtggttggttttatccaaaaatgaaaggctttattaaagagaggggagagtcccttaaggctcaatcgtggccatacattaacaaggggtgcgccggcaccccccccccccgcgtcgtaaggggggcggctgtaaaggaggggagggggtcgtaacgaagggggaaaaagttaaaatttgaacaatttccgtagcgaaacccatagaaaattcaaaaaaattttcccggcggcgcctatcggcaccgccggaccgccccaccccttcccacgaagttttttggaaaaaacgcgccgcaaaaaggtggtttgaatggcttgaatagcaaaaaaaaaaaaaagtcaccggggaaaaataggggccgacgtaagaaaaattggtcctggcgcacccccccccccccccctgcgccaaacgtccgacgtatggggg

SEQ ID NO: 6150 - DNA, 882 bp, Heterodera glycines
atttttaaaataaatttttttatcataattgggaaaatttttcgactgtaggggtattttttttcgttttttttttttttttgctttttaaacatttttccgaaaattctgaaatatgcactaaaaatggcgagtgttatgaaaaaaaactagggttcctccccgagcctcggggagcaaaatgtcggggaacggggaggaaattccccgaaagaatttgtcggggatggctggagaaatttaaaaaatatcggggagcaacaccttcgtcggggaggaaattttcataaaaagtaaaaaaaggaaaagtccagaacaaaaaagtcttaaaaactcatttaaagattcttccatcttatttcaagtgcaatttacgactttcgtaattccccgaaacatgtcgggcagggacgtatccaggatttgggcttgggggggtaccgatccgaaaagtcaattcttaggggtgtattttttaaaatttttcgcccgattcttaggggtgtatttttgaaaattcttcgcccgattcttaggggtgtatttttgaaaattcttcgcccgattcttaggggtgtatttttgaaaaactttcgcccgaacgaccttttttttttttgctcataccagcgacgctgggaaaataggggtgtatttgaaacgataaatttttggaattgaaaagaaaggaaatgaagaaattgaagacagagaaaatgtttctttgtaatttggcgttggaatttaaaattaatatgttgctttcgttatgataatttggcgttaatttaaatttggcattcctttttctctctggggcgctggttggtcttgttggggggggggggggggggtaccgcgggggtcttggggggggggggg

SEQ ID NO: 6151 - DNA, 3474 bp, Heterodera glycines
aagttcctaaatttttaaaggattttattccaaaaacgtgtatcgattttcatgaaaaatttttctaacttaaaaaatttttccaaaaaaaatcttaataaatttttgttgaaattttcaaaaatttttatggtgacaatgatttatattgtttccaaaattacaacaaaaaaaaatcagtgaaaatttaacaaaattttttttgagatttcttttttaaatttttcggggggtggggaggaaaagataagggataggagagggggaacgtattaaaatttacatttaaatttttttagatttttgaaaattttctgattttttttaatttcgggaaggaaatgatacggtaggttctttataaatgacataacatcacacactttgttgaagtaataggcggcctggaacggcgtcagattgtacgtgctgatgccaacaattggcctgtccgacggattctccgctgcaaaaaacgcaacaattataattaggagtgggtaattaacgctaattgggcccgacccaaaatcaacacccggatcttcaacaaaaaagatttgacaaaatcattaattttcgaaatcacatgacaaatctgaagggcagatttggaaataatacacctccaatttacatagtctagtttggagataaaaagtacttcagtaaatcttttgttttaaattttccatgcgttttacgggcttttttaccaaaacacaaccttggtctaaaattcggtaaaaagttttaaaaaataaatttccgcaaaaaaatgcacgtaatcaaacaaaaaatagatgactcattaggctttagaaatggcaccaatctgtggtggggtgggctttttcaaagccaaacagccaaaaaaatgtgcgaattcaaaagttatgccaattattataaaaacaaattgccacaaatattaagggggcaataattttttttttttttttttgctgtttttcgtctctgatttttttacccgtgaaaaatgccaaagccgtctcgccggggttcacataaatttcgttctgcaccggcttgaatttccactgcatggatgagttgacgtcctggagtaaaataggaaaaaagggaaaatcatttttaaataaaaaaatgatcggaccgcattgaatcggacccgaatcagccgctccgggactgtgttcatttgctcaatgtgctccaatgctttggcaacctcaattggaaaattctattttttattgttgtgaaacgttagccatatggaaaatggtttttaaatgaatatatagaggatggtaaaaactttttgtacatttttgcaaaaacctagattttcgaaaaaaaattttttttttgttccaacggcaaaaaaatatttgcatttcgctctccgagaatttttcaggttccgaaagcttagaatttttctgtctcaacagcagccacaaaaaaaatcaacaaaatttcgctactttccaagggggggggggtaggggtagtcacaaaaaaaaattaaaaaattttttggtttttaataaattagcaagtcccttttatctgaattttatgggtttttccaattgtttattgaaaaaaacgccaacatttgtcgtcccgccaaagccggtcgactcgcagaacatccggtacaggggcaaagcagcgaacgtaacaccgaccataatgaacacccaactgaaccgatggaggagggtaaaattaaaaaaaaaaaattttttttcagtcaaaaaatttggcaaaaatcttagggaatagggaagtgaaaaactaaagtttaacattttgtttagaaagcctaggcctggctgggcctgtgtttcttttttctaccaagatcatccaaggttggaaaaaacatacaaaataagtttcaaaaacttaaagtcgtggagcgggctcgaacctccatcccttttccatttcatggaaacatatttttttttgtcgatgagtccaaaatgaaaaaaaagttcatcgaaatttacgctctatacatatcttttcctttgagcaatttcatggcttgcacactcgatccgatggaaaaaaaaaatgaaaaatcgcaaatttctgatgataaaattaaaatttaaaaaattttgttttcacaccccaatccgcgacacgcctcgtcagcgcgtcgctgtctgtcggtcatgaagtgcagcgacgggggcgaccggcgccggttgaaaagcgtgtaaaatgacagggttcggttggcgaacaaaatgggaccctgcaaatgaggaggggggggggggttggtagacgaatacggaatttcagagtttttagggaccttgggaggggtgtccaatggaaaaaattttttagagccaatccgtaaatattttatgcattttcttgaaaattccacaaccctaaagggtaagttcaagtccatctggcgcaaaaaaccattaaaaatacgatttaaaaagtgtaaagccaaaacaatcaagcgaccgtaccctgtgcctgttcaaaatggtgcccaaacagcggcatactgtagtgactggcgccgcgctcgcaatttttgtagctaacataacaaacaacattttttgtttttgtgtgctatgaaaaaagaaaataattttttttatttaaattttaaatacagcgtaaaatgaaacgccaaactccccaaaaacaaaatacattccacaaaaaaagcggaacaccatttatgaacgcatgaaatggttaatgcacaaacaaacgaaagaccagagagattgaagagaaaaatgggaattgagtttgagggatgtcaatgaaaaatgggcccagatgcgcaagagcagaaaaaagcatacgctttagccaaaataaaaatgccaaaaaatatgaaaataaaagatcgaaaagaaattctcatctttaggactacttcggcactacgcaatgtgccggaaggataacatttttcgaaggctaggccgatcggaatcaaaaatctgtttttctgccttaaaagaaattctagtagaaaaactggtattcatttatatctttcgtaaaaatgccaatttttgccaaagcataatttttcttttttgcccgagcagtgccatgagaaacaataattggtggaaacaaacaaataagtagagcagaaagagcacaataataccaaatgaaaaataaaaaattcaagtgaattggatgtaaacagacggcagttttggcacacattcatttcgaactattcggacaacaaaataaatgaaaagcacgcaaaatttgatgaaaattggaagggatgggtttatttggtcggcacggaatggaatttgtgagaaaaatgaaaagaaatggaaaggcgctaaaagcagggctcccaagttttttttcaaaaaaaaaaggacaaacgatgctaaaactaagattttgaccccaaaaataagattttttgaaaaaatgactttaccttataaaaacagt

SEQ ID NO: 6152 - DNA, 5411 bp, Heterodera glycines
cgatcccccaactcaaagaagacgaggcttcaaaaatcggctcgtacccggtgtccacaagcatttgctttagcccactattctggccaaacttggctctcagggcgattatcatcacctccacccttagctggttccagtggctttgattgtatggaattggatcaggttcccgcagcgcccattgatgcacttctcgatcggtggcactcttcatggtaatcggtggcaattctccccgtagtatttgtcgagccaggtttggcattcggaattccaacgcctttctccatgtgtaaaattgctccgagcacctaaacacgttgttgtccactctgaactccacggagaagaagttgctgaacgcgtacacatggcgaaagaagaagtagccacctctcccctcaatttcaacccatttagggtatgggggtttgtcccatacgtcatccgccacacttttaacagccgtgagaggctgatattgaccaggggtcctttcaacccgtttgggcatcattggcctttcaccccaaaatgcctttggcacttgaatcggtaaaggctgctgttgttgtggttgttgttgttggaatgtgccttgatgaaattttttccgattcgcgtcccattctctttgccatttgtccggacgaacgcgctttgctggtttttccttcctcttaattatttccatgcccatctgcatcatgaggagaatcatgtccgaagtcggctctctttcgtcaatgatgtgccaatggtgaagcattcggagatgatttggtgacaattcggtctgcggtatggatgagatccaaaacaacaatctgtcgctgtacaattgttgagccgttgccaaagtttgcataaaccccaaatcgtccaacgtcactcccttcctccagacaataattgactgtacaccttcaatgtgtaattcctctgtaaagaggtgcgcgtcccactcttcgggaaaatggcaaaattgtcgtgcgtccgcattgatgagacaattgcggagcgcaccaccgtcctcttccccttgccccaatatcaaaattggggccttgatgaccttcaacgacggttcgtcgtcatggtaaatgttgtcctccagatgtgcagttggtgttgttgttgagctgggttgttcggtcggttgcccttcatcaatttcgtaccactcttcctccatgctggccaaactaactgtgtcctccattgttaatgctgaaatttcattaatgggattagggtcagactcgagggtctctatttccagtgggtataataaaatcgttgctctttccattatttttccgtcgggcatttttaatttggcagttcggttattgattataccttctattttacctaatttccatttattccggggacacggtttttggtcattgattagtaccacttgtcctatttttggaaacctttgttcatccacatttttggctttttcctgttcccttaatgccaataaatagtcatccctaaagacttcccagaatttggtactcttatacattgttttcttgtgaacttcgaggagttcatcccgttttgtttggttaatttgagcatctaaatcgtctgtatcctctgtttcattagtgtcacgctgatactcaaatggttccccttctgatgcattgagaatatgcattgggcacaagggctccataatttcatcattctcaatgtatgtaattggcctttcattgactatcctttctatttggataagataagtcaataattcttcataatccaataactttttacctaaccctcggtataaatggtgtttgactagaccgattagtcgctcaaaaaatcccgagcgccaaggcgctaatggagaggcaaattgccatgtgatacccttattagctgtacgctcttgtacctctctttcgttcatgatcattgaccatttctccttttcttctaattccctttgtctggtctgaatttgcccccaaaccttattttttctccaatgtgcctcagtaattttagccaatatcttatgagaaagaacaaattggcaagcattgtcagaaattatcatttttggcactcttctacgcctcatgaatctctctaaagccaataagaattaattctttttatagtttcactccttgccttgagcaatttacgttcctgaattggctcaattcgttgtacaaattggagaggtcccttgtaaattcgccaaatatacgccactgtatttctaatcctcttccactttgagaagtggttcacataaactgtcagaaaggaacccaatttcctttggtttctttcccttgccggattcgtcaattcacaaacagtgacctcttgattttgatctgcccatacatttggatcaaattccctgattgtttgtggccactgtgtattttttagacttataaacggcggtcctttccaccataattcattgtaaatcttccggacttgtgccacgagaggcaacgtctgccggatttgattgaccctcaatatgtttgacattccattgtctcattttctctacccgatttttaatgtatctttctaatttcctgttgctattcagaaaatctaatacatccgtggaatccgtccacaactgtacagtctcaattttcagtgatttttctatttgacctttgacataatttaaccatttcgaagtcaaaagcattgcgtgtaattccaaaatcggaatggtccgatactttgatggaattattgctggaaccacaaggctcttaccaaatatgagattggcatttatttgatttggattaatgactctcaaatatattgccgttcccatggccttatgtgatgcgtctgagaacgcatgcaattcacactgacaatttttaatcatttctttcggaatgatattccttggtactgttattgactgattttcccagtctttcatcagtgttatccattcatttagctcttcattagacaacgaggtgtcccatttgagctttttattcgtttctaccctttgccgaaataattttgctggcaaaattgctggggccgcaaatccgttcggatcaaaaggtttagcaatttgtgccaagaccttccttcttgtcaacttctcagacttaaacacgggaaaatgtatgaccagagtgtcattgttgatgtcccattttattcctaacaatttaactcctccttttaccacttggtcttcacttggtaatctctctatttccttggtacagttggacacaaattctctcacattcatatccgcattagaaaaaatctatttgagaagagaataatatgacttaatttcttcagccctttctaaaccaagtattatgttgtccacataaatgtctctctctatttctctcacttagatgagccggtgaacagatgactccaaaagttactctagtaaaccgatactccacgaggggagaatcgtctcggtatgggtctctaacccacaagaatcgcatcgcattcctatccttaggatgtaccaaaatctggtgaaatgccttggctatgtcacatgtcaacagaattggtttaattcgacttcgaattaaaataacttgttccattatgatttcatggatttgtcgaagcaaatccggtgtttttctcagtctgcccaaatttgacaataactgtcttaatgccatatcataatttgttggcaattgagcagccaattcttcattccataacaattctgtttgatacctatcgccattgaatgatattttatcaatcattctttgtctcacgttttgcttttctgaattgagatcagacataccgacatgttctagaccattccagtccataatcagtttatcgaaatcatttggactcagttggtcactattcagttcccattctactgaacctttggaataccctgaatgattgcactggctttgccttcaatgcatgagtctaaataactgaacttatcaatttttgggacatgagagtcctcatgaattattgtacgaaagtaatcccaaaatggtatccactgagatggactaccatcaaatctcttaagctcagtttttggcaaatttttacgcattggcacgctccttgagaggggtacaatgccggaggtagtgtcaccatccgtgttgtgagttatgtctaacctctcttctaatgcctcaattttgtccctcaaaattggaatgagaacgtcagctgccctttgtttctcattaatttgtaactcctgcattaattcctgcatttccgtttctttacggattgcattgtctcgactcagtttgccaatatactcattagccaaacccaaattatcttcaatctttttgtaccaccctttctaagtcattcagaaagtttctgaattgtacagccttcttttgcattgattcggtagggcatttattcccaggtcaggtggaatttcggtacccaataatgctcccaatttgctggcacaccccctaattaatgcctggatgggggctgtcattgctcaaatcaatgaccaaattcgaaagttcggagatgagactccaatttaataatcaataaccgaactgtgaccgaacaatttaaaaatttggaactgaaactccaatttaatcaataaccaaactgcgtactgagttgagaatcagaaattcaaaaaaccagaaaggggggaggggggagggtaaacgattcaagatttgtaagacctttttaccacgcactgtcagagctaagactctgattttaccaagtgcggatggtttggacaatttgggttacaaacaaaaaacaaaaaataaaaaagatttagaccctcggaaatgagattccgaaaatttggactaaatgggattggacaaaaaaaaagtgaattggaaatgaaatgccgataattttttgacaaatttaaattgggcaatttaaatgtttgacttttcgaagatgagacttcgaaattttcagtccgaaatgaacttgattgccttttttagaggcggtaggaacagaaattaaagaactgattaattctggatgagaccagattaatcagacctccccttgggaaaaaaaaattgaacccgcctgtgcacaacaggtcgccagttgtccggggcacgtcttagtaaatggggatggcctgcgcgctgagacgtgcaccaagacagtgcactcaattggttctcgattcgtcaattgtccgatgcgtccaatgtccaattcggtgcgtcaaatgtccaaatgttcagtgcgtccaatgtccaaattgttcactgcgtccaatgtccaatttgttcagctcgtccaatttccaatttgttagtgcttccaatttccaatttgttcaacgcgtccaatttccaattgtccaa

SEQ ID NO: 6153 - DNA, 2073 bp, Heterodera glycines
  misc_feature (2015)..(2015): n is a, c, g, or t
  misc_feature (2039)..(2039): n is a, c, g, or t
ttttttgaaaaatgggaatcaagcaaatttcattaaaatggaacccattttttggtttttcagtagttttaggcacatattgggggattttttttttaaattttttttcaaaaagtaagctttttttgcattaaaattcttgtaaaaaatgttcaaaaaaagtacaaaaaattttgttttttttctttttgcattttttgaattgacctttttatgacttttcatttttaaggcaaaatttaaattttatcaatgaaacagaaaaataaataaatcttgaagcgagaaaaatatttacgtcacaaagaattgaaatgtttttgattagaattgtactagcgaaattgataaaaaatgtgatttttgagaaagtaacttattttttgacagttttttttcaatttttggcacatatgttggccttttttgagctttttagcacatattttggagcttttttggcacatataaatccgttccctggcaattacaacaaaaaatagaacaaaaaaaacaaccttcaaacattaatgcataatacttttaactcttacataagcaacaaattggaaaatgaatgaaatgccgaataatatataaatttttaagaaatttaaatttatcaaaacctaacaatgaatggccctgaaagcttaaattcccagtcaatccgtgacaccttcactttttctcttgaattcagatttatatctttctaaagatctttttgtaatatttaaaatttccgcaatttggcgatcgttgagctttgggttttggtttttcaattgataatattgttttattttttccgttttttccgcaaatgtataatgcttctgccctgtaatatattaaataataaaaatttttaaatttaattaataaataacaatttgtttaaaaatttcaccctttgaaagaatttgatttaagccaattttcttgtcccatttttcaattgttctataataaattccaaacatttgtttaatttttgcattaaattctttccattccttcagcgaatgtttctcattttgcataaatttaatttttgttttaaaatatttttcaacaatttctcttttttcatcatcagttttttgctttttcaccatttttccaacttttaattgtttcttccaataaaaaattgttttgatatgtatgcccaaatgttttgctattattttttggcattttgtcctttttccttccaatttttcattaaatttcgtttttaatttgccatatatttgatcaaattgctttaacattattcttttttcttcaactgaataatttttgttcttcatcattccaaattctcttttccatttgtaaattttctcttgactgacgcccaatttttttgcaatttttctttcaattttcacccattcttttcttgaatatttctttcccatttgcttaactttctccttaatattatgaaatttttccacagtttctcttttctttttatcaattgcatttgaaaaattgtcacaactttgtccattatttgttggcattggcaattggtcgcccaattcatcataatctgtggacatttcttcactctcctcttctttcactttcacattttcatcaaaaatctgatcaaattgtcgaacattttgtccaaattggttattctgatcagcaatttctccatgaattatttgatcattttgacagatgttttcttctgctccgtcgtcccatctttggccaaatatttcagcaaaacttttttcttggattattttgccagcctcaatttggttaattgcttttttgaatattaatgcgcataataataaaaatattaataatattttcatttttttgtaaaaatataatgaattatttttataaaaatatttttcgcaatgaattttgtaattattaattttatagcatggcttaatttttcttcaatcaatattaaccacatttaatcattatttcattaatttgataacattttataataaattcattattanattttccttttatcagcgaattgngtagtaattaatatgagataactataattatgga

SEQ ID NO: 6154 - DNA, 2024 bp, Heterodera glycines
  misc_feature (1895)..(1895): n is a, c, g, or t
  misc_feature (1908)..(1908): n is a, c, g, or t
  misc_feature (1938)..(1938): n is a, c, g, or t
  misc_feature (1963)..(1963): n is a, c, g, or t
gcaaaccaatcaaaattggatttttaaattactgccagtcgccgattctttaattagtgtgtttactgtatcaaaaaataccaccatatatactgtatatacaacaaatgcaattttggttttgtgagcaatattatggttacgttttctttggccgtccatctctcatttgctaagttcccttctcttctcccccttttctttttcaatttgaccattccatcggaaagtgagcagtttctctttcgctgtcatattcacacaattcaactgaaatatgaaagggctttttaaatatttatgtgtttcatacagctcttaaaaatggttcggcgccgctccctttttgttgcgcggcaaatccgatccgtcggcaacctttccgaaggccaatctgtcgggaaaagacagtcgatttaaaatgctaaaaagtaacatagtcacaaaattccccgtagccagggaccaaaaaagaaaaaaaagttaaattgaaaattaaaatgttacgatggctaattcggctataattgccgtcccaatgcctttgcgtcgatattccggctttaccagcaaacggtccacaaacaaaaactcaaaaaacaacagatgatggattcaaacaatcgttagtgttgcatttgtacccgtccagtccaactcgaataagtcttccgatggaaaagggccgtgcccaacacttcgccatcgtcgcagtgacgcgcgacgacggcgccgagggaagcggcggagaaaagtcgcaaaagtttctcttggggaatttgaccacctaagaaaggggggaaggagtagagacaaaaacactgaaaatgagtgatttattcaaacgaatgattaaaaataaaacctaccaaatgttgacgagcaggcatcagtccaagtgttcgccttttcgtcgtccgtaatttcaccgtccatcaaaacagtcaaattaaacggccgattctcataccctaaaacgggaaaataaatttaaaaaatgtcaatacgaaaggtatacgattatgcgataagggggggggggtgccagaaacttctgtcttttcgaatcgcccaaccctttttagtttttagctaattgtaagccaatgcctccgtgtgccgtgcgtgtccctcttcactcactgtgtttggcatatgctatcactttccacatttcaattcgttccattcgccaccactgcgatcgctgctcgccaaccgcgccgattcttttggaaaaagtaatcgcagcagcgaagcgcggaaggacattccaaacaattcgggagcaatgattggccttggacacctaaagaaaaaggtccgtttgatggcaaaaaggacaaccaaagaaatggagttcaccttggccaactcggaagcaattcgccgtccgacgcctttccgacggaattggggccgaatgaaaagttcctccaggaaaagcgactgaaattgcttttcttttttgcccgttttctgtgcctttcactcgccttcccttcggcgagtgatgtgttcaaatagaacagtgcgtggccaaccaattcgttgtgcgaagtgaacgcaattagtgcggacacagcgccgccggcgatgtcctcgcccaattggtcggggtcaatccgtggcccttttgtccgctggggaagcgcagaatcggccaattcctagcggaaaagagaattgcaattagttcagttgtaattggcatttacaaaatggctacccactcttatcaatgcgcagatcacttcggcatcgttcggcaccgccattcgaatgccaaactcagccatggtcaacagctggcaaagggaagtgccgaattttgacaaaagcaaaaaaggaacagaaaaaataattaagaaagcggaaagcaatggacgaagaanattgaaagtttanaagaaacattaataaaccaaggaaatttanattttaattggaatttttttacaangaaaacatagttgataagaaatttaagtatgctgagaaaggatatgtaagaagctgctgaa

SEQ ID NO: 6155 - DNA, 1539 bp, Heterodera glycines
  misc_feature (68)..(68): n is a, c, g, or t
acatagtttgataagaaatttaagttatggctgagaaaggcattaggaagaaggtgctgaattgaggnatgaggaaacaattcttgagaattcagaaaaaagaaaatcaaaacacagaaaaggagaaaatagaaaattaaaaaattacagaaaaagaatatacaaaattaaaaattgcagaaaaagaatatacaaaattaaaaaatgcgcgtcataattcaccgcgccacattttgcccaaaatgccattgccttcgacaaaaaaggcccaagcgaaaatgggaccaagcgtaaaagggaccaaatagagaagagcgggttgacccgtctccatcagcaaaagggcgacaaaagtggcgaacattccgagggaatagcctaaaaatgagtgacaaaaatgaaaggatcaaatcgaattaatttggatattttaccaaaagtgacccccaataagggaggatagtcaaatcatttttggtttttataaaaggtaccaatgatcgaaatggacccgtaggcgtagaagcgactccgtttgaccacgtccacgtagaaacagaaggcgatcagatagcctgaaaggtgatttgcggtcggatcagatgggaatgagtgcactctgaccgggaatgattacgtcgccaaggccgagcatcacgcgtctgtactcgcgttccacttcgacgtcgaaacaacgccccatcggatcggcaaacattggcacgtaaaaaagcagaggaatctgccaaaagaacggccattgagacgatggacggatatgtgatgccgtaccttttccggcacttccttaaggtcaatcggcgcaatcggctggtagttttttccagtgcccgaagccgagtcggctctcttctgctgacagtcgactccggtgacaacctgaaaaagaaatgaaaattattatttacaagtctctcattatgcagcgtgtacgaaaattccggacgatcgtttaaaagacatacaaaattcggataaataaaaaaatggtcaccgccacgcgaaaggaataaataagtctcgccgtcccaaataaaattaaggctttagacgtggcgaattgatgttttttcggttgaaattctgccgtttttacctccatcatcaccgaacacccatcggttgtgagcagtgttgtgccgaacaccatgaacaggtcgtagatgaacatcgccagcatcaaaaaagtgagcagctgacagggcattgtttttcatgaaattacccaaattttcagtgaaaaacatacgcgcaaacttcgaattcggctgcttttcaccgcataaatgcaaaccatgcttaaaaggtgaatgaatagtaaaatatttggtcttattttattggtaaataaatgatcggttaataagtaatttttaatggacaatcaaatcggaaaagcactgacaaaacacacgtacagattgatgctgttcagcaggtaaaaagcgttgtaatgttcccgaaaattgaccaaacagtgcaagggcaaacgcaaaaagaaaaacaatcgacgacagc

SEQ ID NO: 6156 - DNA, 2971 bp, Heterodera glycines
taaacataattattttttacctgcgtttgccgttggtcttccacaatgtttgtgtttgttgcggtcgtttcgtttggcttattccgttcgttttctgtcgatgtttgtgagtctaaatcctctcaaattgaaattagaaaaatatgccagaatcctctttctttaattttcggttaaaatgtgaatgaatggcatgccttcgccttcctctgatgtgccgcagaaatttttgtgcaacggtgccaactttttatcgcccaaaaaagactttaggaaagtgtagagacaactgtggactgaacaaatgccgagaaaccacagaaggacgcagaaaccgagcactaaaaatagggaaaatgagattaaaaaatgggggaaagctttacaacataccagcgaatttgcgaaaaaagtaggcgagagtgagcacaatgacgatgaagacgagagcaaccaaaacgacggacaaatgttggcacacattcatctgggcaatttcggcactttgcgtgcgtttcaaggggctaaaatatgccataaaaagatggcatttgagacaaatgagttggatggaaatcaaaccctttattggtcggctcattcggctgcgcaggttggtcctcgtcactgagtgccgcccgactcgaacccaatccatcggacacggaaacgtccaacggcacgcgttttgcgagcattgctttggactcgaaagcagcccaaagagagcctaggaatttgagacacaaattggaaaatgataattacaagcgggttttcagacaaatttttattttgacaatttgtctctaatgagtgagccaaaataaacacaccgacaagaattgatccgacggcaaacagccaaagaacgccgaccgccgggtccattggccacgccgtttggggacggtaaaagcgaagctcagtggaagacgaattgagtagtaaaggctgaattaattaattcatttataatttgaatttctatttacttcgatttcctgtcgaaatgtgtcattgtaaacgaaaaacacggacatcgaagtgtcggaatcgttaatttcggcattgtaaaattgcgaaaactgaactttttttaaagtgataaatcagtaaaatattatgtgagtggacacaccaaaaagtcgcgacttctgtatcggttgcgtttacccttttccatcaaaaacagcacatttcgcacaccctttggcttaagacgattcaactgaaagggaaaagccaaacgaattgaaaccgaataacaaaaacaattaacaaatggatgaccgtggcattgaccaccgcctcgccctctttaaatttgcatggcaaaagctccgaggacagagttcgataatcgactggaacgagttcatttttggcgaaattgtgcccattttcaaggcaaatgttcgtgtttaaattgctattccaccagccaatttggacaaaattctttaaaaaaaaattattttagaaacagcgcgaaaatcacttttgtgtcggccgacgatggcaattgacggctgtgccattgttggaaattgacacagaaatcggagcctccggtgggcaaacttttgctacggacattcaaaaaagcgaagctggagtcgtatttgtagaaagcggaggttggacactgaaaattttagggatttgaaaaagtgaaaaaaggggaaaagtaacaaccaatggaaggaagaggagaaaagaaagggaataaagccggaaaatggaaaaaaccatgtggaattgtgatgatatgtaaaagtaaattaaggcaaattaccctaaaatgaacaaaggaaaatttcaaggattttaaccagcgatttaaatagacaaaatttaaaaatgatttgtgcccaagctcggttgacttaacgatcgtttttcacgtgtggccatgtgattgaacaaatcaaaggatcattttgagggtgaattaggggaagaagggggcaacatttgttccaaattccttttttgcctagcgatttttccgccgatcgttggttcattttcgccgggggtcggccgttctttcgcctttcttttgttacccaaaagctgtgggaaatggccgtccctttgcttaatgaatttggtcattatcaatttacgcaagccacacgccgcttgtgggggagagattattatgagggaatgaatcaaacggagggaaatggggagaagccgcaaaaagcgtaaaaaggggagaggtgtcaaaaagaacgagttttcacacaacagctgctcacaatcgcatggcaacaactgcttctctatacatagagacgaaaaaccatcacggaatgactgtaaaaatggggagggggaagagaatttgaaatgaaaggatgcaaaaagcgaacatttgaacgattggttataaaagagatgacaaacgaaaatagaaacattaaggaatgcaaactttgctcaagaattactactaattaacggccaatggcttttttgctatttgtctgtgaacaaatgaaaaaattctccaattgatgaactctttttttcaatgcatgtaaaagtgaacaaccaaagtcaaagaattcgcataaaaataccaaaaaggaaaattcaaaaaggagggaaacaacaaaatgcactaggtaatttgttttaactcactaaaaattggtctttcaaaaataaacaaatttttatgttcaatccatctgttcaattggtcatgtctccacttattccttcttcccgttgtgttccacggtacccgcactatttgaagacgcattctcatcaacatcgtcggtatcggaaatctaaaggaaattaaaaaactgtacaataccaaaaaagttaacaaatccgcaacccacaaacaaaaatggaagtcctacgaagaaaaaagcccaatgagactattcaaatataacaataagcgatttatgccaaaaaatccatctcacatccaaacaagaca

SEQ ID NO: 6157 - DNA, 741 bp, Heterodera glycines
aaataggcgatatgttgttgttaaagtaaaacaattagacttctgaaacgatcccccctcccattgtaagtgaattgaatgggtcaaaaataccgtcagaggatgcatttttgccgcgaagttcattacgaatctgaacaccaacaatgaaacttaataatgctagtaaataagttttctcactttcattgccatcactcccaacaaatttttgcctttgccaaccaatggaatgtgtttgaatgtttcgtcgctcagctcggatggaaactgtgggaacaatttaagtttattgtattaaattttacaattttaatggaaaacctcaccttgagcactttgccttcgttttccttggcccattcgcgcactccgttctcgaccattccggcagcaaagaacgagtctttgtcatatgcctgcaccaacaaagcgtcttcagtcgccagcaattggtcacataactcctgacaatgaattcaaaaaaaaactcaaaaccaatcgaggaaagtgcccacctgatgttggtcgctgaatttgtgacgcatcgcatgcaaaatgacctgcacaccgtgggaatttttccaagcatcgatctgaacaatagtaaattaaagaactttaaaaagaaaaagtaccctcgctttgctaacgcccatagaaaacagcaagtcgcgagtgcgtgtcttcgtcttcaatgggtctttgatggaacgcaactcttgggcagcctaaaaaatg

SEQ ID NO: 6158 - DNA, 4790 bp, Heterodera glycines
tacgaaatgttagaatccgggttcggggttcgagactgagacaaaataaggccggattcgtgctcggcgcctaagattacccctaaaaataattttctctaattttattaaaaaaaaatttatttggtctaaattacaaagaggaaaattgtctataaaatgaacgatgaatgtataaatattttctgattgcatattccatttaaatgcgcgagaaaattggaattttggtcgttttcaaaattttataccttcaaatctaaatattcaaaaaagaaaatcgcttcaataaattttctttataaaaattttgccctaaaaaatgcgcggcgcgccgcgcacagaaaaatcccgcggtcgcggatcgcgcatcgcggattcaaattgccgcggtcgcggatcgcggatcgcgcaaaaaaaacgccgcgaatcgcggatcgcgcatcgcggatcgcggtcgcgtcccagccctggtttgggccccaagtacagaaaaatgaaaaatcacagtaaaaacaactttttaaatttctgcataaaaaagcacatttttctatttttgggttgggcccaaacgaccccggggcccaaaaacgggggcccaaacgctctggtcccaaatgtgggcgtaattccaacacaaaaatgatttgattcaccaatgaaactcatttaataagtaaccaaattcatgcatttttaatttttattttatttattaaatcccattaagaaatattaatttgccaaattaagcattttaaaatgcaactcaaaaaagcaaaatcacttttgttgctaagttttaccatctttttctgtggccacgcattttgtggacaaactccggtccaattcacaacaaaacataaccttttgttcacggcattaccgcccgacaatggggaggccgtatacaaatttgacggtaattaaaaagcaattaaattcgatattggctaattacctaattaggcactttttacgcggatcgcatcgcccaattggaatacatagcggaggaggggggaagcacacaatccaacgactgtttggaatacggcgaatatttgaagcttagagaaagcggcaattttacaaaggaaacaatcgaaaaatttgaaaaggcagtgaaacaaatggacgcaaaaattgagcaaattaggggagaaaacccaattttagggacaaaacgcatcgaaatgaacgaattcagggcaaaattggacaaagaaattgtaattttaaaattttgaattaattgtaatttaaaaattataaataaaaaaggattttggattaattacaattttaaaattaaataaaaaataattttggattaaaaagttactttaattgattaattaattattaatttcattttttgtcttgtgcgagtgactcagctgatcgtaatcaaagcgaacaagaaattgtctatttgatttctgggaataaaaaataattgactaattaatgaatttttgttgttaattgcccaatttgctaaattagggccccgcagctgacgatgagtcaccaccactgctgcaccaattggtgatcaaatgcaagcagttcatgcgaaaattaatgtcggaggagggcgaaggctcgtgggtggacatttactcgtttatgggcgccgaagggacggaggagagacacgggacgaccctttggaacatttacgaattggcgaagatacaaagtgccaaattggacggaatgatcaacgaggccatgtgggcggagcacgaggaaaattggaggaataaaacggagaaaaatgggcaaaaaaagaaagggtaaaaaatgggaatgaaaagaaaaacagacatttataagaaaactatcaatgggaatatgaaaatataatatggattaataaaataattaaaaaaatataacacaaaaaaataaaacaattgaaattaaaaaacatttggtattttttaggaaaatccccaaatccatcttgtataattctttgaaatttcattttcatttaatttttaaaatgaattagctaaaaatgtgaaaaatgtaaaagggagcggaaggtcacaaaaagtgattgaatgagtgatttatttgcgatttgcgtttttcgtgtttataaggtatcattaatgaatgaattaattaattggatattacaactcattaattaattaagcaatgaacgagtgctcattgaaggcgctggtccgattggtttgttctgtgccgttcacctgtttttggccggtgccaatgtcactttggtcaatgaccgccccgagctctattcgcgcaaccatatgacctttttggacgcaaaatttatggcacaatttcgctttttcttgggcacaaaatttgatgaaatttacaacaaagaaagggtacggtttacggattacggttactgtaaagagtaaatttaaaaataaaatttgaaagcggacaaaatggttaaaatatttaaattggttaaagaaaatattaaaaattaaaatcagtgaaatgtttaaaacaaaattaatccaacggtaaaacgtaaatttaaaatgccgaaatttaaaagaaaattaaaaaatggataaataatttttgaatttgatttatgaagttatcactacaaaaaatatgatttctttaattcaaaaaagtcaaaattatttaattaaattgaaattaatttttaatgaatttgtttttgtttagtcatttggtcggattaacactttggacggggaagtggggcaacagaatgtgaaagacatcgagcaaattttgaaaatgcgactggtcgaattgaccagttttgtggagagcaaaattgggccggaacagccgaatcggctgaaattgctttatcagacggaacttaaagggattaaacgcgatggcccaatgggtaattgaagaaaaagtattaattaataattaaatttaatgtttttgaaaggaattgaagcgattgttaaagtgtcacccaaattcaatgcaaaagagcaaaaacattttaatagaagaaaagtcgaaataagagcagataacagagggattgacttggaaagtgcggagaagcaaatctttggtcagtcaaatttaaaagggaaaaaattattaaaaatttaagaagaaaaagtcgaaaatgccaaagaaatttatgctgcccgtcgcgcggcggcacttcaccaacagaagcaagctgatcagagtgatctgccatcacaaaagcaagctgatcaggaggatcataatgcggcggttgagcaagttcgcttggaaaaatgggaggggaaagtgcccgaattgcgccatttggcgccaattccctttgacattttgttttgtgccggcggagccaacgatcggattcgcaacaagcttttgggtatgacacgaaattgttgtcattgtttaatttatgtaaaaaattataggaaatccaattcgacgaagcatttcgaagaattacggattggttgtgttccataagggcagcccaaatgagaaagacggaataatggagcagagagtgttcgaccatttgaccggctttttcaaagtcaaaatgagcgattttgagccaattttgcaaaagcaaaatttcgataaatttgtcacaaatcacgggaacattttgccaaaagaattcataaaaaagtatgaaaatttgacgcaactgattgtccgagggctggtcaaggaaaacgaaggcaaatacgaggaggacgaaattcacaaaccgcacacgaaacacatttacaaacagcgtaagtcattagtggggtaattagcgtaattattagtgaagaacccacaaacggactacggtaatatttaaaatgaacgaaatgccaaaaagctgttcaaaccaaatgtttaaaaattggtttttttttattaaaatgggtaattctggatttaatccaagaaaatggccgttttgtgctcgccgacccaaaagaggagcccagtcaaatcgttcgtctgtttgagaatcggccaacacttcacatcgcttcgataacgccgccggcggtggaggaatttgttcgggacataaggcgagagtggctgcgatcggaaaatgatcaagcgaagcagcagctgatcaacgaaatgcgcgtgcgatttgagcgcaaatggagcgccgccatattcgacatgtgtttagggtaggcggtcacaaaggatggacaaatgggaagggtgagggtacggtagtcagacggtgggaagggtgatggtacggtagtcagacggtggaaaggatgatggatggtacggtagtcagacggtggaaaggatgatggatggtacgatagtcagacggtggaaaggatgatggatggtacggtagtcagacggtggaaaggatgatggatggtacggtagtcagacggtgggaagggtggtgctacagttgtcagacagtggaaaggatgatggatggtacggtagtcagacggtgggaagggtggtgctacagttgtcagacagtggaatgctggtacggtagtcagacggtgggaagggtggtggtacagttgtaagacagtggaaaggatgatggtacggtagtcagacagtgggaagggtgatggtatggtagtcagacgggtgacctagcaatactcaccggtaggaaacttttgatcagtcgaagggttgatcaagtagtgcttaatgacagggggtgaccaagagtacggtagataactgactagaaggatgatcactgatcaagcacttctaacggtgatcattgatgaggtagcagacctataaagaag

SEQ ID NO: 6159 - DNA, 1147 bp, Heterodera glycines
aatggcgcccggaaaatgcgtagtggaaaaatcgtcagtagaaaatgcgtcagtggaaattttattgtcacaaaaacagagtcccttgctttttcgaggtcactgaccacgatccagtatccattttggcctcttccgaatcccggacctgaattcgaacaaaaagtcgaaagcccaaattttcgatttagcatttttggttaaaaaacgccataaatgatctcttattgaaggattgatgggtttcagtttgtttccgtgtatttaaacctattttgaagaaaagccctaatttcgaaaattttggctttcgactttttgttcgaattcgggttcttgattcgaaattcagaacgaggttcttatagaagtttacttttatattacaatactaatgctacagaactttatactaaaatatttgtatcattgacacattttccactgacgcattttccggtcacggttttaattgggtcgaaagccgaaaccgaacaaaaaacgaaaagattggcatttaacgaagcatttgaatttgactgcttttggaatatatttgactttgcaggaaattctttggctttttttcctacctctgcacttatacgggaatgacccattaattgattaattaactaactaaccattcccattcattaggccgtttgggcgttgaatggtccgcgtacgccttgagggattatcaccagggaaaaataacggagaaggaactgatcgaacggatgagcaaaaaattgaattcaatagaacaaagagtggtgaaaaaagtgcgagaatatgtgacaattgaggacaaagagggcgaaaagacggacaaagcatcaaccattttggacaaggacgaggacaaagtgtacaaagccatttaccatgccaaaaagacgcaatgaatgggcaaaaaatgatcgaccgaccaaagaacgaacagaaaacgaaatgaattttgaaaaaattgaattgagatatgtgattttgttcagagatatgtaaatgcatttttaaattagttggaaagcttaattatttcggaaaattttttaattaaaatttcaaaattaattaattaattaagtaatatttgcttaaaaataaaaggagcagctttttgatgcttgaaattaccatg

SEQ ID NO: 6160 - DNA, 1215 bp, Heterodera glycines
ttattcatccattgaaattagtaccgatcgaaaatgacgaaatgcgtgcacttttctgcaaagaatcagggggtgtactctttaaaaaaaatgccaagcacgtggcactgtatggttagaaatattcggcgaaatacactttataaaaaaatgtaattacattgaactaggggcagtacaaatacagtaggatttaatttgtgggggttgcttttcgttaaaaaatttcagtttatgattttttcctaaagtgttttaaattttgttatttattgcccagaaagttttaattcatccattgaaattagtaccgatcggaaatgacgaaatgcttgcacttttctgcaaagaatcagggggtgtactcctttaaaaaaatgccaagcacgtggcactgtatggttagaaatattcggcgaaatacactttataaaaaaatgtaattacattgaactaggggcagtacaaatacagtaggatttaatttgtgggggttgcttttcgttaaaaaatttcagtttatgattttttcctaaagtgttttaaattttgttatttattgcccagaaagttttaattcatccattgaaattagtaccgatcggaaatgacgaaatgcttgcacttttctgcaaagaatcagggggtgtactcctttaaaaaaatgccaagcacgtggcactgtatggttagaaatattcggcgaaatacacttgataaaaaatgtaattacattgaaccaggggcagtacaaatacagtaggatttaatttgtgggggttgcttttcgttaaaaaatttcagtttatgatttttttcctaaagtgttttaaattttgttatttaatgcccagaaatttttaattcatccattgaaattagtaccgatcggaaatgacgaaatgcgtgcacttttctgcaaagaatcaggggggtgtactcctttaaaaaaatgccaagcacgtggcactgtatggttagaaatattcggcgaaatacacttgataaaaaaatgtaattacattgaaccaggggcagtacaaatacagtaggatttaatttgtgggggttgcttttcgttaaaaaatttcagtttatgatttttttcctaaagtgttttaaattttgttatttaatgccccagaaatttttaattcatccatttgaaattagtaccgaatcggaaatgacgaaatgcgtgcacttttctgcaaa

SEQ ID NO: 6161 - DNA, 1286 bp, Heterodera glycines
gaaatgacgaaatgcgtgcattttctgcaaagaatcagggggtgtactccttaaaaaaatgccaagcacgtggcactgtatggttagaaatattcggcgaaatacacttgataaaaaaatgtaattacattgaactaggggcagtacaaatacagtaggatttaatttgtgggggttgcttttcgttaaaaaattccagtttatgattcttttcttaaaatgttttaaattttgttatttaatgcccagaaagttttaattcatccattgaaattagtaccgatcggaaatgacgaaatgcgtgcacttttctgcaaagaatcagggggtgtactcctttaaaaaaaatgccaagcacgtggcactgtatggttagaaatattcggcgaaatacacttgataaaaaaatgtaattacattgaactaggggcagtacaaatacagtaggatttaatttgtgggggttgcttttcgttaaaaaattccagtttatgattcttttcttaaaatgttttaaattttgttatttaatgcccagaaagttttaattcatccattgaaattagtaccgatcggaaatgacgaaatgcgtgcacttttctgcaaagaatcagggggtgtactcctttaaaaaaaatgccaagcacgtggcactgtatggttagaaatattcggcgaaatacactttataaaaaaatgtaattacattgaactaggggcagtacaaatacagtaggatttaatttgtgggggttgcttttcgttaaaaaattccagtttatgattcttttcttaaaatgttttaaattttgttatttaatgcccagaaagttttaattcatccattgaaattagtaccgatcggaaatgacgaaatgcgtgcacttttctgcaaagaatcagggggtgtactcctttaaaaaaaatgccaagcacgtggcactgtatggttagaaatattcggcgaaatacactttataaaaaaatgtaattacattgaactaggggcagtacaaatacagtaggatttcatttgtgggtgttgcttttcgttaaaaaattccagtttatgattcttttcttaaaatgttttaaattttgttatttaatgcccagaaagatttaattcatccattgaaattagtaccgatcggaaatgacgaaatgcgtgcacttttctgcaaagaatcagggggtgttctcagtttaaaaaaatgccaagcacgtggcactgtatgcttggtagagtcggcgaaatacactttataaaaaaatgataattacat

SEQ ID NO: 6162 - DNA, 3531 bp, Heterodera glycines
ggcaaaatttgggttttaaacgcaaggaaaagtcgtcgcttagcttttaattgccaaaatcggccttttttggtgaaatctgttaacaaatcaaaacgaaattacaaaaaaattttccggcggcgcctatcggcaccgccggaccctctcccctcgctcatttcccaaaagttttggaaaaatccgccgcaaaaaaattcttaaaagtcaaattttttcatcccgagttcaaatgcaatttgataacagattttcaccaaaaaggccaatttttgtcattttaaccaatgtttttacagaatttgtaccaaaaatgttcaaattttcaagaaatagggttaaattcttcaaaatttctcatgggatattgtaaaaaattaagaaatttttctataattctaaaaataggaatagttatttttatataaaaagttttgagctttatttagttaatgataaaatggcagttttcgacaaaaatttaaaaaagtgttaaaagacaaccaaccgcattgagaaggattgaactatggttcgagccccgcccccgcccccgtcccgtgacatcagaaaatttaatatattttaaaaatttttacaaaataccgaagaaaaacaaaaatttatcggaaaaatcttaatattttttttggtgaatatctgttaatagagcttagatttcaaaattcgcccgacggcgcctatcggcaaattagcccaaaacccctaaatttggtcatttttagacaaaatctgtgtttttggagctaattcaaatcaaacccccgctccctcgactctttgaccagttttgaccgggaaattcccgtcttttttcacggttttcccagccaaaaaagtcccggtttttcaaccaaaaaagtcccggtcccggtcttgctcaaatttcccggtcccgctgcactctcttttaaagtaaaatattaattgatttttaaaatttttcttgcctccaaagttactcaacagtttacaaagtccacttttaccagtgtatttttggacccggacctaccgggtcggataccgggttttggattttccaaaaacgggtccgggtattgaaaaaaccgggtatccgggtctgcgaccaggacacggcctgccttgattatagtgagaaatttctattcaccaactgttcattaaataatatttataagtgatgttttttctctgcactctctgtgcaggaaaactgaaggactgggaaaagatggaagattcaatctcaaatttcgtaccttaggatttgttcatttagatattatacttttaaattattaaaattatttattagatttccatataaaattaaatatttattcggaattttttaaattaaaataaatttggttgatgaaacgactaattttggcttggaggacgaaatgacagcgcgccgattcgatcggcgccacggcggtaaactttagaattaaggctaaaatcgaattgaaaaaacagaatgacaaaagaaaaaaatggcggcaaattctacatttaaatttatatggtttatgagttagaacaacagctgcaaattgacaattgttgcgcactaaaagtacaattatcagttgcgttggtgagttatcgagggcgttggtcacgaatcggacattcatttcgaacaaaatcgaatccaatcccgaacttaccctttttatgggactagtaaaggcaatgtttaatatcgaattgtgttggtagagaagccaatatttaattgaaaaaagtattctcgagattaatccttacccgtatttagagattaaataaatctttttaaataaaactgcggaaaattaaattaccgaaattctaatgttgtcgtcctcaaagccgaggaattcgatgggccgaatgaaacatttgttgagctcgggcgaggatgcggacgttttgggctaatttgccgataggcgccgccgggcgaattttgaaatctaagctctattagcagatattcaccaaaaaaaaattaagatttttccgataaatttttgtttttcttcggtattttgtaaaaatttttaaaatatattaaattttctgatttactcaaggaaaaaatgaaattttcatccggtggcgccggtaaatttttttgaaaagttgatttcaatttgttaacaaattatgcgaaaaattgtcaatttttatagatatttttgtctattaatcataaaaaaataaatgcaaaacaaaacgtcaaccggtatcgaactcatgttgaagcattaaccactaaaccacaaatatatcaaaaataaaagcaaaatttactatatttcataaaaatttgccaaagatggttaaaaaatttaaattgtataattttttatcttttatcccaacaattgctttccatttgatggtttttataactaccatttataaaatataaaaaatataattttattttaacaaataataaaaatttaaaaatttgaaattgcatataaattttgaaaatcaaatttttttgcaattgagcaaaaaatgctcctcagccattgttttggtgtttttaaagtcaaattgtttttaaagtcaattctgtatttttacacaatttttggtattttttcactttataaggcattttttagtgtatatttggacattttcgggtttttagggcatttttgggggataaatctttaattatttattattaggggttccttttttaggaacgaaaaaccgcttaataggtacctaaaacgtagaaaaaaaccgaaaaaagcattacagaataaggcacataaatatttttaaataaataaataaatgctgtggactgctcttcggcctgagggaattttagtgccgtcgcctccccccgcgtctttttttatcggcagcggcgcgattttggacagaaaattttttcttttttttcgaaaaattttacgtaaaattgatttaaatgcaaagttttcaaaaattagtaaatttatctcaacaaatttaagacaaaattgaaataatgctcgtttcaaaatgggaacaattgatgtgattcgacgggcccttttgtgcatattttggccaacaccggaggaaatactttgtcgaaattcgggcccaatacatttgaaatgtaagtgagcaattggcggtgtttgacgcccgtgttgaaaagccatacgatcaatcccataagttccatgtaccgtagggcacccgctgcgggactgtaatttgtctgaatgagaaaaagtgatgctatgtggttttgtaaattctgctagcatggaccttttcaaaaatccgccgtttcgtaaattagccaagggaccaaaaaatgaaaaattaaatttataaaattgagtatagcgctaccattaattactgttttttttcaaacgataataccgggtacgggtttttctagtgccggcggtaccggtactaaccgataaaaatttgcaggggtaaaaatctctcatttaaatgcatacttttaatattttaagtggtatattttaaaaaatctggtca

SEQ ID NO: 6163 - DNA, 4812 bp, Heterodera glycines
  misc_feature (64)..(65): n is a, c, g, or t
agaatatttctccgcttcactgtacacaatttttgtgccccatcactaagcccaggcgaactgnnaaataataaaacatttaaaaagtggggggtcatttgagtgcggcacagtttaagcttttaaacttttcttggaaacaaccaaatttaagaaaatcttattttattcaattacggtcaacaaagttcggaaaactagtttttattttcttaaatctttttattcataatttttatgtaacttaacgaaatttttgtatgcttatagaaaatatttaatgccatttaataatatcaaaattgtttaattccttatttctatgaaaaggtaaaaaaggctaaactctctctgcattcaatcgatacggttagaatttaatccagattaattttaactcattaattataatgtttttaggccttagctgacccatatgtgagtaaatgattgcgcgaataagtacaaattcttcattgctcagttttaaacggacgaatggctgaatggccttacaaaacaatttgtcacccattcccatggcactgaaatttcaaaaattttcaattaaatggtaataataaaaaaataatttaaaattcacacacactgaatcttgcttataatacgagttttcgaaggtcttaattggcattagaccatctggtgtgcaaaaaacgtcacaattttgttgcacagagtagaagccgttgcacaacacaaacaatggcatcgcaatattactgcacagggcaatcttttcaatgtgaattaataacaatgaaaattaattaaataaatattatatttcctataatatagcccgcccctaaaataaagccccccccctcccattgaggggggttgagaaatagagccctcccctattagagccccctgaaataaagccccccccctccctttgagggaggttgaggaatatatccctccccgaattagtcccccctaaaataaagccccctccctttgagggaggttgaggaatagagccctccccgaattagtcccccctaaaataaagcccccctccctttgaggggggttgagaaatagagccctccccgaattagacccccctgaaataaagactccctttgaagggtctagaaatagtgcacccctccctgaatcagacagcccatgaaataaagccccccttttgaggtggttgaaaattattttttttttattttgctgtaccttgtcattgatgtcaaactgatcaaagaatggaaaaattttgccaatttcaactactaataacaaacccttttgaagggtttagaaatagagcccccctccctgaatcagacaccccatgaaataaagactctcttttttgggagggattgcgaaataaagcccctccccacctctcgccatgaattagagctcccgtgaataaagcctcccctgaaataccccccccccccttttttgagttgagttaaagataaaaccccctggggctctatttcaagaaatacggtattataaattttttaaaattttactttaccttgtcattgttgtcaagctgcccaaagaatgaaaaacttttgccaatttcgaatacacataacaaatccatgaccattggcgctggccttacacagaagggtccaaactgacgcgctttttcaatatatattgctggaattgcttggaccgtttttgtcttaatttcaaggatttgtccagattttttttatgaattcgtttaccgaaaatttgttgaccaattcgatcaaattcaattttcgtgaaaaaattgattcaaatgtatcacattgtgtgtaaaaaagttctggaattggtgtctgtgagtagcgaatttggcgcactttttgctcaatttgcagcaaattttttaccaaaataaaattgattaattccttttgatccggtgcctaaaatgcacatatgttgctttttcgtggtgacatttaaattggtaaatgactgtgttcaaggcagattttccgaaaattttaattaaattttttaaacaaatttcgttaaaaatgcacatttccacattgttacatattgcatcaatgtttggtcacgccctttcttgggtttttcaatttttaccaaaatttaaaaaaaaatttcaaatttttttgtgagagttttcttccataaaacaagctagaaggcccattagaaaaatatatcccgcttagttatgcgcttacccaacaaaatttttgagtattaaactaaagtccccttaaaatatagtttaaaattgaattttgcccttctccgtctcttcgtataaccgagttgaggacggcattttttcctggatgctctttcattcgttctgcaaatgccattgtttgttcgtcattcaattttgttggacaaatatttcgcggattcattccgaccgttaagcatttgtacagtcggcatcgtttacatgatgataaatctttttaataaaattttaaatttttttctaagatttaattttttaagattataatatataagaaattctttcaaatttagcttataaaaaaatgcttatccaattaattcattcaaaaaggcaaatttaaattttattattattatttatttattttaatatttatatttgcgctttatttttccctttttcacctttgcactctccgccttttttgcagttgtattccttcatcaacgaaattgtgcgacgaaaaaaatgtttgcaacctgcaatttttaaaggcattttaaattcgagggtttggacatttttcaattatttcttatatctcgagttaaatggaaattttgaaaatttaataaaaattattttttaatttttcttcactttttcttttttgtggttcatttaaatttgattactttcacaacattttgccccataatagtaatattgacactgacaattgcataccgcacattttgagttaccaaagttaggcttcatcttttaaaattcaaaaacgaataaaattatgcaatatattaaatacaagtgaatattgaaaataaaatatgctttgtggagtaaaatagggaaaaaaagaatcaatatttttttataaaatattattattattttaagagtgaaattggaaagggaatatgtcgctaaaataagcccatgtgaatattaaattgattttattgcgaaagaagtaaattaaagaaaattacaaatttttactgattagattttttaatttactgatgggattttttttattatatatttatatttttcatttagtaatattataccgtttattattataccctagtccctaaaatactaaacatgggagtgatatatttcagatatattacaaccccacctccaaatggaacctgctcttttaatcctttaaagtttcaaaactttggcacggacgccccattatttgctcagtcaccctcagggctttttatggcatttcaaaaaataataatagacaaaaaatatgacaaaaagacgaagttgatagatataatgaagtaacaatttgtatttcgttttaacttaacgataatttttacaattataatgaaaattattctttagggtcgcatcaccaaaaaatgagaataatcctaaaattttcaaaaattattataaaggatggtaaacctgggagtagagttgcacggtaatcggtaattgtaaaaaatccggtgccggtactgaccggtaatgcaaaaaccggtaccggtaaaaaccggtaattttcaaacgttggtaaacctgggagtagagttgcacggtaatcggtaattgtaaaaaatccggtaccggtactgaccggtaatgcaaaaaccggtacaggtaaaaaccggtaattttcaaacgtaaaaaattaaaaaaacttattggttaaccttttgttcctgtttttgaagcaaattcccggatttcaactccgtaaattgttgtttgtgtcttgcctctaagtgttccacatgcccattgttgatccatcatttcggagaatttttttaccgcaaacattgcataatgctttatcattcgatgatttgtcgaaatatttccaaatggcagacatttattggattttgattaccaaaattaaaatcatgattctcttgtagaataaattaacaagggataagaaattttaactccaaatatattaatcttcaatgaataaatatgacgaaagattgtgtttaaaatgcctaaaatttggcaaaattttctatttttataaaattttccgtttccctaaattttgcatcatcaattttgtgctaaactcctattcttaacagtgcaaatttttaccggcggtaccggtactagacaaaccggtaccggtactttgatttttgaaaaaaccggtaccggtaccaaaaaaaccgcggctggtaatttcgacactgggtaaattggacactgagtaaattcgacactaagtattttcgacactaagtaatttcgacactacattttcgcactgaattatttctaaaactttcactgttttcctgcattttcgacactggaccatttcgacattgagtaatttcgacactatagagaatttggcgctactgtaaaagttaccctttttgaaaattttttttaaaagtcatgaaaatacatttccggggttttcggggccgctgatcacgaatatgacattcatttcgaccaatttcgaaccccggacccggatttatgatcagtaaattttcattgtaatttcaaatctctagacatatgtggtactcagaacttatgagacacatttatgataataacattat

SEQ ID NO: 6164 - DNA, 1956 bp, Heterodera glycines
  misc_feature (688)..(688): n is a, c, g, or t
  misc_feature (707)..(707): n is a, c, g, or t
  misc_feature (746)..(746): n is a, c, g, or t
tgcccagttggcaccccaacgaattgaattgatcattgcatttttacttacaaactcttcccaaatcacaatggtcaacacttggtttttctcgtcctaaatcccaaaaattcgctttccgatttccatgctgaccacgtccacaatttgctgcaaataaaggcggaagctgactttgactgcgtctgagtgattgaacacgggccgttcaactgacaaatgaaaagagttggggagggaattcgaccgacaaaagtcaatgcttttggaaatgcttttgttttgggccattttccccaatcattttgggtccattttccgcttcttcttctgcttctgcttctgcttacctgggtcgtagcggtccttcagatcctgtcaaaaaatggcaaattaaaatggaaaaaggaaatggcaaaattggatgccaaaaaaatagaaaaaagcaaggattatgaaagggtgtgcctgcaaaagtcggtattcgtcatccgaagctgaggcaaatcgcaaaaaggcgataattaggaaggacaattggaatggcaaaagcattttggaagaggaaaaaaagaattgggggaagggacagaagaggaaggaagggaaatgctgcagatcggtgccaaaacggattaattttttttaatttacaaaacaatcactggcgtccattagcgattgatgngccaacaattgcaattggncttcgcccactcccccccccaccctccgattttggcttntctctctctctctctctcttcatgcttcttccccctccgattggcttttctctctctctctcttccatgcttcttccccctccgattggcttttctctctctctctcttccatgcttcttccccctccgattagcttttctccctccctccctctctctctcgtaactcctctccctctctcttccatatctctcttccctctctttcttctcctctctctctccctccctctctctatcttcccctcctccctcccgcccctccttttcttttgctgcccttcccgtttcatcccccccattaatctgtttaatcagctttttcctctgcccattttcctgcgcaatgaacaaaatgaagaaaacatttagggaaaagaaatgatgggacaaatgcttaatagaaaaacccaataatattcataaatcatatttttttattttcgaaaaagcctcgcccaagccaaaggaataaaaaatttattgggaaaaaataaatcaaaatcaaagggaatggataaaatcgaagtaagaaagtttatacaaaatgattaaaagtgatgtaaaagtctgccaaattgttggccaattccttgtgccgattgaagagccattctcgtcaactgcgtcctgagaaaatggggaaataattaaaattaaaaaaagcgaccaatctcccaaacaaattcttcacctcttcgatattttattggcttcttccctctctctcctcccctcttcccccatctctctctctctccctcccctacttcttcctctatctctctctatacctcttttcctccctctctcctttccctctctcttccctccctgcctcttttgctcactcttctatttcccccgtttttcacccccttccagaaatgccatttgctaacttgaatgagtttccgtccgttcggcactgaattggactcttctgctgactcttcccgcttcagagtgccattggatgcgcgggcgagaaggtcgtaataattgcacagatgtgagtcgcaaatgcaatgcacggaaatgggctccgtcaagttgagggagtactccgctgtacaaccaacagaaactttctaaaagaatcgaccgaatgaatggcactgcgcattcggcagcgttaccgagtcatcgtccaccttaagacacccggcaagcagttcatgtcttggcttggaattggccacaaattggg

SEQ ID NO: 6165 - DNA, 2048 bp, Heterodera glycines
ggagctcaaactgtaacagtaattgaggtcatcggcacgacgagtcagcacactttgcatctgatggcgaattgtccggttgcgctggttgcacatccccgagggttccgtgcacacgcagcctttaacagaaatgaaagggatggcattcaattggccaaatagcatttcctttcgtactgtttttcttctcattttgcctaccattcactgctgtttcctccgatgcttggtaatgggcacaggcgatccctccttggaaggtgctcaaataattcggaatgcgaagaaaattttgcagccgtggcatcccctggccgcatccctattttagttttattaattttttatttagccgcttttttcttttatgctcaaaaatagtggcgcgacatttcaaatattgagtagccaaatgccaaacccccaaatgttgagtatcccaatgaatcactgttgttacctgatcaacaccatcaaagtccacctgaatggaaagtaaaattctgtaaagatacggtagaaaagccttctcaccagacagtaatttcctcgacagttcctaaggcatgagtccattgggcactgttcgtcccccccgggctgactgcactcgcaacactccaaaacaggcaaaggggcgggtgaaaagttgttcaactgagaagcaaagccaaaagtaaaagagcaaagacctttctcgctcacctttgtcctgtcattacaaaattgtccgttacagtaacaatggattgattcggtctgtcccgaataattacatccgtcgatgcccggcggcaatccatcgacgcatcccttctgagaaagtaaaactcagatcagatcagtccaatgccttttcatttcttcttcttttacctgcaaaactgcgactgattcttccgggaacagctccaacttggcgaaacattgctgaccttcgcacgaatcgccgccttggccacactcgcaagtgtccaattggggctttccgtccggcataattttgcaatgggttaagcaggaatggcaaagatggagatgagcaagggaaaaggaggacaaagcgaacagcacgagaaggacggcaaagaaatgactcatcagatggggaaggagcagagaaagaaagaaaaagtgatcggaaaaagaaagagtgatcagagcaacggagaagcaactgcaaatggagcaaataatatggacggaatgataattatataataaaacgtaatggggggaaagttggcggaatttcgataaaaagtgcagaatggccttaacggaaaataaagggcacggcattgggcagagagctaactaatcctaatccattcactctttgccggagggcaaagagaaaggaaaagcaacggaagaaaggtggaaggggacggcacggaggcggaaagctaatcccttcatacaagtggggagaggatgagcaaatcgagaggagatgagaggaagaagggatggaggagaaggggacgaggggggggggggaagccagaagtgcaaaacttctaagaccacgtgagaaaaggactttatggaaaacgaaattttcgttttcggatggctgcttttctcccgcgacatttaatttcggagaattatttaggcctttttttacctgaacagcagagaaaaggtttcggaattataataatttttagatttcttcctagaaaaaaaaattaaaaatttctcttgaaaaaatttttttcgtagcggtgggaggattgggacattgtgcatccgtccgcttcttcgcccgctgtttttccgtgacgattgccttaccaatttcgcttggtgtaggtcctccgatttctgacgatggatgacttctcgtccgtcttcacatttcgtccgggccactgatacaacgagcagaacagactcggggctatgctaatagcgacctcgacctgataccttgccgacatcaacaagctatgttttcgaagtgatccgcgaagagagcattacggaggaggtggcgaatctgcgcaaggacataactgacttctcagcgatgtaca

SEQ ID NO: 6166 - DNA, 3358 bp, Heterodera glycines
  misc_feature (2269)..(2269): n is a, c, g, or t
ctgaccgacattgtttggagtattccgaaatgtttttggattcattggcatggcttttccccctctttgaaaattcccattcttttggccacgccggacagccaaaaatgcgcattttccctctgaaaagcgttgccaaaaagcagctccaacccattgaaaattgtgccgttgttgagactgagccagcgggactgatctgacagggcccactttcccattattattaattattattttaattagcaccttcacaattcgccttttctctttggtaaaccgtcgtaaaagtgtttttgtccgtcctccgttcttctctgttcgggtccctcaaaattcgatgttttttcgttttttgtttcgtaaaatttggccaactcacccaaaagttacgaaatttgcaaccatttcggcaaaacttcgcatgtccttttgttctttgtcttccacactttgtccccgcggcgttggattaaacaccaaatcgtccgcacaaacggactgagaagcggcccacggattggccgagttggccgccacttcggccacgtcgacctgggaaacatttgaggatgaacggaagaggagggcgaacacgcgggcggagccaacgcgcgaacggacgaacgcctcgaggagagcggggccgaccaggaaaaagtctgttctaatctgtcacgtggataaacatggcacacaattgtcgctggtcctgcaaattcccctcactctgttgaccaatgcgtcggggccgtcccccgcggccctttccacgtagtgccgaatcacttcctccgcatagtccaactccgccaagtcatccatggcgcgcatccgcgccaccacctcctccctgaccgcctccgccactctcttccgaaatgtctcttccgtcccttctgtcccttctatttttccgttcgtccattgctcttccgaagtgcaaattgtgatcattgtgctggtagagggaatgtttgagaatggatttgccgggacggcggaggataagtcgtgggagaggaggggccaacggagaaaagtcggccgaaggctcagtgaatcggcggcaacgatcgcctgcgggggggggggggttgggggtgattctcagaggccaacgctttgcccggcacctcatggcccaacgtggccacacaatcgtccaactttcttctggccgccacttcctcctgtgtcagcgcagttttgtgctgcgactctttcaccactttccattccttttcgtccacacatttcgctcaattttcaataatcaaaagagggggaaggcaatcgcttcggaaattaatttccaaaattcaatttgcttttaggcctttaagttaatcgtatcgattgattctttaagtgccaacccgaaatggcaaaacgcatcgaagcatcagaagaaggagaaggacgaggaggaaaagaatcattttgggagaagctcggctggagcattacgggcaaaaaagcggagcccgaaagaaggatttggcgtttgaagaggccttggacgaggaatgagttcatgttttcacattcttagggcactttctcagtctgagtgccacgtcggaaattcggatttcccttttgcgatgcccaccctttgctctaccaatttgtctgatcactcactttgtgtgcccggcaaaaggccgagcagtgcgacgagtcgtgccccgtctccccgcgccatcaccgtcacatgggcacggtggccaccaaaatgggcaatgttcagctgaacccactccaaagcggtgcgaatgtcccaaagggcgagttccctttgcggggtgggccaatgaggcgcactgaacagacctaaaaaaggacagaaagggcttagggaggggggaaggacggaccataaggtcccattcggtagttgagcgacaccaccaccactccgtccccggcacatgccatccttctgatggtgctgatcggctccaaattggcattgctccgtttcagccaatgtccttccggcacatagaccaaaacgggcagcaattgtttggaattcttctgaaatgcggctttaaaagtttattccatggccaatgggaagaacagaatcagtgcaacggtaaatgttgagggtgtggcactgctcggccacgggcaccgcctcgagcggcggcgggtcccaattgatggccggcgcggactttgtgcgaacaaagcttaaattcaaattaacaggctttacttttgccatttggttccaatgcatcctttgtttatccattanactttaccatttgggcatccgttcccgtgatgaatgtcgaaaaagccgcgcggaaatggcgccacttgtgtcggctataacagtgtaattcaaagagatttggcattctgttcaatttgcctggtatcgtggcgtggcgatactgtagggaatgtccaaaaaatactccccgtctcccgacgccaatttccggccgaccataattaactcgtccccgtccacatttacgcgaagttcggtgaacaaatcaggggttgggttgcatccgtgaagcgaaatgaattgatgtgccaaaagcaaagtcagtgcaaaggccaacgcaccgaaaagcgctaattagtgggggtaattagtggggggaggggcggaggaggggtaaggcagcgaattttggggaagggccccaagggaccattttggcactttccagataaaaacattggtttaaacgtacaaaaaagcagcatatctcttccacgagagcagaatataaaagtcaaaggtctctgctgctgttcggcattttcttgtcctttgcaattgtccgacaaatgcggcgaattcggccaattttttgctcggattggcaaattgccagaaggaaaatgggccggaaaaggcattttgaaaagacaaaaagcaatggaaaagcaaagaaaggtcaattgagtattcttctgaacaggattagtaaacaaattttaaagctttttccataagcatcgaacgaatgaacgaaatttgaggaaaagcggaaaaaggggggggggggcaaatggacgatgggcggaagaatcggacgacaaattgggcatgaaattattagagagaaaaaatggaacaaaaatcgaaaaagcacaaaacgtccgatcagatcaatcggaagtgattctttcttcacactttctttcttcaccggctgatcaatttcacatcactcttctgctgttgatcggcaaaagggcggcaaagactaaaagacgggcggagagaaattgacgcgcgggggggggggggttaatgattgtcattcgtgggaggtcagaaacacctaaaagcaggatgaaaaccggattgttgggaggggag

SEQ ID NO: 6167 - DNA, 1732 bp, Heterodera glycines
atcagaaggaaagcgaattgaaatgccgaaaagggaatggcattgaaattcggatttatccgaatattctatcttggaacgatccgcaatgggtaaagtgataatcccagtcacaaaacatcctttgccagcccgaagtcttctcccccccccccattcgatccgtcctgttcctcccaccccccctttcctcctttgaaagatgagcattcattttgtctcccaaccgcattatccaaatggacagctaattaatctcggttttagcaaaggattagctgttggtcagggatcgatcacaaaattagaaatgttttagcttttaagtgaaaaacgatatgacataggaacattgaccaaaacaaatgttgaggcgagaatattcttgaaaaatcatcaataacatttacttttattggctatggtagggtttttgacttttgaatggcataatcaattttaaattgttgccttgttttggttagccgaatatcggccaaaagcttcaaccgaaaaacaaagctgataaatcaggcaaataagtacaaaacaaatcacagcattgctcaaaggcagccaaattttacgattggtatcattcgtccgtcggtggcgttggcggatttaagaaacgttaaatagcaccctttctttatttgtatgaaaatggctttgaaacttggcccaatgacttggtatcattatctttgatgctcgaagtgtttgttcgtttctctcatcacttttcgttttgttcagaattctccgccggtaacagcagttttgcatggtttacaccaaaattagagattcaatctttcaatcccaaaatttattgttgggatgcgactttcacatgtgctgacaaacattggggtggcgtgacaaaacgtcgcccgggggagagttccatcgatttcggcactttgccttatcatcgcttcgctccatttgcgtcaccgttcagcagtccgtccaaaatttaagcagtgaaaaaacagcaatttggttgcttttgtttgcttatcattcccatcccttgtcatttgcattgccttttaaagataatgcgtcattaactaattaattaattattaattgcctattaactgactccttttgtgattggtcgaacaagtgaagtgaatgaatgaataaaaaggaatatttttaggttttgttaatcatttcatttcatttcgaattcgcatttcgtttccccccccccccccttcagactttctttcgtctccattctctccaaaatgtctcgcgtgtgcgtttccgattcgtctcaacttccgattaaaaagaatgagccccgcaccgaatggttgtccattctgctcgcttcttggctggccttcgtctcttcctcccaatactctctctatttcacctctctttggccctttatgaaaacggtaccctttcactttcactttgggcaattggacgaatgttccgtctgtctctttgttttgcgctttcttccgctttatccctgctgatctgtccttccgatcagctcgacccctctgccactgaagcgtcctttggcgttgtgatcgccgtttattccctcgcccaaattgtcgccgctccgctcctcggctggtgggcccatcgcattgagcgattgcgtcccccgcttgtactgtgcaatgtgctgatgatggtcggcagtttgcgggaggttcttgtcgaggcttttcccgccacctttaaaact

SEQ ID NO: 6168 - DNA, 1365 bp, Heterodera glycines
  misc_feature (93)..(93): n is a, c, g, or t
gtgcccgtgccaccgcttttgtcaccggcggagtcgccattggcatttcgctggggccgggtgcgttttcgctgtgcttcggatgatcattgnctaattgttcctcccagccttccaaatcgccttctcctggctctcttaccccggcgtcgcccttttcccctccgttggcctccatctgtccatgttcaatgcgcccgctctgttcgccacatgcattaacattgccaacgtggtcattttggaacgccttttcaaagaaagttctgttggcattttggagaaacgaaaggtgccaaaaataacggaaaaagcggcgagaattcgttggaaaaaaattaattgtccagcagagtcaaagcgaggaaaagcaaccaaattctgtgcccaaattgcctccgccggacagagttgccctgtgcctttgctatttgctccgcttcactcagcagttcatcatcaccaacatcgaaacgtacgtttagcatcaatcggcaattaataaatgccatcgctgtttcagaatcggctccgcttttgccatgctaatgttccgttggggccctaaggaagtgatttactacgagtcgctttctcacattgtccgtgggctgaccgctcttttcgtttacgtcgcttacattgtgcttgacctgggcaaaatgtgagcactttttcctctttggtgatcaatcgctctgtctgtctgtccgatcagagcaaaagaccgtcccgtgtgctttgtgtccctcgtcggtctgctgctcttccatttgctcactttctcatggccctttttgccaaatgatgtgccggaactcagtctgtggtcaagtggtggtggtggttgtcccgacttaagcatcaatcccgaaactcattcattagtctcgagacaaaaaaaaacattgttcaaacgaacacatgacaggagaaccaccaaacaaagactatcaacagaaaaacatcgggttgctttcagtttcgatacaatcgaacaatgtgtccaccactgacggaggccatttgcccacaatggtcggatgcgaccggagagagcacccgtggtgtgacgggctcaagcaggtcagtgaatagcacaccaaatcatgccaaatgcaaatcaaagtgccaatcataggtcgaccctcgcctttactatgcgctgatgatcactgtcatcggctcgacctttcccctcatcaacgtgtccatgaacaccattttctctgctgcagttggccctcggctacaggccaagcaacagagcattctgatggtatcgggtgggatgggccgaatgctgggcccacttctaatcgggttcgatgaaaaggcaaaaaagtttgacgttcttgaaaattt

SEQ ID NO: 6169 - DNA, 515 bp, Heterodera glycines
acgtattacatagctaattcaagagtgtgatctaaaaatatccattcatcaagcagggtcagcccaatcaaattgggctaatagcggcgcgtttattgactggctcggctttatcaagctgtaccctttcccataagaatgaatgtattgcagcctctttcgccatggctctctttcattcagtcatgagccggtgactctgattgaagccatcaacggtccttttacgtcgtcctcccctccggcgccgccactccattccttcgccgttggtactgacgacgccacggcacagttccaacagaagcagcaacaggcggaaaacagagacgacggagcagagcaagcagcggtaaatattcgcgatgatggtgaagccctacacaaaacggcaccgacggcggcaatggtcgcgcgctgtcgcggctctcaaattgtgaccagtactattgtccatccgtcaccggcactcccaccattcgcctctgtgcccaattaccaacacccacaaatgc

SEQ ID NO: 6170 - DNA, 1393 bp, Heterodera glycines
tgggagtgaccaattacccctctaaaccatccaaataacagagtccccagcaaaatgagcaaatgaaaatgcgaaatgaaacaatggaacaaattgaaatgggccaattacgaagcagaaaggtgtgccttcatttaattcgatttcctatcgaaattctaaatcatttccccttttcctccttcacagggttcccattcgagtgccgttttctgtccttcttccgtcgacaattccttcgtttttgccagtcgttcgccttcgctgtgccgtatggacaatgacaacaactgtcactcacatttctccgtgcaaaattcctcctatcaatcggcgcgttcatttgcgacaaaaaccgacggttatagaaacacagggcaaaagcaattggaaatggcgcagagaaacggacagagacggcatttgggcagttcgccaaatttgggtgggcccactttttgaaaattgtccaatatgtcacttgcagtgaatcttacgtttcattcgagcggaggggcagcagaagaaggagtgaaactgcggaagagatcggaatccacggaatgggaggggacagaacgcaagcggaggcccaaaggagcggaggggaggaaaggatatgggaaacggcgatcggaaaccatgggagacgattgggcgggagacgagccggccgaaatgcggtgaataaacagagggatgggaggagagagcggtgatcagtcagtgccaacgattaaagcaaattgtgatcagacaaaggcgggggataaaggcaatgtgattaataatgccaagtcggatatttattcttgctgggccaaagaaggaaggcaggaatttcggagtttaaagccgagtggaatcgattgataaatagggatgcgatttttaggcaaattcctaaaattactgcgcacttgatacgcacagataagcacgaaaaacgcattttccgcttggtttgtggtgtctacgatgaatattataatgcttaatgtgcctatttcgcgatttattgtgcctaaaaatcgcatccctattgataaacatatatttgctgaaccttcatgcgtttttacccgttggacgcttcagtcccaaaggtatttatccatttcagtcccgggtgtgtaacaagggcgtaggcaggggggtggggctgaatgagtcctgccaactcaggcagtcccaatacgtctcccataacaagatgaagaaaatggcacacacattgaaagcttaaaaaataattataaaaaacaaaaaattacgtaaaacctattcaagttccaaatatttgtggtccttatcatgttttttgcgttgccgcgaaccaaaacaataattttttccgggtttaaccatttgtccgaaaaacgtttcccatttc

SEQ ID NO: 6171 - DNA, 2306 bp, Heterodera glycines
ttgctctgtgggtattagtcatagactcgccattctataagcaaatcggtagagaattttgttctctttctgataggcctactcattttttacagaaaaattttcccaaccccctaggaatttttgttcgaaaatttcccagatttcaagccatatggggggggggggttgattggtgcatgacacattttctcgaggacaaaagagttatcggtgtagtttttgggtatttgttagtgcattaattaatgtttcttttagcgtaaataactcttttttcccaccattcatttttgagaaaaccggggttttttttttaaatttttgttccattacttttgcacctgactgtaaatctcaattgaaatttaaatattttcgtttctttttcgcctgaattcgtttgccgaaaacgaacgaaaattaaaaaatgaaatcaaaattaaattttttaatccgataaattttttggacggacgaaaacgaaaattcagaatgtgccgaaaggggacgaaacgaaaacgacacgaaagaaataaagaaaagaatcggaagcgcccagaaaattctcagaaactaggacaaattgtagagttggactaacttctgaaaatttgttcttagtgtgtaagaacgactaataaagagctcactgtcgaaaatcacttaatgtcggaatgacagtaccatggctttggcaatacccaattaaatacggtacatcataatttgtaaaaggtccctgcggcctccaatatccatacttttattagttttatattatttgtgcaaatcattaaaaatgtgatagcatttgcatgatgatcttctctcctataaaaggttgacaaaaacttccggtaacttcagcccactgtgtactgtaatggtcgccttggaattgacgctgaatgccggacagaaaaggccgcggggcatgtttctgtacaaataaggctaattattttttaatttgcaagtttaattttaatcgaagcttcagggaatggggttaactgattttttccattcactttttagaaaaaattcaatttttttttaatttttccgattatccgcaaatgtcccctgcggcaacgttctgccctccccctctgtcttttccccgtccaccgacttaaatgcgtgtacacaaagcggcgtgccattgatggcgaagctgagcgtgccccggtcgcagtccatcgccactccgatcacacttccgcagccgatcaccccgctgctcatccgcccgtggtgagtgtccgcgtggaaaaaccacgagcgctgcccgtccacgtacatactccagccatgcgcatcttttcctgattagacaaaattttaaaatggaaaattagctaattaattaattattttttgtttgtatgtcccattacaatgaccaattagttaattagtcttcgctcctcccatttttggtctcaccgagcatcgcccttcggttgaccggtggctgtgccactccgatcacaacgtctgcgttcccgtcgtaccggtccacgctcgcctcccagtaatgaatgccttgcgaaaaggtcactgtgcccagcacggtacggtagtcaatggacgcgccggttacggtacaacaatcgttggagaaaagcagcagcaaatcgtccccttcagcgattgggagcggggaagaactgcgcatggcaatgccgaggccaacttcagctgaagaagaagcggactcggcagcggtggaggaggaagggacagaggaggaatcatcggggctgagatggaaccaggcaactgaaagagagggacaatttatggggtaaaatgggggggggaggcggattaatcccgaaggctacccgagataaccccaaatgtcgcgccatgttcccgaaagtttcacgaaggcaggggtgttcccttggcacagcaaattcccatacaaatgttattttagaagagaaaatcaaaacttgagcacaaagattgaaaaaagcagacggttaatagtgatttgattatttttcgggtgttttcccatggcaattcgcccccaaaggcgggggtcaaccttttgagctaacaaggacaattttcccgggcagaattctgaatgaaaacgtttttcgggtttctccctgacaaatgagtgctaattgtttcgatcattgcctggggctgtctgcagactgatcagttcgctgtaagggccttcgcccgacccattgaatgccctcactcgcgcactgtacaaagtgttgaaatgcaatccgtccagcgagcacacactttctggtccacaatacacttcc

SEQ ID NO: 6172 - DNA, 2629 bp, Heterodera glycines
  misc_feature (36)..(36): n is a, c, g, or t
atcgaattgttctccgctgaacattcatccgccacnaattggggcgcagaaggcgctgaacaatggaaaatcggcaaatgattcttcggatggcattcattatccatggccgattcggcgcgagagtgccaataaattttcaatttcccggtaaatcaaatatttgggcttaatgaccctgcaatatttcaaaaaaaaaaatcccaaaaaattgtacaaaatatctaaaaattcgaccaaagattatggaaagtgaatttttgtcactcattcgaattggcacgcaaaacgaccctatcaaaacgaaggaagaggaggcatttgggaaaatgggataagctaatggcaaaaacaacttcgaattacctaaaaatgcatttggaggacaccacaaaaactgagactttcttcacaaaacacacgacaaattcttgtcattttccaaatgatttccacaaaattttgtttaaaaattaaaatattaaaaatgaaatttcatttccttggcgtggaaataaacaattggaaatggcatttccatttcctcttgcccacctcctctctcaattggtccggcctcatttttgtgttgcttctctccaatttcttaggtttcaaaatttaattaaaatatttaattaaaataactttttatttatttttttgtttggagagcaattaaacgcaaatggaagcaaaaaacaaaagaaaattgtcgtgagtgactcacctttcaactgaataaattccaactgatcgatggccgtccgaagttgtgccgaatcgatgtcgaattcgaattggacctccacctcgggcttggttctgatctcgcggtgccaaaggaattcctggtcagtcacacgggaggccaacgcgaagccaacctttggaagatcattaaatatacaattaatgtccacccggttctgattactccgatcacctgcaaatacgccgccgggtcggactccttcagaagttcgatgcaaaattggatcagtgccctgttccgaccgagttgtgccgtagaccgtccgatctgttcccgcaactgcgctttcctccgctccttttcccccgcggcgaaatcagtcagctgttgccttcgcagttggagaagggcgatcagttcgtccatctctcgctcaatgcctcggctgaacgcgtcgcaattggcctttaacgtgcaaagcttttcctcattagaacagaaacaagcgaattgttttatggcaccaaaaattcacttccttttttggctttaaacatttccccagaatgaaaaatattgagtttggttaaccatctgctgatgtggcaccacccaccaacattaacattataacattaatcgttaattaccaaatatgcttacgaatatattaagcccaaagaaatgccaaaatcccccccccccccccctctttctctctgatctgccattcccaagtttccatcttttgtctcctacccaacacctacgtcgatttcgttttgcaactgtttcaatgccgtgatgtcttcggtcgcttgtcgcactttggcactgagcatttgcagcgattgggacaattcggtctgaatttaaaaagatgtcttttgcaaattgtccctttcattattatctttcgttcctatatcctttttcatttttttttcattgtaaatccatccaattaatcatccatctttttccccctttttttctgatgagtgtccaatcacaaatttgtcatttgtctttacatttggctcagtttaataatttgtctcccatcattagcaattttttccgttgtcctttttcttccaattgtctttttcgacactttgtccatttgcggtttaattttttttcatttgctttttccttgaacatttgtctgtttttttgttcatttcttaatttgtccctttaccatttttgacttttccttcgcctttcccttcttttgtcctattttgtttgtctccgttccccgctatttgtctgttctttcattttgtcctttttggcaatttgtcccctttttcgactgtttgtccgtttgtccccccggggcggctttttcttttcctcaactttaaatacaaagaacaaaggaatgcctatgacaaacacataaaggacgaaaacgaacactttgaggctattggtcgaccatgaaatgagtctttgtgggcaaataaacaattggcgtcggccgtgggcggcggtcactctttgagggaacggatttaaacgatcggattcaaattaaaaatttattagcatctctcatttgcacttttgctgcttgccaccctcgcaaattgctaataaatgaatcccgtacatttctgccaaagtggcattaattgcttttaaaattggcaactttcttttctcttttttcttttgtttttccctctttcttttctcttttttcttttgtttttccctctttctttctctttcctctttctctttctctctatggcgttctccgttattcattcaaattcattcatttattcgtcggtcattattcaattacattttcccgcactcccaactctcgaggggcgaagaagcagcagagaataaagtgtgccgggggtgggctccatttcgcataacccaaag

SEQ ID NO: 6173 - DNA, 2292 bp, Heterodera glycines
aatcaatttcacattattttggagtttctccggggaatttctcgcaactatcgaatgaacccgtgaatttctgttaatttttacattttttattgttaaaattattgttgaatttatttttaaactgtttattttacattttatgctgaaatttaaaaagttgtttttactgtgatttttcatttttctgtacttggggcccaaacgaccccggggcccaaaaacgagggcccaaaaactggggcccaaacgcccccgactcctttttgagtatttttgcgcagataattatggcacaacccaataatgcttcttcttttttttttgcagattttttgacttaattactcaccctttcctttttatagtcaaattcaacaaaaataataacattttctggcccagaaaatacgcaatgaacgtcgaagaatcgcctcttttgacggagtttaagacctttcttcaggcgactcttgtcgcattcggaagcgacggagcacttttctcactggtcaatcagaaattcaggttcaaaaattggccagccctaaaatcgagtcaatgatttgtcttgtttgattttagcgaggattgggttggctcgccctctctcaaggaatacgcgaccaaattgggtttcgccggttcaaaaggcatcctcaaattgctgcagtccattcccgaccaggtcattgagcagtgcgttatggtctctaatcgctgcaataatttacatgtgatcattttgaaggtgtcaattttggtgaatccgaccggagaagtgattttgaagcccgtccctatggaggagacgcgcgacaatctggccaaaattgacgcgaccaacagagagctcaaagcgtgtgttatttgtttgggacagctaacttcctaccggctttcctcccccccccccacccctcccgcactcgaaaattttaaaattacataggttttattttaaaaaaagtttgaagaaatctaaacctccattttggaaaatcagctttgttttccttttgaaaaatctgtttgttctttttcgatttttggtgaatttttttaaaataaagtttcgaattttggtttaattcgggccctgggttcgaaattgatgacgcattcgtgatcagcgatcccgaaaactaaatattgtttttttttgtttaattgaaaaaaatataaaaaatgtggggcctaaacggaatgagagccagaaaattctatgtgtttgaatttctcaatccaacagtttatttatgaaatttttcttcgaatttcaaactcatgctttgctaacaaacgtcctttgctttgcagtgagaaaatgcgacgccaacaattccatgggcctcttccggcggctgtcactgcgcaattggccgctgcgatgatgccgggttggccacccaagtgccggtgcatccgttggcctcagttttcaatgcgagcatcaaacgcaccgcaacgactccgtccaatgctggacttttcccagcaccggcgaagaagaaaatcaatcccaatttgattccacttgaaccgactcgtattgcacagtgtgacagtaccaataacatcgtggacaatggcaatgccaataaagtcaccagcggtgtcagttgcagtgccagcaaaattaccaacaatgccaatggaaatgccagcaaagttcccagcggtgccaataaaatcaccaacaatgccaatggaaatgccagcaaagttcccagcgcttccaatcgaagtcccagcaaagttaccagcggtgccaataaaatcaccaacaatgccaatggaaatgccagcaaaagcggtgctaatggaagggccaataaagtcacaaacggtgccaatgctagtgccggcaaagttcccagcgcttccaatcgaagacccagcaaagttaccagcggtgccaatataattaccaacagtaccaatggaagtgccaaaattgcgcgaaatgccggtgctattgggacaaacggttcgacggcggtgacacgaacgacgagcgcaactgagcaacggcagcagaacatcaagatcaggaaagtgagctttgagaaggcgatgagatacatggagagggaggcgtggaagcaagcggagaagcgaagcgagtgagcgattaataggcttttcatttgaaaatgatacctttgggtggggagaacccaattggaaccaaccttcataaactatgattggacttacaaaaaaatgattggactcataaaatgcattagagccgcgcttttttatcccttaaatgaagcttttacatat

SEQ ID NO: 6174 - DNA, 4588 bp, Heterodera glycines
ttttccgggtcagcgagcgcgcgtctaactgttacggcgtcgctctgttgccgtgccttacaggcatttgccattcgcctaatttattcgcccataaaacataaaatataagtggtaccaattcaggcagaggcgtggacccatcaatgtttttgaccgcccattcgccttcggcaacttcgctgttccgtccttccacgtccgctcccgccaaagcagtgtccccgtcaccacgaacgcaggcacaagagccgaagcaacagccaaatgtaaaatttacagtattaaaccgtgagcaagggcgctaggcttttaaaaattttgctttttcaatgttttagttttcaaaattaacgaaattgcctccaaccccgagattgacccccccccccccctctgactcctcaagctttgtctttcatataaaacataatttttttgtccatttatcattttggcttttcagcttcctcccaataacaatgctcattgtcagctgactcagttcggtgagcagaaaattgactctgttctgaggtttgtatttccgttgcattgttttccgacactaactgacttatgtttggcttttcctctttagctcttacgccgttttgttggattcgctgaaggaagcgccgctttctccgccgttcagtgtcgatcagttggttctgttccgtcctgcaaaactcggcctgtgtcatggtaaaattgtgcgccaggacaaccaacatttggtcgtgaagcatttggacactcagaaagaacattttgtcaacattgatgctgtttacgcatttcccagccaacttttgaaggcaattctttgctgcttttgggggttttagccaaggccctcactttttaggagcactcggcaaagccccgttcgtgcagcaaaatggcatgtcatcccggcactcaattcaatttcattgtaccctttaatggtcaacagttccgctgtttttgatgcgacaatatgaagattctcagatttttcaataaccattttttactggtttatatttatttacgaacattcacaaatacaatttcttatcctttctttcatatttatttttaataaattacaaaataagttgctattaaaatctttttgaaaacaattattggcaagtaattaattttaaaaaagtgaaagaatgaatcccgttttttccttacatcgccctgagttttgccggacagaaactcgccctcgagttgttctccaacaacgttttgtagcgtttttgtatggcgtaagcgcccaatttcggcttcctttcccttgtcaacactcctttatggttgccgatcgcccgactaacggctaaagtgggaaatggcaatgattaataatgttgcactatttggctgacatggagcggttataaaatccgcgaagttccacagcatttccccggcgatgtcttcagagaatcgcaactcgtccaccgctttgcccgtctcctggatcagttccgcctggtactgttcggaaaagggcacgctcggctgctgcaataaataaatgttcacttaacccgtccttgggcagtgtctttggccacctcattaaagccgctaattgcttcggcgccgtactcactcaaaatcaccggtttggtgtaattgtgacgccattttcgaaattgatcgaccaaaaaagaattgcattacttaatgcaccgaaattgccaaccaaccaattggtcgcggatcagtcccaacatgccaatgtttctgtaccaacctcaaattgaaaaagtaacaattgcaaaatgaacaaatcattgaaaaatgccaccaaaatattccttgacacaaatgacgtccaaaagtgacgcctcaaagcaaaaggaattattggcaccagcgaaagtgccttttttgtcacctcaccactttaacggccgccgacgcgtggccaaaaacaacggtgaccggcctcgtggcgtccaattgtttggtcaaagtgaccaaattccttgtcgtcagaatgtttctcaaaattgaaaatgtcccatgcctttacttgaaatatttgtaaggtgtcgagtcggcgggcattttcggctcatttgacagtgaccacattatgacggacggatggtttcggtcgcggctgaccatttccgcgatcatttccccgtgcagtttcagcaatgccgaggagttgagcttcctaaaaacggacagaattcgttcaaaaaaatgggcattttgttgtttgggatccccgaaaaagccgaaaaatggtcgttggacgtcctttgcccatcccccgcgacggcaccttcgcctcaccaaattccaacggccggcacttccgtaatgaccgcaattccccgccggtccgcccagtacgctctctcttccgcgtaagggtaatgacttgtgcgatagcaattgccgttcaaccactcgaacatgttcatgtccttcaccatcgccgcccggtcaaaacctctgccgtgaatctgaagagaaatgaaaaaacaattagcaatgaaattcaaaaatacaggggaaatgaaaattaaagatcttaatttgcaaatctcagactttatgacttcaaatttgttcactttgttccttcccctctttttactttggacgaatacccaactcatactgttaaaaaaaaattctttttgctaaagttgaaaaagttatggacaaatctttgacgaaagttgcgacgcccttttgccgattaacagtacgcctcggggcagtacgagttggatttttaccttttattctacccccccccctccctttttgtttattttttgtttggcatggcatttggtcaattcgtactccgatgtcctcgtgcattccgaatccatgacagtaaaatggtcgcccattgatgtaaattctgttttggtccacagttactgtccgaaagccaaaagtctctgataaataagggaaaaaatgattgacatggacaacgaatggcacctctgtaaacatccgacaacaaatatttggaactgacgtaagaaagagactcgagacgaaccttaagacatggaaatttcaaaaaaatgcaaaaaaggaggaaatttgttaattgttttacttcggcggtgtaaagggtcggtttgcccattccccgcggccaccaaaggtcaattttggcaaaagttgtcgaattttggctcccgaaaaattcgtaaattttctttgctcccttagattgtaaaatgaggacacgaattcgaatgtcctctgcggggtgagcgtcgcgggcgacgtcaattcggtaagaaaatgagcctaaagtagtgaaactgagatgaaaagcaggaaaatttgaatatggagaaatgaaattagggcaccattcagacaattcaaaaaacaaaaaaagcaattttcgaattattttaaaaaagggatggataagttgcttccatagtgatcccgatagtgaaaagataattacccaaatggtcagtccgaatttgtatgccacgaataaaaattggcgccaaatgccaaaggtaaacggagcgaagaatgccggcgtaattgaaaaagtcgaaagagggcaccacactgactaactcacgacccgatgacctaaagttggtggaatgattggcgaacaaatgctttgaaattggctatttttaaaaattatttttgaaaaatcccccaaaagtgaccgttttcccatgactcacagttttatggtggcgaaatcgccgggcggaattgtgtcatgtgacaaagtgttgttgaccgccaccgaaatgaggttgacatcgacgagttcgacttcgacttggaatggcaaatgcccgccacaatgttccgtcaccaattttccatttacaaactgaaaactgcgacaaatttcacaaatgtccaacaaagtcctaccacaaaagcgtaataattgacactttcaaaacgcaaaaatgatcttcttccgttgggtgacgcgtcccgcaaaaaatgagacaaaaagtatttgcgttggtaccacacccatccgacatggtcgcgctgctcactgtccgccgtcaaatcgttgaaagccgaagggacgggaatttgtgaagaattctgcaccaaacattcagaacagacacttttttgggctgccaaaacaattcattgccttggtgtggctcagctgacctcaaacagggccaattccaacgaagcccattggttttggagaccaatcccgacactattcgggggctctctcacaaaggtccacaaaccgtcgagactatccaattgccggcgttcattttgctgggaaaagatatttaagcattgaaataatttaatatgtaaaaattactcacaacagcaaataaagcatatccgtaattagttgcataaatcagcacaaaaatgaaaaagaaattcagaaaaaatccattattggataaagtgagcataatattagggctgagattatttatttatttattcaagtaataaaagtccaaaagaaaggacaaaggccgcttatattttcggagaatatgatagtccgggaaacatgatgatgtcagatctcctacattaaattaatcttgta

SEQ ID NO: 6175 - DNA, 6210 bp, Heterodera glycines
aattggcgcagacggcgaaaaatgacagtgttcaaaaacatcacacaaatggagtggcggagcattgcccaaatgttgagcaaaacaaagtccaaaatgcaaacattttcagtgctaatgtacaaatcgatcgtacaaacggcgaaaatacgacgaaaacggcggagaaatgcgacgacattttgatcgatgtaactgaaaacaaaaatgtatacgaaaaattgcaaattaatcagttttttacatgatatgaatgtctcggaatccgatgactttgttaggcaacggattttgcgggattggcaatggatttccatcggaattgacaatttgcattttcttcgtcccattttcttgaatgtcccattggataagaaattgtttgttcaatttccatttgcgcgtcttgaaatgttcgtccacgtaaatgtcaaagcgatggctaatcagtgcaatttcgaggccaagttgagaaggcgcaagaaaatcgaacaccaaaagccaacagtcgctgcagataaagctgaaaattgaaaaaaattttcgaaatattaaaatttttgtttttatttacatttcttttttgtgagggcgtcgtcgttttttggcattgtccaaaaagaagcaaaaaagaatggtggcacaatcgaccaatagaagaaacacggtagacacactgaaaataaattggggaaatgaatgaatgaattaattaagaaaaggaaaagcatcaaagcgagggaattgaaattgaatttttagcctccaaaaagctaatctttcaaaaatgcttttgaaatttgcatctcccaattctggtcaaaagtgaagcaaaagaaaatgcgaaatgtcagaaaagaaagaaataataaacgtacagaatttctgaagacatttgcggaacagaatgaccggaaaatagagggaaaataatgagagaatggaatgaggaggaggaaaagaaaaaagtgcatttttatactaaaaatatttgcatagcaattcggggagggaaaagtcggcgtttttacgcagttttgtttctttgtggttttataattttttgaaattttctggcaaatcgaaaacacttagacctatcaatttgttttaagaatattttacgggtttgaccgttctaaaagcttaggagtccccattttgaccattttacattttaatccgggccaaaaacaattcaataggcttaaacattacaatggattttaaaagtatattgtattcctcgctcgagagtctcgggaaattttctgtctcaagcagcactagtgcgggcagagatgggcgaagctcggcttagcactcgaagccaaaggcaaagcccaatttttttcgaagcacgaagttcggtccaaaaaaaaaaccgaagctttcgaagctcgcagtttcgcccacccctggtgcgggggcctcgaatttcagaaataaacacatttggaagttaaaattaaagatgagaagctaaactaatctcgtttatttcagagaagagattcctttcaaatctcacaatcaaggcatttaaaacttttaacaattttatttattttttggctaacaattgtttattaaagaattttttgttgttttttaagcaatgtgccaaactttaaaaaaaaaattctcagtgacgaactgaacagtaacgaaacgatcagtgacgaaatgagcggccaccttttagttgaaaagcgtcaaaaattaattaaaaaattgaacatttttgggaacattttgccaagaatttgattgcaaaaaaaaagaacttttgtaaaaaaaattcaaaaaatttcaaaaatcgccaaaatatgtgccaaaaactaccaaaagcccaaaatatgtttttattcgccaaaagcacaaaatatgtttttgtaaaaacatataaatcagttccctggacatatgtatgaaatagtacgccaaaatacgaattttttcactctgcgttctttatttatttggttcaactaaaattttatataaataatcggaaaatgctcaaatttgtcatcatttttcctcgtcttcttttaaaccgcgaacgaatttgtgttccttcacttctaattacatttttaatcactattttaccttttatgtacacgtgtttattgctctgattccatcatgataaacattttagcaaaagataattttattttatttatttttaaattttgttttaaatgccttcaaaacgttgaacatctgtatgaagagactcctgaacaactaaatgaagggatttcttggaccatacccaattgtgtgatactttacaccattattgcaaatttaactttttttcacctttccaaacagtttcatttttcttttccatgtcatcaatccttcaaccttttcttttcatcttttcattttagttcagtcgaaaattctaactttattatttcaattccccgatttttccagcatttcctccaattcccattatttccttttttcagttcagctatttttgctcctgaaaatcttacggtttcatcgaattgaaaaaaacctgacaaaaatcgttttcatgaataaatttttcgggtttgatggaatgcttcctgtttgtaactattaaaacttggttttaacgaattttggaaaataaaattattgtaggttggtgcaacgaatatattgtatacaaataaactacatacacctcaattatgtttaaccgaacgacttttgttcacccagcatataagtagcaccagaaggatgacattcaaactcttttttggactcattgttttatggattaacgtgaaaatttaggtccaatcggtgaaattttagagatttttgaattttttcatttcagggatgctttctaagttacctaagtttcatactttttagctgtttaaatattcttgatcaaaaagtgtgaaaaaataaagaaaactcagattttctaaatcaaaaatttttattttaaattattcaaaaaacttaaaatggcataaaaagcattccttaataggaaatagtttaaattttgtgaaaatttcgccgattttacctagattttcacgtcttaaccaaacaaaggagtccgaataaaaaaaaacgaggtagaaaaataaaaaggagttgaatcaaatattcgataaaacgaattgagcaaaaacgaattgaccagaaaatgaaattatcgaatctccttaattcaccaatgtttgacactctccggattacagatgttcaacgttgtcgggcaattgaccagagaaaatattgcgaaaatgtcacttaatcacttaccggattcagaaaaatttaaataattctcaagaaaactacagtaagcataaatggaatcggagcaatatccatatgtaatatagctttaaccctattgcgctaaagatttgctcctgagatagtctaaatggaaaacagcaacagcaacaacaatgaacttattggaggtggtggcaggttggcagttccggaacgaaatgtcgccttagaacaagatggagaagccgaggccgatgcggggagggaggcggataaagcggaggatgacgacgacgacggtgacgacgactactcgccgttcgctggggacaacatttttttgccagcccactggaagcctaatttctgggcccgccagttcactctggaggtgaaacagtagatgaaacattggcgcaataaaaaagctgttctcctcagacgttctgcacattgcacctggaggtcatgggacttcggaacaccatggccggcacattgagggactgtgagatgacagttggcaatttccatccaatgccacccgaagaagtgcccggcgcaatgcagcagttcgtcgcctggttcaaccacgagctggcttccgcgtcgtcatctgccgctgaattcgcagcgcgggctcagcacacgcttgtgagtagaataaattaaaaggccgatggtaattagtagggctacgatttttagttgctaaaaactgtgaaaatagttgcaaaagactttcaaatttagcgtgtaaaatcacaaaaattttatccaaaaaggaataaaaatagccaaatcagtattgagataaatcattttaaaactacaaattcttgtaaagaataattttaaaaattaatttcttaggggtgtattttcgcttttattgcgtttttgtttatatttttggaaaaaacgccaaaataatttttaaaaatttttttcaaattttcgtttgattttttcggttttgttcttaaaaacaaaaacctagaaaaatagttcgtaataactcgagaaccagtttaacaacaaccgaaaaaaacatgtttttcagtgaacaggacaaaatcacgccgccaaaatccgccgggaaaaaatcccacccccaaaatcgcgctgggacaaaatcacgccgccaaaagccacggggagctcaggaaaatattgaaaaaaactaaaaatcgtagcctcatatatcatcattttgacaaaaattgcctaaggacaaaacgccaaaaaaccccactaatttaaaaattttgccgagattttcccttgattcatccgttttacgacggcaatggaaggacctcacgcctgctgatgaacctcatcatgctgcgccgtggataccacccggtcatcctgcccgagaaaaaacgtgatgaatattacacgtggctggaggaagcttcagacaacaacaacattgagccattcataaagttcatcagcttccaccagcaatgtgctcaagacctggagcccgcgtcctccctcccctcatcctcatcctaattttcaatcactaacccatattatattgtacttatatgtgtatatattaggtatatttgagaaatgatcttcaatctcaccaattggaatttgatttgatgctctcattttctctcagactcactttttgttgaataattcattcgttcgaatatacaaataaatattcattgaattctatttttaaaaatttctatgaaatttttaattatgcttatattttaaaaagatttagcgaactcactaactctcatatttaaacgcttatttacctattttgaaaatttttaaaattctgagttttccagttgtttatacatatatatatgattttagtttttgaaaaaaatttcaaactatttttcgcatattttgccatttaacctccaatttattaacatttacaccaatttacgcgatttctccataaaatactatcactgctgaattatgatcgatcatttctcatttaattcacttcctttgctgatcatcagtgatcactgttgttgttctctggcggagaaaaaggcctaaattaagtgcaatttgaatttaaaaaaaataaatgcttcttttgttattcacccaatgcaaatattgacatcgtgaatcccaatgtgcacattgttcaaattgctcgaatttacttcttcgccttcccactgaatcgccgccgtcgtctccccattttggcaccgtttcattatccatcggtcgacccattcatcttcgcttgctttgatcaatatcagcttttcattggttcgtccgttcaccaattcaaatggctcaagcagcgaatggtcgggcaacggaaatggcactgaattgtcttcgtcgataatcacggctaatttcggcattgctgcaacagcacctttgcaaattttgattgttctcaaaattggaaattctgattggccatcgaaatgtttgtccaccaacgcatcaaaacgtggcgaaagaagtgccattttgaggccgagttggggacggtcaaaagatgggagaatgtccatccaaacgtacctaattttttttctacaaaaccatttactaagtttttaatttgagaaagaaatctttgtttatttgttaattatatttttttgctaataaataatcgtccctttttgtatagacggtttttcctgacaccactcaacgttataacaacattttttttatattattcttcatcttttatatcttttatccttctttgaaggtctttttcttttttaacagatttaatctgaaatttttttaaatgttgtagcaacaacaaggccaaatttcttgaaaatgagaatgaaacataacaaaaaaacattttttaatatataatttattctttaagtaacataataaaaaatgaatatatttattttaaattta

SEQ ID NO: 6176 - DNA, 2283 bp, Heterodera glycines
ctttctggtcctcttccactttctcttacacttcctttaacacgttctgtttctcttccactttctgtttctcttccactttctgttcctcttccactttctgttcctcttccactttctcttccactttctgttcctcttccactttctcttacactttctcttccactttctgttcctcttccactttctggtcctcttccactttctcttcctcttccactttctcttccactttctgttcctcttccactttctcttccactttctgttcctcttccactttctcttccactttctcttccactttctgttcctcatccactttttcttccactttctgttcctcttccacttcctcttccactttctcttccactttctcttccactttctgttcctcttccactttctcttccactttctgttcctcttccactttctcttccactttctcttccactttctgttcctcttccactttctcttccactttctgttcctcttccactttctcttccactttctcttccactttctgttcctcttccactttctcttccactttctgttcctctttctcttccactttctgttcctcttccactttctcttccactttctgttcctcttccactttctgttcctcccgtacccggtttaaaaacttggacccggacccggctttcctggacccggaaaaatacgttcaaaaaagggcaatcccaaaaaagtgctatttttgagtcatttttcgaacacagttcgaacagttctgaaaattttggaaaactgatatttttcccttatagcccttgcaaaactgcgtcgattgacaccacacccaccccctaactctcaaaaagactcgagattttcatttttatgcttggatcatgggtataaatttcttatatagggaaagttgagtgtttgtatgtatgtatctgctatcgtttgaattggcgtggcgttttgttattcttttgccttaaaaaatgatttgaaaaatgaaaagtttgttttgcctttttttcattttggttttgtttatgtaatttatttgcttttgatttgtattttatgtgttattttttgttatttgtaagaaaaagtttgtttttcgtttgtgtaaatgattatgtaaagaaaaaagcatttttctttttgtatctgcctatttttagattacttttcatgattcctatttctcaaattttgtttgttgttttgaatttgatatttgcatgaaccaagtattttgcttttatttatgcttaatgtttaatttataattatgttttgctttttgtttatttgttatttagccaaattgtattggttttaaactgcaggttttattgtattatgtgcctctcatccttgagacacaaaagtggaatttatcaaaaagttaatttaaatgtattgttttgagatgtacactactgtgtctctaatgtttttgagaccacacaagtgttgaattttgtcaaaaagaattcttttttgtattgttttgagatgtacactactgtctctcaaaaaagatcaattgatggctaataaatggctgataattggattttgaattagcagcaaaccctgccggatcctcgtgataagagaaagatggaatgatcactgatcagcagaagaagcgaaatgatcgctgattttggacagattaacatttcgaagattttatagttttaaaactttcattttgcttttagaattatttcttgttggaactccaattttaatcttcttccttttcccaaaatttagctagaatgacggaataattagtttttttttttggtctaagagttttttaaaggaacaaattttttcctgacttcacataaaatttgaaaatgaagacacaaatgcgtcaaaataaacagaaaatttctaattttaaagtttaatattttaaattagagtgccacggtaccgggaattttgggcaaatccgggaccttttcagattggaatatcaggaattcttggctgagaaaccctatgactattattcagttacggacataatcgatattaagaaacttttttgtccaataccataatttaatttaaattacataatttatttattattataaaacaaacactcttttaaatgaattaaaaacattaaaaatatcccaccaaatgtatacaaaatattgtacaccgcccggatccgaacttcccccccccctcaaaatgatgcctcagaatccccaatcacacagggattctgagggctgaacgatgtca

SEQ ID NO: 6177 - DNA, 2643 bp, Heterodera glycines
aagaaaaatcaattaataaaattaatttttttttttatttattcggataactcaactttaattctttgaagccttccaaaaatattaattaaatttaaaattccgcattaattacttaaatttccaatttttgtaggtcggctcttgtcgacagtgacgaattcccattcgcattgaaatatttacatttatgttaaaaataaaataaaaatacccattttgatataaaaatgcatttctggcaatctttcagatttaaatcatattttggataattttgtgaatagtctatgccagggtttttgcgaatcgaaacataaaatacgaaaaagacgaaacaaaaataaatacccaaagctgaaatgcgaaatgcgaacacgaaacgcactaaaaacaacgaaaatgcgaaacgcaaaacacgaaataatcaacgtccctggtatatgcccctggcattttatttatgaaattatgcatttaaattaatattttagtgttctcagcaatactctcgaatgaatgggagtttaaaatttaaactagggttgggcccccgaccgtcggggttggaaaactcggggttcggggtcgtcggggttggaagcgtcggggttcgggtcggggtcgaccaaatcgttcggggtcggtgttcggggtttttcaatttttttcttccattttttaaaatttatacaagcaaatgattcaaaattaaattcttaatcatcaataatcaattcattttcataataaatgagatcggtaggatcaggttaaattggaggtgccagctttatatcatccatatttgccttaactactaacatctgtcgcactgtttttccggaaagtctaagatataattatttttaatttgttttacgatcaaataaaccaattcacctgtttctcaaactatttgcataaattagtccagccttgctaaaaagtctctcgctgcacacggaggttgctggaattgaatgcacaatttgagcaatttttgccaactcaggaaagcgaggtccgttttccctccaccacataaatatgtccgcatcaattccaaatcgttaaacatctttgtaaagcgctaattgagcttcgattttggtgccaacggcggggacaggttctccagaaagtgtcgatggtgtaatttatgaacagcaaggagattttgggttactgttccaaatgtccactaaaatttttattacaaattaaagttttatattcaattaatggtttacattttaacgcactctcgtcgctttcactaaaatccgtaaattgagccaattctgattgatccaaaattctgtttaaaattgtttaaattactttcctttgcaaaatcaattaaatcctcttcaattgatttccagaaaccacccataaataaattcagatcatatgcaaaatgggggtccaacaacattgaaattcgcaataattcattttctctgtaattgtgcattcgtgagccaatagattcagcgagactctgcgcaattaacctaatttgttgtggatgttcttctttggttaaaaaatcaaaaagcctttttagagttggcaaaatgcaagaacaagttgacttttgacgtgaaaacttaaaatgagaaatataaataaattgttattactctttccgtttctctgttaaacagctccaacaaaggacaaagttggcgcagaaatataaaatcaatctgaattagcggcggtaaatgatcagagacaaaatcgagcagtgaacgctttgcttatgaaccaaggaaatgaaattcagtgcgttctgcttccattgaaagtaacggtttttctggcgacgaaaaacatcgagcatttgatacacggaattccatcttgttataactgactgttaaaattgtaaaaaaaaaattataacctggaccagttttattttctcaacattttatttttcttggtggcgtttcaaacatcaaatcccttccttgtcaggcaaaattttacccattcgtgtactttgtccgtaagttccttgatttggcccaatttcagtacatcatgaaccacaagatgtaaaaaatgaaccacacattgatgacttaaattttgaatcattttcgttttataaaatgttttaccttgattttcctaagaccctagccattcgctgcatgttttttgcgtcatcacggacaatggaaattaatttcacaatttttaatccgttttcatcaagtgcattataaattgagtctgcaatgtcgttgcctgaatgtgattcgataggaatggcgtccaaaacaaaatcgtttcgattgaattcattgttagtatgatggacagcaatgctataagtagtcaattaaatacgaaataacgagaacttaaaaccttcataatgaaggagttgaagtcggtttgccattttcggtagaacaatttgtcggaaatgtttcctttgatggagctacattgataacaacctatttttatgtaaaatgccatttcttcaatctttcggttttgaaaatatttggataatctgtgaacagtatatgtatgctctttggcgtttttatttattaaattatgttttaaaattaatattttcttttttttaaattaaaaattatgcattaaaattaa

SEQ ID NO: 6178 - DNA, 2134 bp, Heterodera glycines
ttttgagtaattgaaatttcaaaattaaacatttaacttttgtttgttggtcaattcataaaatgttttcaaaatataatcatcatcattatgattttttcatattttgtgttcttccctgcagcttctgagaatcaccttattcagcaaattatcttgtgattatttttgaattttggttgtcgtagaaaaatgacggaaatcatttgaaaatggcaaaattaaatttgcattagcataaccttttgcatcattcatagtcaatttttggggaataaaatcggatatttaaagcggagaatttatttttttaccattcacttttaaaaattgtttattaattttatatttattagtataaaattttctccatttgatttgagctttcgagaactttatacttcctcttttagcaatttcagtttttttaaaaacgaaaaaaacacacacagcgagaatcgacctaaaaattttccaaaaatacaccaacttaaaaatggaaatttttaatttgtatccctcgtcatttaatttttcttcaataaagttttattttttaaaattcttattcgtttataagaataaaatcgttaataagaattttaattaatatcattgggcttattttatctattttataatatttagtaactgttttgccactttcttacgttttttacctaaaaagcatagcttaataataagacaaataaatctgccaataataataataataataaataataataaaatttctaataaaattgattaatttcaacaattatttccgtaaacaaaaatttgtacatttttattaatatatccgtctgtatcttttagcataataataattattattcatttttctaaaataaaatggcattattcttcgcttcttcaattttatttctcggatttttttggctttttgccaacatttcgcttttttgttctgcgccaaatccaataacaaatttggctataaaccaaggtttggcatagcggtttcattgctaaaattaaaaagtcatttttaaaaaggtccaacattttttggaaaatcgccaaaattttcggttcaaatgaaatcggaagaacaaaaaagccattccaatatgatcaaaaatgtgatgaatcgtcgtcatggctcagcacattcaccaatggaaattggtaaaagaaaataaaataaatatatttattaataaacaaattctagcaattgaaaagccgataaaagcaatagaaaagaatattattagaccaaaaattgaaataaatttggaaaatgaattggatggacaaagcgccacaaactcaaacatttcgccaaatttcaaatgccctatcaacgaatatttggccgctgttgtggcttatcacggcttttactacaaagtgcccgcgaaaacaatcgcaaaaattgcaatgaatttgatttttgctgttctgttctcccaaaattggtccaccaaacagcaacagaattctgatcagccaatttttgatggcattttgatatttgaccatttttcggtgatccgtcaaaatgaatttgaatttggcgccgaagaattggcgggaaatttgaaaattgaatttaacggaacggtggaaaaagtcaaagactcacgggaaagaacacttccatcagaacagagatcgaaaaagcagatgatttggctgaaagatgtgctgtttatgagtccagagcaaataaaagtttgtcattaattgcttaattacccatttaattacccaattaaataaataaaattaaataattcaggataaaagaagcacaacaaccggcaaagacttggtgtggttcgttggtttgctgctctaccgaatgttgttcaacaacaaacaccccatggacaattgggagccaaagcgccgtttggacatggaattcatggccaagatgggcttctccaagttgaaccagttcaattgcatgtacaaaacggacgattttgtgacgggagactttggcatcgttccattgaagccgaaaagtcggtggatttggatgccggagagtgagcgagatgaaactggggaaatggcactggtggaggaacggattggcatggaacaggtggctgccaattaaaatgtctaaatggtg

SEQ ID NO: 6179 - DNA, 1525 bp, Heterodera glycines
  misc_feature (28)..(28): n is a, c, g, or t
  misc_feature (62)..(62): n is a, c, g, or t
tgcagaccaatcaaaaaatgcattcaanttattcaagatttgctggtgatgaagagtatacngcgcctcagaaaaaactgtttgatctgaccaaagtaattataattaattaattattcaacaaaattatttaattttaatttgttttgctttaattaattgatattgcatttatttttatttaaaattaatattttagatgtgccttcatacatttcctgagcatcgaatctcgcctaatttccttgagcaaatccttgttttgatttcaaactggcagatgtattgtgattaattgtcgaaagcattgcttcgttctaattagccaaaatgatttgataattcatattattgttgtaccggattgtttttaaataaaaatattttaattagaatgactctttcaaaaagattatttcccaaaaatgttgtttaaattaggatttgaacgctatcgcacaataattactttgattttttaccgttttcaacgatgttcatgtttttattataataaatctgagttttcaaatagtgttgattaatctcgtaaaatccgctaccatctgccataacttatataaaatttgataactttatttgaatttttgcttagaatgactctttcaaaaagttatttcccacaaaatattataaaatatacaaattaatcttttgaatatatttaaatttgataattttatttgaatttttgcaggctatcagagaaaattctgggatatcgaacaataacaagaatatgaaattttgttacttttcaacaaaattaggccatatttactgaaaaaatagctaataatatcgaagttcatgtttagttaatggtattttgggtccctgttttttagaaaatgatcaatttttgaatttttacgaaataattcaaaaaatatcgaactatagggaacagcctgtcaacactaatattaggttctgctgtttaatattagaaaaataaattaaatataatgggaccatcgcacggctgccaattaaaattaatcggaatcattttcaagttttacaaatattattaatttttgaaatattttttacttgtttcaaaaaaaatgactacatcaatttcgctagtaataattcgaaatttaaaaatccaaaaataaataaacaaataaatgttaaattaaattaaatcagctactatctgcttgtcaatgtattctgattccaaattgacaaaatcacgttgattggcctcatctattgcttgggataaattgtttctggcgaaatgtttttgaattttttgttccgccaaattcaaattggcaccgcctctccgtccaccgcccaaaccaatgaatttgtaactgttcacaatcacttcgtccaactcctgcttcaatttgttgtcattctgctgtaaatgccctccgacattgtgttgttggctttgaatttggatgtcattcatctttttgacaccgacaagccaagttttgcagaaaatttttgatgaactaaatgggaaaatgcaaaatat

SEQ ID NO: 6180 - DNA, 921 bp, Heterodera glycines
acagccacagccgctgcaacaaccccttcctgcttctgccgtcgaagaagaaatgcccactattcctccgcctaggcgggggaccaaacgccactaccccgtaaatggtgagaatgatgatcaggtgcgcataagaaaacgcgtgaggcaagcgagaagtgtgagagtacagtactcgcccaaaccgggcccatcaacatctgcagtagataatattcccaatcaaattatcgattgattttttcgatcgataatttgatcgccgattttttttctctgcccccccccccttcccaagcccaaacctatgggatggtgtcgagagagaaaataatgactgagggagtgagagagggagaatagtgagagagagaaaaaaaaacagtgaaggagagaagtgcagaaagagagagaaaaatagtgattgagagagaaaataaacgcgggagagagaaagagagagaagaaatagtgatagagtgagagtaagaaattgcgagggagagagagtgtgagagagaaaagaaatggcgagaaagagagagagagaacagaaatggcgagggagagagagagagagagagagaggataaatggctagagatagagaataaatggcgtggggtaaagagtgtgatatagagaggagaaatggtgagagagaggagagggagaaaaagtgagagggaagatgagaaaaaatataaaaataaatggaattaaagttagagaaatagagaaaaaagtagccattaaaattattagatatatagtattcttttttgctcaataaaaaattaaaaaattatgattaattgtagcatcaaaatatttatgtattataattttgttttttgttttttttaaatcttatttatgtcaatttatttatttatttttcacgttatatacatattaacc

SEQ ID NO: 6181 - DNA, 5254 bp, Heterodera glycines
cgctaattgtgaacagggtgagaattcctttgcatatttctgcttattcattaattagttaattaattactcaatttccccaaaaagttctcttcgccgcttccgtcctctccgttttgtgctctcttctcgcactttcaatcgtttgtccttcctccctttgcccggcaatttggtccattctctcccccgccgtccgttgtccctccgtcgtggagaggacgaaaatattcaatttgccgatggattgaatgtgttggcattggactttcattcgtcgaatttggaaaatggaaaaggcgaagaaaacacttttgtacattgaatttgatgatttgttgctgatgatagcattagaggtgaaaacagcgaaatgtctgataataaacaaaatgaaaatgttattaattaatgcaaatggcacttttgtcgaaaaatgccaaattctgttaattgaccatttaaataataaaaggcctccgcttcagatgaatgtcaattctatgcgcttcgttctccaccggcacaccaacaacactcagccgacgccgtttccgctcagtttccaattgatcgttaacagttcgacgccgttggaaccgattggccatgcgagtgtcgccaggcggaacaatggtaaagcaatggatggaaggcagcgaaaagtggcactttatagccaccaattaaaatttttttttctttaagtctggcattcccttaaatgttttttatcccctcgctttttgacaaaaagtttaatagtgcagtcaaattcgacttgtttttaccgttacccacaaaatacccccccccccccccttccgccgccgccaaaggacaaagatcgaaaaagctttcaagcgctgactgtttttcccatcgcaaataatttaatgcctcggacttttccgatcgtaatcaaaaaactaaaaaatattatgatatattttttcgcaattaatttaatccccgttgggcttttccgagcgtaatcagaagcaaaaaaatattctaatacattttttatttgtgctgttaatttaaattgttttattcgtgattataattattttgttttttaatatgctgattttgattggactcattgtcattgcgttcttttgtttttgttttttgtctgctctgatggtcacacgtggtacaaaaaaaatttattattattattatctataatgatgatgatgatgattccttatttaagttcgctcgcactctgcctcggcatatgagcgctttcgccgtgtttcgcaaactgccaatcgtgcacatgcaattgacattgaagagcaccacacaagtgtcggattgaacccggtgcgtggacgttttccaattgacgacgaaatgctgttgtcaatgtttcgccgcttggtgagtttaacttaattcttatttaaggtttatgtttttttttgacaaaacaaatcatttttaaatcgtatttagtaacagtaaattataatttgaggcttttttcgaatttatttgttacgaaaatttggccactgatttttagacaataaatttaattgaatagaaaactaaacaaaaaaaattttaaaattgatgtttgcttattcattcctgttcacattttttcagaacaatctcacgcgcacggttgaatgtataaaaattggcctccagtccattctcatcactcagcgtttgaatagctgggatttggatcactgcagcgaaggaattttcgtgtatgatggtttactggcggaacatttggcgaaaaatgactgtaataataataaaacaaaataaatatttattattttttaaaaaaggttttgtgtcggtccgttgtctgttacctgccaactgtgcctttggcttgttttacttcgaagttaccattctgcgcatggaatcgtgaattaaaaaaaaatgttttgaaaaattttgatcatattaagtgatgttggagtgggactggcacccgagcatatgttgatgcatgaattggtcgggcattttgagtccagcattgcgctgtgggctgatgggtctatccactgtaatttgccgcacgtgccggatatgatggatggattcgcgcaatttggtacaggggacgtggtcggatgtggcattgacgcatccaacaggggtgtttacttcacattgaatggacgcaaaatttgtaagttaatgaattgagtaaaaacaatttcgagttgcctcattcttaagcatgcggatttatgcaagccaattcattgcctatgtacgcgtgttgtactctggtcgacatgaacgattctgtgcgtgcaaatttcgggcccgactttctgttcaacctggtcgagatgttgcctttctgaggggtgtactgtcatttgccagtggatgatcgatcgattggttgggaattgtgatgttgaaagtttttcaacactgttaaccaaataaactataataataataattcaattgaattggattgaattgaatccgttgccctaaaataaagtaaatacttgctttcattccatgtcttccattggattcttttgttgcttaagctccttttgctccatggaacaaataatccccccccctcctttcccctccgatctatccatccatactccgttcctggcaatcttggtctcaaaccttttcttaaatactgtaatgcattaaaatttatatgatgatgatgatggggggggggattttatttaattttctgattgttgtttgttaagtttttattatgttacaacgattagcgattctattttttcgtttaaagactgcaactatttttgcgtaataaaaggcagggataactattgctaagtcactatatttgcacattaaaaaaatcacattttagcttttctttttttctgcacaaagcactcagtgtcgaatgcgagggcaagttgtcacagcaatgtttcctgtttaaaaatatatttagaacctcactgaaattagagcaccgtttgcatttaatggacaaacaaattttgttattttttcgttttaagaataaatgtacatttcttacccggtttcagcctgcgtggtatgatggtttgacatttccgttgccggtacaccaccaaccatacctgccttttccaccaccaccacgaccaccaccaccattgctgttaccgtcgcaagtgccacaaatgccatttcttcttaacccattcatcaatccaatgtcaatgccgtcccaattctcgcctcttccattgctgaatcaatttgcgcatccgcttacagggccatttccacatcgggttttgctcaaacatcgtttcctgctgctttttcccttccgcaagggatatcactcacccatcgacaacactttgagcgcattgctacagatgtccatagccatggcgtcaccccccaacaacaacaaattataccaatgatcaatgagggaacgggtcaaaatgcgggtgttcgatcatttctggagcaattttatcaggatggcactacaacaaatgattttttggtcttcgattggcaaattggatcttacatcacgtaaaccctttcattactgtctgagtaaaaagaatttttttttagtggactaacccttaagctgcttgaatttaattttgcggaaagaattccttttcgcaatggcacatccgcgcacggcataaaccttttgttggaaaatgagcaacatttgcgtgttcatatttgtgctagagaggccagggctacccttttatcaaacactctcttggttggaggcacttaccggttcatgcatttgaatgtgagaccgaagcgcgattttggacaatctgtgaactacactttatctttcgcatttggaagttcagttcacttgattcgggttatcctgttttatttatttgtcattttgaatttgatgagtttaagggaccgacagtagcatttaatccattaactcttcgaagtccgagcgaccgggttcctcaatttgtttgtccaaaaactaaataaaattaaatagtcgatggtcaaaaaaattccctaccccctcaacatcagcagcacagtggaacgatttcgcacaatgatcgtccatataatcaggaaccaatgcaaggtagatacacaatgccgccacttcgagctgagcaacatccgccaccactggcgccacaaacaaacaatgtacagcagcaacaaccaactgtaccgagtccgctgaacgagcgccaacagagtgtacaaccaacgcagggtgaacatccacaaatccgggcaaacgccaccttgcaaccaaacgtggttcaagcgcagcagcagcagcagcagcaaagtcatcagtttttggcacttgaccacgacaatgacgatcagcttttgaaccaaatttttttggtagtaaaaatgtaaaaaaaaaatagacatatcaattacaggatctcaccactacagctgaaatggaacctatcgctttggacaacagcaacaacaacaacaacaacaatatggttgttaacgatttttggttttgtctatttgtttaatattgcattttgtttagaacccacaaatttcttcatctcggcgccgaaacaatgccaatgccaatgccggacgtggccgaggaagaggaggaggaaccagacgcagagcggtgagacgcatgaatgaatgaagattaaaaaaaaaaacattttgtgaattattattatttgtttatttttaaataaagaatgctcgtcaacagccccaaagcgaacgaattcagtcgtcccaaccccaaacggtccaaatactttctccatcagtggttcaacatggccaaggtttaacacgtgaacaatgcgatagtatacttcccaatctggaagtgaacgaggcaatggtccgaaatgatgagcgatgtgttatttgccaaatgggatttgacttggggtcattgaatgctaccgaactcccatgtaaacatctttatcatttgtcatgcgctagagattggcttatgcaccaaaatcgttgtgccatttgtatgcgccgttttgtgcttgactctgatgcttaaatcaatttgtcttatgcaaaaataataataattacataaaggagtgcacatatttatttaaaaaattcatgtcaaaaatattaataattcaatgagaaatcattatttgatgagacttttttgcaaaatagttttgtgttatatatgaaaaataagatgagagcgaatgggagcgccgtagcatagtggtta

SEQ ID NO: 6182 - DNA, 5936 bp, Heterodera glycines
  misc_feature (8)..(8): n is a, c, g, or t
aaccgcancatttgaaaacaaaaaggaacagatcaaagggcaaagggaggcgagggaatttggcaaaatgatcaaaagaaagctaaaaggagcagagaaagttgaaaaaaagcatttgcaaatgcaaaaggaaaggttaaaacacatgggaagagaaaagaaatgggggactgagaagaatggtattctctgtctgaggtcataataaatgttattttccaaaaagggagtgccatttgagtgcattccgagtgcggcaagggcaaaacgagtgcaacggtaggggggggggggggggtatagaggaggcggaataaacgcataatgggttgagataccagcagagatttattcttggttctcgagtcaataaatttctctgggcttttctgtcaaggtcattaaagttttttgaagaaaaattgatacaattcttgagtcgagaaattctcaaattttttgggtacaattctctctcgttctcttgcaatcaattcttggtctccgttttctcgagtctctcggaaatttcaacactcccggcagccccagcaaacgaggggtttatccccgtgatccgttcgtggatggattggcggggatggcccctaaatcgggggcggggacaaaatgccatatcattactgtaattttttgtcataggccgagttccaagcacattgtcaagcggacgtgcacaagttcaaacaggacaacagcagcagcggtgccaagaatgccgcctcggcacggggcacggaggttggcgcaactgagtgaacgcgaatgcgcgccaaatttggattggcaacaaacggacaaatttatacaacgaaagcctactgtagctgatcgatgatctccggcgagttaaagcatgcttcttcttcttcacagcacaaacacacctactctcctctctgtacacacttaccacatttgtaatagtttctggaaaagctttaaattaccgcgtcgcaaaaaacaccacatttttggcattctccccccccccactttttttggcataatgtcacacacaataattttgattttttttttcattttttttgtgttttcatctatttggtcagcaataggctttctctgttctctctctttttgctatgtttgcgccccattgattttttttgatcgctttttcattgttttacacatcgccaaatttactcatatatttaaaacacattcgcgtgcagtattatttttgattaccatttatcacatttaaataaaaaaacaaaagttttaattgtttttttgctatttttcgagggctctctgatcattggcttttgatcaatatggtcatgcctcaactgatcgctcggttctttttggttctatcgatagatcagaagtggatcagttggtcatcgtttgatttcaattttcaaggacctgatcagagatgactggtacattcaaacgatctaagcttataggaactgatcaataatatagatcaaaggttggctgccagatcggaggactttgctgatgaattggttaacggatattagctcaatgatcatttatgactctgatcactccggtccgtgccttaaaatctcctagacattgtttttgagagaaatcaactccataatttgtttaattgatgacttctgctgctgccgctgctgcccaatttccataatcgttcaccataatatattttgtaataattattttatcactgatcagttaatcgtcgattgatcgttgatccgcttaaatttactcattattccccctccccgtccccgctttgttccccccgtgagtccaaaaatgatctttgaaaaatgattttaaaatgtgccaaccctttcaaattgaggagcacataatgccaacacaaattttgctgctttcccttcctttttactgtcattccaaatatacgattaccgtaagaatttgtctgttattttcatatagtatacgatcaccatacatttttttaaagattttttggtgatcattttcccacacattttctgtatggcaataaataaaaaaacaagttcatttattccattattaattaattaattaaattaaagataggaaacaatgtataattagaaatgtaattatcgtatattaattattagagtagaagtataccgtagtttggccaatgtaataacatagaacatttgtactgtacaaagaaagagaggacaattcagaaaaaaaatgatgaatgaattctgtacaatttgaatttgaacaattgaataagctaatgaattaattaattgattagtcataataatccgatcagaaatctgatcaaaaaggaggctggatcacttgatcatgaactgatcaatgagacaagaaaattgaaaaaattaaacagacagaaaatgatcaatgatcaactcaaatcagtggatgatcaaagaaagccgagaaaattttgatctctgatcagtgaaatccattaaaaaaacgatcactaaggcagtgatcagaaaataccatgaaccatacaaaaaatcacttattaatacatagaagaggaaaagaaagccctgctgaaaacaacaaaacaacaacaacaacaacaacgagttttgtgtgctgtgtgctaatgccatccatctcattttggcggattttgttgctgattgtgagcagcttgttgctgttgttgttgttgttgcagcagtggtggaggcgtcggttgtgtagcagcgatttgttgcagttgcaccagttgttgctgctgctgctgctcggtgaagccgatgccgccaaatgagtgttgccggaacagtccgttggcggtagcggcgccggcggcagcgactgccatcgcggcaagccgttgttgttgctgttgctgctggtgttgttgttgctggtgttggagcagttgctgaacggaagacagtgcgttgctcagtgcgaccgccgcaaccgtcgctgacgcgttcgcggcgactgaggagggcgactgttgaggcggttgctgcgactgcaaaaggttggcaaccgcggcggctgcgggaggcggcggtcgaaatgcgctcggctgctgatagtcagggacgctgaacagatttggagtggaccgcctcatatgtgccggcaattgggctgaaatatttggaggggaattagttactactgatcagtcgggtgatcggaaaattggcagtgatcgaaaaagttgatcgaaaaatattggttccaatacgatatacaatgaatgtgatcagggaatttgatcaagaccacgcgatatacaaattgatgtgttcagggggaattttgatcagccacagcagctttcagaaaattgatcagaaaaattttttaccgtgtagcgtggacagcaccatttgctggttcagtaagccctccagggatggcatgcgtgccgccgccgccgcttcttgtactgcttgatgctgctgctggttctgttgctgtgccgcggcggacaacagcttggcagccgcaaccatgtgctccatgtgctgctgctgtctctgttgttgttgctccattgccgccgttttgtggttgttgctgttgccgggctctgccggtgccgggtcaggcggcgccggaggttgtggttgcgcgacgacgcgagtcgcttggggctcgtcccatggcacagtcgccgacgacgccgatgacagcgacccgccagcgagtgcagttgttgtcccagtgtcactgagcgactgttgagctgtggccgtagtgccacaactaccgctagtgctggtactgctcgcagttgcggcgttgacagcggcaccaggcgacgacgatgacgacgagttcagcgacagtttgctgatcggcggaatttcggcatattccattgttggcgtgccggcgaacaaaaatggcaccggcgagccgtccagcaacaaatgggtgcgcatgtgccgggtgatcatgtcgcgacgactctgtgttgaaaacagtgcaaattaggcacggcgatagttacttaacgatactaattgcgtcaattaaatctaattgggggcaaaaggactccttttcctaacattttaaatagaaaagaatttagtaaattttaaagaaattcaaaaaaatttaaggatttaaatccatgtagatcttaaaaccttaactaacaagtttgaaaacaatttaaaatcactcagccgttcccttgtaaaaaaaaaatatttaaaaatttaaatttttcaagaagtagagaaaatcaactcgttttaaagagattaattttaaaaaatcaaaaaatttttaaaaccaaaatttttttaataatttaaaaaacctagaaattttgaagaaaaaaattctaatttttcatttcgaatttttttttgttgaagaacatcaaaatttgcaattcttagaattttactatcgtgggggaacaacaattaatgaatttgaaagcatttggccaaatttgtgggccaaccagggctgcacgcaattacggattacggattgcggattacggaaattacgggttttgggagttacggattacgggttacggatttttgggatttttccgtaattttgatccgtaatttgatttttggattattttttcgagacgatttcttgtaagattatttttataaaacaaatttttctattttttatttaaagaaaatatgttcatttctttaaattcttatttctttagcaatttaaaatgtcaaacttaaatcctggtaattggtggtattattttgagcgtcaaggcaaatcaactgctaaatgtaaagccgatggatgttcctactcaaagacattaaatgcttctctcagtacaacagtgcttgcttctcatctcaaaaatcaccacccacaactttacaaacagcgtgaagattttgttcaagcagagaagcaaaaaacagaaaagaagggacaaagtggaataaacccattaaaaagggcttttgtcggtttacgtgaggacaaggacaatcgttattcaaatataaagaaaacaattgcgaatgccatcgaattgcggcttaaacaagccgaagaacaaaaaaacctagttcttgcaactattttggacccacgttttaagaccatttaccttgacagcagtcggctgaatcagtacaaagactggttgataagtgaagttgagagttaccatgcaaagactgatgtgattttattttttctatttttgtaacttaatttttttaggaaattgatttacaaattgacgtaagagactgcagtggttcaagttcggctggggatattttttctcgttttgaaaaggacgcagaatttgagcaaataatgaatactgtaaataaattttatatacccctcataataattaatttaaggcaacatcccccagtccatctgccttggagacaagacaaaaagccgaagttgaagtaaatgaatatttgcgggatccaaaaatcaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgttttataaatttgctttttaatatgcttttaaattgctttaaaagatttataggattttttaaaataaaatttaaaattattaaaaaaaatttttttttaattgcggattgcggattaaggaaattacggaaattgcggggtttttggacacccgtaattgcggattgcggatttccgcaactgagaaaatcgccgcaattgcggattgcggatttccgtaattgtaaa

SEQ ID NO: 6183 - DNA, 4576 bp, Heterodera glycines
  misc_feature (19)..(19): n is a, c, g, or t
tttcggccgacgacgtttntggggtgcaccgcattgcgacgcccgtcgacgactttaaattgttttgttttcaaattgtgcggcttttccgctgtttttgttgtgtgattgttcaacaacattcgccactcaattttttttgttgtttgatttattcaacaacaaattttcgtcaaattcaactcctgttttttgttgtgtgattttaatcaacaacttttcttcaatttcgacaaatggctttgaccatcgagcaacatttgcaggaaatttcgcagcaaaatcaaaacccgtcactttcaggcattgacgtatttgaattgggcgacgaaaccaccaacatcgaagattggctgcaacaattctgctttgcgttggattgttcggcgcccaatctgaaagatgagcaaaaagtcaagctactgatgacgaaattgagcaaagcggcattcagcgagtacaagaagtcgtgcttgccgaaagatgtgaccgactccaattttgccaaaacggagcagcaactcaaggcattgttcgccaaaccacagtcggtgtagatcgacaggtatgagtgccttcgggcttccaagagcgaggatgagaacttcctctcttttgtcaaccggcacaagcgcctcctaagggattttgagttcaagaaactcaacgaagagcaattctattgcttaagttaacagctttaaaatctccaaaggatggcgaacttcgaaagagaattttgggcaaattggcggcagatggcgatagggcaaaatacgataaggtcgcggaggacctgcaaatgtatttgtccacaattgctgaagctaaatgcatcgaacagccagccccatcaaagcaaattttggctgtcaagcaaaattttgttccaaaaacaaaaggctttgaagcacgtggtcaatttcaacagcagcttaaggtgtgctggcgctgtgggcgaggctcacattttccaagtgcatgtccgcatattaaaattgcgtgccgaaagtgcagcaaagtgggacatttggaagcgcagtgcaaccaacaccaaacatggctgataaggcaagggaaaatgcaaagccgtaagcaaggcaacctcaagcttggaggtgtgctgatcaatttggtgaaccaaccgaaacggctgattgaatgccctattaaaatgaatggaaattttgtggaattcgcgctggactcaggtgctgaggttgtagtggtcaatgaagagacacatgaagcgatcggaaaaccgaagctgagtccatgcaatgttgaagcgaaataccacgacggaacaaaatgcacccttcttggaaaaggggaagctgagttcgaattcggagggataatccgaaaagggcaattttacgtctccaagagagggtcattgaatttgttcggcatcgaaatgttggatgcttttggcctcatggacgacgtcagaaagaaagtggccatgacattgaatgtgaataatgtcaaaaaggaagagtctgttgttgatgaaacactgagcagactcagggcgaagttccctaatgtcttttcgacaaatttgggccactgtaaaaaggcaaaagcgcgcctttccttaatggctgacgcaaagccagtgtattgcaggccacgtccggttccttacaacaccaagttggttgttgaagctgaattggaccgtcttttggctgcaaatgtcatccgtcctgttgaccacactcggtgggcagcaccaatcgtggtcgtcaaaaaggcagctggttcggcacgtgtatgtgctgatttttcaacgggtcttaacaatgttttgctgtcgaatcagcacccgttgccagtgcctgaggacatttttgcgacactaaacggaggacatgttttctctcagatcgatttccgtgatgcgtatcatcaaatcgaattggaagagggatcaaaagagttgtgtacgatcgcaacgcaccgtggtaattttgagtaccagcggttgccattcggagtgaagtccgctcctggcatttttcaatccattatggattcgatgttagcagattgtccatttgccattgcttatttggatgatgtcattattgtgagccggactcggaaggaacattggactcatttggcagaagttttcaaaagaattgacaattttggctttcggatcaagccagagaagtgttccttcggcaaggaacgaatcaaattcctcggattcatcattgataaggatggccgaaggcccgactcaaccaaaattgaggcaatccgaaggatgcccattccaaccaatgtgtccactctccgatcatttttgggaatggttaaccactaccaacaattcgtaaagaatttgcggttcattcgccaaccgttggacgaccttttgaagcaggacacggtctggaattggtccagcgaatgtcagaaagcctttgatcaggtcattggcacgcttcagtcggaccaactgctcacacattatgacccatcacaagaaataattgtgtccgctgatgcctctgagcatggtatcggagcagttatttcccatcgttatgcggatggaagcatcaaggccatcgcgcatgcatcgcattcgttggctccggcagaaaggaattatgcccaaattgagaaggaaggcttagccttaatttatgccgtgcaaaaattccacaaatacctttatggaaggcattttatcctgcaaacggatcataaacctttgctgtcaattttcggcaacaaaaaaggaattaaatcctgcaccgccaatcgattgcaacgttgggcattgattttgctcgcttatgattttgatattgagtatcaaaacacatcggagttcggacaagcagacgctttgtctcgattgatctcaaaaacgacgattgaagacgacgaagtgatcgtggccaatttgatgaatgtggaaacggaacttttgaatgctgttgtaaagcaatttccgttgaattccgatcaattaattgttgagattggaaaagatgaagtgctaaaaggtcatgaagtaccttcgcactcaatggcccacttcaaagaatatgtctttaaaaatcattccatttcaccgcaggcgagaagccttatcaattgagaatgtatgtattatttatgctgaccgggtggtgatccccgcatcacttcagaaggaagtcttgcagcaattgcaccagggacacccgggaatgaaacgcatgaaaaatctggccaggcaatatgtttattggcctggaatggaccagcaaatcgaagactccgttcgatcttgccaagcttgcgctgaagaagcaaaagcaccagttaaaacttcttcactcttggccaaaagaagacggcccatggaaacgagtgcatatggactatgcagggcctttctttggaaaaatgtatttgatttgtgtagacgcattttccaagtggccagaagtctttgagatgagttccaccggatcagcagcgacgattgacaaaattcgttatctgtgctctcggcatggacttcccgaaacacttgttaccgataatgggacacaattcatttcaaatgaatttaaggaattcacgaggaagaatggaatttcccatctgttttcggcaccgtactgcccgatgtcgaatggacaggcagagcggtttgtcgacactttcaaacggacgtttcgaaagttgaaaaaggagggggtagcgaataggttggatacgtttttgacaacctatcgtaccactcctaatgagtcgctggctggaaacaagagccctgcagaaatgtttatgcagcgcaaaatccgaacgactttggatcttctgcggccgaaacgacgcccaatcatcgaacgtgacgaagcgatggaaaggagtttcaatcgccgtcacggggcacaaccaagagaattcatggtcaatggcaaagtttttgcccgacatcgaatttctcaaccatggaaagccggacgtgtcactcaaaagaaaggagtaatttatgacgtgtcattttccgacggatcgtctggtaggttccatgcgaaccaaatgttggttcgtcacacgccggactatgaggaagaccccttggatatgcttaatgatgcatttgggcttcctctggccccatcggtggtagaagaccctgacggacaggctgaagttcaacttcccatgcgcgccgacacaccggagccactgaacgatcgaccacttgacgaagatgtgccaagaatccccgaaggacggcccaaaagaaacagacgccctcctcagcgcttttcgccgggatgatggacaaaccgattctttttgatgggggaggtgttaggacgggtcatatttaaattgtagttggcattctgtcccctttgccacgtcacattttgaccccactccatttgtccttaaatatcctcccatttctctcccctcgtggttcatcaccattcattcatttatttgtcatttcccaaagcttgggtggccgaacgtttcgtcactgaacctttcgtgggtgggacttttcgtcactgaacctttcgtcactgaaataaaa

SEQ ID NO: 6184 - DNA, 1623 bp, Heterodera glycines
  misc_feature (70)..(70): n is a, c, g, or t
atcggacgtcaactggacgatgaatgaacgaggacatttcgtgaaactgacggatgattcggtggcatgngcattccatttcctctcttccccttccttatattttgtacacgtttgatttcctcattgctcttttccttttcttttgttccttctcaattgtttcttctcaatttccttttttttgtactggaattttcggctgctctttctttaatctacccctcaaaattttgggcaaccaaccctgtacagctcttccaactccgcacttcgtcttttgcaccgtttcttcgctccactctgggacggaatgaactctggttgatttcctccagcccctcaggccaagtctgttcataaattgagcagctggtgcacaggtggttggattgggaaccgaagggcgaaaccgttctcggactggcgcagcatcatcgacaaacttcgaggatcgaggacgatcctatggaaggggggagctgtaagggattggccaccctcaaaaacaatttttattttccctcagcagtcgtactttccactctttattatcacattttctcatctcatttattccgttcatccccgccccttttccgttcgcttcacacttttccttcccccagcgatcagttagtcagtcgtcagtcagtcgagtcgttaagcctattcgatcagtcgttcgtcatggaatatttcaatcatcattttatccggagagaataaattagtcttataacaccgaggctttttggggaatttcaccatcaatcctgggcccgggattccgttccccaaatcgtcctcccatttattcttcgagcggtgtgtcgactgggggacccaacacgcctccctcactttatttttttaaaattttagcaaatattggagaaatattataattcaataattttaacctattattttttatttggcaaaaattaatctgaccgagttttcagtttttttaaataaaagtagcttttttgcagaaatattataactaaaaattcgtccaaacgccgacggaaagaaattatttaattttagcaattaaaatttacctacaaattaaatttaacaactagaaatgctttccatgaagtgcatgagaaaaaataaaaaattctttttaataataaagtatgttaaaaatggcttcatatcatttgagaaaattattaaaaaaaaattatacttactcgcaagagcgaacatagactaaagcaaccaaaaatttgatctcatatgcgagtatttcgtataaagataaaagaattatttatattcaaaattcaattattttcaaattaaaaaattacacaaaactatttcaaaaacaccataaaaataaatttatattattctctataacaatcacaagtaaataattattaaaaataaaaattagaaaaagaaaatattccttaaattattcaacctatttttggcgctaggtcacaaacaaatcagctacattgacactcattacacttcaaacttaaataagggcagaataaatttagctaaataaatgataaaaaataaaaaaatttgaaaaacttaatgaaaaaataggaaaagagaaacaattaagattttttaagtgtaagaata

SEQ ID NO: 6185 - DNA, 2189 bp, Heterodera glycines
taccgtattttctctaattatcaccccgtctccattaatccccccgtctccaattacctatcccccctttcggaggagcttgaaaaataatccccccgtctccatttatctctcggggggataaatagaatttttattttttcgaaattttttttttaatatttaataaaaattaattattctaattgaaactcgttaaatgtttaataaatagagataaaaatatgtgcgaaaaattaggaaaatccactgtatttgtgcctaaaattccagaaaaatttcattctttatcattttcgcccgcacaatagcaatcaaatacatttggaggcgttcgtgggtaaaatgggtggtttttttctaattccattgatcaattgatgagaattcgatttggcatcttttggcattcgaaataaataaaatttatttaaaacattgcaaaaaattgttttagggatgtatttttcaattttctgccatgttaaaaatcgaaaatttttagaatttttgaaaaaattcttttcatctttaagttagaaaaatcaaataaaatgcataaaattctctcgatttctctttgtgcaataaaatgagatttttttgaggcgatgacattttttggcgcctgttaaatttaaaaaatttaccacgaaataaatctgtcgattcttctgtcggaaaataatctcccgtctccatttgccccccccccctttctgaggaggttgaaaataatccccccgtggtgataccccctaactagagaaaatacggtattttagaaataaaaagttttgactataatttgaaaagaatctctttgatttttttattcttgttattttaaaaattacggtgtcccctccattcacgggactcataaaatacctttggacttatataagtcgattggactcataaagtgcaatagagccaaaaattttcccaaaactaatcccagaatttaatataaatatttaactttttacatgtttttgctactagtgttaattttttgtgactatctaatgcctatgatttttttggttaaatttttggaatattatgacagtgacgaagcactacacatgtgttgtttcatatcactatttaatgctttctccataatacagagaattgaatattacaaatcaaatagctttacaaaacagttcctggtttaaaaatgtgagattaaatgtatggcaaaaaaaaagtgaaggaaggccattcgctgtgacagtcatcaatgggggataaagtcaaaaaccatttgctgacgctcgtccaacggtacttcgtcgacgcgcacttcgctgcaattgtacagcttcacccattggtcgaaccggaacaaaagcaactccatttgtggcgaaatatatacttaattcttattcacagaatttaaaatatattttaacaaattaatgctaattcattgaaacagtcgtttgtttttatgtacaaatttttcaattattgtatttttcaagtgtcttttggtacaattagtcttaatttacagtcattcttttgttaatgggaaaacattgggacgagtcacacatttaaaagtcgggacggactacggtaattattgcatgacaatttgttaattgtttcattaactttgttttgcatgaatgactctcattatattatcgttgaaattttttggcaaaaataaaaaacaaaataaaagtaaatgagaagttatttaaaaaaaaactattagagaaaatgcgtttataaaggcgaattttcttttaaatgaatgaacaaaaccttttgtgttcacttcactctaaaatgcttattaaattatttcacactatgggcaagactattaagaaataaaataattatttaacaaaatgcgcgtttatttgacggttattaggggcataagcatcaacgtaatattttacacattcttagttttaatagcattcaattaagtaatcctaaaatagatgtggtaatactttgttagagatgcttatgattaaaaaaagcacctgtcaaaattatttattaaaagaatttcaactgattattggtagataaaaaatgaaaatgattgttcgtaattaattaaaacgattaagaaaaagctgacttgggaggggggggggaggggttaaaggcttaaaacgaggaaggggagtgtgtgagaggggggg

SEQ ID NO: 6186 - DNA, 3058 bp, Heterodera glycines
  misc_feature (16)..(16): n is a, c, g, or t
cggtgccttttgatgnagcgcaattcattaagaaaaaagagaataatattccaaatgaaagcctgggggccaatggcaaagtatttaccaaagccactcactcgcatggcacgtttgccagtcgatgatcgaactcagctgatcacccggctcgccattgtccaaccgattgaaaaacaaattgttgctccaaaggtcgccgtgacaaagcacaggacgaatgcctttggtaaagaaaaattaacccactttttgtgccgacaattggggggggggggaaatgggggtgaatggccaaggaaacgcaaatcccttctcaccatatctttcgtgtacgtccgtcttcaatttgttgtgtttcgaaatgaatgcccgcagcgttttgtggtgccttttgaagaagggcgagtccaaactgagcactctctgtgccaattggtcctccattccgtccattcggccgtattcattcacccgaaaacggagcaacaaattgcgcgggaaagtcaaagtgaacgcgtgcaatttggccaagtggacaatggtcgactcgacctgtgctaacatcgacagttatcggtttggagcaagaagagtgctaattattgcaaatttgttataaattgctttgcctgtccggcggtcaatccctcgtaaaaattgggctgaactcctttaacggacaaatcttccatcagcaaaaagccttgttccaaatgttgattgtttggaatgggacggacagcaaaaggaattggcaatattggcaacaaatggcgcggaaacaatggcacaatctgtgggggaaagggaaattgggcaaaaaaagggggggggaaggagaccaatttgaagaaccgctcctccaaatcgcacatttcgaacagaaaggaacgcatctcaaaaagtgagttttaaaacaattccctcgctgttctcccaaaaagcgcactttttcagtgtcccacccaatttcaacgactttcccttccgcttcttcgtccctccctttccgtgctgcgtcctcaatcggattaagccgttccaatttcactgtggaggccacctgctaatgagacgcaattagaggggagtttaaagaaaggaggacggtgcactttgagaatggcgacaaattggcgcccgtcgataaagcgaaagaccacgcgatggatggaggacattaagccttggccatcgatgggattcgcttccaccgactcaatggcgttactttgcgcttcaatcgtggcaaatttgtcgcattggactctcagagaagcgacgagcgaatggaaaatgtgcgcagtgccggggacgcactgcgaaagatccgtcgtctgaagggtttccgagccgagcagcaaagggaaggacattctctgttgaacggaccgattgggaaagatttgtgtgctttgataagcaaagtgatcattgatcactgatcaaaagtgatcagtcgtcccgggggattttgacttttttattgcaaatgttaacagtgccctgggtatatcaaatgtttttagaaaggcgtatgaacgaattgggcaaaaaaagaacaccaggaaaaacaggactcatcgaagaaaatttttcaaaagcattcattagcgtcaaaagcatcattttataatttattataagagcgaaaaaattttaaaaatattttaattcctaatgatcaaaataaaatttaaaaaaataaattaaaaaaaattaaattagaaaaacaaaaaaaattaaacaggctgagttttatatattttgaacgttttttacagacaacattttatgagagaagcacgaaaatcatattttctctgctcaattttcaatttagagaaactttttagcgtggatttagccaaacttatactttttgcttatggccaaaagtgcagtttctagcaaaattttaagaatttttagcacatataaattagccccattggtcattttaagaattttgctgaaataataatcattttaaaaattttttgatcaaaaaatgacaaattttgactttccctaaaaaccacaaaatgaggctaaagctcacttacacgagctctgagaaaatcagaaaaacattaatgattagggatgataaatgataaattgatttaatattttttgctttataatctaatgactgatagcgaaaaatttaacggaataaaaatttattacgaaagcgaaggaaagggggccgggtaattgtcatttatcattaccaggaaagttgaaatcgattttcaaaaacggaaaagatacatcggaattcggattgggaatttagggaagttcaatttcaatttcaatttaattttcaagaattggtttgtcattttttaaagctaacatttatctttaattgtttccaattgggataactgaaaatcagcaaaaatggataaagtgtcatacttttttttcatttggaggataagcgaaaaaaaggactgcaactgtcatccaattaaaaaaaagcaatgatttgtcagggcagagattaattagctaattttagaaaaaattatttatcgaagaaaatataaaatcaaacgatgaatgataaataaatatttgacaatttaatcaaaggtttgttctaatttctttggaaatgttctttggccccttataatttccaatcactctttttttcgcttaattttccttttttttcttttttgtctttcaccgttccctcttcggcactttccctttttgccgctttttccttttccaatttcctttccctttgcctttcctgccattccttaaattcttcctccgaatcgctcaattcgaaatgtgccgtcctttgctttgtttcgtcttcgctgtccgtgtccgaaaaagcgtccatcgaaacgatgagttttttggcaaaataattcggacgtcggagtaaagcaaatgattcattattttacgccgtctttttgcggtccaccgaatcttcaggcccaaattcgttgctcgcaatcaaatggaaattgatcaccagcaacagaaggaaagtgccaatgccaatggtagaaaattt

SEQ ID NO: 6187 - DNA, 886 bp, Heterodera glycines
taattagcatctgctaattgttctgctgttgtggaggtccccgatgttgatccatcagcattcaaagtgatgctgggctttgtttacgcggacgatttgagcgaattgaacggagacaatgcaatggaagtgctttatgccggtgaatttattattttttaaaaatttaattgaaaattgtgttagccaaaaagtataacatcactggcctgatcggcccacctttacaaattcccatctccgaattgcgcaatgttttcttagcctatgcccaggctctcctcttcgaattagaggtgagaaggtcaaaataaatttaattttattatttttttttttgtatgaattatgccttagattttctgaagatccaataatttttttgtataattttctgtaattaatacatttttaaggattttgtcagcgaatgtttgcggtacatttgtcaaaatgcagccaaattgttcaaatcaactgattttttgcaaattgatcaggaaatgttgtgctatttttttgaacgcgatcagttgttgatcagcaatgaatgtgaactttggaaagctgtaatttcaattaaattttgcattttattttgtttttcatttttgctttaggcacttcgttgggccgacgaaaaatgccgacaaaatggtgttgaatgctcaccggaaaatcttcgtgccgtcctcggcccggcattgttcaaaatacatttgccaaacatccatgaagcggatttttcaaaatacgttggtaaaaatgtttgaaatcggataattgaaatttttaagctcggaattaatttccttttaatgtttgaaattaattcaacttttttaaaaaaataaaattattttttctgcatcgactattttgttgt

SEQ ID NO: 6188 - DNA, 2691 bp, Heterodera glycines
  misc_feature (189)..(189): n is a, c, g, or t
  misc_feature (229)..(229): n is a, c, g, or t
  misc_feature (2379)..(2379): n is a, c, g, or t
atgtaaatacatgttttttcctggattctccatagtttaattagtagaaaaaaacacttttttttgtgtttgcgaacaaaagttgggactttaatttacatatttttacatatttcgcattttttcgtacatattttcattttttttttttgcatattttgaggatttttgagaatttatagaaatttnttgtgaaaaattaaaaaattttttttttgaaaatgtatcncaaaaaattgaatttttaaatcagatatcaaaaattaattgctaaaatactaaaagttggtttctaagcctatttagttgcctatttcaccctttatgaagaatttttcccccaaaaataaccattaaaaaaattttatttacatatttggtacatattttgggttttttgtacatatttcttacaaattttagcattttttatacatattttatttacatattttgcgatttttcttacataaaaaacaaacactactcatattttatctaagtgcttcaacctaccactaccccaataaccctgaaccccatatcccccattaccctaccccccgcttttcgccgcttggcaaaatttttaaatttatttgtgatttgttaacggttttcaccaaaaattgccaattttatgcaaattttaaaatattttatgagaattgttaatggattttcaacaaaaaattgccaattttgggttaattttgaattttattggaattttggatccggcgatgatacatgaatattttagaaaaatattcaaaaaatatttaaaacataccaatttaagccgaaaatatgtgcaaaattatttttcaatttggcagaataaagaaattcttagaaaaattcataaaatattttaaaaattttttattgaaaactgccatttaatctttgagtatgaaatttaaaaaatttccttattgtttttaaaaaacccataagaattgtcatgaatttaacccgatattccttgaaaattttctaacatttttgttcaaaataaaaaactcagctaaaaactacacaaaaattgtattttttttttggtcaaaaaccgttacaatttcacctgtggattttaaaaacttttcccatctacgcaaaaccaaaaaaatgccaaaatatgtgggaaaatacgtgccaaaattggaaaaatccggtatttttacgcataaaaattccatttggcgtaaaattagaaaatttcaacaggtaacttcgaataaaatgcaaaaatgtgctaaaaattcaaaaattgcccaaattttttgcgatatgttttttgttgttgccaaaaggtcaaaataattcttattatgtttttattagtcgctctaaatcaaaaattgtttggagaaaaaatgctattttctctcgccataacaatccaaaaaaatatgtaaaaacataaaaacctcgggtgatcattcggatgtgcattttttggtgggatacggcgacgcaaaagaggtagagattaatttcaacttaaaaatggacattgagttcaattcgcacccttttttcacaattataaacaaattgcagttacaaaattttgaatccattttttacacgtttggcctctcctttggccgcatctgaaaaattcgaaaataaaacattttgctataattcatctcatgaaatgtcaaaaagcgaaatagttttatgcatcctctaaaaaactgatcatatcgaagcaaatttatagaatggactcttacaataataataagttttgaaagaagaattttgctaatggacattgagttcaattcgcacccttttttcacaattataaacaaattgcagttacaaaattttgaatccattttttacacgtttggcctctcctttggccgcatctgaaacaatggaaaagaccacaattcatgctgatttttcttctcagaaattttaaattttaaacctcagctaaattacccgtcccaaacttgcataattttaattgttttattcgtctaggggcgatttttcagtattatttatctgtggttgttccattttctagatttatagaaaacacattttaaaaagaacataccttttggtagcgaatgcaaatagtgattgataaggagaaactttcagacctaaaccgatttttctggagcttgaaattaactttctattatattgctaattttctctgtaaataccaaaatttcaatggcacctgaaaataaaaagtctgtcttttttaagacaagacatttcaaaatagcaatttctcaaaaataaattcgaaaataaaacattttgctataattcatctcatgaaatgtcaaaaagcgaaatagttttatgcatcctctaaaaactgatcatatcgaagcnaatttatagaatggactcttacaataataataagttttgaaagaagatttttgctaatggacattgagttcaattcgcaccctttttttcccaattataaacaaaattgcaagttacaaaatttttgaatcccattttttacaccctttggcctcttcttttggccgcatctgaaacaaatggaaaagaacacaattcatgcctgatttttcctctcaagaaattttaaatttttaaccctcagctaaatttacccgtccccaaactttgataaatttttaattgttttatttcgtctaaggggcgaatttt

SEQ ID NO: 6189 - DNA, 3949 bp, Heterodera glycines
  misc_feature (3897)..(3897): n is a, c, g, or t
gtccgtgggatttccgaatgaaactttgtgggtgcatagagcacccatgggttcttaagaaaaatggtttcaatttctgccaaataagtacgagtgccgagttatgacgtgccaaactttttttatcccaataaattgaataatctattgcactgttttgtgctgtttagtggtgcagaggttgtgctctcgcctttactttttccccccacaagttcgaatccctcttaagtaaattaattttttttaattttgcccttgaatacccttttagaaatgtaattattttcatttataatatgcatttatatttttttaatttatttttgaacgaaaatgcatgtaaatcctttaaatgtcattcaactgctccaaaaaaaattctcaaaatacaaagaacaaacaccaattaatgcatttgaatcggatattgcaaaaaactttgccgaagaaattgaaaggtgcaataaaaacgatgaggaaatggagatctcccatgatctggtgattgacgaaaatgcaaattatgtcagaattgaaggccaaaatgatgacttttccgattttgatgaaaatacagatgaagaaaccgatgaagtcgggagtcctttcggttcaggtggtataatatgcttttaaaaatattttaaaatctagaaaaatcgagtgggtcgagtttctttccgtcccccgaaaaaaaaacaccacggaaagacacaatttcatactctgacaagaaaaaggcattgcaattttatcgctcaccaggaaagggatgccgttctttaaattgtatgaaatccaattttcgttttatcaagtcagaatcggatcttaaaatgatacgaaggtgaaatagaaaataaatcttttaaaaaatatattttaaggtttgaaattaatttaaaaagccgagaagaggctttaaaacaaattgatttgtttgtaatcgatcgcttcaaggaaaaattccagaacaatttgagcatatcagatctcattttacgaaaatgggcgattcacacgaacaattcacttggggaaaacaaaataacggaatttaaggcttcgaaaaattggttggccaaattcaaaaaacgccatcggattgtttcccgaaaggtcaaccctattctccggaattaataatttacttttttagatcacaaagttcatttcaaaaagtcattatattaatcttgaaaaggtcaaaaaagaggcggaagaatttgtagagtgtgttaagaattttgtcaaagatgaacaaatctcatcccgtgatcttttgaatgccgatcaaagcgggttcgagttagaacttcatgctaaaagatcgttggcaccagtcgggaccaaattaatcgaatgcgttgtgcaatctgtttccagcacaacgcatagctatacagtaatgccaatgataactgcaagtggctcgcttttatccccgttatttattgtgttagccgagcagaaagggaaatttcctcaaaaaggaatatttcaggttttgagaaattgaaaaaaatattacatttaatttaaggccaaaaatatatatgcggtcccaaatactagtcatataatgacaaaaaagttaatgattgaatggctcactcatgttttatgtccgtctttgcgtgttgatcaaaaaacattgttattggttgacagttggacagggtggaatgattttaaaccaccagagaatgtccaacttaacgttaaacaaattccgaaatcgagaatccgctcaaagcgctgttgacaatgtttctgctgaagtctgaagcggtcgcatcggcatctgctgccaaaaagctcatttcgcaaattctggacacggatgccgattgggaactcgcaacatattgcagtgcccgagaagacgacgtcaaaaacggcacatttccatccgaatcggacgtggaaagcgttttgcgaatttggatcggccactgccaaattgcccgaaaagaagtcaaaaatcggcatttgggccaatttcaattgagctgccccaaggcctatcacttctgcccgaaactgaaagagaaggcatgaggaaatcgctcgaaagtgcgccatttttgctggagaagctccgtgccacggaaatccaaaagaagacactcgtcaccgccgaaagagtgattttaggcgattcaaatgcctaccaattgaagaaactatggccgagatcagcatttgtcggagtgcaagaaggatccacagccgaagtgatcagacaatttgatcaagtggtgctggcctcaaaagtgaagtggctgattgcgatggtcggaaaggactcaattttggctggcgactcggtggacagtgtcatcgaaaaagtgaagagactgcgccaactttgcctccgatttgcgcatgtgaagatcttctggctgttgccgccttttatctacaacaaaaaggccgaatctgaagaattctgtggaagaatgagggcgctgtttcggaagaaaagcgaaattgagctggtagcagtgacagaagaaggaagaagtttgctggagatttggcgtttcgggaagaattttaacaatgaacatgttaatcataacggatggatgacagaaaaggggctgaaaacgctgaatgcctggctcacatcattggttccgaattttccgggcgatcgagagctcgggatcagaaccgtgaagtcgaaagtggtgaaaattggtgccgtgaagggtggtggtccaggagacccttccttaattcgtggcaatgcaccagagagaaatgtgagaggagaaggcccaggtgacccctccccatctcgaacgattggcatttctgacaatggccccacaggttccgcccgaccaatgaccaatcaaaatcgcgggtttgagtttggacgagtcggcacaggttaccgctcggtccctcctccgacgttccgtggcccgtcttcacgtttccatccatatcagcaaagtcgtggtcgtccggcgttccatccgactccgatgaatcgtcgcaatcggttcgagccgcgtcgctgagcagtgatcccagacgagcccccccaccttttgacagccgaatcgaatctcatttttgttttatttttttgtctttccttctttaacggcagggacgccgctcgtaattgggtgggatgtgatatttgacctcgtttttaatttaaataattaatttgtggcattttgtctatttaattttgttccccttctaaatttttttgttttctcagtgttttctcatattatattttggcttcaaaatgatggtaatttattctcatcgctctccgactttcgaatttttattgaattaaatttgttctgttttgtgctgtggactttaatttgtgttggagatacacttttggttttaattgtttgagtgcaattcttttttgttaattttggttgacgacgaacggggacgagaagtgaattcggaggagaagagaagagccagcaaaagccctgcatttgtgttctccctcattttcttcgaatattttcgacgtcaaaatgaaattgtttctccattttgagaaagcatattgttctgctgatgtgtttatcgtagattatgatgacacactaaacactttcttcaaacccgagcatgacttaccaacaataatcggcgaattattagctattcattttgtgaatttttttagaaatctccagttccattcaagaaaaagccctatattcgtgcattgttcaaactaaattcatttcaaaatccgattaaaattctctcaagtacatcgaaaacccatttaatctgtactaacttctttaaagtcgaacctgcggatatattctgataaaattatgatggttaacaaaatctcaagggaaacccaagcgtattcccttnctgacatcatccggaaaataatagctgctcattttctaatatttatagaaac

SEQ ID NO: 6190 - DNA, 1427 bp, Heterodera glycines
  misc_feature (1368)..(1368): n is a, c, g, or t
ttttgaaaattttcacttgtcaagccttgggtttacgctaataaaatttgttttaagtcgatttttcatgttttattacgcttcctttgcgctactattaattttagaaaaaatcttatttttagggtccgcatcttagtttttgagccattttgtcttattttgaaaaaaaaacttgggagccctgcctaaaaaacaaaaatttcgaaagctttctttcctctggagtgttttgataaagacttgcccgtttctctcgattgttcgagactggcgcttgagaaaaaaggattgattgtgtaattatcattaaaaaaggacgtttaaattcttcgtaataatttattggctgcataaagcactaaaatgagaagaggagcaaagaaaaggtcgcggaaaggccactaacagcagtaaaaaagtctgaaggttgtctgtctgctgagaagacgggggatgacaagtgaaaagggagagaatgggcgagggagggacaaaaaaagtggggaaaagggaagggaagggaagggaagtggcgattgttgaatgagttgggtgggaatggacgacgagagatcactcccaaatgaaatgataacgggcaaatgagtagagtaaattgggcgggaaatgttcaagagtttaaggaaaatatttttgggaaaataatccaaaacaatcgtttgattttaggtatttatttgtcctctttttgctgattgaattgtgcgttcgttcgtttcctttgcccttttttcgttttatttgtgtatttggccccgttccctcttctctctcgcccattgtcggcagtataaaacagaaaaaccaacaagcattggcaaaagagaaaaggaaaagcagcaaaaggaaagggccgccgatggacggacggacgacgcaaaactctcccccgccccctctttctcattctctccgtctatcgcaccaattttatatacgaagcacattgtctatttgacaaaaaattgtcgtaaacaattaggcgcggttaaaaaaacctttgagtttaattgattgaaaattaaattgggttttaatggatggctacaagaaaaattagaacaaaaacaacatttacccaacaattacataacgtactcggcgtattatacacaatacagcaggtgtttaaattttgaaactgaaaaatgaaattttaattttattgcaaatttttgcgacgaaaaagcaaatgtctctccgattcactttcttttgggcgtacgcttcccaacaaagagagagaggagagagcaaattggccacgatccaaaagagttagagaccaacgaaattggaaatttatcaaaataaatccccgaccaattgattttcgactggctnaaggtaagcattgaacaaatattaatatgccaagcaatttgagcgccatccgcgcggac

SEQ ID NO: 6191 - DNA, 4609 bp, Heterodera glycines
ttaaaaggtgcgccttcccttggcttttgctcacttttcactttccgctggtgcgtcacttcgctgtctttcgccctcttctgagaccgtttctttggacacctttcaaatttaggcattgttttatttttcgttttggcatttctctctttttccccttacggtcggcgtccgtcggatcaatcgatggaacgacgagcgaatggaggagccgaggaggaaatacgacgacgaggaagaggaggaggcggaagcggcgttggtcagcgacggcggcgactcgtccgccgccacagacagcccaccgctgagccgcgcgttgctcgcgctgtggtgggacgagcactcggagacggacgaggcggacgacgtgcgcgcgtggggacgcgcggcactactcgcgccgcggcgtttgccatgccttggcaaaggaaaaggggggaaatgccccgattattaatcaactaattaggctattatcagaatgagtctaagtatttaccggttatgtccatttgccacccgcgtctgattattatgggcatctttttgttgctctgcgactgtcgccggtgtcttttttggcgccgggccaatggcagtgaaacgcggagagagtgacgcgcccaaccaccagcccatcgagccttaaaagcagagcaaatcaaatagattagcatcggtttcgtcattcgctgcttcttttacctgccgtactttcggatgcgctgcgcgcactcgccgaaccgcccgaagtcgtcggcctccggcgcgtgcatttcagcgccgcctccgctttgcactgtccgtgcagcgaacatgagcacattttgcaccgcacgccatgccgcatccaaagctgaaagtgcgtgatcaccaaaataagtgccaaaagcgtccacgccgaaatagtgtcctttttggtcagaccaaatgaccgttgggccaaattgtgcccgttaaaaccaaaaccgggattttcgattcaaaatgatgaggcgggaacacaacccgtaatgccggctaatatccctattctaattgaacaaaaatcccgtgactgtacccagagagtaattccggcggatacagttcaaaattcaccaatttgttgcaatgggcacaaacagcgggtgccagaaactgagcgtcagtccattggtgcgcgagtccgttgcggcgcaggccggccaccaaaacgctgctgtccgcctcctcctccgcggcgcccgccggacattttcgtctgttcaaccgttggaaatgcctgcacatttctgcccgactgatcagtcctgatcaaaagaatgatgtgagactgatcagtcatttaattgccgataaattcgcttgccatctctgtccgagtcaatttcgccaaatgcgtcgagaaagggaaaattggaggcgaactgtttgaactcggcacgcgaaatgtagctgaacaacaagcaaattgaaatcccaaaaagagatgcgttctcttttttggcttcctacccgtcccggtcgttgtcgtagtgtttgaacacggcgtcgaccattgcggcgatgtgcctgaataggaaatttttgcattttttggcaggaggtacggcggaaatctataatgaaaattctatcataataaatgataaattttgcaaagtttggccatggcccctcccccatcgtgccgggtctgatcagcagactgatcacacttcggattgattgactgattggtaacatggtcagtcagccaatccctcgctaacaaataagcattgtcccaacaccgacttgtccaccgtgtccgggtccggctgtgcgcatacgcccgccgcccaatcagcgaacaccgccggcggctccgccgcgccgctcggcgccgactgcgcggcagcgacggaagatgccgtcttcggttcacgctccagcgacagttggtacagctcacgctcatcgtacgcgatgtcgaacagcactttgagtgtgttgatcagatccaggttgacgtcgccgaaacagtgggccgtccgacaaacgccgagaaaatgggacaaaagttgcgagagttggaaaaggcctgcggaagtgcggcaccgatgaaacaaattggatggcaatgccctcggaggtaaacaaacatttttcggacattcggcgcgagttttcgaactgttccaacccggcactgtgccaaaatgcgatcaaatccttcagatgaactcccctgtatgttatgggaattcaaaaaaggagaaagtcatgtccctcttttcacattatcggaactttgaagcggccaccgaccgaacgcaaagttttgcggtaagcggcgtaattattggcatgggaaagcaatttggtgagggcggaaaggtcgtcgagaatgtcgggcgggaggagggaatgggtgaggaggaggcgggccacgttcgaatgcgtaatgccaccctcaacaggggaaggatcagcaggagtgatcagaagagaaaacgaatgatcagatggaaaatgggtgagtgatcaactggaaaacgagtgatcagaatggaaaatgggtgagtgatcaaatggaaaacgagtgattagaatgtatgatcgatcgatgggaaaaaagaaaaatgatttaccgaatagaaaaatgaatgagtgatcagaaaacttactgagaatgagtaattaaagtgtatgttcagaatgaaaatgaacgaaaaatccaaaaatggaagaaatgggattaaatgatcaaaaaaactcactattacggccatcaaagtgttaaaattattgttgcgccgaagatgctaaaaaataaacagaattattttgttacctgtcacttggttactgttgtttctgtgtacctacagtatcccacccacccccactccctttaccgtaccctgcccacttgcacaaatttcgtgatgatttcagcgcgttcgcttgccgtcgctttgcttaacacttggcattgcacccaaccggagaaggactaaaggggaaacagtttgaaaacttaaatttttaattatatttaattacattgaaaattccgatcgatcgttccaaaagtggcgtttgttggcaaagtctccccacgcggacgtagcgtttcaactcggaaacctttgccattaattgggagaaaaggccaaaattttgctaatattttgcataaaatactcacgttgactcggctgagcactttgtgatcaatgtgactaaaccaaaaaaaatgctttcaattgttattcgtcttgtatttcgaggattctcgagattctcgacgtcgctaatcggttggaaaatctcttggatttttgtggtcttagtcttggtgccattctcggtctcgtttttggggacgattctcagttttcggcaccaattttcggttctcgagtctcggaaacgttcaattctcgagcagtctcaactttttcacctcatcgaagtcgcaatgtcttcggggctccactgttcaaaacacagcgaaacgtggcgagagaccgggtttcgcacagagacattgcgcagccaagcataggagggactggacggacagaatgccaaacaaaatgccatttaattcatttttcaaaattaagattttgtacatcgccgaaatgtccaaaagttcgtcgaccaatgcccgggaaatcgtttcatcggcggcggccaatttctaaaccattttggctttgttattgttttaccgtttgctcattttgactttcaatcggtccaacagtcggcccaattgggcgttggcgtcgaaatgtgccgggtgccgacggatccaaaagccgacggccgaacaaaccttttggccatatccgagcggatcattctgcaaaaacatcatttttaattattaatattttttccattttcaattgcctggtaaagcgaaacgaaaatggccattaattcggccaattcggggcaaagccattcggaggccgagaaaaaccagcagggaaagtcgggatcgggctcagccgggtcgccctctgaaaagaattgaatttttaaatgcaaattaaattattattattattattattattatgggaggacaccgaaacaatcgcaacatcgacggatcaattcgaacaaatccatcggttcggttgcgtaattcgagcagcacggggaatcggccatttttagttaaatgggcctcaaaaattgaacatttttatcatttcacatggaaaaatgtgaggcatttgtataaaagtggggggggggggaagagaaaagagaagagaaacaaaaaaaggaagagagattatcttttgaatatggcgacgaccaaaaaacaagttacaacaaaaaaaatatgagaaaaaaggaggacgaaacggggacaaaagcagaaggaaaaggaagggggggggaagaatcggagaatgggacggggaatgatcagaaaaggatcgggggattgggatcagagggtaattaggaaggggatatgtagtggagaacgagacagaaactgatcggaaaggagtaaaaagagagagtgaaagaaccggggaaacgggggaggggtgaagaagaccctaattaggactaattaggagaggaaagaaagacagagggccagggg

SEQ ID NO: 6192 - DNA, 1444 bp, Heterodera glycines
gcataggagggactgggcggacagaatgacatagcaaaatatcatttaattcatttttcaaaattaagatttggtacattcacgaaatgtgtcaaaagttagtcgcacaatgctcgggaaatagtttcatgggcggcgggcaatttatattccattttgtctttgttatggttttaccgtttgttcattttgagtttcaatcggtccaacagtcggggcaattgggcgttggagttgaaatgctccgggtgcagtcggatccaaaagacgatggtcgaacaatccttttgttcatattcgagcggatcattctgcaaaaacatcatttttaattattaatatttttttcattttcaattgcgtggtaaagataaacgaaaatgaccattaattcggccaattcggggcaaagtcattaggaggctgagaaataccagcagggaaagttgggattgggctcagccgggtcgccctccgaaatgaattgaatttttaaatgcaaatttaattattattattattatgggaggacaccgaaacaatggcaacatcgacggatcaattcgaacaaatccatcggttcggttgcgtaattcgagcagcacggggaatcggccatttttagtttaatgggcctcaaaaattgaacatttttatcatttcacatggaaaaatgtgaggcatttgtataaaagtgggggggggggaagagaaaagagaagagaaacaaaaaaaaggaagagagattatcttttgaatatggcgacgaccaaaaaacaagttacaacaaaaaaaatatgagaaaaaagggaaaaaaggaggacgaaacggggacaaaagcagaaggaaaaggaagggggggggggaagaatcggagaatgggacggggaatgatcagaaaaggatcgggggattgggatcagagggtaattaggaaggggatatgtagtggagaacgagacagaaactgatcggaaaggagtaaaaagagagagtgaaagaaccggggaaacgggggaggggtgaagaagaccctaattaggactaattaggagaggaaagaaagacagagggccaggggaataataataataataattgggaatggagaagcaattgaagaaggtgagataaaagaagcaaaatgataaataaaatgatagtaaagtagggagaaaaaaatggaaaaggggagaaactcacggggaaattttgataagggaaaaaggagggaaaagggggtcaaatgattcaccgaaacatttgaaaagatgaagcgcattttgacagtgaatgaaaagccaaaattggggaaaaaatgaatgatcaatagcagaggaaaaatgttggggtttcaggattaatttgttgaactttctgtcgggaattgtgctgggaaaacaaagcgtacaaacggacgaaaggacggacagacggacggacc

SEQ ID NO: 6193 - DNA, 3273 bp, Heterodera glycines
cacattattcgagacacagcacgagaagagaaagagagaaggagagagattgcttagatttactccactccatctcttcccactcccccacccatcaagtacacagcaaagaaagggggatgggtttagcgcaagggaaaggcaaaatgaaatgaagtgaagaaataagtcctaacaaaaaatagcaaaaaaaattttttttaccgcacaaaccccgaccccggacaaacaccggtaatgcgcaaaaacacatgttttcacgccccggacaaacaccggcaaggtgtgaaaacatgtgttttcacaccggacaaacaccggacaccgaccggtctttaactactcatgccctcggaccattgcttcgtagttggccctgttccgaccatatgctgccttgaaaacaaaataattgataaatttgacagattaaacagatgaacttacagctgcatcggtattggccgcattctcatagttccacttcgaatgccttcaacaacttgcgataagttgtttgtgtcgttccataaatccaacaaattaatacacatttgattccgcgtacgatcactggcattagaaactgaaataaattaaactcgtcagattctcaactcaaaacgcaccattagggtggataattggtttattaaatgtaacagttggaccggcccgaggatatgaacgcggacagtcgagaacgacggaaaaaacacaaatcccaaatacacgagataacatctgaaaatcaaaagtaatagccaaaatattgattggaaatgggtcacagaggaaatgaggagaaaaatggcaaagtgaacagtgaacgaagggaggaagaggaggggtatttatgcaaaaataaatgaggggtcaacagtgtatgtgtgtgcaccagggttgttccgggtcacccgaatcccgaaacccgacatttttctcgtcccgaatcccgacccgatgattttgatcgggattcgggacaaaataagcactggtaaaaaaggggtctgggtgaaaattagtagataaagaaattggtggagaaaggagaatttttgaaaaaaaaaattaataatttatttcttttaagcattttattcttatgtttttgtggtctattggctatactttctgcttttattatttgtcgcttgggttcaattccccacaaggataaaatattttttttatttcctttacattatttctattaaaatttatgtttaaatattttctaataattaaaaattattattttttcttttttatacagcctaagaccgcaatttaaccaaagttttggttatttttttgacaaaatctgttaacaaaatcactcaaattttcaatttttccccggcggcgcctatcggcaccgcctcccccccccccccaatgttcccaaaaaattttttggaaaaaccgcggcgcaaaagacatttttaaaatcgcaaaaatttgaaattttttggagaaactctgttaattagtgcactgaaattttcaaaaatttctccggcggtgtcgataggcaccgccggacctcctagtccccaaaatttttttaggaaaagcgcgccgcggaaaaattttttattgctttcttccttcgaataaaaaaattttatttttgatttttgaacatatattaaaaaatttttaattgacccgaatccctaaacccgatatttttctcgtcccgaaacccgaatcccgacccgatgttttttcggccgacccgacccgatatttttctcgtcccggaacaaccctggtgtgcacggtgctatgtcgttatataaaaaccatcaaaagggcgttattccataacttttgtcaaagtcaacagaattaaacattcttggtaccctaacatttctctattagctcacctaaatttcaaaaaatttggtcaagtttgagcaaagttatggccaaaagtacccaagacaccgggttttcaaacatttttagctataacttttttggaacctaacgaaatttttcgaaattttgcaggttaatagaggacatatagggctagcgaatgatagtaaaagcactttattttgttcgttctaagaatgttttgatcagaatttttgatgatcaaaataatttatttttaattaaaaaatttctgttagaaattatttttgttttttatttttttgctattagtcgataaccctatgtgtcctctattagcctgcaaaatttaaaaaaatttcgttaggttttaaaaaagttatggccaaaaatttttgaaaacctggttgttgtgtacttttggccataactttgctcaaacttgatcaaattttttgaaatttagatgagctaatagagcaatattagggctatcgcatgataccaagaatgtttaattctgttgactttgacaaaagttatggacagttttaggttgaaatttttcatttgatggttttttatataattttagactaagctcgtcaagagcttttgaatgataccaaatctgtcaggattcgatcgggtttatacctgtcggatcaacttcccccacccctagattgatctgtctcatcgagagctatcgattggtaccatattcgtcaggtttcgatcgttttaaaaatcccccggataagccaggagtgccgtggagcagggatgggccgaggtttcgcttttcgcattttttggcgtttcgcatttcgcttttttttcatttcgcatttttcagtttcgcaaattttgcttttcgcatttcgctttttatttttcaatttggcccatccctggtctaggcctaacctaagcctatataggcgttgcctttgtacgagttgtaatgagtagggatgatacttttagtgacgaaaaatctcgaaatagttaactaaaacagtgagtaaaaatgccaaaatagtgatataatagtggcaaaaagtccgaaatagtgacaaatagtgacatcattttcagccaaaaactaagcaaaaataatttttattcaatagttgcagttgcaaatgagtaggactaggatttttaagggcaaaacccccaaaataagtacctaaaaaattatttttaaaattaaaaattcttgccaagaaaatgaatttttgagaaaattttttcatttcttaggagggcatttttgggtagatttttaggggtatatttttctgaaattttttaagtcgattcttaggggtgtattttttggttttattgcatttttgttaaggaattttccaaaaaatgtcaaaatagtga

SEQ ID NO: 6194 - DNA, 2369 bp, Heterodera glycines
tatgtctgttgacaatacctctctctttcatttcactgtttacaaaataattgtaacagaattttgatttttggcaagtaattaatttcatttcttaattttttttaatttatccgaggcttaaaaacgctgttaattttccatatttgagccaacctaaatatttttgcccctgattcgatcattgattagttcgcgacaatccattagccaaaatccaatggcaaataaattcggcgctatatgaaaagtggtcgattttgaaattttttcaactttttttttggtcaaaattttttgttttgttttttacacacggcgagtcaattttgggctccaagcgcaaatatgttggttttttcgtcttagtggtctgtgagttagtcaacaaaaagaggggctcaggttcaattcctccttgtgtttgtgtataaaattcaattttttaaagcaaacaaataaaatataattaattacagaacgccaaaagaaaaaaatttcaaatacaaagagttagactattttttactgctgattttattgaaattttttagcttataacttggtcaatactagaacaaataaaatcattttatgctcattttgaagggaaaattctgaagaatatttctaagttagtcaaaagtttaaaaagattgtttattggcaaataaatgattcatgtgttattttatatgttagagactaggaaatagtacgcccaaatgagagaaaaagaaaaaatttgccctgggaaaagattttttcctgtgggtaacttttcttaaaattttgcataggccaatattttgacctcctctagcgattccaagtttattttgtgaaagttaagtttttaactcgagatcggctcttgcgtttcttacaagggaaaattccacaaaaaaattttaaattttgaaaagttttggcgttctgattactaaataaataataaacttatttgcagtaggagcccaaaattgactcgccgtgttaaacgatcaaaccgagcaaattggtatcactcgaaagatttttatgtttagtctaaaaatcagtgaattaggtcgaatcgactgcatttaaaatatgtatgtagtaaagaatccggtaatagtaccgatggtatcacaccttttttgaaatttttttcaaaaattcaagtcatatatttattataaggttttcggggtcgctgagcacgaatatggcatccatttcagccaattccggacccctgatccgaattcaaacaaatcgaaaacacaaagttttcaaaattcacatttaacaaaatcgctccaaacgcacgataaaagaaaaaagaaaaaaaattcaatgttcgcatggataaaactcagagacatgcagccaaaaattgtaaaaaacattttcacgattttcaagccattggtcaaactcattgtcttctagtgccaatttatcgtgcaatttttgggacgtaaagttccgaagttcttttagcacagcagccatataataattttaaaaaagaactgaaaacgttaaaacaaagtctgtttctgctttttatgaatctccgtgcgtttggagcgattttgttggataaatgtgaattttgaaaaatctgagttttcgatttttgttcgaattcggatcaggggttcggaattggctgaaatggatgccatattcgtgctcagcgaccccgaaaaccttataataaatatttttatgacttttgaaatttttaaaaaaaatttcaaaaaaggtgtgataccatcggtactattaccgaacaaaacgtacattttattaaatttctttgcacttcgtcaagatggtcggacattctttggaatgacaaattgttcgttgttattctataataaataaagatgtttttcgcttcttaaaaaataagtaaaatttcgatttaaacagggaatctgccaattgagaaaatgttgagcactggcaatgaatgggaatgaaaattagagtagagcgggatcgggaccaaaacgcggacaactgagtaccgaagtcacggttttgaccgtgatcggaaaaagcctgggttttcccagccaaaaagtcccggtttttttcaacccaaaaagtccctgtaccgtaccactctagtttcacgcagggcttacgaccgaaaattttcaaaatcaaccatttggcagacaaaaataatcataaaaaatcaaaatgatgaaaaatcacaaaaaaatcaatgaatgatatgtaaatccgagctcagattcgtggttcagcgcattttttaccccagaaaaggtgcttcttaaattattatcattttttctcagaaaccacaaaactttactattgccaaaattggaaaacactagtga

SEQ ID NO: 6195 - DNA, 1069 bp, Heterodera glycines
ttatattttttgtttttgtttttatgcaaagttaattatataaaaatttgtttaaaaaacaaaatttttattttaaatatttttccattaaaatcaaaaaattattacattaaacataaaaatgcaataaatatcctgtcgtctttttaaaaaatatttttgtataatattttttattgagtatgttatgtatcaaaatgaatagaaaaataacatttttttataaataattttttgataatttactttgcataaaagaaaaaattaaaaaattaatttgcatagaggtgatccgaacctggggctcgaataaggttgactagcgcactacctctacgccattcgataatcaaagccaaaaaattattaaatttgttttttcattaaaaaagtttggcacgtcataacttggcacccatgttcatttggcaaaaataggttaaaattcataatacaacccatgggtgatctgcccaccgaccaagtttcatttagaaatcccatggtcacttgccgacctctcctttgttaggaatttagggtaatatttgaaaaagcataatgctttttgcgcaaaaagctgtaaaaatagagatatataaagagttttgtatatttagcatttctttcatataaaattaataaaagtttttgtaaaaattcagaaaaaaatcaaatttttagaaaaaactcgaacatttttctcttattgtataatatatttattgataaaattttgtcattaatgttctggttcaattctctcgcttgggaagactgtatctttttttttttttttgctgagggcagctttatatatgaaaaaatattttaacgaatttttttttaacattgataaaaaaatatgtttttagtagttttattaattgactgagtattcatggatatttattcttcaaaactgcaagacttttaaatttaactttttaattgttgagttttattttctattgtcttagtataacattacatttctattattttttgttgttgtcaacaatacagaaatttatagttttatcatcttttcatgtataccaagggatcc

SEQ ID NO: 6196 - DNA, 2730 bp, Heterodera glycines
cttgcttctttttattattagttttatgcacatcattatcatcatgtaatgtgaaggaaatttgacaaatttcaccacttctctttcggttaccttttattgcatacgcattgttatttcgttttgatatttttttattgattatatctgttgtatctcatcgctttgccatattcttatattctatgtatgggctgttatcaaatcatttgttttttaaagctaaattaattcaaaatttaaaaacttttataattgtctgttttaaattgattcatttttattttaattattttccttattaattttatgctcatttttattcatcatgtaatgtgaaggaaatttgacaaatttcgcaaatatattgtataattaattatctatttactaaaataataatttaattttatctcgagattgaagaataggcatatgcagtccgtaaatcaccttcaacaaagttatcaagtgtttagtaaattataagcaatttttaactaagtatttaagaattttttgcaattttaccgagatgaaaattaaaattatttgtataaagttgagtaaataaatattgttttttaattttaaattatttcattttatttgcagaacaacaattaaacttattttcttataacttttagaactgaccaatagcatcatagagtttgttgaaactatttaatttctatttcaattatttaatgcttttttcgttcgagtggtgtatttaaggcatcagctgtcttaattacaattggtgtgattcaagataggcgggtaattcaattttaagcaattttaattattatgattttaattttttcttttttaaatatatatttttgttttaagaaaaatatttcttgttttaatttcaaatcctgattggttttaataaaaagtattcattaattatttttagtagaatatttttatcatactttaaactaatgcttcaattattttaaaatctttttcctaattttaggaactttctttatttgaataaaaaatatttgttaaaattatcttaagtattaattagtaattatcaattttatttataaaatgtacccctctccagttaatttgcattcgaagaactgaaaaaatatttttttggccaattttcctgctaggttggttctagtttgaaaaaaatgccttaaaaaacgaatttttatgggtacattttaaaaaattttttgaatttttcacaagaaattttgataatttcattcaaaaatttaggaaaaatgctaaaaagtctaaaatatttaccaaatatgtaaaatgcttcaaaatatgtaaataaaagtaccgactttattggcaaacacgaaaaagaaaatgtttttcctactaattaggctatggagaagacaagaaaaaagcatggatttacataataaaagaagccctgaaaaatgtttatttattaaataaataacatttttaactttcaaatttctcatatatatcgttatagtatgaacaaacttgatcatttaattcttaaatcaatcataaatcagggtttaaatttttttctttagatttaatggcccaagatttttgattaaataaacattaaatttgataccataaaatccaagccaaaaatagtagattaatttcaattttgtagcaaattagctgttaagatttactttattttgttaacttttaagtgcgatgtcacgcataaaaatttggctttggatgactttcctcgttcttttttcgaaaatttttggtaaaaaatatgataattattttaaaaattatttgaaatttttttatttttttataatttgaattttttaaattattaatataaatagttaaatgttaattaaaatttttatacccgaataacacgacttcagcgcgtgaagaaacaataattttcgctttaatttatttataacatcgtagtcaattctggtagttctagatcactttatgtttttttttcaaatctttttttataattttcttttcaacaagtatattaaatttgttttttctatttttgtataattattaatgtgataaaaatcaatgcaattgtgtgacttccagattttcggaaagtaaatttccataattctttgatgcatatttatttgtttaatttaagctcatcagagattcttctaaatattttaataaatttattaaactctagtttattgaaagcgaaattgggtaaacatatcgtaatgcaaaataatctttttttattcttatattttaatttttgtatatttttttgttatctttttattgttaataaataaaaatactattttacttcaaaaaaaaataatttaagaatatataaaaataaaaattttattgattttataacatatattttgcatattttttggaattatgaatcagctttttactaataataatcttgaaagctacccaaagttatatttgtttattcttctaattttttcagatgttaatagttgagattgttattaagcaaacataaattacaatatttttaacttataccatataagaaatttgtataattattcattatcttaacatagaattatttattatttatttttaatagtcgatgttgcattttttcgattttgctcatgccaaaaattctaagaaaattgtataatttatactggtttcagcaattcaaacgcaaaaaatgtttttaattcatttaaaatctctttt

SEQ ID NO: 6197 - DNA, 2261 bp, Heterodera glycines
tagggttgagcggtaccggtaccggtaccggtactggccggtaattaccggtttttttggtacctgtaccggtaccggtaccggtaccggtaccggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatggaattacacacatgcacatgtggtgtagtggttaaactttctacctttcataatttttcgcctgggttcaattccccacttggatagaataatttacatggccggagaccccttcgcaaaattggaaaattggctgctgaccccttgttttgcaataatctgaattttgaggtctatatctgaattttagtgttctatgtcctgaatttgaaaaaaaaacttggtcaacctgaatatacatatacttctgaatagagaccggaattctcaaaaatgccggaccggaccggactggtattttcaaaaatgaccggattcgggatccggtctctcataatccggtcaatccggtaatccggtcaatccggtaatccggtcaatccagattttcaaattgccggatccggaaccggattccggattggtaaaaatttaaattttcacatgttaattttggaaaaaacccttaaaatttcatctattatatgtagaaatttggtgcaccagaaaatgtcgtcatagaaaagacaatgcgccgaaaaaaatatataaaatttcaatttttcaaaaaaaatttaaaaaatttattttagagttttttatttttgaaaacctatgtttaatgaaaaaataaaaaattttttttgcggcgccctttttccaaaaaacttttgggaaagaaagtagtgggtccggcggtgccgataggcgccgccgggaaaaattttgaaaatttgaggcgatttgtaaacagattttcaccaaaaatgagcatttttttttgcttttttgggcaaattttttaaaaagaaaaaagttttggaggcccggcggtgctgacaggctccggcgggggagaaattgaaattttgaccatttaaagttaaagacattatgccaaatagatatttttcaaagaaaaacgaacaaacgtcaaggttttttggttgagaccaagccggaccggatccggtcaaaaattcgccggaccggaccggattggcattttcaaaatgaccggattcgggatccggtctctcataatccggtcaatctatgtaatccggtcaatccctatttttccaaaaaatcgccggaccggattcctgatccaggaaaatcgggtaccggatccggtccggtccgctctctacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctattagctattcttattttcagtgtcttcaataagtcgtttcaattatcttaggttcatgaaacaaattgttttcggattctttctgttttatgaatataataaaaaaattgttttatttttattttacttgaaatcctaacttattattttcttatgcagcttttattttaattgaaatgctttgattgttttttaattaccgatgacgatttccatatttacaaaatttcatgtattcatagtgatattttccttttattattattaatattgtttaaattattcaataatgttttatttatttatatttataataaatcttgcaagaattcgccaaaaattttttgttgtgtaggaaaacggtttttttgtgaattgatctgactgatgtgattccttagtcatattcgaattgccaaaaataaatgaatatattttattaggttatttatcttttcgaaattttaagttttttggagtaataataaaccgattaacaaaatatttttaacagatatttagtttttttgtttaaaataaattaaatattttaatttttatttatttttttaattagtatttcatcaaatttacatgatttttaaacattatgtaaa

SEQ ID NO: 6198 - DNA, 3065 bp, Heterodera glycines
atttactaattgatggaaaattactctaattgtccttaagatttaattaactcggtcgttaatttaaattttttcttatttgtttcaaattaaagtccgccgcaacatccgccgcgaatggtgccgcggtcggcgtggaatcgcacggtgcagcagccatccccagacgccacgcccgccgcatggcagatgcggtccagcgcgaggcgtctgcgcacgcgcacagccgcgagccgctcgctgccaagctggcagcaccgcaccaattccggcgtcgcagctctaccacacaaaaccatccgcagccgcgtgccctgcggcgggccgagtcgtcgggccgcgacggtggccgcgacgcgctcagcagcagcagggcaatggaatcgccgccctcgggcagaggtgcaaaaattttgatcacttttacgccatatgatcagtttaaaatcatcaaaaatcaaattttacaatttgaaattacagtacacgatgctgtctacagtaccgtgcgacccattggcgaccgcgtgccgtcttccgcaatgcacacggggcggccaatgccacgcggatggaccactgagcagccgcctccggcggacggcgaagtgcgcagttaccgtgcctcgcgcaccgtcgaacaccaccgtcgcgttcagcgccgacattgattgactgagtgacggcaaagtcagtacatgccatggtgtggtgccctgataatatctaaatcatccaatcagatccggggatttaattagtccaaaatcgtggaattaactaaaatagtcagttcgatggtggtcagacggtggcttaattgttggatttttttttgatcgggtggcgatcagttcggtcctcgccacacaaatttaaagcaaattgtttggcgctcaattgtgcggtactcaactgaccgtgttttagtttagaactttccattagagtgcagcgggatcgggacttgaacacggacaactgagtaccaaggtcccggttttgaccagttttgaccgggaccgggaaattcccggcttttttcccgggtttcccagccaaaaagtcccggttttccaacccaaaaagtcccggtcccgatcttgcccaaatttcccgatcccgctgcactctactttctattctatcgatgtatttgatccgatcaattttttgccagagttatgaggatggtcgagcactgaaaactgatgcgatgcgttgtagcctcaatcttgccaaaaaaaaaattgtgattacacatcgttctgctggcacaacatcacactcaataattaattggtgtcgctttgatcattacgattagcgcattagacaacatacagtatcatcgaaagcatacggtagaaacaattgcaacgacaacaaaacaacgacacagcaacaaaatctgtacataagggcatcgtatttttccagcatttacaaagcacagatcaaccaacgctcatcagcaaattttaagggtttgtatgaaaaattgtgcccttcattatggtaattcttagaacacatacggtaaattaaaaatatatacggtatatataagggaatgtgccaaataaatagtggaagccatttttattcactgctttggttgggtgcttttatggcttttgcactgctcgggatcagcttgttccagtgaattgggccaatattgagaatttatttcgagatttttgatgagtcattatggttgagtttaaaaaatcgggactcttaatgggtaattaaggctgacttttgaaaaaccgagacgcttgacggatcattagggctgggggatttaaaaaaacgaagaaaaaaaaatcatgaaatttagtgacgatgcacaaaaatctcgaacaataactgatcacaacatgctctatctgctttagttgcaaataaattataataaaaacatttctgtgtgaaataaaaaaaacaaattcccttctaatttcagcctcgtcaaataccaaaagcggtgagattttttttcaaaatttaatttttgtatgatttttgctgtgttcgctttttcattttttttctttctatatttttgtgtatggcttagcttacaggcgcttcccgaaatcaaattggagccgtccgagccacaaatgcatccatattataaggtcccttaaaattgtatttttcggggggggggatgggattaagctgctggtcaacaaatctcaaatttattggggtgatcagacacttttcgagtttttttttagtttagatatcatatttgctattctgatcagagagaactctgatcgaattctaatgcactattcggacttgaaagtgatttggtcttatttttgaaagatcactaactgtataaaatcgatttgcttgtctgatcaagactctaatctccgaattctaattcaatattcggggtttgaaaatgatctcgtcccatttttgaatgatcatgaacggtataaaatgaattacaaatataattaatgatctgatcaacttttggatcggcctggtttttggtttcctttaaattctggccctggcccaataagattgcatctgatcaatccaacctgatcggtcgtaattgttattttgtcattatttcaatcaaatgccaatgccttcccgttcgatttcatgccaaagctcctctgctgctttgtgccaaatgctaatgctttttcaggagcacattcgcgagtttttggacagccgctcctcctcagcatcggcacaccgtctgcaccaacaggaaagccggcacagcggctatgttactgtgagctccaaaaaatgggcctcgctttaccgtatttactggattagagattcttcccccgcgggggggggggctttattaacggggagggggaagtaatgtaccgaaaaatagagtcccctagtttatgaggcactaattgagtaaatacggtagcttttgtgtgttggcattttccctcgagtgtccttaatattctactaaaaagttgtgcttaaaaaaggtgagagccaatcaaaagagtcctggaaattggttaaactaaaagccg

SEQ ID NO: 6199 - DNA, 3612 bp, Heterodera glycines
  misc_feature (67)..(67): n is a, c, g, or t
gagacgcttgacggatcattaggggctgggggatttaaaaaaacgaagaaaaaaaaatcatgaaatntagtgacgatgcacaaaaatctcgaacaataactgatcacaacatgctctatctgctttagttgcaaataaattataaaattcccttctaatttcagcctcgtcaaataccaaaagcggtgagatttttttttcaaaatttaatttttgtatgatttttgctgtgttcgctttttcatttttttttctttttatatttttgtgtatggcttagcttacaggcgcttcccgaaatcaaattggagccgtccgactcaaatttattggggtgatcagacacttttcgagttttttttagtttagatatcatatttgctattctgatcagagagaactctgatcgaattctaatgcactattcggacttgaaagtgatttggtcttatttttgaaagatcactaactgtataaaatcgatttgcttgtctgatcaggactctaatctccgaattctaattcaatattcaacttttggatcggcctggtttttggtttcctttaaattctggccctggcccaataagattgcatctgatcaatccaacctgatcggtcgtaattattattttgtcattatttcaatcaaatgccaatgccttcccgttcgatttcatgccaaagctcctctgctgctttgtgccaaatgctaatgctttttcaggagcacattcgcgattttttggacagccgctcctcctcagcatcggcacaccgtctgcaccaacaggaaagccggcacagcggctatgttactgtgagctccaaaaaatgggcctcgctttaccgtatttactggattagagaatcctcccccgcgggggggggggggctttattaacggggagggggaagtaatgtaccgaaaaatagagtcccctagtttatgaggcactaattgagtaaatacggtagcttttgtgtgttggcattttccctcgagtgtccttaattttctactaaaaagttgtgcttaaaaaaggtgagagccaatcaaaagagtcctggaaattggttaaactaaaagccgattttttcatatttttcctcatttttcatagccaatttttcttaaaaactattccacaatttacgcattatctaaaaatgtgccccaacctacgcattatacattctgtaacggtggttttgccgtacccgagacacatatcgattagacacaagtctgggtttcaacgaactaatatgccatacctgattagaggggaagtagcattgaggtgatgtgcatggagtttatggaagccaacctgctggtgcattatttattttttatatgggctttgctctagcccggatcccttggcattttttggcctacccggatcacagacttttttggccctgacccggatcccattggcatttttttgacctaattcgttcctaagatgtccatctcgaccgttataaatccttgagaattcctgaatttcttgtgtattctcaccccctagggggcgccaaattttgtattattatgcccctctctccgccgatggcaagcaggacacctcctcctccatgtggcagttcaacggcagcagctcgttcagccctcgctccttggtcaccgtgaacgtgccgccgccggcgtcgcaagccgtaccggacgacgacgtcgacggcatgcttttgcgcgtgcgcacgtccatgggcgctgggacaagttcgtccgcgtcgcatgcgtccacctcgtcgcaaccgccccagcgacagtttttgcggaacggacacgccacgacgatgacgcggacgaccgcgactaacggcagccgacacgcaacaaaggtcggtgccgtagttggttgtccacacatggcacaaaggtcacacatcacatcataccgcggcacggcatgccacgtgatatcagtcaccacacagcacacggcagcaacaaaatgttaccttgtttctttgtttgttggttgtacatggcactcacaccacaacaacaacaaacacaccaagatggcacaaatgccatcaataaaataaaaaattgttttttgaattttcgtctttttataaattttttttgctaaacataaaaataagtgttgatatgaagataaaaattaagactttttatttgatggtctaattagctaattagtatagatgggttggcacaaaacagggaattaattagttgttcaaattagcgaactgtcgtttttacgcatggggcggcacatcttttcatgagatgcaccacacttcaataatgcaccttcacatattctcggacacatttgttatgtgataacatattttgcaattttaccgtactctcgctgcagcagaacttactgtattaaagtaccatttttacagtgtgtcgcttcttggcgaaaatccgttgcttaaacccgctttagcataataatgtatatatacctacattatgcaacacatttgccattcaatagagagagctttattgcttttttcttaaaaaattgtaccctttggctgtccttaattttaagtacgcgctttttaaggacgggccacataatttatgggcaggaaagggacagggacggtcaattttttgaataaaagtgaatttttcgactgaaattatagcatttttaaattaaaaaattcaaggacacctgtatatttcaaggacagtcaaagtttggcaaaacattcataaaatttgcttcccccgctgaaggagcgtgccattgtgaaggttgaagcgccgccgccaattgtgcgccggtcgccggtccgtcgtgaggtggtcgaagtacggcgcgaagttgtcaaagcggcgccgaccatcaagcacactgtgcaccgtgtggaggagaaaaagcgcaccgaggaggtgcagttttcagctttatggaatacggtagcattctcgtctatccttctactatgtctcaacgtgggatatggtacggttttagccggttgtttatacagtaagccaccccccccccccccgccccccgctggacaagggcgtccttatactgtaccgcacaggaagttgacggttttagtagcctcagccatacaatataacattctccaaattttccaattttgccaggtcgaacggcgtgtgattcgcaaggaacgccggcacaaaagccgccgaatgcaccgcagtcatcacagcagcagcggcgatggtgcgcatcaggaatatcagtacgggtcctggggcggcggatcacgaggaggcggtaggttaaaaaaaccttaatttttagggggcctaattaaaaaaaacaataatttttccaccgtaaggcggctaccgtagcagctccgcgtcgcgggcctcgcgcggcgcgtacatgaacggttacggaagtcatgcggcgatggagcatcatttgccgatcacttacgagggcggcggcacgcgttctgtgcgtagtggtggcggaggcggttttgactcttcatccgatcgctactacgcgggcggcggaggcggccgacagcaaaacggtgggtgtactgtaattatggggggggggggggggggggtactgt

SEQ ID NO: 6200 - DNA, 3475 bp, Heterodera glycines
accagccattcgtcaattaccgttctgatttccaaggcaaattccattttatcgtggaatttcggcaaaggtacttttggttgactaaataattgtttttatattagtatttttagtattaaatcgttttaggaacatcaggtcattcgacaccatacaattgtacaacaatgaaagcaaaaaatcgcaactgtttgaagggcacaccgcgtgctttacccaattcaaagcggagaacaattcgaaacccatcagccttttctgttacgcggtgcgcagcaaaaatggcgttggaaaagttggactttcaaatttaaaactcgcaaaattaaattgctgagtgaacataaatcagttgcacatagtccaactttcggaaacgcaaacgggtaatcaaccatatcagtcgaatactgacaacttccatttccacaccgatgaaacggacgattttcctgtcgcaattcaggtaaaaaactaaaatatatatgataaatggaaatttatgtaaattatttgtcccatttaaattattttcctttagccttccaaatctggtcttttgtatttgttcaccaaacttgggtatgttcatttgttcgacatcgaaactggtacaaaagtttgcaacacgcgcatttcggacaaagccgtgcttttgtcgacagaactgaaagaggatgacgaagtgctctgcatcgatgggtcgggaaaggtccgtcccatttcaaaacggaaatgcatataaacatttacaatcataataggcaattttaaatctaaaaatgactaccaatttattatatttaatgacttaccaaattcaggtcattagtgtcggtcttgataagtcagcaattattccgttcatattgaaacaccataaaaacacggaattggcgcttaaatttgcttctcgttacaatcttgacactgatggggtcactgtaattgtgattaatttacttttaagacatattttccttcttcagtctgacagtaacaacaatgatcaacccgtggctattcaagctcatcaccaatgccaatctgtacaacaggtgcttcaaagaaattcatctgtaaatgcaatgggattacttatatctgtttctaattgttttaaaaatttagtcgagcatttccaatggagcaaattctggcatctccaatgggacggcaccaatgccattgttcgagtcgaccccgagaaacgtgcttgttttcaaaggtgttcttttaaatcctttcaaaaaactctttcgttaaagaaaacgtcggacgcatcggctccgtttcttttacggtcacaaatcgtgaaacgtgtgccatttacttcaagatcaagtcgacttcaaatagcttttattcaatttgtcctgaaaacggaattatccaaccgaaagaaaacgtcgaagtgattattaagccaaatgatgacgagcttggccaatttgcaagaaataacgaccaaaaagcacaagttcttgatcatggtatcgagctgctgttttcggtttttcttaaattccttttcagtcggcaattgtttcgaatttggcagtgcaagcggaaaatttttggaaaggcaaaaagcacttctcagaaggtgtttattccaaaaagctgaagacgaaggtgaaagtggcattattatactcaaaaataagttttaaggtgcaaaaaactcctcacaatcagcaaaattccgaacaacggaaaggctcaacaaacaaaggaaaaatgtctaagaaggggaaacaaatgatggaacaaaaagaaaaagcatcagaaccgattgaaatcccaaaagcggatttgggagagacatcacaacactctgagggactgttggaaaagcggtcgaaaaagacgtctccaatcccagagaatttggaaacgatcttagagagcgatcgggagcagagtcagggattggcttcaccagcaccggagagctttcaaggctttgagttggttccacgtgtcgccgagacgtcaaacaattcggaaggagtgtctgttcaggaaccgaaagtggaggccaatcgctccaattcatccgtcaatcgtttatatggtctaaaaatgaattaccgttgtctcacctcctaattggtatttttttaaattttagctcaatattctgccgaaattgcattgtcactgctcgaaaaaatgtcagcgagggatgccgtgcagttcagaatcgatttgaacagctttttggagaaatacgaggctaaattccttgacgaatgagtcggaacaaatgctgctgctttttgcgagggctaacgatcagaacacttcgaatacaatatctttcatacgtagtactaacctttttatatttcggaaggcattctcaaaattattatttctttatttttctcgtttttaatattttcattttatatacttttttttgtttgtttttttatcgtccacgcgcatcacagtcagtttgaacattgtgtaaattgagttcactgttttatactaataaaaatatttgggttgatttgattaacgaattaaataaataaattttgcagacgaatttttgagaaaatttttcatttcttaggggaatattctgaaattttggtcaatttttaggggtatatttttaaaattttttgggatcgattattaggggtgtatttttcgtttttattgcagttttgctatgaaatttctggaaaaaggccaaaaaggtgctaaaactcgaaaaatgccaaaataggtgctattgaccgaaaatccagttttaggtatttttaggtgctaaaaagtcgctctaaatcgaaaatgttcggagaaaacgctatttttgggcttctctcatcataactaagccgcaaaaaaataggtaaaaccctaaaaatcccatctctacagatcacatcttagcaatttaggagaacttcaaattaaaaaggattttataaatttaggataaaaattggaaaataaattgatttcgagtactttttcaccaccctcgggaaaggggctcccggtaaattggacaccagaaaattggacaccgaaagttggacaccagaaaattggacactgttgtaaataaaaatgaaaataaacaaaataaattactaaacaaaaattttggtttggcctaaaagatctttatcttaatctgccatatgttgtttataagcgtaaataatatggaaatgaatttgttattatttttgtaacttcaggagaagaaaaacatcatatcattcataaagaaataagttttattactcatttctggttcattttttggcccattgatcaatcatccctcatttttggttcaatcttagtgtccaattttcctttagtgtccaaaattccggcggtgtccatttttccgcttggtgtccaattttctggtgtccaatttttccgggtccaatttaccggcccccccggaaaagtaccctaaggtttccgggtaatt

SEQ ID NO: 6201 - DNA, 1996 bp, Heterodera glycines
acgtgggcggcgaccaatgcaacactttggaggagatacgacacggtaattgacgagattcatttgctgattgaattggaaactccgtccattttggggtttaaaatggtgcgcttttaagggcagtcttacgttttgtcatcggcagaaaaattcaaaaggattgattatgcaaatgcggcccagccgatgtggtcgtttgtgtccaacaaactgagcgaacctccaaagtgcggactgagagagacattcaccagggcaaggccgattttgaaggctaaacaacaaccaacaacaaaaatgcgtttttaaaggaacccaacgaatttgtgcacccgcggataatcacaattatccgaaatgggattaaacctcgccgtgtcgtgcgccatttgctcaacaaacgcaccgcgcaatcttttgacatggtcagccaattatggacaatgatttgtttggttttctgcacccaattcatatttttccaattaaattttgcggtccctttcatttttgcctaattattttggtcacatcaaattctttgtctttctaatgattcttttaggttataagtgacattacggcgataatcaaactgaacagcggagtagtgcgcaaattgtattcaatcagcgggaaacaggtaggaaaaatagtttttttatttattccatcccatcgttttttagatgtcaacattggccgactttttcctcgacgattacatttttatcgcttacggcacggaacgcatttctttggacgatttttttgtcatttctgaaggtattcattttcccccttttctgtctgtttttaattttgccgggtttttaagaatataaacggatggaaatcaacaagaacaaaccaccgcgattgaacggacaattccgactcagaccgacgcagctgaaaatgctaaacaaacgcagcgaggggaaggagcgccggaagaaaggggacggcacttccaacggaggtggccaatcggagggggcggatgacttttgttttcggccattgcccgtgggacggacttttcaaatcttggccaaagaagcgtatttcttacatccgattcccaaaacacttcaaaatggagtgcgtttttacatgttcagaggtcgaactgccaatggaactgaaggaacaagtgaaaatattggaagtgctcggcgacggaaacaccgctttggtttataaggcggcattcaggtgggatggatttgcaaatgtttaattactcaaagttttctgttttgctttattattacttaaaaaaaatttcttttaggaccgaaaaaagggacaaaaacgaggaagagcaatggatgacggatgcgcttaaaattgtgcgcgaagaaacccttcagaatgacgaagtgcttggctttgtgcgcaccgaagtcggactgctcggagtgctgagccacgagcacattgtgcagttgagggacgtgcagattttggacgggtcctggttcatccgcatggaacttgtccaggtcggagtccaatcttgaaattggaaaagacaaacccaaccaactcgggaggattggaaacgccatttcacagagaaaattaaaattcggcttcaggacggcgatttgttcgaacttctcaggaaaaaacgaactctcagcgaaacggaaaggtcaatccgtaaaaaaataacaaatatttgtttattcgccttttccatgcctccttagtctctcctcatggtcttttttgtttgttttgttttgtttacaattcctttgcgtttcagtgcgagttgtgccgaatgcctttgccatgcgcttgattacctccatgccgagcattggatagtgcacagagacgtaaaattggagaatttactggtgattcattcaaaaactggatttcaataacaattaaaaataaaacatttttgtattaatttgtgccctaattgtctctggattgtcctctctaattgcattttgtaatgggttttccgctt

SEQ ID NO: 6202 - DNA, 3063 bp, Heterodera glycines
tccgtcgccctctttcgattccatttctttctccgtcaaacttctcatcgttcgattgcttaacaccgacccaaattcgcgcttttccgcctctgatgtcattggttcccaatgggttaaggtcgtccaataattaattattcattcattagttttttatttctttattttagagtcacgggcaaaaggacgaaacggcggaaagtgaggtgtgtcgcttctcttttctcctaaattttctctttttttcattgcgttaattaattttaagatttaatttagtaaatgtatttatttgcttggaataaacaaacatcttttgtttcttgccattattttttcgataaggccatacgccaaaatttaagaaatcgaataaaaagtgcaaaaaagttaatttaagcggaaagactatgactgtgtaaatttgcgtgtttttgttggttttttaaaattttaggcgggtccataacgggaaacggaaagcaccattaccgctaatattgttattcaattagaattgtttttaatgcttaattgtgacttttaaggctgaaccgcttctgaacgcggcactgtccgaaatgcgttttggccaaaacgaggaggaggaggacggacatggggatgctgattcgtgcgattttgcggtgtccgagtcgagcgccgagtttttcttctcgagacgcgccagcatggacgagctcagcgagcagggcgggagcagcagcggaccaccgatggatcaacagcagaaaacaaatgcgaacagtgatggaaccaacaaaaagggaggcattgaagcggcaaatgttgtcggaacaagtcgaagagagagcgtccagaagcacattcaaattggcaccacgacaccggcgacattggcattggcactgaatgggacaacgatggacggcgagacagcgacgacgacgggcaaagaaacgccgaaagtgggccgacgggtggtggttggacagcagcagatgaggaagacatgagcagacagcgacgaagggacggattatggacggaggaaaagcccagaaaaacggaccctaaattatggaccgattgtttgttgccaaagttgctttctgttaatcggtttactattattatatatcatcatattattttattatttattttatttccctgtaacattcttctgatcaatcattgacattcactcttcacacactcccaaaatgactcgtttaaagttgccaattgttctcaacaccgaatgccatttttgtacattctttttcatatgcaaccattcgatatcgccaaatgctttatgatcaattacatggtgggcatttttgcctaattgattgttttgtgttaacagagatgtaaaatcaagaaataaattcgcaaattgtcagtgtaacttccaaaattgattcgatggtttccgttttgtggcgtggcattcattcttcggtcaaatcgaagaatattttaatcaaaaactgatgggaaacgcagcggggggggggggggggcgaagaggagtaaccaccgccggtgctattcatcataacacttattccgttgcaaaattccattcctccgtgtcaatgggctgtacaaaaacagaagggggaaaaacaaaaacagtgagtggcgggggagggcaccgagaaagcccctcgggggatggcacttgacctcccttcccttctcttcctcccctcccctcccttcccccgcctttgaaaatccgacccgaagaaacggaaatgagctcggaccaaattacacttccgtttttgtccaaaattggattaattaattgactactgaacgaacaatcaatgcattaattacttcaattaggagagaaaatcaaaatggtccaactaattaaagggtttctgctgcccctgaggcgtctctttggttaattaattcgtccgccgttaattgctttgttcgcctgccaatgtcactttcagctgctcatgtactctgcttctcatttgtcgcattgtcgtccaatgctttattgagtatgtttgtgctgctgctgatcacttctaattactccaattagtttggccatccatttttggcacattttttctcggtttttttttggcttcgttttgccgactttttggcactttttggcatttcgccctctctccccttttgttgtctcttcatttttgactttcctcctccctccctggtcagctgttgctgatctgtccctgtcccctcttctcatcgattgtttgtgccttcgctcctttcgccccgtctgtggcactgatcagcaaacctacgacaacatttgctttttacactgtgccaaacgtttgaacgcaggcaaaaaaagatgcgagtggagggaagagaaagtgccaacgcgtctttttcagaattgcgattggcctacgacggcgtttgttgtcctcgtgccgaactgtgcacagactacgaggatacggtgtgtgaccaatttggtacggtgcttaagggaatgcgaagagaaaggggtgggtatttatttactgggtggccatttgaatcgcaaagaatcaatcattttttggcaaattgtctctctttttttgtccatttgtcaggtgttcggtacgacaacgactgcatcttcgagtttcacaaatgcattcgccggcgacgcattggcggcgaagcgttgcgcgttgtggggaggggcgagcgaatgtgcggggcgaagcggcggatggcggcgagcgagcaaagcgcggcgacaacggcgagcactgctcgcccatcagcagcatcccgttggagcagtaacggcacggcgcgtgctaatggcaccaccaattcgtccaccttttcgtgcgatttcccctgtgaaaatgccgtggcgccggtgtgtgacagccaaggccaaacgcatcagaacagatgcaagtacagacgaatggacaaaacgggcactgatcagcgccagtgatcacttgccacgctcagattcgacttggccatctgtcggcttaattcaacgcggcagttgtgtccgccattgctgaattagcatgggagcggact

SEQ ID NO: 6203 - DNA, 1869 bp, Heterodera glycines
  misc_feature (16)..(16): n is a, c, g, or t
  misc_feature (95)..(95): n is a, c, g, or t
atcgcgtagcaatttntttgaaaaaaatgaattttcaaccatttataattattttttcaagaaatcagaaagacgaattttccgaaatttaaagntgtttagtacatctgggattgaaaaaatgtaattttgaacccaattttgggcataagcgctaatgtctcagacgcaattgtccccccccccctcccttattttttatgctggtgtttattaattttttaaatttaataatataaataaattttagccaggaatgcgactacacgtgcatcacgcccaccaggctgttatctcatcggtgggtggatgtgaccataaatagccaaagttttaccgttaattattgcgaaataaacatttttaaagcgaatgccatgcggcagcgcgtgccggcacatccgccgatgcggcgcgacaatttgaggacgaggatggccaagaaggcatcagtcggaggaacgagaaggtgcggaaaataaaaatactatttatgaattaattttaaattaaaaaaaggtcgcagaatttaagtgcgaatatttattttatgttatttttaaataaaataaatttatgcttttaatgctttaactaacacttaaattgcctatataaggaagtgattttgttcagtctcttcagttagtcacttacagcaggaaagcgcgaagatccggcggaaatcaagagacacacactttctttcagattttgacagccttttctccaatttgaatttggcattggcacacacggctgtgggtaccactctcggtggtgtttggctttgtcgggttttgattgagagtttctggagttttcggttcgtctcttctccgttttattttcattctaaattgaaaattaaggcagactcatcaatcaacctgtctctatctatctatctctctttgtctttgtctttcccaacgatgggctctctgacccctcgtcttgcttttctcattttgtactgatccatccatgagcattttgagcaattgagtaatttaagcaatatgagcattagaattattgaagcaatatgagtagttttggccatttatcattcattctctaaagcctgcgggtgtatatgagagtgtttgcatgttccttttcattcctttcctctcccccttccctctgcttcattttttcattgttttctttttaattttcacttcgttttcccttactcttccgctttttcttcctttcactggggcgtgcgtgctgcttttgttcggtccttctgggacgctgaactggggtgtgcgtgcgtgtgctttggttccgtccttttgggacgctgaactccctgacggtgtggttccgtccttctgggacgctgaactggggtgtgcgtgcgtgtgctttggttccgtccttttgggacgctgaactccctgacggtgtggttccgtccttctgggacgctgaactggggtgtgcgtgcgtgtgctttggttccgtccttttgggacgctgaactccctgacggtgtggttccgtccttctgggacgctgaactggggtgtgcgtgcgtgtgctttggttccgtccttttgggacgctgaactccctgacggtgtggttccgtccttctgggacgctgaactggggtgtgcgtgcgtgtgctttggttccgtccttttgggacgctgaactccctgacggtgtggttccgtccttctgggacgctgaactggggtgtgcgtgcgtgtgctttggttccgtccttttgggacgctgaactccctgacggtgtggttccgtccttctgggacgctgaactggggtgtgcgtgcgtgtgctttggttccgtccttttggaacgctgaactccctgacggtgtggttccg

SEQ ID NO: 6204 - DNA, 4351 bp, Heterodera glycines
tcattcaacaaatttcccaccacttttgcatcggacattttgatgtgaaatgtgaatgcataattaattaggtaattattggttgtaaattatataggatttacacaaattttttctgcgtatatggtataaagaaagggctcaaaatttcaacgttagaattttattgatttggtgaaggtttttagttcatatatgtaaatccatttttggggattttcgggaataaatccatattccgctatttttgcatttttagtccatatttcggccattttttggaaatattccacaaaagatgtaaaaaaaacaataaatacaccctaaggttctagttttaaaaattagaaaaaaatacaccccccccccccaaaaaaaggagaatgtcttctaaattttggcaaatttttatgctttgttcgctcccaaaaattttcgctgacaacacatgagattgttaccataaaatcttgagatttgcaattgtgaagctagaaattgataaaatttggcattttttaagagttaatccacattctttattatacatacatacagtaaaatgtgttactgtcgaaaaatatttacaaaaattttttctaattatttttaaaaaaaagatttgagcaattgtcaaatcgaagcattctgaggcccaaaatttttccgaaacacggaatttcgaaccaaaaaattcagaaatcgtaatttcgtgtcatccatcatatctactgttgctggtcaggactgggttgttgttgttgggccatgttcatcagttccaactgctgcgaaatgctgcgcggcactcgtcggcacatcacggcatggcacgaaggctcgagttgtccggtaacgacattggcacaatttggcgtgccgtccgcgttgatttcggactccaattcggaaatgcgcacctgcgcacctcggcgaccacagccgttcagaatgctgtccacacttgggtcagctgaggatgagccagttgtggtgttcaacggggtctgagcaccaccgtaactgcacctgttggaaatattaaattattttaaactttttggtagatttttatggggatttagggcataattcaggcccatagcctgaaatttttttttgttactcttcaggccaaaaaatccaaaaattatttctccaaaattattttaaaattttttgcgcactgcaaaaaaaaacagaacagaaatttactcgcaaaattttcagcaaaaatttttgaaaatttcttttaaatatgtatcccttataatggtgagtagaagaattgatgagggttttcttaaaatttcatgcatttaagtttataatgaaaagaaaataattttaaaaaaaaattttattttcacaaatctaacggttttatgtatgccctattaatatttgagccgtacaccttgagaaattgatgctttcacgacaaatattaattgtcaatggtttattattgggcggttccggtggtgaatatgaagggggttgaacctggaaaattggaaatttaaaattaaatttaattagagggccctatttttaaaaaattttatcgcttgcctcaaaggtgggcggttgctgatttatcggcaaccgatgcgcagcgtaatacatattctgttgcaattgttcatctccaactgatacaaatgtctgggaagatgggtacaatttaaaatgcaacagtgcattatgttccccgcccccgccgcaaaaattttttaagtaaaaattcaaatttagaaatttaaaaaaataaaatttcgaaaaattttttataagaaaattctaagaaaaaatttatgaaaaatttagagattttttggaaaaatttaaaaaaaattagtaatccatcataaaatttgaaaaacgatagaaaaatatttcaaaaatttgaattcttttaaaaaaaattattttatttttttgatatttctgtttgaaaattttcaaaaaaaaattacgggtggttggtgaatttaatctgctgattagagtggaatattatacaagtaaattgaattcgaacaattttacccgatcaatggagagaagctcgtcggataacagtcgattcgcctcctccggatcctcatgaatggttgcgcaacttttcattgcgctattcgttccagtggttgttgttgcgcgactgtccgatgttgttggcatccgtccgcgtgcaatctgtacggacaatgtctgatcactgatcaaaaaaacaaattatttaattaaaaatgccaccaaaagtcaaatccctgctgttcatccatcttatgaaaggggattaaatcattttcaccaatattgagacactaatgtaatttttgggcgaaattaaaaaaataataatgcaaattataggtctggtgatgccaaaccgcaaaaccggaaactttatgaagaaaattaccgtttttcctataatagagcccgggggctctatttttcgaccccctaattgcattattcgaatgttaaaggaggataaaaaagcaaaattacagaaaacggaacggataaagattacgagctgggcacctatatggggtacggacgtatcagctaaagaacccgtaaaattcagtactctgtaaaaacccgtatcggtcgaaaaaccgtatacagggtccggcccgtattcgctctctatttttttataccgtatacctctctaccgtattcacctgctgttgacgctgttgctgttgctggtcagccattagcatgacaagcggcgtcactcgacgacaattctgtgccgtcagtggcaacacttgagtacgaccaccggtggcaaagcggcgcggcgggggcggactttcggccggcaaatgagccgtcgtacgatgtggcggcaacaattggccacgatgtgccatcaatggtgttaagctagactggcattttgttggtggctggaaaaataaatgggatttcatttgaaattggattacatcatgctgatctggcagggtaccaggataagaaaacaaagcattttttagaattccctgaatttttaacatattttaaacaaagattggtaattttgatggaaaaatttagcgacttgggaaattcagggaattgtccgaaatttcagagaaaattaattttaaggcctataaattattttaactttctaacagaatatttaaaattgtcaccgtaactgtttcatcaactatcgtaacattttctgttgcttttggttgttgccgaaatgattgggcggccgattgttctggatcatcatcaacaacattcgttcctgttactgcttgcccatcgcgttgctccattttcagctgttcttctgttttggcattttgttgttgtttttgttgcgtttgtccggcacaaataccattcggctggagaaggcaccgctgagataattaaaaaatccatagtgaattaggtaattaattcttttgtttgttttttgacccgttcttcgttagtgccagagaaaaagccgccatttgatggtgttcgatttgtcaaagtttccgttgttgaacgttttcgatgccgaggaggacaatgcgtacaacagcagaaccgaataaagacggacataattgtcaactttaatgaatgaaattttatttaacttatataaaaattaaaatattttcaaataattatatcgatttttcatttttttaaatatttttatccattttaaatgtattttaataaaattctaagtttaattattataaaatactattcaattaatataattaaaatcaaaaaagaataatttaaaataaaatttaatttatttagtttattattccattaaatttaactaacaaaaagcattagcagtgaaagaagcataagaaggagtaaaccgaagtgtaaagaatcaattccggcacgttcaacgaaaaatttttgccattggcgcgcccacgcgggcattggcgccggaggcattattgcacaatggcaaaatggcaaaacgccaatgaataatgctctaatgagttggcctgccttgagggattaaaaagtgaatcaaaatgattgatggaatcgtagggctttagaaaaatttaaaatttcgtaaattcaaaaattattttagcattttttattcaatttaaaagtcaaaagaaattttaaaaattaaagccaaaagaaatttaaaaattaaaaagtcaatttaaataaaattttttaaatcgaaaattaaatttttaaaatttaaattggtgataaaaataataaaatttttcggtctttgtaaaaaataaaccaattcttatccgagtaaaaagttttcaattaaaaaaacaatttcatttgattattattt

SEQ ID NO: 6205 - DNA, 5700 bp, Heterodera glycines
tgccagagagaatgaaaaacgagcaatggtttcgaccaaaagtcattttttggaacatcggaattaaccacgagggtaaatcatccgcagagagtgccatctttcttttacctccctttttttgcttcgtttttagcttcgctggcggcgtccatcggcgacataagtctcgaagaagaaatcaacagaaccgcacttcggcacacggttgaacattgtcttacgttgacttcagaagccgaacatcggacgattgaaaatgctggactgctagagcaattgcttacggaactgcagcaaacggtgggagggcgagtaaaagaagtgaggaagggtaaggaaaagtacccttttaaataggtctcttcgtgtccttcaaagaagaattgggctattttcacccaagtgatggcactgaacagtgcctcaggcggagtgccaatcatttgttgtaaaagtgggaaggatcgtacatcgatgggagttacacttgacgaaggccgaattctgaaggagagttgcggggtatcgaaccaacaggtgaggggagaacgaagccgcatttggcgcaatgcaaccgaatccctatttttcagatttccgaaatgattaaatgtcttcggaagaacggagtccgtcgcgaaaactgcagaaagaacatcggcaaacccttctattcgttcagtcccttccaattaggctttttgccccctccatttcgtccgccatcaggaacattctcaaacgtagtctcctcctaattaccaattcatatacttactatatgtaatttattgactccttccaatccatcggaaatgtttatccatgcataacattccttaaacggcaatggtcaatggagcgaaagtgctcaagactctaacaataaaagtgataataatgataatctacagatagatgaggaaggcataagcgcaaaatgcggtcgagatcagagtcgagtaataataataaaggtagaaatagcataaataaaggtggtaggaataagcatacgcaaagcgagtaataattaaaaagtcaaggggaacggtcacacttttcttcactgtccacggctctgttgggttcttcgttgtcctcacgcgttgagtcaaagttaaccacacgtctgccatttgaggacgaatcggggggaactgaatgagtgaaaatataaaattaaataattatttatataaatgcgtgttttaactgactctccgtgacgtccctcggggtgtaaattttagtcggcgtattctgcggtttgcttcgtccttcttggatgtaacaggcgatcagagattggccaatcatcgaagaatccatcgaacgagacatatctttatcgtctaaacaaatttggtgcaaattccatatgaaactgaccgaagcgtggcgtattcgctttcccattcgaatgacaggacatgctcaagtgacttgtccgctttcgctgcgtttcgggtgttcgattcggcggagtggacgcactcactgaaggcacggcaaaactttttctcgtccggggtgtcctggaaacgaagtgcttcattaaactcattatgaaacagtcattttcaaattgcttcggtgggttttctctttccgcgattcactcacccgttgtttgcttcccctccgttctgtccgttcagctgatactccaacacttccttctctttgaccacggcgtcagccttgactcggatgtcgttgagctcgtgttggtatccctcgagctgtacaatcaatttccttaaccaattcgtttcatattaaccattctcgcttatttcctctttttcgaagttttgtttcatttttctccgtttatctctctttctcttctccctctacatttgccttttctctctcacttttgcaactgtctcaaacggttcacttcgtctcgcaagtcgccaattcgtgcttccaatttgactatttgggcctctttttcgggcaatttgtccacttcgaattgcaattcgcgatttgcctgtctcaatttgaacatttcttcgttcttcatttgcaattcgtaattccgactctccaattctttgtgaagtctctgaaaattaaaaagaaattatcatatgcattgtgatatttatgtaaatggcaattaatgttcacatttgtcgattgactcgccgattcggccaattcccttcggtgtttttcttcttgttccgccagttttttgccgagtttctgtacatgtttttccaattcgttcacggttttttgatgctgtagttggatcttcgcgatgttttccgcttgttcagaagaaatttttgcgcgtaattcatcgaactgtaaaaagtttttgaaattttttcggtggttaatccgccctcttttccccatttctccccttttacggacttccactcgatggtcctccttcgcccgctgaagtcgctttttccagttgcagtccactgcaaaacaaacgattatggccaaaaaggtactgataaggaataaagtgtagacggattgggggtgagtgcagaagagaagggagccaacccaatttgggccatcggaggacggagaaactttgggacattcttttgcattgaaatttgaaaagaaaagactgttgataggtgacataagcctcaataactttgtgttattcaatgctttatcaaaagggaaaagagaaagcaatttgatcgcaatggaaaagcatttgagagaaaataaacgcaaaaggaaatggggggggggggaaggagccgaagccgatgaccaatggaaggggagaaccgcccaaatgaattggagtgaatggtaatgagggggagataagcatcaaacgatgggaaaggcattgtgcagtcaaatgaaataaaatgggcggacggaggggcgacggatggaccaccgctcgggggagtcgaaacaaagaaagaaccccacacaaaaacaagagaaacaccacaaatgcgaaggagtagacgacttacgctcggcgatggccctttggtgttgcgccgcctcgtcgcccttttgagccatcagaacagccgattcggtgttggcattgtccaactaaaattaataaatctaattaatttggtttcagatcactaataccccccccctcacttttctgtcaaaatgtgatgccaccacagcgaacacatccaatgtttttgtggtctgtttcagcatttgcttcgtcctgttcagttcgtcttcgacttcctttcgctgtctgtcggatgcattcgcacttttcgactctttcgtccttccgtttgcgatgtttcggccaatgccggacaaatgtttttgtgcgactgcgacgtgttcaaccgactgacttttcgtggtcattgaacgacgggtcatcccagacattggtgcggttcctttcagtgcaatggaagtgttttcgcgagaactgagcaccggacgagcagacggagtgattcgagagcgagaatggctccgtgggagagcaactgaaaagcgacattgaaaacatttaacgcagagtaaattcggaaaaacgcatcaccctgtgtaggggcactggccgaactttgcgcagatgcgcgtggcaacggaggccgttgttgggatgcctgggccaacagcgacctcctcggtttcacttcctttactttagggaccgtttgttccattgtagtcaaattggcggtactttcggttgggactgtttctaaattacactttggtatgttaatatttttcttatttggtttaaaattattcggggaagatgataagtttttctaaatgctacgaaggtagtctccaaaacagtaacttttttgaaaaaattttttggcagcgaatacttaaaaattggcataacgtttttaaatttaaatagtcaaaaagaccaattattttccaaagtcaattaattcattttgaactttggttcctccccgacccatgggttaattgcgagtgtcattgctgttgaattatgagaacttcgagtcatatgagggtctttaaatatgtttctacacttttttgttttagtaaaattaataattatgtttttttgaacatttattcctcgacaagggtgttcctcgctatatttttaaaatttctacagccatcccctagggtggggggggggaactctatcttctgtgtcgatggaacataaaggtgcttttttgccttctcctatttaccgtttaattcgctcttttcagcgtccattgtccgctttttctcctcctcctcccttttcttcttttcctccttctttttcttcttttcctcctcttcctcctttctctttttctcctcttcctcctcttttttcttcttctcctcctcttcctcctcctttctctttttttcttcctcgtccctttttcttttctcctcctcttcctcctttttcctctttgcccgttgcttttccgcctctatgctcgctttcagttggtccattatcatttgggattttgatggtgctttgcatttggttcgcattggatttgccggaggggcggatgggaagagagaggcctgtgaaaaatgaagtggaactgcctgggttagcagagataggagggaagtgaattggcactttttggatgatgcctgccattcttgaagtgtaaaaacaatgtccgcttcacacttttatggctatacggaaaagagaatggcctgggggagtgtttccctcgcccgggggagtgtttttgctgtcctttgcccccccccctccgcttggttggcttgccctgggccgctttggcgtctcttttctctgctgctggtgggtctcttccccccgccgttgtctttccccgtcgttgcgattgttgttattgttctgctgctcctccttttggctgatgacacttaatcccccgtcccctcttctgtccactccacttgtgctgctgctgctgctgttgttatttgcgttctgctgctgctgctgaagggatccgatttccatttctttccttttcctcccaaattgctcaagtccctccctctgatcatcgctcttctgctgctgatcagttgatcagtccttaccgctgctgtcgtcgtcttttgcgttggctccgatttggccgcaaactccagtctcaaatggttcctgttcagtctgtcctcgtcccgctcccttcgaaagtcgtccgtccgactcatctcaaccatcggagtgggcgtctcttcgttctcctcctccgccctcattttgttgctttcgatcactggcaatgccaaattcagagttggcccgtccaaaatgaccgatctgtccagaaaactcccccgctttgtctcttccgcttcttccgtcagcaaaaacatccgattctgatgaaaagcgtcttcctcctcctcctccccttctcctccgtcactttcgtcctcgtccaatctgagcaccgtcgaatcggtcaattccaaatcggaaagcatcagacagtccgagtcgaaaacggtataagtgacttgggaattggccatcagtgcctcgtcgaaaatgttctaaagaacaataaaaatgaattggaggaggagcaaatgcatttgaataaaatgcgggggaaagttcaaagggatgcgatgaaaggggagaagggggcggtgattggcgagaattttgacgagagaaacgcacagattattttggcaatgcgtcgcgggggg

SEQ ID NO: 6206 - DNA, 452 bp, Heterodera glycines
agaggcaaattggggggggggggtggcgccgggggattgacccgtggcgaagacgaaggaacattttattcatccgacgaagggacatgaacagctgccgttgtttcacgtcctccgtccccccccccggcgttttccccattttcttccattttcccctttttcgctgccatttttctttttcctttgaaaagggccgacaaaacatttcgtccattcattcatttcattcactccccactcaattcattattctttttcattttgttgatctgtcagttttctgtgcatttattccccccccccccctttttttttgatcgtcgcactttttcattaatgggcaataataaattaatggggcggggtaaggacagcgaaagaacgaaaaggcaaagggagagaaaggcacgaaaaataatcggcaataaaatggcgaaacgagaaccatt

SEQ ID NO: 6207 - DNA, 4869 bp, Heterodera glycines
ttaataaaacggaaaaaattactgcaggaagtgggattcgaacccacgcgggcatacgcccactagaacacccagtgaaacgggcaagtgtttgcgtcacttgagtctagcgccttagaccactcggccatccctgcacattcaaccacaatttactttcccctttctcacgaaaaaaatgctaaattatttttaataataattaattgctgtttatttttatcatcaattttctttagcgcaacattcatgtgctgatccgcgcatgcatttccaccagccatttcgagctgctctacggcacggtgtacggccaactgcagaaggacagtctgtgcaggcccatcttccttgaactgcttgaagttgtcgggactagaaaaatgcaaaaattattctctcccattttttaacaggaatttgtgcttgactcacagctggaccgacctccgcccggcctggtcaacgactatttggcctatttgttgtccgaaggccaactgccccaatttgagcaaagcgtcactcgactgcccgtcgactgcatggaccttcaccaggcaattgattatcaattcatgaattttatttgattttggttttatctgtttttaggtgatgaccacctgtctgcagcatcagctctttgacggactgtgccatgtgatgaacaacgcaatgcgcgattacattgggccattgaaagtgggggcaaattactcatcatattttaatactcaaacccggtgtttttatccccgaaattaatttatttaaacgccattttcgctctcgaggaaaggatattattttctacagccaaatttctgtttgtgaattccgccgcctctttgtccaggagatgtgcgaacacatgcagcacactgtgcgcaaggaggtgctgtccgactgcgacattgcccagggcaacaaactgttgctgtacctcagctgctgtttggcgggccgtgcctatccctacggcgaactgccggacgaacatttggccaaaactgtgccgttggagacgtacaaagtgagagggcacccttttaaaaaaaaatttaatttccattcagtttcttgtccaactgcgtcccaaatttgtcaccggaccgccctcctctgcgacgaccactccttcgcccaccaccgcctcaaaggaggacgatcaaggtggttatggcattgctctcgatgctgctgctgttgtacaacccatcaacaacaaccacgtcgacaacaacaacagcagcaacaaaccgtcggtggccgaccttcgcttcccgcacctgcaactgttgttgaagttggatccgcagcagttcctgaacgtgatcaacacctgcgcggacgcgcccgtgttcgcctccgtcgacggtggggccacaataactttttgggcccataatttcggattttccaaatatttttaagctattggatggattttcttatttgccctttcccaattgaacttcgatcggggcttcttcaggtcgtttgaagcgcctcgtggacgtgttgatcgcaatgtgtgtggagaaaaacggggaggacgaacgcaacgaactcgggcccctgctcatcgcatttgtggtcggactgttgcagaagggggccataccaaaggatgtgttcctcttcagtcaggtccttttcgcttttccaaactatttataagctaaaatttttaaaaattaaaaaaactataaaatatttaataatatttgttttgcagttgatcaaacgggtgttgcaacgtcagtttctgaatgtgcgtgcccagaaacaggccgaacagcacattgtggacctgttgaaagtggtgcccgaaatcgacttggacaatgtgttagacattgcgcaacgccggccctagtaaaaaatgttttactcataataattagggtcattaattacatttttgtccctgctcaaagtgttcacatttgtgcgtacattttcaccattcgcaagcagtacgttcagctgttggagtgctgtttaggcgacctttttgaaccggtcagaggatttctgcccattttttgccaaattattttgaaaaatttcagcaaaatgttttccatattttggccgatttgttgaccaatttgcgcgaccatggccaactgtgtgaacttcgtcagtttgtctgcgctcagcttggcaaattgtccaatttggaccctcaggcaaaacgaactgccaaaaataatgaaaattaaaaaaattccatcatttcagcttgcagcccacctggtgttgtcccacctgcccgggctgttggccgatgcccagtccaacccgcgcaaattgcccttccaattcatacgacaatgctttgcgctgcggtacgcttttaatttttaatggacacaaaagcatggctaggtttaagtcgtcagcaaggccatcggacgctgtgcggtgcggacgatgaccacgagcaggacgaacagttttttgactatctgttcgagggcatcatcgacgaggccgatgtcgccgccatgtcgtcgaacggtgtcgaagaaaactgcgagggttggaagccggaattattatttatttgttaattgttttttaattttattttagccaccactatcacttcgttggacaacgagttggcggacttgttgcgctattggcttccgcttggtgcagcgacggaccattgtctgaacgtggccatgcaatggcagcagcagaaacggcccaatggtcagtgactcaagaagacattttaaacgcaatttttagcttaaattttaattaaattaatttgttttaatcccttacattttcagctgtcctttacttttgttacaatgtttcagctgtccttatgtcgaccatttcgcttctgctggtcgcccgggggcacatccaacgcgcatttgagcacattttcaacgagggcgttgaacgacggttggacagcaccattagccaagttagtattgcgacatttggcatttacaagggcttattacatgataaaaaccatgacaatgatattccgatgccgttggaaatttaccccggggcggtaaaagcagggtttttggtatcccgaaattcggcacatgtgctttccccattttttgttgaagcctcccgccgccgacgaccgttgtgtcgcctctctgttggaattggcctccgcccatccgtcggatgcgcgacgtggcgattggttggccaaactgttccggcaccttttgaaggcattgcccgaggaaacggaagccaaaagtgatggtgatcagtcggggtgggagattatctgacgagactcccgacaaaatcattggattttggtcccaactcccgatttttttaaacggtcgttcattgaaagtcggagccattgattccttttcaaaaaattttttaattaattaatttttaaaaattagataatgcagcggaattcactgcctccgtcgttcatgaacaaatgacgcgtccaaattcgcaactttttcgtctgctctgtgctatcattgaacagcagcaccaccacgacgacgaacaggagcaggacggactgagggacatccaaattggagcggaaaaaggtgaataaataaataactaaagcacattgggacaattgtcgagagtcagtcgggaatgaaaatttcggattcatcccgggttttattggaaagggctgggattttcagccagaaaacaatggagggggattttcgtatcaaagacatttccagtttttaaattaatttttaattccccttttaattgccttacattactcccccccccccctttttttaggcacttcggcttcagtgctcgttgccgagctgttcagccacccgcgatttcagcatgcgccactgcacatttttcaccgatttctccgtcaaattttgctttggtaacaacaattaaaatattgtcactgattaacccattaagaatgaaatttaaaaataaaaataaataattgttaaatataattaaatgccattgctttctttctctcttttccacactattttcaggtgcgaaattcgcgtgctgatggaacgggcaacgcgcgactgcgcccgccacgaattggccgttcaattcgcgcacaacacaatgttggggctgggcaaaaggtgtgccgagtgtgtaaaaagggtgggcgggagcatcgggagtctcgagacttgtccaagtcaagtgaatttgttcgagatttccttgtttttcgacttaattaacccctttggtcgaatcgactcctacttttttttaatactcacaaatcgattctcgtgtccgtgttgagtggctcggtcggtcaactacatttgtgtcattttgtggtttcattttgtcaggcccgcctttgccatccaacagtcctccgtcgacaacaaaggttttccggatgaatatgccaaaggtgccgtcgttggcacatcagcagcgctctcaccaacaaaatcctcctccgtcgacatggacgttggcatgcccattggccactgtctgtggtgccgtcgtcgcattgacaagtccttccacctgttcccctgcgggcacacacttcacttggagtgtgtggaagagcagcacaaactgatgcagcaacacgacttgccagggatgccaacaacaacggcaatgacgacgacaacggcacttccggcggcaaaaggccgccagcgcccgcggcgtttctgtccatgcgatgcccggcagcaaaactgtgccgcggctggcatggtgaacagtttgaggagaaagtggtggcacaacaacagcatagctgggtcaggtgctgcaggtctaatctcgaaatctggcgagtttttgatctgaaatccgttcggcacttat

SEQ ID NO: 6208 - DNA, 2492 bp, Heterodera glycines
  misc_feature (116)..(116): n is a, c, g, or t
tcttgcgacgtcgtcattgtcgggaaagcaaatgccagtgtcgaatgccaacgagacgaagaacccttctgccggcaaaaatgacagggaaatggacgaaaggtgggcaaaaaagngagaggattcagaggatagtctgacccgtcgagaattgacgccggcggtgggtcgggaccgaccagcagcacttcaaaccggacttacaattagcaaacaattagtcccctaattgcttttcaatgtgcaaatttggtcccttccaaatgatgggctctgttttcaatgtgatttcgcacattttattgtttcaattgcctcaggcgagctgcaagtgccgtcttccgtcgcctggagcacgacttcccaattcgtacgggccccccgccgccggcaaagacggcgaacaacgctttccaccgaacgtcttcgttgatttagacaaacttttcatttttattgagaaattacattttaatgtagagctattttcttctgactgttttgcccgaatgaatgaatgaatattaattaattagcataattcaaatggcctgctgaactttgttattattatttgccattttttaatttaaaaagaattttaaataatttatttattttcaaccctttttatgtcccgattttcactcatttaactgtgattgtgccagtcaaccaaaatcaaagaattgtttatttatgcgttctacttaattgaaaataaatgtgtgccttccaaactgacaattttaaattaaaaaatcaagttatattttattcaattaaaaaaagcatatataatttttagggctaggatttttatgtgctaaaaatcctgaaatatgtaataaaatatgtgctaaaaaatgctgaaatatgtgctaaaaatccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaactccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctagtaatggccaaaccttttggttagaaaaaaatgtttcaaaaaaaaacgccagaaaaaaatgcgggaaaatttcccgcaccagccccggacaaacacccgggtttgggacaaacaccgggggcgacccttgttttcacacccccctcccaaaggtgtgaaaacacatgttttcacacctgggacggttgggacgctccccgtgggataactactaatgacttaaaatgagcatgcatttccataaaaatgggttcgaaaaatacattaaaaaattggtaagttacctaaacagcaggggtttctgtaacaatatggtcgagattacggtaatggaagaaattatatttttcattatacatagttcccgaaaaaaatcacttttaataagttgaaaaaaaagatggccaaaaattttggaagaaatattttggtaataacctttttgaaattaacaaaaattttcaaaatttggaagctataccaaacacttgtaaagctatcggatgatatcataaaataaatgactcccattaaaatggcacaacattcctcaattggttttcaagtgtaccatcagcatcatgaacatttttggttgcagttatttgttgtacagttttcatacaattagctgcgcaatgatcaaaaaggtattttataatttattaataattgatcaattatcatttttgtacggattaccctcttttatgctaattagtaattacctacaattaatttgaaatattaagaaaaattgctatgtcgttgtcacattatgcttcgcactaacccttgactttttaccagcgcttgtcaacatcatttttgacctcgtatggcacatttttaaaatttaaaatataattaaaatcttttttaataattggaaaatccaaaataattttcagttcgacttgggcttcatcggaaattttgggtctacctgcactgttttggactcgctttgttgtgccgtttatttctaattttttttgtgccaccccggctggttgaaaccagcgtgtca

SEQ ID NO: 6209 - DNA, 1699 bp, Heterodera glycines
tttaattcaaaaatttaattcaccgattttaaaaacttagtcttcactttttgtacagccaaaattaggcaattaattaataaagaaccatattttggaaaaaaatttggaccctttttgagtcgttttctttcttttgaatcttttttgttcataaaataattttattttatatttttgattttaaaaagcttttattttattttaaaattaattggatattgaagagtaaattttaaatgaaaaaacgatttactaatttttataatatttaaaacacttttagaattcgactgaagtccaaaatgaaactttttttataaagcaatttgcgccgcattgttgtaaatacagtgacccagaaaagttggaattcgttcatttttgctcaactaaattgacctttcgcttaagatttggcatttcaaagatcaaagagaaatatttaaaaattgaagtaattaatttaatttattaaatttatttttgtatttttaaaatttattaggcgccatatttacaatcgtacaaattctttgcaaatcgaagaatggaaattcgccaaattttccagtttggacataaactttgcaaaacggtggaccaatcaaaaaggaattatttgggttggcatttaaatttaattactaataaattaaattttaattaaaaataaataaaatttacagagatgaccaatcgcataaattttgtgtgcatattcgaagaggcgatttcattcgacttggcatagaatcaaaaaaagattttactgagcagggaattgaatttggatttcaatcattgaaagttatgccgaaataaatatatattttttattttattaaaaatttagaaaaaatttaacaacactcccatttctttcgttttaatgggaaaagagaaagacttttttaaaaatttggcaatcaatcaaacggtaaaaaattcacaaaattcttaaaatatttgttgcaattgttttttacagcaattttccaacgtttatttgcccaaatcaatgccacgggcaaatgatttggcatttgccacaacggcatgcgactcgctgctgatcacggcacaatcttcaaccttttcgtggtggattgcttatttgatgccggacaatgcgaccattttttacaactcaaaaataaccaaaagtagcgcaaattgtctcttaattaattccaggatttttttaaaaattaaatttatttgaattttaaatacatatttagacatttacacaacaaatgaaaattttttggccgaatgggtgccaatcgaattggtcaacggaaatattatgttgtcaaatgggtaaaacatttaattgatcagaaatttaaaaaaattaatttaaagtatttttgatatcctatgtgtaaaaaaaaagttattatcccaattaaatggaaaaaatattttcaaatgtaaaaaataattaaataaataaaattaatgaagtaaataattattatcaaaagaaaatatataaatattatattaatttaatatttgcctacattctcttctaatattttaagaatttaagaactacaaatggctgtttcaattgccaaaataattatcttttaatcgtcctcttaatgtgcatcatttttcaattgatcacgtaaaaaatatgttttttttgagttttcatttttcatttaaatcccttaataataat

SEQ ID NO: 6210 - DNA, 4028 bp, Heterodera glycines
  misc_feature (101)..(102): n is a, c, g, or t
gtaaaaatttgcactgtaagaaatgggggtctggtcgagaaaagagtaggaaattggtgaagagggagaaatttttgagaaaaaattaaattttattcatnntagtcatgggagtacacacatgcacatgtggtgtagtggttaaactttctatctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaattacaaattttttcccggcggcgcctatcggcaccgccggcccctcctgtcccccaaaagtcttggaaaaaacgtgccgcgtaaaaagcggtgttgaaagcaaaaaaaaggtcattgatttacattaatttacatggccggagaccccttcacaaaattggaaaattggctgctgaccccttgttttgcaataatctgaattttgaggtctacatctgaattttagtgttctatgtcctgaatttgaaaaaaaaacttggtcaacctgaatatacatatacttctgaacaattctaatgctaaaaaacaggtactcgcgcgaaaactgaataaaaattttgtatttggaaaattttgtccaaaaatttttatgttctaaaattaccggtttttaccggtaccggtggaaaaagttggtaccggtttttgcagtaccggtcagtaccggtaccggtttttttgcaattaccgattaccgctcaactctacttttctcatcctccactagcgcttgtcgatcgttcaatttgtccttgaatcgtcgcactttgctgcccatttcgtcatttcgcgtctccatgcggttaagcgcttcttcgcgatctttcagttgctaaaagggaaaaactcttccgcgtataattaattacacatcatctcatacagcatgtgtggaacgttcacagttcttctcaaagtcatgcgctttcatttgttcatccttaaatttgtaaattccgactaaattagcccaattgataaactaaaactagtaaactccgccaaattatacactcacaatgtgattgtccaccgccgaaagctctttggcaatgtcacactttgtggtgtacaagcgaatcagttgagcaatgtgcatcttcgttctgcgggggtccggttgaaatagatcggagtagagaaattcgttagaaccatcgaacaacttgttgtacaccaaattgctgaacaaattgtggatgcaatgtatataaaactatacgaaaatactaattgtaagatcaaaataacaaaaaccaacgtaccaatgctgttgcgttcggatgatcatcttggcacgagccctcgtcagttcagtggccatttcatactcgttctctttggtggtgccgacattttcaaaaatcaaatcacacagaaagtagtaggcctggatcaactgatcggacggctgaataaaaaaaaataaaattcaaacgatcataaagtcaaaaacctgtgaattgtcaagcaattcctgcgttactccaatctctttagcctcacggttgaagaattcgagaataaaacgagagtcgggtccagccatttaatactcttaattagattgacaaaagtaagaaaaaagttatggcttaagaaactgaggatggtcattgattggacgcgtaaaagtcgattggacgcgtaaactgcattagagccgtaattgctacctaattaaccatactaatttgatgtgtgactatgtatgtcacactttgaatggattatttttcgaagcgaaagcatttgcaaaaacaaagagagaatgaaagagggaaaagagaattattattgttatgagtgaaacaacaaaagtcaataacatttacgaaatcaacacacttaaattcgatttctcttttcttattattgaattattattccaatattccgaatgttaaaaataaagaagtcaaatcaaacgtttcattccgttccttgaacaaaatcattttaatagcaaatttttaatggtcttgaatgtgtacaataattttttaaaaattatttgtgtacactaaaatgattttttgaaatatgtataatcccctatgtatttaaaaaaccttttttcattaattgattttatattaggctgcggttgcgtttctcctggtgttttattttcaatcaacttttacatgaccaatcataattttcgcgatcaatcaaaggcttttgtcgatttagtatcattttaacaaaaaatcagacttaaatgttaaaatctctgaagtaattcatttattgattagttcgttgggtttgctgccgatttttttattatcggtttgttttttcaattattgtaatgatttccaattgatcgaaaatattataaaagtaattttaatgatttttttaatagttttaaatttttttaaaatttttactcccattttaaaaaaccttttttcatttgttaggatttatttgcagttctgctacaattttagtctccaatcaattttatgacacccaaccacaatttgcgcgattaattaaaaacgtttaccgtattatctctaattatcaagagagagagaaaaaagtgagaaagaagaaagcagtgagagagaagtaagaaaggagagagggagagagagagagagagaaattaaaagatgagggaaaatgaacgatagagagcgtgataaaaagaaggggaggaaagagagagagagagaaaggaaaagagagagagaagagatgagaaagaacaagagagtgaaagaaaaatagagagagagaagacagaaaatttgagagaaaaagagagagatagagagagagataaagagagggataggagtgaaagtagttagagagtgtgaaaagagagagattaagagaagaagagggagagaaagtaaatgagagagcgagactgaaagagagaaagagagaagagattgagagagcaaaggagagagcaaaggagagtgaaagaaaaatagagggagagagacagagaaatttgagcgagaaataaagagagagagatagagttaaagagagggagagggagagaagggaaatgagagagcgggattgaaagagagagaaaaaaatagagtgaaaaacagagagagagagaaagagagagacagagaaatttgagcgtgagagagagaagaaagacaaagagagagaaagagaaagtgattgaggaggttaaaagagagagataagagattacgaaaaagggagaaaggatgtgagagagggaagagagagagaaagaaagagagagagtgagagaaagaaaaagagagagagtggtgagtgagagagaaagacagagagagaaggaaaaagggagagaagagagagagaggggagagagagaaagatagtaagtgagagagaaagaaagatagagggagggagagagagagggagagagaaagtgagtaagtgagagagaaagaaagatagagggagggagagagagagggagagagagagagaaaatgagagaaagtgagtgagagggaaagaaagaaaaagagggtgaggaaacatagaaagaaaaatagagggagagagaaagaaagaaagagagagtgagagaaagaaaatagagagagagagagagtgaagaagagagagaaaaagcgatgaaagaaaaagagaaggagagaaagacaaagaaagagagagggagggagataaagaatgaaaaagagagatagagagaaaaaaagagagggagagagtgaaacaaagaaagagggagggagaagagagagagagagaaagagagagagaaaaaaagagagagagaatgagttagaaagagagagactgaatgagaataggagagaagaaaatggaaggcgtgatggaaaaaagttatttttagacaattttaatatcatttaaaaa

SEQ ID NO: 6211 - DNA, 1106 bp, Heterodera glycines
ttaattattcgttcttaaaaaattatcacttttattttaccgttcatgtttttcttccaatcggattcagtttgcacaccgaatcgtcgaatggcattttcggatcggatggtccaacggaatccgacggttggacaaacttaagggaattaaattgatcaaatagttaggctgggaaaattgttactaaatgttatatatccacataacccagataaagaaaaatggttaactcagtaaaaaattggatctcttcagatcgggtttgcctttctttctacccatgcttccatggagcaattggagctgcggctgatgaacagctccatcttcagctgttctctttgctcttctgctgtttggtgtgccatcggcagcatgtccaacgcaagaagccaaaggtcggcataatccgacaaaaaagacggaccatttgaacggaggaaatcattttgcatggcacgcccatcgaaatctgagaatggcattttgagaattgtggagaatgccaaatttgaaatattaaaacataaataattaaattatcaccattttcctccaaagaaaagcgagagaatggcttaaacagtttattccattcgaaaagcagagaaagccgttttcctgctcccaatgtatagcttaataatttataatctttttactataattttttttttattaaaaattttaaaattacaaaaattcaaagagttcacttacgcatttttgattaatattttaataaataaaatatgtactaacaatttcttaaaggcaattgatgactccaaaatgattgatctttctttgtcattgttattcgtttgcattggcactgtgcgcattttaatggcgcgccaaatgattgtgccatttttgttgccatcctttggcatcttttccaaacattccttttcaatcgaatttccctggggagttaaacatgtaattaattaatttttaattatgtaccccaaaatttaccaccattttagcatcaacgatgaattttcttttgacttttgaatttctgctgctggtgtccaaatggttacctcgttgaagcagggcccggtaacagatgagaatgctattaattcaga

SEQ ID NO: 6212 - DNA, 4475 bp, Heterodera glycines
ttttgtgagtggtgattttcatccaaagtttgacggacaaacaatcgaaaaatttccatggagaatcttgtttgtttccgccttataaaatggggtgaggaggacgatggcattgactcatcaaattggcgggaaatttgctgttgctccatagacattgtcactacttaaaaatggggaaaggtttttttgaaaatttctcattggatttttttacatatttgggttaaatattttggacttttttcttatatatttcatttgttacagattttgaggattttttacggaaatttttggaaatcatcaaaaaaaatccaaaatttcggcaaattttttgtatattttttcattttttatatattttgagaatttttgaaaatttgtagtgaaaaaataattttgaaaatgtacccctgaaaaataccaaaaaataatttttaaatactaaaaggttattctaagcctatttaggatgtttttatggcattttgtgcctatttaatccattaggaagaatttttttccaaaaaaaaaagtttaaaaattttatttaaatattcagtacatatttatggttttgtgtacatatttcgggatttttgttacatatttatgtacatattacatattttgaccaatttttgtacttatttttggcagccctatttattagcattttaaaaataaaaaaacattaataatcagtgttaaattagggacaaccattttttagttaccaaaaataagcacattctggcctttttttaacatttccagcaaataaagaaagtatttttcataaattcaaaattttcagaaatttttcctcgaaaatacaccaaaaacggatttcccaacaattagttattttggataaaatgtaaaacaattttgaatttttcaactgactattgtcatcatcatcttcatcagatgttccgacggcgatgttaaaattctgcaaaatcagcacaattgacaatgccaaaacccatcttttgtatgcgaaaataaaaagggcaaacattaaaagcattttattcttttacaaagaacggatttgcctaaacgaatttcagagcaattactgacttaattaagacagattttgatataaattaaaattatattaaatataaaaagaaaaatatgctattttaatataaatgtaatttaataaaatgtaaaagccataaaataatttatgaagcatcataataaatcaatttacagcaatgcaattggcatgcgaaaatggcttttacaaattcatatgacattcattggctggcgtggcgactatttgcgtccgcagagccgaacaaaattatgaattggattaattgtgaattaagaaatattactaaaaaaacatttaaataaaaatttaaaaaattacacatttttgaatttgaacagaccaaagaaaaaagtaagtaagaaaaaatggtcaatgatttgacataacatgcataatgtaaaattcaatttttcgcattatttaactttttttaaatttaaatttgtgtaaataatcattaacgcgtgatcagaccaatttaataactaaaaaactattatagttcagaaacaaaaggcatttttaaatgatacaatttgtgtcaattaacaaaatatgagggaaaaattgaaattaaaattgtcaaaaaaaagaatttttttaaatcattcaaaaaatattttgtcgataggaaaccaatgaatatacaaaaagaaaattcaaaatatttcaatttctggagagggattgaacaatgggaaagaagtagaaaatcaagaagactagcctctagaccattttcataattgtgttcgctacttttaaggtatatattaattattattttttaattttttcctttaattccaattttcatcactaattataccagggttcgcagatctgaggctttagcctcattttgtggttttttgataggtcaatgaggctaaatttcaaaatgaggctttgaggctttttgtggttttttgagaaaaaccgcaaaataaagaattttttaatgaaaatatgctaaaaatatggtcaaaattcttaatttttcccccggcggcgcctatcggcaacgccggaccgtaaaaatccttaatttacaagcaaaaatttgctcaaaatcgcaaaatttggtcatttttcggacaaaatctgttaacaaatcgcattgaaaattacaaaatttttcccgtcggcgcctatcggcaccgccggcctcccccttttcccaagtttttttttggaaaaagcgccgcaaaaaaatcaacttcgtttttcatgttcagaatccccaaaaatgcttatttctaacaaaaaaatgctcaaattaatcatggacaatcaaaaatataacatttgaacattttaaacgtgttttgaataaatttgtgaaaatgaggctttttgacccaaaatgaggcttttttgcttgccaaatgaggcttttgaaaattttcatctgcgaaccctgaattttacactccgacccccattcttaccagtgcttgtgtttcccggttgccctaccgggaccgggacctgagatttaaagtgaaaaaaggaagatttcgagcatttaaaaagaaaaaatgttttttttgttaaaaaatttagttgatcactacccgatcggggtccccgacccccgacatttgagctccccaaggggtcggggagcaaccctactaaaaattgaccaaaatttcagcctaagaaatgtaaaactttcgctgaaaattcgttccaaaattagtatttatatatttcagtttttttagcacctaaaaattcggtcttatctctatgtaactaaaaatttaaaaattgaattctaaaaaaagttaatttattaatgattatttttaacagaatgttgcatatttctctgaacagcttccgacatttattttatttcattttaattagtgaaattacgtgaaaatgtgaacattaattaccgatgttgttgaattgcttcgatttcgaaattgattttatttatttattttatttgcctttttgggtcatcattttgccttttttaccattatgccttcttccccccccccccccccccccccctctgactcggcatttttttcaattcaaaatgaccctgaaacttcttatgtcattccatcactgtttatttgcccttggttgagcaccaatctctcttcggcacaaaaatgagaatataattaatggcaaaatgacccatttaggtaggtcaattaataagaaaaaaaggacattaactcattttcattttactaagtgggaaccaaaagagcaaaatggacacagaacgggaaccggccactttggcgcaggccattttggcgcaagactctatatcattttgatttcacagcaaaattaaataatcttggtatgattttaagtggcttgatagtgcctattaacctgcaaagtttcaaaaaatttagctgagaaacaaaaaagttatggccaaaaacctcaaaaaattgcattttcctggccattttggcgcagcgcgccatatctttttaaaacctaatataattttttgaaattttgcaggctaataaagaacatttagacctattgattaatatcaacattattttatttggtcaaattaaaaaaaagttatgaatctttaaacttgtctgcgccaaaatgaccccgaccccacagaacagcacaaaaagggaaaaggaaaaaatattacaaaaatttgcaaaatcaaagacaattcaaagagttttaatcaatgaaaaaactcgaatttccttaaaagcaaaactaaaaggattttcggggaaaaaatcggaatttctttgacaataaatcccaggtaaaaaaatatggaagtaaaaattaccagcagttgcatatttttattgcaaaatttgattaaaattaaaagaaacattaattagaatattaaattcttctctttttatattttattaaacgaatttataaattattttcaaatgaatgcccacgcgccgttagaagctgatcagaacaaaggtaaacactgaatcattttcaattttctaccaaatttgaatttccatccattttggcactttcatcagacaacaatttcaaacgctgtggccaattttcgtttcggctgaccaatttcaaagcatttgcggaaggccgtgggccaaaggaagtgaccaatgaaacggcggaacacatcaacggattggcatggaaaatccaagtcaaacacagcgaacaaagcattgggcttttcctgcactgcgaaggaaacttagccggtgggaaatgaatttaaaaatgccaataaacgcggcatttaacaaaggcgccctagggcattggcatatgaaaaattaataaaacaattggggttttagactcggatttacgatggcttcttcgaggcatgggatttgttcccaagtcgcccatt

SEQ ID NO: 6213 - DNA, 6806 bp, Heterodera glycines
aataattactctgaaaattagcgattaattgattgacactctttgaggagctgatggatgtggcgaatggtttttatgatgcgaaagacgacgcaatggcattcaaaatggaagttgccgcggaagagccgaagctaatgccgtaagtgatcactgatcagtgaacaccacacagaaagaatgatggtgatcagtttttggatgtgtttacagtattttaacaccgtaaagcatgtccatttttggcaattaaaaattgcaaaacgctgtttgttgggccaacaaaaacccaatggcttatttaaattaaataatttattcattttttagcggacttcgcaatgagcacgcattggtggtcaatggcaaagtgcttttcgtgaacaaatatgtaagccaaactgattgtatttaatttttaattattcaatttttatttcttttaaatttagcttttggccgctcattcgaaatttttcgaagaattattttttggcgcaaatgcgaaagaaacgccagagattgagatcaaagaagttgagaatgcggcggaacactttgaacgtgtgctttccgtaatgtatccgcagaacatcgaattagacggtgaaaatcgaaattaaattaaattttaattttaataatgaataaaaaaacattttatttaatatatattttcctgaattccgcattctctaattagtaaaaaaaaagatttttttaattatttaacataaatcgctatttgtgatttttacataaaaatcatattcaattttttattcaaatattatcattttcttcatttcgcagatgaatgcgtcgagaatgtccttctgttggcccatcattttctgttgggttccgttggaaatctctgcgtcaaatttttgctggagaaaagcaaaaagtcggccattagcaaattccgattggcacaccaatgcggcatcgttggcatgaaagtgaaaaagaattgaaaaataaaccaatttaaatcacaaatttatcttttagaagaaaattctgcaggggatgagcaaggaggactttgtggtgacggcgaccaattacatggacaatctgtggaacagcaagaagttggaggcggacgcagtggcggaactgacggaacgccacaacgaattgttcaaaaatgaatgaacgagaaaggacgggcagagagaagggaccattctgctgattatgttgtatcacaagttcatcatttcttacagtacacttatcaataaattttcaaaatttgcacgagggttcgcaaatttgacggaagccctcaaagacactgacccattaaagacccagcttttgtggacctttgtaattaaaacggactcataatcaattaaaaacctgcaaaatacaccaactctgactgatcattgaattaatagcctttaattgggctgtatttcactctcaaaaataaataaaaaataatgatgatactatgatttaaaataaaaagatttataaaattttggaatttaattccgaaattaatcaaaccattttctgaaattaatcatcggcttcgtcctattttcccttcatcacagcctccagcagagatggcatctgatatttgtgtccggtttggtagccctgtgaattttatttaattagcaaaataattataaaatttttaattgaaaaagaatttcaaaataaaaattcaaccgaccgccccgtccaattggcgcatccacgcctcccactccaattcgcccactccccattcgatgtctcccattttctcataagtgtgtgccattgtaccgttttggcccgatgccgtacgattcattccgttggctaaacaattttttaaaattaaaatacgaaaaccaaaaactttacttagtttaattgtcttttgcttataataaccgcctgtgtttgttttagaaatgcgccaaatgaaaggaaatcaaaaaagtaaattcataacattttaaaatccaaaattttaattgttttcctaatagcctgcttattttatgatataaattttaagtctcaaaaatcttttcaacttttatggtgattttaagtaaagctgtaaatttattctttgtgtttctgaccatttggcgaactaaataaaacccattagcaccataattcccgccccctcccttaattggtgtaatttcttctttaattgtttgccccccccctccctccccactttcatttccttcttccatttcccccattttaatgtttcggctttatccccacccctaatttgctgccctttcttctttcctccacctccgtgctgtgcgatgtcataagcgcgcttcttcgcaatttcatttgggtatatcaaatttttttcgcccgccgccatcgcggacacttgagtctcacaggcgatcagcgtgtgataggccaagtggagcgcctcttccacggaggcgccgcaggcggcaaagccgtggttacgcaagaaaatgacccaaagggataattattaattttaattatgtaaagcacattttaagttgtaattggaagaatcataaaaaaaggttgttgaatcccctattttaactaattatttgaatttttcattagaattttagttttatcataaatcatcgttttcatatgaaagtttattaggaaccaattattccttttaattgcataacataaaatcattcaaaaaaatattataatcatttaatattataattatttacttttttgtcccccaaatgtttgacaatctccgttttttcatcttcggcagaaagcattccctaaaatgggaagtcttttcaacaaattgctctcactctaatccaaattcgcccaatttacacaatattcgtggtacgccacaggtccgatgaccatcgattctgtgaaaattcaatttcaattgaacaatagagacatctttttttaatttagaaaaaggcactattaattaccctgattcagtggcaaaagaccgcatttcattgacgaaacggcggcacccgacgcgctgtggaggtgaagcacacatttgacatcgggacgggcctcgtgaatggccgtgtgaaggcttaatgaatgtgcgttgtgcattcatttcaaacaattaattatgtcttatcaggaaataaattcgaatatataattagttcataatgacccctctgcttacatatatccggcctggttgatccctgcggggaggcgattagcattcattatggctcattagtctcacaatagtttaccgagcggagttgatccagggtcaacaatgcgtccgtccacggatattttgacaaatgaactggcggtcacctcgcgatagatcatgcccaaagggttgatcagaatttcgtggttctttccgggcagtcgaagcttaacacgaaaaaaccatgatagaaaaaggaagtcatgttagtttatggggcattgaaagagggaaagctgctgtttttagtgccgaagttcaagccaaattaatctcgtagttatctctcgaatttcaaattccaccggcccgaataatgcctcaaatttgagacagattctgttcagggatggaacggaattccgacttacgattcttttttgggcctggaattcatccctgtttctgactgactgtgatgtggttgtagatggcctgactccaatggaacaggtcgaccagccggtacaatgaggccaatttattgcggcagtccgtctcttccgccgagtacttgttgctgtcgcccaggtcagcaatcggcaccaaaggctttgctaaaaacgaatggcaaattatgccaatgataaaagtgccatttttcacaaatccgacctccaagtccgttcagagacagagatatgtccatggtgagtaattactataaggatttgagtgcaaaaggatctgtggtaatattttgtcatcatcattaattaattgtacccctaattatgcacccatttggtgaatgcccagttttgacaaatttgttttgggtaaaacttcaaatgagttagtcgagacgaacaaatgccttaaatggtggagcgagaatgcccttcccttctgctgatttgtgttaaattcctcaatccaaaaataaaagtgatttcatttgttgccaattcatttttaccgttgtttggatttttagggagagaatttgcaaatattttgagtttgtcctgtgatatttactgtccacatttgccatggttttgcttgcttttggtgagtacacaaaacgtgcaaaatgatcaaacgtggaagtccaacccaactgataaaccctaattactatcagtgtctttatcaaagcacagcaaagaatcattaattaattaatcacccgaccaaaagaaaaagaaagtgatggcaagacaaacaagcagcaaattcagcaattgagcagaggacaacaaaatgaatgcttaataataattatttattttacaaaattcggcgaatcgatttggtccatccattcattttaatataaattgctctttttcttctattatccttcttatcatcatcagaaagggacataaattttcaaatttcagtttgtattgataaagaataattataattaattttggaatttcgaattttatttctttttcgtgctaatggcactttctttgcctgctaacttttcttcctccggccatttcacttctatggcacaatttggtcgtcctgctgctggtgttgttcctcagctgtgaattgccgccttcctggtacgacttggtcctgctgttggtgcctgtgcagcgacagcgtcggcaccaaatggtcctgcgtttgttcgtcatgagtttgttgcacgagttgcggcaccaactgcactgttcctccctctctttcggcaccattcccgtgccgttgttgtccctccttctagtcctccgatttctcttggtcccgcatttcttggcattgtccgttgcgagttgtccaatgagtgtcgggcccttccgtggctcacaactgctgaaggcggtggtgcagaatatgtcgaggctccatttccttggcccatatttggccacgaattctcatccgatggattcactgcctcgagactttcttaaaattaggaggttcccgacgcaactcaagttcgttttttggggaaaatttaaggaaaaaataatttagacaatttaaaaattaaagtcggcacttccgagaaaagcgtttgaatccccgaaaaacaaagaacaattatgacaatgcattcggattctaactaaaattttatactttcaaacagaaagaaacaaaatgctattatggctatttgttaattatggtaattaaaaataccttccgaactaatcggatgtacggtaagtgaattgtgcacattcgaaacagcgtcgttggagtttctgtcaacatgcgaattaaccgatattattacaaataagagaatgtaaaaaaagacgacggagaaaattatcaaattttttatttgagaaaacatttaatttttgtaatttactagggaatattatatgagtttgttttcgcaaatcgaatttgtttaaataatgtctatttttagtttattttttaaataaattcagctgattttactcgagaaattcatgtgcttacttaggctaatgatgctaacattaattgccacatgaaaaagaactgttcagatcttcacattttagcagtaaatatgaatatccatccgattagatcggaaattgaaaatgctaaacagaaaagaaaaatacgccaaaacggaagagaaagaaaggggcaaaaccacagggacaaagccgacaaagaaaaagagtgatggaagagactgtggctaatagaagagagagagagagagagggaagggagtggggggagaatgcggctaattgaacagagagagaaaaagagtgagagcgtaagacattgattactcttttgaatgatcttaatcatcatcctcgtcctcatcatcactttcttcctcctccatcaccatcttcattttcagctttccctctgctgctgccttttcgttgcactgtttttgccgttctctcaatttttggatttggcgttgctcgtcaatgcgaatgccatttcctctctgaataaaaaaaaagtaaattgaaagcgtcagaaaaaaagttggtattggcacagacttcggttgagcagctgctgatgccctgctgattctgagcagcggtgcgttcggcttcacgttccgaactcgtctgccaactcgggtccaacacccgcaatagctcacgtgccatctttccgagcagccgacgaccccagcggttgtaggccggcgttgccacatattcgttggccaatctgtgccaataggaatagtaagtaaaaagtgctccagaaattatccaggtcccgcttatccataaatgagtatctttccttatttggcggcggtgcaccccaaaacttcgccggccgaaacgtcgtcggaagactttttgaaccataactttgttcattgtcaatcaaattaagcattgttggtgttgttcgatagctctgtgtgtctattattaatttgcaaaatttcaaaaatttttgttaagtttatggccagaaggaactcaaaaacctaatatttcgaactttttttgcctgattttttgtgcatgaataaaaatttttgaaaatttgcagtttaatagcgttttttcaaatgctttcgaataatagcaacaatgtttaattttgttgagaaagaaaaaaattatggtccaaaaacactgcgacgacgttttgtcctgctccg

SEQ ID NO: 6214 - DNA, 6701 bp, Heterodera glycines
  misc_feature (28)..(28): n is a, c, g, or t
  misc_feature (68)..(68): n is a, c, g, or t
gtttcagcatgttcagatcaacacgcancaaaattcagttcccctcattctgatgcctgtggccactnttgtgtctatttcttggccagccgatgttctggcaccccgttttgcgatgtaatgaaacgctgcgcaaaacgcgtgggatggcggactggttggtcaaatggtatgtacgtacactggcgcgccatgtataaaaggccgactaaaagtggggagggcgccacattttttctttcattgcgagaacataaggatgttgttcttttatttcttgctgatcgccttcatcgtaatttttttccatgttctccgtctatctgctggcgaatggattaatgttgagctgagtgtggacccaccaaacttttttgaccgttcatttcgcacaatttccaagacttcaccggcgcaacattggttcggctataaccgggacacagcatgtcatgttgagttggaaaggaacatcaatcggctgtacaccaacccggatacatggaacattgccctgacagatgttgataatttaatgagcatgggacggacaacagttgagataccgtcaaccgccttaccatgggcatgttttgggcatggcggccatagttttgtaattttcaaccttcaaaatgctgcgggtgaggtgaccgtactgcgtggacaccagcaaaaaatagcagggcaattgagcgcgtatggccgcattttgtttgatcatattgccgcccgattgtacattgtggacaatagcgaacgccgaatcaacgaattgctcattggcgatttggagcgatggtggactctgaataacacggacgatggtgtactgaacaggacggcaccacatgtcctaagaagcaattttgttggctttttgccggaacaaaaaacggattatttcattgcagctgaccatgtgtaccttatttggcgaaggcaagtgtacaagttccgcattggacactatttcaacgatccttcgtcacagctccagtttctgaccaactcaagcgacattcgcttcaacttcctcttatttgaagcaggtgccgaaaagctgggtgaaggcagcggcgatcatagaaatagcagatcagctattgttgtaccaacggtgtcgtcgaacggaattgaacgcctcttgctcgccttgacttatctctttgatcttgccgtcatattgattgccatttgtgcattccgccatttgcgccgatttcgaggtggtggtgatggagctgcacgaaatggggatgacgcgatgaaactaaatgaatacgatcttttccattcactttcgttgcaaaacaacaatgggggcggagcctatgatgcgtctgctgcatacaatccaaccattatagcaccaaggaccgcccaccagctgagatcttgtgccactatttaaatgctcacttttttttgaattttccataccacttgcataaatttactgtcattttatgacagccaaaaataattctattgtgcatttgctgctaactatttcatgcaaagagcgataaaatattttcaagaatcttttgcattcgacaccgttgaacagttgtatgcgcattttaaagaagagattttgagctcccccggtgaatattacccaaaccctctttgtgtgcttgattgtgtacacattgtcaacgacgaacacgctgatttgccggtgttcattgaaggaacgcttgatttgatcgccggactagaactgtattccacatgttatccgaggacggaagcagggacaatcaaatggtaagcgagcagagaaatcaaaattcctagataaaaaaacatttttaatttaggagcgaagtcttgtacgtggagttgaaggacatgatgatttgtcggggcgaatcggctcgctgtcgctgcgcacaatccatcaacaacaacctgtcacactaccagctgatcgtggacgagctggaccgttggatgatggacaaccaccaactcaatcggcgggacgtcgtcgaacaagaagaagaggaaaacgtcgaccactcaacctggtgaaggcactgtgtcgtttcaacggcggctgcatgccatcagttttgccgcagatgattcagaggagacgaatagaaaatttgtgttttcttcgtgatctcaggctgcaaacagtgcatctgaagagtaacattatgatttccgccaactcattgtcatttcacagtgcaggcagtttgcttgcctaccgtggctatttgtccataacggtagagcagcacttgtacgttcgccatcgtgttcgtcttaggttccccttcctgccctgcgttgtgcaatatgggggaaatcaccatcactattattttccattagaactgcttgaaatatgttctcgtccaactgacgaatcctcctaatctacacaccttccgaatactgttttattgttgctgttgctattgtgaaaaataaatgtttgttaacacaagtgccgatttggggttattattttggggtgagcacttttcctctattccaactttcttccctcctgtgcgttattctggactatttagtttgccgccgcctcctcctcctcatcatcatcaccgctatcgtcatcagtgacttcggcttcagactcagttgaagaactctgggccccttctcgatgagagtcgatagctatttttttaattttgtaataatcatcatcatcatctgattaccattggaacaatgcgcggcctcccaatcacgaaccttttcctcagaacgttcaaccctacacaaaaaaaattggttgatcgagtcaacgcagtttatttttgctaatacttttttagtatggtgtccaaagagtcttccccaaaatcgaccacgtccgaggcattgtcgtccacacccatttcttcctccagtttggagtattttttttccaacgcatccagcctgtttttaataggaggcatctatgttatgccactttcacaatttaccattcggcacgtgcttcgccctgtgccttgatcattgcgcccaacattgaggtagcggacccatcaaatgaatgacgtcgttttcggctatcaccactgctcgtggaaggcggtagctccttcttttcatccttgggcgtttcgtttatcgtcatgccgagaaaaacaatttcttcttcgcccttttcctctccatgtcctttttcctccggtttcagatccatttccttttcagttttgcattcactgttgtccatgttgtcactgctaatttcttgtcctacaattgctctttaaaggttgttgattagtcattaatgaaataaacattgccaaaaaaaccaattgaaaacggaattatgaaattcttaaaattttatctacggcgattaaataggtatgtgataggttcattatcgcttattcattgataaccaaaaggaagaacatcaagctcatcagtgataattcccttctggcagacgggcagatatcgcttgcgctgctcacgtgtcacaatctgactcgcacgagtcggttgaattttatcataatggaacacggctggctcctctccttgacgtccatagttcaacactttctgacgaaaatgctcaaactgtagggtctgactgttttgcacgtcaaaagttattcctctaattttttgcacatatcggatttcgccagttcgctcatcaaccatttttagtgcatattgttttgctcctaagcggaaagaaatatgtctattacaaatctatacgccgctatgtacctccacaaacgaagttttttatggaaaatccggtgtattcttctgacatttggccaaggaattcgccggtttgaagtggcgccaaatcacgcctatgcttcacaatgacactgtcagtgtcctaaacaacggggtgctaattgtgttacaaaacacaagacaaactaccgtataaagcaattctgctccttcggtgttgtacacttgctgcatataatcgagtaacttcaaccttgcacgaccttaaaataataatgggagcaatgctagtgttgacaaaactaactagtggtccacagactgagcacgatattgctggacgaatgttcatcgataaaattttttttggtcctgtacgaaacacgaatgacttcatcggaaaggggaattatggcataaatttcctgcgttggaaaatttccataataaattaaggcgagcattcaaatactactactactacttacgactttatggtcaaggatgagcttgtaaaattcctgaggctttgtgatcacacgatttgcgcccaactcattgcgcatgctgaattttcccctaaattttgggttactttttttttttttttttttatcgttcctaaaacataccacaaactgttcagcattaacttagaaatgaatcggagtccaggatttttgttaatgcgtgccaaatccagctggacgttgtaccttcgcatgtattcatcggcaaaaatttttctgtcctggtctgtttcaacgccatccgggaagccgcttgcctccacctatatgacaattgtgaaacaaaatgagtgcaaattgtacgtattgtacaaattacctttagctttatcataaggcgaacatattctttgaaaattttgtcactcctaaatgtagctgatggatgttaggcggcaattcatacactcttaccattgctcataatgccaagctctccagaatcggtccacccggtagccgcactctaacgcacgtgccagctcaatatgagtgtaggttccggtgtaggctcgctgctcggctgtgtgttcacattggtgtgcacgccttgtgcccatatggcgaaatttgcttgcacatctgtggcagcaacagaacagtaaacgatcatccatcttgagtggcagaatcggtattcgaagcgctcgcggtggaatcacacgcacacgatacagtcccctgtagagcaagtcatccggtgaattcctattccgcaacaacataatcagggtgtcgtgtccgccacttaccaatcaaccattatttcttcaacgcttgggtgaataattttcggtataccgacagggtaatttgtgtcgtagttgacctataatcaatataaaatcgatccctccctttaatcacaaaatttattgtctgtctaatagacacaacatacccacggatacaagctcacaatatcataaacgctgattttttcatcgtcagaagcctctgcaaacagcttcagtggaccagttcgacctgttaggcaaacattaacgaggaaaaaaaactgggtccacttcacctccacagtaagcggcacgtgggtcgattggccccctttcattgcccaaatcgtcaaaaaattcgcgcatctgcctgttacgggggtctgatagcagagcgttgatctcgcattcctcaaaaaaaaaaaagaagagcagttagatttataaattgcgctgtgttttaacccaaatttcttccacttcaatgcatcttcgatactcgtctggctcacggagtttggtcagacggtcctgggttgattcgttcagctctctgcacgtttttccgtccaccagcttatcaccaggatcatagcaacgctcacatccatgccaataactgtagtagcaatagcacccgcacggaatgaatcacacttaccatccaagcacttcaatgcatttgttctgttcagcaatccatccgtcaattttgtaattttttatgcgtttttctcttccattgcctgcgtgttgtacttgtactccttcacttttggctctccagtccaaatatttaattgcctaaatgtcaaaataaattttaaaaacgccccgaaagctccaataccagaacactggctctgtcgtttctctcgtaccctgtctctgggacgatggccaactgattctctgtcatgaacattgtacgaaaaatgttcatacagacgctattttgcaaattgaactcataattatcggtcatttcctcccttcccgtcatcttacctcgcaattgtacaactaattgggagaacatctaacccattggttatgtcgcgcaacaaaatttggcgaaatttcagaattgcaagcatcagaatttctgtgtcattttcacaataatcgcgcaactctgcaggaagaaagaatggcgtgtgtcggttctcttcgtacctttttttagttcaaaaaatttattgtatgccatatagcgtgtgtaaacaaaattaccattgttcaaatttttcaagttttgccggcttcattgaaccggaaaaatatgcttcttttggtggtagatgcgggagccgaatttcataattttcccttaaaacatcgatgacaagtggtagctgtgttcgagagatgtgtcttctacctccgattgaatccgtagggaaaaaaaggtttatcgggacagtcgagatcaaaggtgcttttcagtccatccaaacgtatcgggaacagcaggcatgagtcgcgccaaattaggaaggagttcaccgccgaatgttgtaaacgaaactcaaaaattttaagtccgttcatcacaacgtccggtctccttctggtctcgcccagataacgaagaacaaaatgtccgtcaaatctggacgcgttatgggccttgtaaaggggcgttatggccaaaaagcatgacttaattcactgcttgttcttaccccaaatgtaa

SEQ ID NO: 6215 - DNA, 2475 bp, Heterodera glycines
ttatccttcttaattgcgtcaaatttcttacagttagttattccatgtacgtcgttaaaataagcaattacattttatggcaaacaaaaattattataaaaaaatattatccaaaaatctaaaaaatatgcaaacagcataaatagtcaataaatttatcaatcaaaaatggtgaatatatttttaatgtttcaatattttattatacccatgaaaaattcatccactaaaatttgcaatttttttcctatttttgctctacaattaggcttttttacgattagaacatatatgtacatatttaaattatttataaatttattattttttcttttaataagaattttggagtttttttcatacagttacaggaatgacctacccatttttgcgttacagtatattaattgtcattttgtgccttgtgtacggtaatgatgacgaaaacaggcaagaagcaattcataaaaatgacgattatatcattggtgatgtttatcttggtgacgaattttgggaccaattttcaccgatcactgatttgcccacaattgatggagtcgaatttattggaaatcatttaaaatatactgatcaaacggagaatgataaaactcatgaaagtgtgattgaaaaataactaattaaaacattttgataatttgacacaaaatcaaaaaaatatataaaattaacaatttttaatatatcgaaaaccgatgagtattaaaaatttattttaaatggagcggcattcctcgacgagccgctcaaacttgatgtccgtgttcttggctcggtcctcttccatcattttgagacagcgctccctcaaatcgcggtcagctgagctcagaccgctgatgaacacgagagctttgatctcctccttggtcagtgtcatttgtgcccgttcacattgtgcgctgacttgtgccgcgaaatcgattggactctgtgaaggtgctttctgcaactgaaaacactcaaatcgtttaacaaaaattgatttgatgccgcaaaatagactctttaacttgcttactgtgacattgtatgataggtctgttggtttttgcgggagaatgctctccgtgaaccgcgcgtattcttgcgcaccaagcttaccgaccaacagacgtgtcttcatttcatctggcaatgattgtccatctgtctcaagaaatggcccataacgttcgtgccaaatttcaaaaaccaaatccgcctccgggttgtagatgaattcggacaattgggaattaattgtagcgaataaatcggagttttgtttattgggatttgcattttgatttgcaatgtttttgagagtgtctgttagctgttggaacagcagtgccatgtccgcgggatttgccatgattatgagtgaaatgaaaacaatgcaatgatcgagtccgaatgagagtcgaatgaattgggcggcgtcgggaatggcttttggtgtgaatgcttatgaattggccagtccgcgggtcaaatatgatgatgaatgaacataaaatgattggcgtttaaaccgtcggctgtttgtgggaatgcgcgagtgaatggaatacacatatgttggcttcactgtccacctcaatgtgttctcattcactttcaactgtgcgggtgttcacagagctcgcaatgagttggaattccacacagagtgttacgtggaggtggcctcgggttttgccaaagatgaatgaatgaggagagaaatgaaagatgcctgggactgccaaaatttaaatgaaatggatgaaaaatgccttatgctgactgcgccaaaaatgttgtgtcttttgcttgaccacaacacttagaaggaataaactttaataaacaaaataagtccacaaatagataaataaaatagaacaataaattgatgacagaaaataatgcgaaatgaatgagagatggcaaatgacatggactgaccaagactcactgtgtgttcggctatttatgaggacgaacacagggaagagacgcatgaatagtgaaggagagagacatgacaaaataagagagtgcagcgggagagaaatagagaaatgactgaaagggaaatgagcgaagagcaaatattgattgactacccaacacttttgctttttattgttgaaatgcgctcgacctttctgcggctgatcactgctcttttcaggcgattacgtcaacggcacaatgctcaccggactgtgccggcaaattctgctcgaagaccttaaggagtcgcgaaagcacgacattctcgagtggacagaagtgccgcaaaagctgaaagaacagctggaaaagcaggaatttgatcagaaatgcaactgaacagaatggaaaaagaaagagaggacaaacaattgcaaatgaatgatcagaaaaaatcaaacgggacagagaaaatggcccaatcgggccactttttttgctgaaacgaaacattttccaataaaacga

SEQ ID NO: 6216 - DNA, 1471 bp, Heterodera glycines
gctccctaaaaacaacaaaatgattgactcattcccgcctcaatgccatttcaatgccaatagttcctccacatcattaaaaaatgatcaccttcccattgtgccattcatccaatcaccgccccttcgtctcctccgcttcttataaatgagtgccgtctctctccgtgtgccatttagcacattccgcgccctctctcactccctctctctccgccattctctctctctctctctcactctctctccctctgtccgaatgtctctttttctcttccactctgttctgctcttcatttttcttcagcttaattcttcactcatcagaggtccgtttctccattcattcttccgtcgttcatttgcttctcctccctctcccctcatcagctgattacgtgactatgccctcaagctatggaacaagcggcgcaatgagtcagagttacggtatgggaggaggaggaccacccgcggcatacgataccggtgcacgaggatcatacggtagtgcaggagcagcctcatacggtaccggcagtatgggttcgggagcatcttatggacaggcagaaccgaaaatgtccgtggcaatgccatcggcaatgccgccaccgccggcaatgccaatggctgcgccatacggtggggacggaagtggccgctatggaaatgacggtcgtcgatgaacgaaaagaaacgaaacgatagattaattaccgtatcattaattcccactaattacaaaacatttactattttttaaataaaatgttttttttttgctcatttaatttggtgtttttttttgtagttaataaatttccttcctcccgtttaatttcattttttcataaaaataattccgccattttttcctcccattctccaccaaatattttatgaactgatttgtgagcaaagtgagaaaaggcagcgaaatgggaggagagagtgcgtgggtcgattctgtcattaattaccaaagcgccaaattccgtcgtttgtcagcggcacaaaaggaaatttgggggaaaagggggggggggggggaagtgcgaattgggggatgacagttcgatggttttttcttttgggagggcggggattacactccgtccgccgcacactcaaaactcaaagatggccccgtccttcgcttattccggttcggcccattggcattttttttcaactggcgaatcgtttttaaagagagaagagttgccgcttcaaagacaaacgctcaaattttaaaacttcgccgccaaatataaatttatttacaaatttattttaattattttttgtttttttattttttctttaagcaaatgttccaaaaaaacacagcatttttcctcctatttattgccttctttctcggcattgcttctgctcggctaaagcgtggtaaaaaataaattcagtttccaagtttcgagacaaaataaattaataaattcgaaat

SEQ ID NO: 6217 - DNA, 1497 bp, Heterodera glycines
aatccgccgccaactcctctcccgtcgcctcagccctgcgggcagtacaatcagtacggaagcggcggcgcctttggaggcggcggaggaggcagctacagtcagccgaactgcaacacatacgggcagcagaacaactacggccagtccaattacggtggtcagagtaattacggtcagcaggaaagtgcgggtggatttggcggaattggcggcagcccatctcagttcggagtgggggcgccaggctgtggcggggcgagttgctaatcgactgaccgatcggaccgatgcgaaaagccaaccgatcagcgaccaggcgattgaatccgtcatttcctgttaatcaattcatcttagcgttctttttacaaccaaaaaaacaaaacaaaaaaaggaaagaggaactgccagttttgtgtgctttagacgcaccaaaagccattttttatcaactccattcgccgaacatcccgatcacacggattctccctgccaatccgatggctcttccctttaatcccccccccccctctcttcgcccatttgtttagcgatcatctttttagtgctgatctgctgatgacgttgttgctaatagatgggtatttaagcgcattcgttcgatgttcctttaccattaaattaatttcccattttcattcgttcgttcgcttttccaaaaatgccgcgcctttctttcccccttttgttcctttcttttgtcattactttgcttctgattttcacgtcaacaaattctgcggctccatctgacactttacgtttaaagcgcggtcagtgcttaaaaatatggggcgggggattggaagaaaggggaggcatttgacaggctaaaagataaagcggggaggagggaattgccaaaactggaagtgccaaagtcccctcacagaatgtgaaccaattaaaagtttgcatgtcattccaagtctaaaacattcgttcattatgctaaacgcttcttaggctacggcggatacaacccgggaggcaatggcggcggatggggcggaaacggcggaggcggccgcccatacggaggcggcggcaattggaacggcggcggcaattggaacggcggaggaaacggatggcaaaactgagaaacactgagggaattgagagagtggcgatacggagaaagacaattcgaagaaagtgcaattcgacacaaattcattttgtgataaaatgtttttataatatttgatgaccccaatggcatttccggcaaatgatcagcgatttatcggcaaaatgatcgattggtgaccggcggctgagctgctctcactgatcggtcatttaacgccttctccggcgggcgcagaacaaacagcacaaaagggacagaatgacagaaaggacgatggacacggccaaagagatgagcagagtgttccaccagtcgatctttgaaaaggaagggcacagaaagtcgcttcgaaagtcccctcggtactcatcttactg

SEQ ID NO: 6218 - DNA, 1751 bp, Heterodera glycines
atcagctggaggcggggcatcgatcggacggacggctgccgagaaaatcgaagggggggggggatcaaggcctacggcaaaggaaccacgtaactaacacctgctgtttgggggggggggggaagaatgcttgcaattccgcgtgactaacgtgggaaaaataaacaatggcacccttcttcgacgttcattaattaagcaaattgcaaattggcaattaacgaatgacccaacacacttccttttcgtttgtttatgaacacaaaattgatgggaataaatgagtgatcactgatcaaattaatgtaatttcgaatgattagcggaagatcaaacggcgtttccgctggaccgaacgacattagccgtccattcattagcctttccccgcgcgctttttcaacggctcagtccaatcggctgctgcacgttctccccggccgcgttcgtccgctgggcccttccctccggatatttgcagcaattggacactcctccaacactttcccagcacagactcacttccatcccggtcaattccacctcaccgctaatgcgtacctgtttgtagtctttgtgggcatcgatggtgcggtggaaaaatgaacagaagggagtgccattgatggaaatctgagggaaaattagaggggaaaagggatataagaaacgggagggagataagggggggggagggatagaggagagaggtggtgaggagaaaaagagggggacgagggagggatggatagtggagagtgataatgtgagaaagggcgggggaagacagtgtgagtaaggaagatgagaaagcggaaaaggccaacgatgtcccgtcaattggccccaggcaagtttaaaattcttaatttgcggttttcattgcagcttttttaagtttaatcgcttgacaacagcttaacaattgtcttaaaaagtagagcttcgaaatgatataaaagattcattgaggcggggaaaaagaacggaagggaacagagagagagaaagaagagaaacaaaggacagaaaagaaatgccgaaaaggactgacttggagtgccaatggctcgttcagaatgaccaagtcgaacccctcgccctttctgaacgggaaagggcctccttcactttcttcggcgccccattctttgtccgtttgggcatttcggaccacctgcaaattgatgagaatcatttaaatgtccatggattatgggaatgacaatttgcttgtcgaacagtgcactcattctgaacagctcctccaaactgtcgctgatcagtgaaacggcgaaatcgccgcggggaatgccataaacgaacagtcgctgcccactttcgagcgcgtggtcgtggaaagtcatttcgtacggcatttcgaagtatcggccgccccaatggacggcggacagcgaaacgtcgcccgacgcctttgaattggcaaatattggcgaatgcacggcacaaatcataggaccaccaaatgtgtttttacttggatgtggtcgatttttcggaaatccgtgcggtgttcgaacacagcccacggcacttggttgacaaaaaagtcgaatcttttctcgtggactcgaattcgcacatcaaatggtttcccatggaagaagggattcgaatgaaactcctcctcgccccattcgccgttttcctaagggacggaccaaaaaaggcgcgtggacggaaacggcacactgaccaacatcgagttcaaaatggtgatgccgacttcg

SEQ ID NO: 6219 - DNA, 4442 bp, Heterodera glycines
  misc_feature (10)..(10): n is a, c, g, or t
  misc_feature (151)..(151): n is a, c, g, or t
aatcagcacnacgcgtggacgcgctaggcacagtaaaacggggaacaataaatcactaatggttaaatattttttacttttacttcaggtacaatcgcgcaaaggacgacccgttctcactgtttttggccgaggccgagaacaacccgtntgtgcaggaagttgcagttgaaggacatgattccggcggaaatgcagcgactcgtcaaataccctttggtgggggggggggggggaatattggccaaatgagcattattttcaaataatttacaaaaaaaaattaaaataaatttattatatgtacacgatttcagttgctggaaaccgtggccaaatacaccccggagccaagcgacgaattgcaaagggtaaagcaatttttgacaatgattgtgcatttgtattaattaaataatcgattcatcagttaactgattaatcggaattatttcccaattgtttaagctgctgagcggaatccaaggcgcaaaaaacattgtgtcggaagtgaacaggtgggtgaacaaaggaattacaaaaaaatttctgaaagattatgatcatctccggcgggggcggtgatatagctaatgggacactttaaaaatgcaattaaatttattgaaaaattacgtgatttttttaatatttccacaatcttcaacattgttctgtctctttacaaattagcccaacttctttacggatgctcaaatcattttacacataatccattcattgatttattaatgagaatgattagtccgctaataatcgcattcagtgcaaaacgaaatgcggagaatgtgcggcggatggaggagctgcagaagaaattggacttttctggggctgaaaagagcttcttccagaagttcgactttcgaatgtgcgcctttcaattatatataattaataaatttatccaagatcaatacaaattaaggcacaaattggtcttcgagggtccgctggtgtggcggcaagcacgcggcaagaacattgaccttcacgttgtgctgctcgaacatctgttggtgttcctcaccaaaacggagacgggcggcggcggacagcagcccaattttcagctcaaaattcacgaggtggcagcagaagagcactttttttaatcgaattaataaatatttttaattactcctccgattgctccgcccttttgcgctttttacttttgcttttccttaggccgggtgcattccgatcatgcgactgacatcggttgaggtggaggagaaggcgggcgacaagcgttcattcaacctgctctacaaatgcgatctgcgcatgttcgagttggttgcacaaacggcgacggaacggaaaacgttggtttatggaaagggacggggatttattgatcagataaatggaagcccatccctagtcaatgactgaccaacattgattaatcccttccgatgatcaaatgctggaaaaattctctctaattagtccattgacttgacaacggttggagaatttacaaattcattatcactgatcaatgttttggctattcccacataactttttgctcattcccctctctaattttaccacttttttcgatttccagttggtttcggctgatcgacaaccaggcgtccgtctcgcggctgtcgcccgtaccggccgaactattcctggacggcactctgtccgcctcggctctgacgatggctcagcatggcggcggcgtgacgccgctgacgaacaaaagcagcgaagacgggtcgctgcaaaggctgaacagttccagcatggaccacgtgcacgtgctaatgcacccggcacttgtcaacgcggtatgatcttatccaatcacagtatccaattaccatatccaatcctcatttactaataattggtaaaacaacctgcggcctctttcggcattaaatcgaatttttgtttatgagtttttctctgtcttaaagtgatgataattcacattttcgattctcgggaaattgttcgagtaccgtaaattataaattaaaatcttcaataattagccgctcactccttggcatttctgacatacaaagcgcaatgcttacttgtacattttatcattttgccctttcagaatgaaattgtcatccaacagcccaccgtgatggacaatgcgcagccggtgctgagcgtatcggaacggttgcgcaaaaatgaccggatgatttttgcggcattggcggaaaagcaccaaattttggcagaacttttgaacgattacggaggagcagcagcagcggaggaggacggggaaaggaataatgaagtgagtgaggagagaaaaaagagcaaattggggggggggaataagcaccaggggaaggatggcacggcacaaagtgggaacagagggggagtcacggcgcaaaagcatggcacggcacagatcgcattaccaagcgtacaagctaattttttttttcattaatttaaattgattttttctcgcttatttcttgtaataactcttttggttttttcattctctgctaattgataatattgataagttttgcccctatcatttaactcttcagaacaatggcggtcgaaaagcagcgccaaacactgccgagctgctcgatcggatggctgatcagatgaccggcctggcggtgctcgacttaaagcaacggaacgccaaggaattggcgatgtccgccattgtgcagggcaaccgattgctggagagcatcaacaaagtgggccatcatttcgtatatatttctatgaaattaaaataattttgttagggaatggttgtgaagccgtccgacgacccaactgcgaagcccaagttggacaacgaagacgaactgatgttgccgtcagtgccctgctacaaattgacctcggtcgattgtgcccaaaactgaaatttatgtaaaaattgcaattttcaggtggcagcccccctaatgaaccatctgaaggtttattggaggaccaaacaaatttcaaataatttttaaattttttcaggcaatgctccaagtgcttcaggaccaagagcgcgaaattcagacactgaagcagcggctaaaggtgcggcacttttcatcccttagctaaacaaaatgccaaatttaccaccactattcacatataaatttttatttggcaactcgtacttttcgtatttttgaatttctacagtatacgattggatggatcagtccgaatcagttttgcccttctttatgaagcaaattttcacttaacaaaaaaggcccacagaagcgaaaattactaattattttatatatttacatttaaaaacaaatttcgctttgcttaattcgattcattccgcaggacactcagtcaaatccgtcgagaaaaacggcaagcgaagaaacgcttgtcgagagtggagagcagcgcataaaagtgacgaggacatccgtcgaggaggacacgccgccgccccctccgagctcgaacccgccggcctcttagtcaccgcacacgcgaacgttactgtactagcaaattcagctacagtacaacaaatcccacagtactacgttctccttttctcattggcccgaaagcaacagcagacaattgagaattttgtgtgaaaccgatagtgtgcaaataaattatcaattcactgatccattcacccattatgcatatatatgtatttaattaacggataaataattaaaatttaaatcttttgtgacagctgaaagtgccggtgccattggaaaaatattgattgtaatattgatttcttaagggtctgtttatgtcagtgtttcaatctcaaaattttgaaaatcctcatttcagccataaaaaatcctcaacactaaaatacttcaaaaaatcctcattttttaaaacatcataaaattgcgaacaaaatcagttaactgtcatatttttaaatgcttgttttacggcgctttttccaaaaaacttttgggaaaaattttgtaatttgtataatacgattgttaacagattttgtccaaaaaaacagttcattccaatttttgctccttttttagcaactattttgggcatttttcagtttttttagcaactatctaggcaaatatttcgcgatttttagaaactaaaaatcccatccctagcataaggtgcgcaatgaaaagcatcatcatttttggcccgcttaattactccattaaattctttttcgtaagaaagaagaaattttcgtttcgatgacatttatttttttgtataaaattagctaaaggaaattaattaaaatttatgcaaaatgaggatttttcgaaaaatgtttaagatttgaagaaaaagttcgaacattttgccaaatatacctaatgcacacatttttcgattttgcttacatgtaatttaacagaccaagtgaatagcaaaaaaatgaccctgac

SEQ ID NO: 6220 - DNA, 1742 bp, Heterodera glycines
ggttcatatttcgtcggcaaagtgtagtttttttttaattttaaattcgtttcgtttggtttttctgccagaaaattaaaattttcttttaggtttcgccaccggaaaaaaaaaatgaattttcgttccgtagaaactggcaaaattcgtgaaccattccaagacaaataaattcctacggggattcctattctttaaattgcttttttaatcattaaaaaagcatttaattgtttattttaatttggcacgattgacaattagttgattattcttgcgaaaatcgttaattagattgattaaatagtatccttattaagtgaaatataattgattggttaatccctttaattatccccgctaatcggcagctatttgatttcgattgactaaccatttttgttaaaaccaaaccgtttttttcatacaaataaatttgcattttgtgaaaacatttgtgaattccaacaaactcggtacaattacttataaatcaggcactaatcaacaatttttatttttaataaatacatatttttcgctgccattttcaaattatatttattgaaatcatataaaatttaaatggaaattcataggaaatatatacgatattttgttgacaaaacaaaagagaaacacatacttttacaactgctgtttgatgatgatgaactaagaagatattattttgtggggtctaaaggctttttgtctgctgatcagtgagtcggatgaaatgaaaaaagttcgaaaaatgcgcaaaattaaataaaattaaaatttgtgcgattgaggaacgaactcgtctcggaagatgaaaatggatggaaaggagagcaacaataatcggaaaaacgatgtgcataaaaatgtttggatttgaaatggataaacgaatgccgtgccgaaatgcaaatgaatgaaaatggattaaatgggagaaaaacgaacacccgttttgcctaattgataggaggtccagtatttgtctcgtagaattgtttaaaaaatgacattctcattattaccggttcaagcaattatttccgaaagcgctctcaattggacaacaagcgttcatattttgcctaattgataggaggtccagtatttgtctcgtagaattgtttaaaaaatgacattctcattattaccggttcaagcaattatcatttacgaaagcgctctcaattggacaacaagcgttcatattttgcctaattaataggaggtccagtatttgtctcgtagaattgtttaaaaaatgacattctcattattaccggttcaagcaattatcatttacgaaagcgctctcaattggacaacaagcgttcatattttgcctaattgataggaggtccagtatttgtctcgtagaattgtttaaaaaatgacattctcattattaccggttcaagcaattatcatttacgaaagcgctctcaattggacaacaagcgttcatattttgcctaattgataggaggtccagtatttgtctcgtagaattgtttaaaaaatggcattctcattattaccggttcaagcaattatcatttacgaaagcgctctcaatttgacaacaagcgttcatattttgcctaattgataggaggtccagtatttgtctcgtagaattgtttaaaaaatgacattctcattattaccggttcaagcaattatcatttacgaaagcgctctcaattggacaacaagcgttcatattttgcctaatt

SEQ ID NO: 6221 - DNA, 1591 bp, Heterodera glycines
cattcattcgcaacaattaacccaaaaagtgcgctcttttaattgttttgccttttcctaacaaattttattcggacatttaactgctaattgactgctctttccttctccttaattaatacgctaaccaaatgcacagaaattggcggacaaattgcgccaaattcaaagcaacacttcgcttccgcccggctcgcgtggtgccaccaccaccaccagccaacactcccaggcgggcgcaggcgccgacttcgcctcctccgcgggtgccaacgcgtcgtcgacgttgcgcctgcggctgttggaccgatctttggacggcgccaacagtgccgccggaagtgtggccaacggcggagggggcagcagcagagggacaccgccgccacagccacagacagtgcagctacagcagcaaatggcattcggagaggagagacccgcctcggaggcgagcagcagcacacggcggatggaaaacaattgcaatgagaagcagcagcaacagcacagccgaagcagaaggagggtcgaacaggttgagaaggacggactaacggaggggggggggagagaggaaatgggatgggaaaagggggacgaagcggaccaaaaccacgcccatttggcaaactaactgttgtgtccccacgagtttcaggcaaatgcacttttctcagttctgacaacttttcctaatttgacccaattcaatctctttttttcgaccttttttttttgaggttttattaaagcaaaacagttattaaagcaaagcaaaattgtttaagagtaagaataagcaaaattggttatagcaaaattggttaagagtaagcaaagggagagtaagtaggaagggagaatggcagtaagaagaagtgttttccaaagcagaaagagagcttaaatacggcacaatttttgggaggagccaagcgaagccaagcgggtgagaatagtctaggccacattacacaaagcggagagagagaattttggagagagggatttggtaaggattgagagatggatgaataaaatgtttacgatgagaattggtggaaaatgggtcaatgcaaaaatgccaaaaacaaaaataaataaaaagaccaaaatgcagacaccacaatccctctcctccttcgagacgtcccgtccatcatcattcccaatcagcgtcctccgtgagatgggccggcatggtagtgcgcgcgtccaaattgcattccacgtcccccgcgtccacgacctcctccacggcctccgcggtcccatcctcgtgcacggtgacaggtccatgatgaacagcttggcggcacatcgtgatgaccatggaattcgcgctccagctgacggaccagatagcccacgcgcttttggattttctggcctccattcttccattgccctctagggccatgccctcccatggcatagcccctgcctctctttcccagaggcgctcgattaattggctctttgggcccttgccctgggttctgtgggggcaaagcctggacaggctctccatcttccatcgatgggcttttctccacagtaccttccgatcgctgatcactggctggtg

SEQ ID NO: 6222 - DNA, 6962 bp, Heterodera glycines
ggctttcctccggcaacagacgctgttttcgccctccggcattagttgacatttttattgtgtccagcactgtccgtatctctcttcccaaaaacttttgggatggactctctccctgtgccgctgcacacggcgatgccctatattcctgcataaaaacgaattgtgcaattttgagggactttccctcatctagcaatttcccaactccttctttgaaggttctgacgaagcgctctgcttcgccgtttgatgaagggtggtagggggccgaggttaagtgtcgcaccccttcgcctttgaggaattcttccatttcatttgacacgtattgagtgccattatcggttacaaatgtttttggcgaaccaaaaatgccgaataattcacgaagggcattaataagagtcgaagagtgggttgaactcatttggtacacaaatggaaatttcgaaaatgcgtcaattacaataaaaaaattggtgccccaaattgggcctgccaaatcagaatgcacgcgctcaaacgggaaccgcgcttcaggccatctgcggtccggttcctcgcgcggtttatttggcccatttctctggcatgtccaacattttttcacaaaatcctcaatgctttcattaatccctggccaccaaaccaatccttttgccctgtccttattgcgtacgatcccaaaatgtgccctatgaatcagttttaggatcggatcacgcattttctcagggatcacaatttgccttaggggtttttttcgaatgagtttcccctctaagtacaattggtctcgtattctgtaaaacggttttagcttttcctctacgggctctgaccaattttcttttattttcaaaacaatttctgacaaaattgggtcctcaattgtctctttctcaattttatcacgacttatttcattttcgttttcttctgaaacgagcaaatatggtatttcttcttttatttttgcttctatttgttcccactttattggcacacgcgacagagcgtctgccactcggtttgcctttccctccaagtaaataaccttgggttcaaactcttgtaaagccattagccaacggtttaattttgggttggaactcgactttgaaaacaaaaaagtcagtgggcgatggtcagttaaaatgattatttcggagccatatattattggccgaaaattttgcaccgcatgcacaattgcggccaattccccgtgggttgccgggagttttgcctcagttgcggttagtgtcctcgaccaaaacccaaccgcatgcatttcatcacttttctcagactgcatcaatgctccggcatatgcagttgcggatgcgtcggtaaacaaataaaatggcagcttatagtccggcgctctaagacagggcgctttaagtaattgccttttcaagttttcaaaagcttctgtctcctgatcttcccatttaaactctatgttttcctgttttgtcaattgatttaagggataggctaattttgcaaaatcagggatgaattttctaaaaaatgacatcattcccaaaaatctcttcacttctttggcatttttcggcacaggaaaggcttcgattacttctcgattgttcagggatggactgtacccatcttttgtcaaaacatgccccaaataagtgcactgtgttttaaggaaactgcatttttccttttttacttttaatccgttttttcccaatttttcaaaaatattgttcaaagtgtccaagtgctgttcaactgtatttgtgtggacgagaatatcgtctatgtacacagtaacgtttggaattccatccaaaattttatccatgactctttgaaatatgcttggggcattttttagaccaaaaggcaacttaagcatttgataaagtccccatggtgttacaattccgcatttatatgagctctttttatccagcggaatttgccaaaaccccgaagccaaatctaaggttgtataccacctttttcccgcagctctgataatcgttttatccattctcggaattgggtacggatccgggatcgtaattttattcagcggtctaaaatctacacatgggcgtagctgaccattcgacttctttaccaacactatgctgtgtgcccagggagtgcaactttctttaattactcccgactccaacattttctcaatttgcactttcaattcactttcatatttttccggcactggataaggctttattttctctgggatttcagttgttgttaaaattggaggggcctcgtaggcacagtgtcctaagtcatattcatgacttgaaaacacatgtttatgtctctccaaacagcgttctaattcaaccttcatttgctctccgtcttcaattttccgattttcctcacaaaattcaattttaactcctttaactttttcacaagcaaaaatttgaccattttctttactaatcaaatttcctgtttgcaaatccaacaatagaggcatttggcggaatgtgtttcttcccacaattaaatcataactctgcgttccgccgatttccgcttcggtcacataaacaattgtctccacataacatccggctaattccaacaaaattttgctctgtcccaaaataggaacaatctttccacccactccgattactccagaaatttgggccatttccaattttgtgattcccaatctgattgcagttttcatactgcacaatgacacatgagctccagtgtctaacaagaaaataactcttttctcatttaccatcccaccaattttaaaatttgggccgcatgcctccttctcaacaatatttacttgtgccactccttcgtcttgcccattttctttaaaattcaccttttttccttgtgacatttggccattttccggggatggccacctttctgttaatggcatgatatttatcacttccctttctttttttaaaatgggcttaggaggtattgccaattcatttgaattattttttatttccggacggcttgcatttctctctcttggaattcttcgccttttccgaaaaatctttgtaatttgaccgattagtcctaagtactgaaaggcctgggcaattcgttgtgggaggaataattggattaaaatagttatcgtgacatagcagcaacagataaacacccacaattgatttaacgtaaaaagacctcctcttaagaaagcaaataatccgttggcaacaattgttgccgcaatttgatcagttcgttctgactgttcgtcccacgagtcgggctttgataaacgggtaatttcttgaacaatctttgctgcttcaattgtctcgttaaaattttccggtgaatataattcagtcaaattggccattactttattcttaaaaagctgaaccggaaattcaggaaaatcaattttcccatgccgtgtgagctgatggagagaatcagaggggatatgatttatatcaccatttaattggtcaaattgcaaaatattttcctttgttgccatatataaaaaacgatatttctggcaatccgtttcgctcgccctcgagcgaattatcatagttttggtgtccaaaaatccgtgtttttgtctcccatataatgtaaaagtaatggggagctgctcaaaacaatgccctttttgccagctaaaatgcatgtcacgttcaagtaatggaaaacacggctttatttccagggtctcttttgtcactaatcttgctgataaatagggatttgccaaataaaaacgtgccaaaagggtcgggtttgcatcagcgagtgcaattgtttgatccgccaaaaattgtaaacttgagcaaattttcctgattgtttcagcaaaaagacgctgcgtatttcgagaaattttgacgctgagggcagtcagttgcgctgctaattgagacgagtagaccaagccaacatctctttctcgtcgtcccatattactttccctatttcggtttacaaatctcgtcatattggtgtgacggtacggcgaatgcttggtccgaaattacaaattctgccccattacagtccgtttttctcgaggcatttaaaaatgttagggcgaaatctccataattggctgtccaaatcaatgtcgagtattctccgccccagcctccgactctgacataggcacattgctgggtttcatccggtttccatattagactagcctgtgggcatcggcatgcccctgactggtaaatgcatgctgtgcattcacttattggcgtaccaattccgggcattccatgcctggtaaatacgactgtttcataaacatagcaatttgacacatctgttgtgctccaaaataaaccagcaggccatgctctccatcccacctccaaagaattatttgtacttcttaatgttccattatttgttgcacttaagtctcctgctggcgagtgatcaagctctttcatttgatggcaagttgccgtcggaacatcaatgggatgggaggttatttcttcgtatttagtccaaaataagccaatcctccgggaaatactcgtttttacacatttacaaactgtggccaacgttttatactgtatggtgttttgccgaaagattgtgaattgcgctggagttggctcttctgttggcatccaagttggacaaaatggatcggtgggaatagaccaaagacttaatggtgcgtccggtaagcaaatcatgggaccggctgctgcattcattgccatattaggcgtaaataatgcaaaaatcgcaagaaacgccaataaaataggactagcaactcttgcagcccctaatcttcccccaaaatgtactcttctcccaggcgattgtgatgagttggcataatccctggggttatcatttggcgtcggcgttcctctgaaattcctttcatttcttggggccattcccctcacataacgcgaatttccttcgcccgtgccggtattccattgcctttctctttcataatagccgcctcctctttgcctcccgcggacattttgtctttcatcatttttctttgttctgcaatctcttaccacatgccctggccgcctacagtaataacatctccgtctttcatttcccattttattatttatcccctgatgactctgccgaattgtcaaagcctcgacctttgtggacaattcagcaacagaatcagcaaccgaaatttgatttgttcgccttgaacttaaaagcagctcaaaatgctgtgctagctcatatgcacttgaataattagttggccttccaggtttaacttcaaattgtaggtcgggggttaatctttccacaaattcttcaaaaagtcttttccttatcacgtcttcaccctctccggccagtgcagtccttattgcctcatttaatcgattggcgaactcgtaaactcgctctcccggcgcctgtttacagattgagagtgcctgacgggcaattgagcgtgtattctcattttcaaatttttgtcttaaataatttaatgcactagctaagttccggttgcggttccatcgattccaactcggcgcgggcttgtccaatcaaaagaattcttaaacgacttaatttctgcgcctcagtaagctgtggatagagcgaaagcatgtcttcgaattttgaggaccacctcgaaaatgaaatactcgggtttccgtcataactttccaacggggcaattccaccaagaaatgggtcagagatcattatttcacagttttctccggaatttggtgggtcctcattaagaaattgctcatgctcaaaggaatgtccattctcagcccataggttttcgtctgacacttcctccatttccagaaattcaactcgttttcgcaaaatatcaatgtcttctgtcattttcgccatttcacttttcattttctcaattattttgttaaatctgactttcgtaaacttttcaagacttttcagacttaaaccgaccgtatctattcttccctcaatttttatgaccttttcctccatctgaaaatggtccaattcttcacggtcttccaaatcagccattgattgttccaattttccaacacgtaagttctcattcgatttttggaacatcccgtttatctccgctaactcgtattccaatctccgaaattgccgacaaacagccgactcaaaaagtctcattcggtttagaagatttgcaaaatttccattttcttcagcggtgaagaaaactgggtcaaaatcggagccaatttcattttctccactttgtgaatttgaacaattttgattgctcattttgattcactttttggctttttttttttttgaaaattaaaaattagcacaacagctcggctggaaaacacacttgaccagctcaaaatttatttttgtatttggcacaacagcctggctggtagtacacaactagaccagctcacagagattgttttggtaatggcaccgagcctttacccctgctgaattttgttcagcgcctggtttaacccgtgcttctcctcgtcccgggtcgtggcaccaaaaattgttgtgtccccacgagtttcaggcaaatgcacttttctcagttctgacaacttttcctaatttgacccaattcaatctctttttttcgaccttttttcttttttttttgaggttttattaaagcaaagcaaaatcgtttaagagtaagaataagcaaaattggttatagcaaaattggttaagagtaagcaaagggagagtaagtaggaagggagaatggcagtaagaagaagtgttttccaaagcagaaagagagcttaaatacggcacaattttgggaggagccaagcgaagccaagcgggtgagaatagtctaggccacattacacaaagcggagagagagaatttttggagagagggatttggtaaggattgagagatggatgaataa

SEQ ID NO: 6223 - DNA, 1271 bp, Heterodera glycines
  misc_feature (207)..(207): n is a, c, g, or t
catcatttttattgttaaaattattgttgaatctatttttaacctgtttattttacatttttatgctgaaattgaaaaagttgtttttactgtgatttttcatttttctgtacttggggcccaatcgaccctggggcccaaacgaccctggggcccaaaaacgagggcccaaacgcgggggcccaaaaactggggcccaaacgcccnccactcatgttgaggttaatttttgaaattgaaaatttccaattttttggcattatatctgcattttttcgagccaaaaaaaaataaatttttcgtgtttttggcttttgcttcacatccgtcgtttcctgtgtttatatgagggcgaattgcaggccagggacgcgttgttggacttttgtcagcaacaggtgctaacaatggcaaaagaaattgcaacttttatgttagctgatcacaaaaaacagtaaacaactaaaggacaaaatcatttcataatattattgctcacaatccaaaaaatcaaaaccgaaggaagtcgaaaagattcgtcccattttcagcatggccgcacttctcttttctcctcctccaattgttcttccgttgcggctgcccttctcccctccacctcatcttcttcttcttcctctgctgctgctggtcccaatgctttgctccgcgacgcgcattttctggacagcggacgcaccggcgaatgcgcacagtgcgcaaatgcgctgctgcacgccgccaaaattgtgcaacgccagcgcaattgggagctgaaaattgttaaggtggtgagccaaaatggcaaattgacgccgatttttatgggaattttcaaagcgtttatttttgatgattttaataccaaacaagacgaaagatttaaaaacaattttattatttggacatttttgtagcattgtgccattattataaagtattaaagattaggacggtgggggcttgtaattccaatttttgccgactttttgaattttgttccccatttttgcctaacttaatgcctattatctgctttattggacatttaggtatttgctctgctcaaaaaacgttatttggagggcaaagaagaattggagggtcgccaacgccgaatggaattaatggcggaagaaaatggacagtacgtaaagcaattggagacagaaagggaacgactggtgaaggagggtcagtcagttttgacaaatatccatttttttccgatctcagaataatgaatgtttagaaaaaactgcatatttgac

SEQ ID NO: 6224 - DNA, 1740 bp, Heterodera glycines
  misc_feature (114)..(114): n is a, c, g, or t
gatgggaaatcagttgccattgcgtcaaatatccgattgaatcgatgagacagacgatgaattattcagcgccattgaaacggaaaagagaaatgagaggcgaaaacggagganaagccgaaggaaaagcaggaggagaagccgaaggatgttttagggacaaaaggcggagaaggcgaagacgacagagtaaaagtgaagggatattttacaaaagtgccaattgattcagtgggctgtccctgctttggttgtgctaattgcggttacgatcgctgcaatgagcagagagctgcgagtgaaagtgtaggaattgtgttgtattatgcaatttttttatttcatttcaaaaggtgccaatttcaatcgctcaaccgcaaaatgccattgtccctttgcctttgcagcagatttcgccgttaacttcgtacaaaattgctccacaacagctcagtggacttttagcagaaaatgattggtattcgaaacataaaacgccagaaaatggaccagagcaaacgcacgcaaaagcaggacaattttaccctttggggtaattaattagttaattaggcaattaataatgggaaatgttttcacaataattgcgtcggaaaagtttgacaaatgctgcgagtgcaaatgtcgatcaaatccaaccacaacattcacttgcccctgtttcttctgccgatgagccgacaatcaatcgacaacacgcggcgattgtccaccgaccgcacagcgattcgggatatgccaaaataccgcaattagcacgaaaatacccactcccagaatgttacacggacgagagcagtcagtcagccgcaaaaggacacaaaaattaattaaaaatcaattaaacaaccaaattatattattattattattattattactttataaaaaatggcttaaagaaatgcctttctttgttcatttaatacgaatttccattctctgtcaggttttatgtgctgtaatgcccaattggaagagaccattcaccgggcttttcagcatctcatcgacaccattcacaactttcataattgcaacattcagaaaatttcgagcaccgttcaggtgacgctaattgacttttgaattgaacactgttcagtcatttgccgagaaacagttcaacatttcattcgaagtggtcaccgggttgacagattatgcgtccaaaagtcacttttacagcaattacatttgcaaagtgcagagggacaatcggtaaaacttgacgaatatcgtaacaaagttaaatgaagcattttacagtaggaagttttaatgatcgattcagtgaccattagtcgaacagtgacttacaaattagttgtggcaaatttaaaagtgttcttgaggtaattgaattggtttttgttgagtgcagcgggaccgggaattttgggcaaaaccgggaccgggacctgagaagccgggaccgggacctcggttttttcgggacgtgaaccgggaccaaccgggaattttttaaaattttaaaaatttaaaaaaaattcaaattttaatttattcaagtgaaaatatcaaataattaaattttgatttttattttataaaatccaaataaaaattttcaaacaaattttcttcaattatttcaaacaattaatcaattttggactaaatgatcgaatattattagaaattcagatttacttttcacatcactttttttctgcgcgttttttcaaaaaaactttt

SEQ ID NO: 6225 - DNA, 2647 bp, Heterodera glycines
aaatcaaaaattgttcggagataatgctatttttggacttctctcgccatacctaagccgcaaaaaaaatatgtaaaaacataaaaatccgggccctagcgatcactgatctgcaacgcataaaactatagtgaacaaattttcacgaaaagatgataataagaccatatctgggacttagaacttgtatcaaattaatagattaattgttggttaatctctattacgactaacttcaatcgtttctcagcaaaatatgaatgtaaataaagaagaggaacgactggaaaagaaagtcaccaaatgggctattatgctaaccagtgaagacaaggtgagcatgggcattcctcagtatgggattttgggtaatacataatactgaaaaattgcggtaaaaaggtaaaacagaaacccataaataattagatggttttgcaaaatataagtcagattcgcaatttagcaattttttttactggatttatttcagagaaagttataacttggaatcgcaattctgcaatactaccgggcccattctgcaatataaccagatattcaaatcgtctccgccgccggggggaaatttgaaaatttgcgtgtaatttgttcacagattttcagcaaaaaaaaggctggtttttgggataataggctcaaattgtaaatggatttctttaaaaaatgataaaatatgtgtcaattaaaaagaagactatgaggaatcatattttctcaataggaaaccaatgagtatacaaaaaggaaattgaaaataaactccaattttcatcaataatttttcactcagacccccattcttaccagtgcttgtttttcccggttgccttgccgggaccgggacctgagcttttcaaaatccggaaccgggacctcgaaaaaccgggaattcccggcctggtcccggtcccgctgcactctagttttttgtatcgttaaagcccagcagaaatattaaaatctatgaacctttgggcttaattttagcacttcgggaaattctttgaaaagaattttctcaaatcagctgaatgaataatgatctttgatcgatttaatagtgtaaaaaacaattttagttatattttggcttatgcaacgccacgttgggaaattgaagaagtaaaagcccattttcaaactaattcttcttttgttgttatttcagaacggaagaaacacaaatcaacattttgtgctataattagggctatacattgtatttttgtgattggatcccggaaaatgcgtcagtaatacagtattttacgtaacaaatacatatataaaaattctttctgaatttttttcaataaaatttttgaaagaaaattaacccaaatccctataaattactactgtaaatgggttatatgttgtaagcttgtttctatatagtgtcacggtaaaaagtatttgagcaaaaaaaaattttttttaaatccgattttctcaaaaatcagtagtggcatatttgatgacgagaaaatcgatcatgacccaaacaacaccttttttggtgggacaaaagtaatggagcaaaacatttatgaacttgggatggtaggtctatgacctatacccacagaaaaacagttcatgaaaaattcgacaattcaaaaatgactgatttctaccgtattttaagggaaaatgatcaaaaatttatcatttttatggtactcaattttgacaccctctctttctctgctggtattagtcctagacccaccattccaaaagtaattcggtagagaattttgtgctctttattacagtcctattgaaatttccagaaaaacccaaccccctaggaatttttttcgaaaatttcccagatttcaagccatttttggctttttaggtcaccatgaaggagtgatctgaccaagttggtagaccttaagatttcaaatcatatcattaccccgcctcgtttcagagattctgtcgctgatgcattttccgttttttcatttctgcgcatatgataatactacatatgtgaagaaaaaggctcaaaaatttgttctgcgttacaattgttgttttggtgaaggtttttggtgcatataaatgcatattttgttgattttaccagaataaatgtatattcactgtttttgggttgaaatcgatctaagggtgggggacgttgatcagaagcgattaaaccggtttttgaaccgattcaaaccctaagaaaggtgcatttaatgcagggcttccatttgttcttatttctaagaaatgttctgattttggggtagcgaccagaaattgttctgatttcttaaatatattcataattttgatattttatggcagaatgtcactattttatcaagaaaatataagatttgaagcaaaatttggttatttttgacaaaaattgttagcaaatcgcattaaaaattacaattttttccctcgcggcgcttatcggcgccaccggacgctctggtccccaaaatttttggaagaagcgggccgcaaaaaagcgtttttaaaaacgaaaataaaagtcgtcgcttggcttttaaatctaaaaattggccttttttggtgaaaatctgtcaacaaatcagagcgaaattaacaaaaaaaatttccggcgggccta

SEQ ID NO: 6226 - DNA, 7548 bp, Heterodera glycines
  misc_feature (686)..(686): n is a, c, g, or t
  misc_feature (721)..(721): n is a, c, g, or t
  misc_feature (1397)..(1397): n is a, c, g, or t
  misc_feature (7426)..(7426): n is a, c, g, or t
  misc_feature (7477)..(7477): n is a, c, g, or t
  misc_feature (7498)..(7498): n is a, c, g, or t
attcaattacgattgtgccgtgggttcgcttgccattgctccctttgccagattaattgttttgattaattttagatatgcgagaattaataaggtagggaaacatttgaagaaaaaatagttaacatgaatgcgttagtgtggaggatgtgctagaagatgaggacatggccatgggaccgaatggggcattggtctattgcatggaatatttggccgacaatttggactggctccactcgcacctcaacgagggcgaagacgactactttctgttcgattgtccgggtccgtttttagagtttaatccctttataattggctgtaaaataagggccaaatggcggttgtttttaggtcaaattgagctgtacagccatctgccggtgatgtgtcaaattgtgcaggcgctgcgcgagtggaacttcaacgtgtgcagcacctttgtcatggacaccaccttctgcttggactcgaccaaattcatgtcagccactctcaccgcactgtcaacgaccgtttcgctgcaaacgccggcagtgaacgtgctcagcaaaatggacttactgaggccggaggaccgacggacagtcgaagaaattgtggacggagagctccaaaatgcaatggaaaaggtgtaaaatgaatgcaatgcaaagacacacaaataaattatatataattanagcaagggaaaagccaatgggaggaaaagcatcgncaattaacggacgcactctcgacagtaatcaacgactacagtatggtcagattcattccgttggagcttcaggatgagcaatcaattgaaggtggacgaatgaacgaagaataatggggaaaaccccttcgtccgttaattttagaaattctcttggccgttgacagtgcaattcaatatggagaagatgcggaagttaaggtcaaatatccggaggaaagggatcaagattttgaatgacaaatcgatggcagttgttgttgtgtttggacaaataaaaatgggtcaatttctttaatttacaattgtccatttggccggctgttcacagtccgagacgttgtcaggacagaaacggttgaaggttgtccgtgcgtcgtggccgagtatttcgcggtcctcgtgaatacggaaggaaaaggtggacaaatgagtgccgatgaaaaacctgtcatttatttacggatgtcacagaaaatggcatgggtaatttgccttgaatttgcgcaaatccactgaaatttttggggattaatgggttaattgtaaacacggaatgtgtccgacttggtcgattatcgaaatggccgctcccgacagttccatttgctcattttcatcagaaaattttaccattcggacattttgtttcgccaaaagattcgccaatgtttcngacttctgagggggtcgcgtcggtgctaaggaaaacgtcgctgatgtccaatttcgacgcattttgcgcaatcttagaaggggcattgttttttgctgacaatccaaagtgccatcgcttgctttcgacctgtgccgcggcgccttcaattgacggaatttcctcgcgatgggcccacacaaagtcggcccgtcgcaaatgagcgcacaaatagtcggacgtattggccaattggtcggcgcggaaagtgtcgccaatcgaacgaagtcttttggcgtatcgcattgatttccgcgccttccaaaagaaatggtcgccgaattggtcgtgcagaatcgtttcggcacggtcgaccatcaaagaacgacttaaaattgaggaggcaaattccgccgcacttttacacttcgccaacccctcggggaataattgtgcaattgcttctgcgagtgtgctcgactgtccctggatggacagacattgcaaatccttcgcatggaaatggtcagcgtaatcgaagaaatggccgttcctgtgatttccttttttgtttatccttggcaaatgtgtcactttctcttcgttttcccaccatttgtcgccccttttagcgtaatatttgtccgcctcaatgcacgggcgaatgtcgtatttgagagtgtattcgccgccttcggcccatccctccgcgtaatgctgcaaatacaaaacagtgctgacggaagtgccctgagctaatgttgaaaatgactcccggggaggcggtccttttgtccaccttcgaggaactcgtcgaactctatgaccggcacaaagtccgacagactgtccaagtcgaacagttcagaccaacggattttcgtctgccgcggctttgtgcgccaatgccaacagtttccccaaggcggcagcacaagaacaaagtcgaagccttccaatttaattgtcgaattcattccctccacttcattcagtttcacctttctctctgagctgccgtactgtgttggccactctcaaatagacatcccttcgcaaattgaagccctcgccggggttctgtcaaaaatgaacactttgatcagtgttagtctcatattagatttaacccaattctaatatattaattaacaaaagaatcgaaaaattaaccacatcgtagagcaaaaaacgccgttccgcaaaactgaatttttcaccaccggctctaaattgtgccaaagtgacaaaattttcatggttgttgggaaatacgaagtcgataaagagcagaaataccgaaaagatttttaattgggacgaagaaatatccatcgaagaaacggacgaaaaccgaagaaaaatgttgaaggaaattcaaagattcggattctttaaaccatttctgttttattgaagaaataaaaattaaagcctttaatataaaacaatttgagcatatttgacaattggaatttgcttacaaaaaaggaaaaaggctgtgaaatataaaaataaatttaaagtgtcgaaagaaaattggtcctttgccgtctttttgcttttcaccggttttattatgccacttttggacattggctgtccattccctgttcgtcaacaattttcggcaaacgcaccgcagcagcacaaataggcaaaacattccatcagatcggacgggtcgcagaaagcgcagcaaaggaaacagtcagaacacccgctgagatctttgaagggaaattcctttttaattttatgtaaaaacattttcctataattttcctgtaaatttcacttttattttatgccactcaccgccccctttcgttggcgaattctctttcaattctccgctcggagtttcgtttgtcttcggttgtgcggtgattactgcttttgtgtggtccaatcctccgactgtttttccgaagtcatttgctgcgctgttgcttaaccgctgtcctttttcctgctgctctccagaaatgccaggcaaatccatcagaaaataatggcttacaacccagtttaaatctttggttttaaaatttaactgaattaaatcaacctaggtaattttcgtttgttgactttggctgtctcacgaaaaaacagatgaaactcaaaaaaattcaaatacccgccatttggcaaaatgtttgttttattttcgaaacaccgaaattccttgaaagtgaaagagttttttgtgaattttaacgctgtttttgaaaaaatgagtaattttgacgcctttcagatcggttttcgaagtttctgtccatgtgggaacagaatgaactgcaacataacttctcaggttttattttgcttataataaatcaaagtgttgttacttcttgcattttttggatttttaaatcccgtaaaatgcaaaagtaacaaatgactcgtgttttatgtttgtaaatgccgtcgtccgaataaggacgggaacagggacacgcaaatgcaaacattgcgtaaagggtaaacccaaacggctgcgagttgcgtccgaaagcgtcccccaatgaggaaaagtgttcatttgattaacgaattccaaaaaatcaaccaaatctcagaagcactgaactccaacaatgtcaagacccattctcgacgaattaactagggcgctttttgcgcatctccgagggggaaatgcgtgctttgatgaagtaagccaaaagggttggagaaaccctccgacccaacggacggtcggaccgtccggggcatttcatgacggatttgctgggcgagtgatgtcggtgtgggcatgcgaaacgaactgaaaatgcacttttgcaggaaaacgaactcattgaactcttccgacggtgtccccgctgctcgcgcagtcttcgcccgatcattttggacaaatttaccgacgaaaaagatggccaacagtacgagcgaatgtggtggacatgtccgggcatagagcagaaggtaggcatatccatttttgaaattagcttttatcattttgtccactatttgtttctttaggagtgtttcttccccctggacatccccaaggaggtgttctggactcgtcgctccatggatcagtcccttcgtggcattctccctttgcccaacctccatttgttgcccctctctttgcgcgccctttaccacaaactcttcaaaagcaaggtcaacattgagaaaattgtgcgcatttccgccttcgttccgtcggatggacagaagagtgccgtacaacaagcaaattttggtgccgaagaacagccaaaacggcaagaaagtgctcaaattgtgcaggtaaaatctggaaatttctccaatcatttccattttccgaatggtttcccttttcagcgttccgtcggttctgtcggcccttcgcttccgagcactttcccgccacttcctgcctcttctgttcgacatttgccaacccctccctcagttcgttctcacaatcagtgcgcctccctttgtgacggctttccatcgtcgtcaaagcgttgcgaccaacgaacggtgcattcgtagtaagaaattcatccaataatttgagttgattttcccgtttagcctcaaagaaacaatgcacaatcgcctctgttctgccgaaaaagcatccgttaaacgcgacggtcaccgaaaaagcgtcgatttgacttcgaatgcgagtacggcgctggtaaagtgtcattattttctcgttttaatttgcctatttccccagaattctcacatccttctgaatggcaataacgatccgaaatgggtggtcatggtcaattctctcgactcattggacccggagactcgcaaaaagacgagtgttccccgttactattcacagcagcagcacacgcgactgcaagggatgttcagaagcgcaacactcagtccgaacggaaggggagagttggaaaagacagcacacgacggccgttgcccgcgttatttattcgcacgaccaccgctaaatggggaggaaacgacgaagaataaaaagaaaagggtagaagaaaagccaaaagggaaggagaaacaatcgaagaaagaggcgaaaacggacgaaaagggaaaaaacaaaggcaaagacgaattggacgtattcgccgcattgggcacactgcaaaagtcactggtgaccagagacttgatgagccgattctgtggacaacaggtgagagaaaaagagcggaattggcatttgttgctcattttatcgataaatgccatcaaattttgccatttaagcgttcgtcattggtggcgccctccgaagaagcgattgtcagtcattcgacaaaagcggacaaatctatggacaatggctaccccctccgcggcacaaattcctttttgccacaatcgccgtccgttgggccacggtcgactgcaacgccattaacaaattcgtcgggcagcagcgaaagcgacagctcatcgttgggccggtttcgaagaggtcgtcgacaaaaaatacaacttttgttcagtttcattagtcttttaggactgtccattggcccggcatttcccggtatttctgattccgtcgaagacccctcgctggccgagaaaattacacggaattacgaaagtatcttcctaaagacattggagcaggtgaacatcactcgccgttgctctgagacaccgtcggcatcctctccggtaattgcaattaaaatccctcccccattaattgagtgtgcgaataattactaattaatcctaattcctgtaactgtttgcccattttccccttcagctccgtcctcccatttcgccccaatttgtgtcccacgaggcgctcgttgcggaggaaggcaccctcggcgggattccgcacgacttccacttcccttctcaacccgtgccgtcttttcctccgtccgttcgtccgtccaaccaattaacgcccattaattacgccgatggggagaatttgagcacgcgcttcgcgcacacacaaatggaagtgaccgaactaagccaacagcagcaacagatgcccggttttgcattggaggaaatgacggattacgacacttatttggggttcggtctcgaggaggagggcgacccggcgaatttgcacatgacgccgatgatgcccgcgggggaggcggaagacgaaagggactttctccggaaccaattgggcatgctcccctgaggggacggactgtctttttttttgtttgactgtcgcccgtcgttttctatctttttaatcttgtcacaaattttgtttgtttaaccgataattaaatagaaagcataaaatatgcaaaaaatgattctgcgcattttctccatgagtatcagtcgcattttcaatttgtttttggccgccattgcactcggagcatttcccatttctttgggaagagaaaaaaaattgtttaaatttttaagttctttggaacaatttattttattagaattatatccgaacgcaattttcgagtccctcccattattaggacagttattctcaaccacaaattgccggtgattggcacttttggctgtctttttcggtgcccttttccctacctgccaatgttcgtccctccgttggcatttgcttagcgatggcatttcttttctctcctccgttgtcaaatgcgcttttttggtagggccgccgaggcaaaggccgctcaaacggtgtacaaaatggcccaactgacaaatgaacaatgggagggaaatgccattggcaaaagcagcggcggatgagtcaccgccactcacccggcggtcgaagtgccaccattcaatttctgagcggtttcaattaggctttacctccgcttttcctcccttttccgcccttaccgtgtccgccgcactctctcagtgcgactcgcctaaaaagggaccacttctgtctgatcactttgccctatgtttgtttctctctcaattgtcaccattcatctcctccgttcgccgtctctttctgtgcccccaggcatcggttttcgtcgcttctcagccgccaccctccgccgccctttgccttcttttccctgctngataccacaattgccacaggtcgaatcccaacgagcacaattcatcgaaangtggtgccgctgggccatcgnaaggctggaagaggggcgactgagcagacaaaggcgcgaagacgggtgac

SEQ ID NO: 6227 - DNA, 1152 bp, Heterodera glycines
  misc_feature (38)..(38): n is a, c, g, or t
atccggtgttgcagaaaatgttcgggccacacgtgctncaggtactgttcgatgttgatgaatgggtgtttttgttgagttgtttctgtccctttacccatgcgaacggacgacagcccaaccgacggcgcaattccacgcgttcactgaccttcactttgtcattattttaattagtgccattttgctaattgccccgctttcactgacatcctgcgagttgacagccatccgtgcttctgttcgggaaattagtgcttttttgggggattttgcgacttacggggcgccactttatagaagaaatgcctgcaatggtttgggtggttttggccttccttttggctcgctttacctccattcgtccatccaaacttcactcagtcgtgccaaattcgcatttaaaactctgttggacgaactgccggagggaaagtcatgtggcgacgccttgcggaacacgtggccaacgtgggagcatgggacgatctctactcgaccgccgcactgccaaacctttggagcgaaaagcacgcaaaaatgccgtggcattcattccccacaaaacggacccgtaaagacatttcgatgttttcaccgccccaaatgtccatgcccggatcgtaagtgcccaactgctcgaaataggcccggtcgatgctgaacagaccgccagccattgtgggcgaactgcgcgagcagtgcagtggcggagtaattaaggtgctaatgccatgctcacctgattggcgctgttgggacggcactccgtgcgcgcgcaatgtccaatggcacggaatacctttggcaccggggggggggggggagggaattccatccgattggccatcaaagtgccatttctgaactttgtcacttaccaacggaattgcaagttccaattgaatccgcctctgaacagttcgatgcccttctgaagttccgttctcttcgttctttggtttgatcagttcccacctgataggcaaaggttcggtcgttgatcacgtcaatgattggacatgccaccgcccttttctcctcgccaattcgcgccaacaaaggctccaaccatccaacggtgcactgacagaacagagaatggcattccaaggcaatgctttcaaacttaaatacctcaccaatggctat

SEQ ID NO: 6228 - DNA, 1328 bp, Heterodera glycines
  misc_feature (90)..(90): n is a, c, g, or t
  misc_feature (161)..(161): n is a, c, g, or t
tcctattaacaattcttttcgctcgcccgcttcacgacctcgcacccttttttggcattttcttattgtcagacatttcttctcaatatnttaatgacaacaattttaaaaatttatttggcaaacgttaataccaaaataagtgtaaacatataaccatntacaaataaaatcacaaatcaaattcaaagtcgatctttttcatattacaaagtgaaaacaaattaaaaatcctttgcttcttcaattttttactaaacaaaatcaaaaaaacacgtctctttaactatcaaattcttttctctttaacaataacaaattcttttatagaattaacaaattcaataatgaaaaacgcgggaaaaaacgattaaataatgtagaaaagtaaaagcaaaaactttctcacaaacaaaaacgggaatcagaacgctcgttttcctctttctatttattaaatatttgatataataaaagatgggatacaaataaggaagggatgcgagacaaattttctattatctctcgctttcatttcttttctcttatttcttttacttttccacttactctctctttttcctcactccctccctcttccacacacacgcacgcctccaacagactgctgctgcacaacagcacgcgcctgttcactgtctacccctcccacccgccgctgcccgcatcaacagacagtcagacagtgcactatctccctcctccctctacctaaccacaacagcctgggaagagaaatctttttgctttaactatttcttttgcttttttcttttcctatactatttcttttaccttcttctttttcaaaactatttcttttcatctctttttcttttcaatctctcctcacagcaaatacaaaacgccacattcaaaccatgtcacaaacagacaaacactcaactttattatataggattgtgtattctttaagtttgtttaagcaaatattgaatatttttggaattttagtaaattaatttttgtcagtttttagtccatattttggttaatatttggccatttctgagctttttagtccatataatttcgagccctactgatggcactatttagtcatttttaattttattatttgtgaatggcctgctactaatacaccatggatattcgatctgaccagcaccggtatcctttttgcattgtttggacgccaatccccctcatcagttggttatttccctttattggacacattggtattgcaactagcaaaggtataaacaattctttcctttttgcaatattacatttaaggctgcagtttgtgatattgagtatat

SEQ ID NO: 6229 - DNA, 2200 bp, Heterodera glycines
taagcagcgtgaaatttcccttcggaatctgcaaattcctaccattgaaaatctcggagttaccagggtaagacagaaatgctgttgttatatataaagtttaattaataggatcaatttgatgtcattgatttgactgacaataatattcgaaaattggacaatttgccgagattgaaacgtttggaaactctgcttttgcacaacaatcgtgtcgactttatttcaaaggaaatcggagatcaattgacgaaattgtccacccttgtgttgactaacaataacctggcacaacttggtgatattgacgttttggcctcctgccctcgtttggaatatttgaggtgccatttttcgtatgtttgttaattattcaatttttcagtctccaagggaaccctttgacccatttgcccaaatatcgtcagtacgtcatttataaactgaagaatgttcgggtcctcgattataaacgcattcgccttgcggtcagtcattttttggcggggagcgatgtttttcgtttgtttaatcggacagatactacacttaatccccccttaggaacgccaagcagcgaagaaactctttaaaggtgaaagcggtgcgcggctgaagagcgaattggtaaagcgttcgcagcaaatttcggaaggaggcgaagagacggaacagccgccgaaaaagcgcgcgacggaagagcagaaaaaaatcagagtgagttgccaatgagcacagcagcagtacacctagcaaagtgacaagaaaagtaaagtaatattggccatgtcaggaactgatctccggtgctaaaacacttgtggacgttgaacgagtccaacaaatactccaaagtggcgaagccaacgggacagaggagcagcagaacggccaaaatgggacagacgtacacatggaggagcagtagtgattaagagaggacaactttgaccgattgataatgggatttgcttaatttgataaattttgttggaatttttaataactaagttaaaagttaagccgtctttttctatttgtcgtataaatttcttcttaacttattatttaatgaatttataagataaatggatgaacttgttcatttcgaccccagcagtgtgagttttactatttgatttcagtacacttatccatgatagcataactggaaaaagatattcacagggtgtacaaggcaccaacgtttttgtccatttttcaataatttttaaatgagcatccctttctctgtagatttctctcttttcggcaaatgcgttgtccgttgatgatcagagcagcagcactattgccgaagtctgttgcccttctctttctttcatttggtgtgttctttttcaggaaaggcctctttcgtccgagtcacaattagtcgcccaaaagtcaattggcacagatcagacggaacatggcgaaacggacggaaggcgagtgacagagacacctttagggggtgggcgaagatttcatgctttcatcttcctcccccccccccaattcgcctccctattttggcccctttttgttagtgcgcgggagaaggtcactctatttttaatatgtggggaagcccttggcaaaacgaattcgtttagattttccacttaccatcgaagaaaaaacatggaagtggtgcacagacggaatttgatcgaacgtttggataaactgaaggcatcgcacgaagccttcttcacagttccgcaggtcattcggagagactcgattttttgaattgaattttttaagcttaaagccgtctcaaataatcaattgtctctttttctgcgtcggctgctaaagtcagcggacatcaaacagcacatttcaacagaacttttggaaaggattcttttgattgaagaatcgaatgaaaatgcatcagacacagcaaaaatggcattccgaacggagggcgaattgggccaatttgcagatcgactgacatacattgggaagtccgagacacatctgaatttaaatcaacaaactgacgaggaggacgaactaacggacgaagtcagtccatccccaaaaaatacgagtgaaaaaagaaaagtgggagggggaaagtcaaacgagttttggtattataacattgtactttttctattaaggaagttacagaattcgaggatgacgacaacatttttgggccatcggatgagtttacgtt

SEQ ID NO: 6230 - DNA, 1438 bp, Heterodera glycines
gaaaaaggagttaaaattgagggggggggggggggttacgacgaagaagaagaaatgaccaacgaaattgatcaagaaaggtgtttaactgggtaaaatcgagatggcggaaggacagtgcgttttcggagcagccaatgcaaaacgacgaccaattgggggaggggcagcggccaacggagaatagtgcgcggtgccgagcatttctcagtgggccacgacgtgccgtcatacggcgcgattttgacaggtgaacgaagcgatttgatcattgaattgaacagtttttgacatttaacgaattttagttcgctgaaaaaacagcgcaaaagtcggcccataataccaaacaaacggtgcagcacggaacagtacgccttcgcggactgttcgattcactcggaattgtcacttccttccggtgcgctcatttgtttgattattaattaatagggctgtttatataatacatattttttcctggattctccatgctctgaataataggaaaaacatttcttttttgtgtttgcgaacaaaagtgtggggacatttatttacatatatttacatatttctattttctaattatttcggaatttgctacatattttcaactttttcctacatttttgcactttttgaggattttaaattcttatcaaatgccccaagatttcacaaatttttcgtatataccctacacatcgaaaatttttgagaaatttgtagaattgcttgttaaaaattaaaaataattttttattcaaaaaaggagatatcaaaaattaatttgtaaaatataaaaagggatctaagcctatttaattttatggcattttgtgcctatttcaccgtttacaggatttttttccaaaaatataaatataattcagccgtaccattggatgctcaaattatgaaatatttgcatgtcgccgatttcatcccagtggaaattgaaatgagaaggttctaattatatatgaaaacgcccttttaagaatcatgcaaaaacagagcgattgattctctaaacctgacaaacgcttcggtttctgcccaattcttatttttccctcttttaggtttaaaacctaccaaacggcgttgaaaagtcaagaacaactaaatgagctgaagcatgcattttacaatttggaggaggactttcatgaagacgacgacagatttggcactaccgaagctaagggcatcaaaatttcgctgccattccgtaaaatgttaaagaagcgaagtgttattgtggaccaaaataccgagcaaactgacaccgaaagcgacccggaagattatgaatatgatgccgacccatcctcgccacgggaaatgtgcaaattcaaacgacgacggatgacatactcttcaggaacagcgaagccacccaaagtgactaaatcgaaataaacgtttaaaa

SEQ ID NO: 6231 - DNA, 1688 bp, Heterodera glycines
  misc_feature (66)..(66): n is a, c, g, or t
  misc_feature (86)..(86): n is a, c, g, or t
agtgattaggaacgagtgtgtgatcaaagagagacagagagagatcggtgtgagtgagtgatacangagagagtgaatgatcatanaatgatcagagtaagagttagagatcagatagtgattgggacttaataaatgatcaaagagaaaaaataagtgatcacaagttagtgtgttgtgtatgagtgatcgtgttaatgtgcttatgcgtgcacgtggatgtgtgtatgcgcatttacatttagatgtgtgcatgcgtgcgtgcgtgcgtgggtatgtgtgtgcgtgcgtgtgtgcatgcgtgagtgcgtggtgttgtgaaaattttggtgcaaagtgcatttgatgtgcctgaaagtgtaggtgcaggtggttgttaagtgcaaatgtgtgcgtgttttcggtgcagggcagacacaaaattaggtgaaaatgtgtgttatatgcaagcgttttgggtctaggcaggtatgtgtgggtgtgtcaggtacaggtgcaagtgtgtttctttgcaactgcaggtgcaaatacaaatttgatgcaaatgcatgtggttgtgtgcgtgctatggcgcaggtaggtgtgtgtgggtctcaggtgcaggtgcaagtgtgtttgtttgcaggttcatgcgttcagcgtatgtgcaaatgctgtgcgtgtgagtgtatttgtgcaatgtgtgagtgtctgcatgtgtaggtgcagatacgtaaggtgaaaatgcatatgtgtgagtgtatttttggtgcaggcatgtgtgtgtggtcaaattcaggtgcaagtgtgtttgtttgcatgtgcatgcgttccgtgtacgtacaaatgctgtgtgtgtgagtgtatttgtgcaatgtatgagtgtctacatacatatgcaggtgtagatatgtacggtgaaaatgcatatgtgtgcatgcgtttttgtgcaggcatgtgtgtatggtcaaatgcaggtgcaagtgtttgtttgcatgtgcatgcgttctgtgtacgtacatgcgtgcgttctcatgtggtgttgtgcaaagttaatgcaaagacaagtgcgatgtgtgtgcctggaagtataagtgtaggtgcatgtcaggtgcaaatgtgtgtatgtcagatacaggtgcaagtgtgtttgtttgcaggtgcaggtacaattgttgttttggtatgtaattgtaggtattcatgtccaaaagataggtaccaaaaagcaaaatacacataaaaataaggagtttcatatattttttgcaaaaaaatgaaaatatgttaaaaagtagaaatgaatatataaaacaaaaatgatcaaaaatgcaaaaataaaatgaataaaaataaaattttaacaaaaatttattataatttaaaatctccggcaagtttcgctgggattcaaaaaattttaaatgaggccaaaaagattgacccggaaattacgaccgatgacgtaaataaattcctagaaaaacagagaacatacacgattcacaaacccataagaaaaaaattcccgagactaaagacgataccgagcggcttccataccgattggcagtgcgatttgtgcatatttgaccagttgaaaaagcataacgacggttacaaatatctgttggtatgcatcgacgtgctgagtcctaatgatcttcaatgtaccggccaagtcaaagaaagagttacgacatgattga

SEQ ID NO: 6232 - DNA, 3432 bp, Heterodera glycines
cataaaaataaggagtttcatatattttttttgcgaaaaaaatgaaaatattgtaaaaagtagaaatgaatatataaaacaaaaatgatcaaaaatgaaaaaataaaatgaataaaaataaaattttaacaaaactttattataatttaaaatctccggcaagttttgcggggattcaaaaaattttaaacgaagcgaaaaagattgacccagacataacgaccgatgacgtaaataaattcctagaaaaacagagaacttacacgattcacaagccaatcaggaaaagattccctagactaaagacaataccgagtggcttccacaccgattggcagtgtgatttatgcatatttgatcaattgaaaaaacataacgacggttacaagtatttattggtctgcatcgacgtgctgagtcgaatgatctttagtgcaccagccaagtcaaagaagagtgaggacattatcgaggcttttgatcgggttttcgaaaagtcgaaaattatcccgatgaagatatatagtgacagcggactcgaatttcaggcgggaaaaatgaaaaattattttgagggaaaattcatcatcaaaaatgtaatgtatagccccgacctccacgccggcgttgttgaaagggcaaatcgaacaataaaagagcgcttgtacagatactttacaaaaatggacactctacgatgggtcgatgtaatagataaaataattacaaacattaacaacagtgtaaataggacactggggatcaagccaacttcaattacttttgaaaatgcaggaattatttgggaaagattatttggaaatatagaaactcaaaaaaataataaattcaaaattggtgatttggtccgaattacaaaagaaaagggtatatttgcaaagggttatcttccgaattttacggaagaaatttttaaaatttataaaataattaaatcagacccaatcgcttatagaattgaagatttaaatggagataacattaagggaatattttatgatgccgagttggtaagagtttcgaaaaatcaaataaataaaatataaaagaactttgacaaaagcaaaaaataaataatgaataaaataattttcttcgtagtttttggtttggcaatcggccaaataaatagtgattgttgttgcctatctaatgaagagaaacaacaattaaattctgctagaaaaactattgaaaaatgttttcgggatacattccgattaaatactgaagcccgagattttgctgctgcttctcatagggcaattacggaagcagaaaaaattaaagttcgtcatcctgaggcaccgggtatgaaaacgtggttcggtaggttattagaaggggtgagaaaagtacaaggaatttccgaaaaaattaacgaagaaaggcagaaaataggccacattagaaaagaaatggataagtgtttggaccgaaaagatgttttaatgtgtcgtgaattggcagacgaagcgaagggagcattagaaattgttaagcagtatagacaggacgtcggtactgcgtaccgtaacgcctatactcaatctgacctcgggattggggaattggccgataaagtaaagaaaacaatgaaggaatatttatcccgccccggaccttccccaagaccaacatttaaagaccaatttatatctgattaatgtataaaagagaatggaaagataataataaatttttaaaaatgattcaaagaacagaaaaaggaacagcaattttgttggaagcgctcaaaaaagaggctgaaagggcatggaaggaagtttcggtattggcagaggaagccgatgattttgccaaatcttcacatggagcccttaatcgggcaattaaatctcgagaaaaggccccctatgccccaggggttcgagaatggttcgtaaaaatgtcagattgtatctgggaaatttacaccattctggataaaattaatgcagagtctgaaagggttgagaccatgtggtttgagattgaacgttctaaagatttcgatcagaccacaaaacttgaggagaaagtatttaagagtttaaacgaaaccaagaagttgcatttcgagtcccgtcggattcatactaaaatattggagcaagaaagcagaattcagtctatagtgttgggatttattgagcttcacgagtaaaatggaggcaattcagtataattgtcacgtaattaacaaatttgggatcaaaaaaacatattacaaagtttattttttccggtacatctgattatgaatttaaacaatctctagaaaaaatattagaaaatgcatatataaaagaatcaggaatttttaaaacaattctaaaactacaatattctaattttctagtagtcttgccactacgattatcacaggaaaatacaattgacgttcttttagagcagcctatattttcacactttttaccgttggatgataccgtaatttttgaaataacaattgttaattttaataatgacaacaatagaccaagaaattaattttataaagacacaagtcgaaaaggcttggaaaaggggtagaaaattagttagagaagcagataacttggtatcttatgcctatgagctttcgaaaatagctgagaattatattacagaaaatgacccacgaaataatttattattcgaagatttttgaaacggacgagaaagacttggattctttttcagaaaatctcacaagaatataaaaataccgcctttgcaatgagcggatttgagaattgcctaaatacaaaaaatttgatgatttgccaacgagcagagaaaattttgaaaaaaagccaagaattttttgatagctatcaaaatcaactcgcgaatgttagaattgacttagaaaaattaattcaaaaaatacctgagcctaaacaagtagagcgagaaatattctttacaccctaccgtaggagacagtccaaaattaataagtcttatgaaatatattatacaccctattatacaacgacaattaaatgaaatattttacagtccatttaggatggattaaaatttaaaaaatcttaattccttaaaaaactctaaataaagtaaatttgaaatttagtagcacaaatggttgtaaattacgtgctaatacttattattttaaatatatcattattcgtcaaattaaaaaattaaagtaaaataataactgcaaaaatgtgttccaaacacaacaatctttcaaatattcaatctaattaaactatttaaacaattatttcgaattattgttattttctcttttcttataagattttataaattcaatttttttatatttattatattccttaatttttaattatttttcattacttttgattctgtccctaaatttcaatttttttaaattaaatatttccaatc

SEQ ID NO: 6233 - DNA, 1711 bp, Heterodera glycines
tgcagctgatgccgtcggaaaaagctcacgattttttggggaaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcttactatcggccgaccaaagacaaaaggacaaaaaggcttctcacatccgactcattcttgccactgatgcacacaattgttgttggctgatttggcacctttaggaaatggttcggattataaaaatggacaaaaaggaaaaagaaatgccaaacagggccaaaagatgaacactgaccagccacagctctgccgacaattctccgccatccattggcgtcttcgcgaacattcgccggcggaccgccaatagccgcaggaaatgtgccgatcagtgcatccttaagacgaaacaaaatgaaagcttcacaaattcggtccgacctttgtgcgccgtttgcgcttcgcattgatggcacgctctgcggcaatatctgtgcataaatgccgggttggccgagcattcgctgagttttgcccatgccgaacagcacgggtcgtcgttgaaacagtcgttgctgtggccaattattgctactgattgtgagtttgtgccattctctgctccctttgccattgtcgtcgtcgcttctgtcgaattgaacgccttttgcgcgaaatgccaatcatttcgattaattcgccaatttcaaaattgcctcgactcgccgcgtttgtatctgaggcatcgaaccaatcgcattttggagaagttcggcaaacgattcgccgttgctgtgctgaagggacatcgcctgtggaggctgaaaagcaggagtcaaagtgatcgaaattatcactaatcaatgggatacccttttcgacaattgaatttggcgggcgacgcaacgccaattttggcactcgccctcccagcagcagtcgatcccctcaaatccttgacaatttccgccgattcttatctgggaaaaattatcattacaaacattaattatttcgagagtaatgcccttaatgacattaatttgttgtgtcctttccacctttgacacgcaatgcggagtttcggcgtcccttcggtcgcagaataaaaacggagaaccgcagtcatcctaaaagaaatgttgagaaaaatgcaaaggaaggaaatgccaaggaaaagttgaggaaatgccaaggaattgccgaagtaaatgttggggaaagttaggaaaatgccaagagaaatgtctggaaaaatgccgatccaaatgcaatcacttcaaaactgcaacttgggcgtgctgagaatctgaacaaattgtccgtgtaagcgttggacaaacctaaaaaaggacaaaatgtccagcatttatctaaccatttttggatttaaataattctacgattccaattttggcactgaccatctttgttggtcaaatcgaacggacgcatttgtgcgttggcgaagtgatgctgattggagcactcagaaaagtcgggcggaaaagcct

SEQ ID NO: 6234 - DNA, 3809 bp, Heterodera glycines
aaaaaaaattttttttaaattcaaaatgcaaaattatatctctccctagtgaaaatttctaggtaaagtgataattgttaattcatacaaaatactttgataattaattttttatatcagcaaatgcttgtttatttatagagttgcgtgcactataaaattatatttgtttttccaaggatatatttcttttaaattattttgttaagttttattcctgtacatatgttttttattagtttctttaaattttttaaatttaaagctataatgtaatgatttaatttgtccaagcataaacattttccaataaaaacaaaacttaataaagttaaagctcaaattcactttttggttaaatatatggtatctcgtttaattactttcaaaactccagtattcgaaacatacaatttaataaaatttgatacattatttttaatttttatcttttaattagctcgttttctctaacatgcttttaagagtattatcatatttataacaattttaatattattttattaaatggttcaggaattgtaattgactcattccatttattctcgttcaaagcttccattcgattgttgaagcttatagtctaagatattttaaatatatattttagtatgttttttaattttcaattattttctttacaattttgaattctaattattaatgaatggacactctgatttaaaatactgtttttaatgaaagatttattaattaattattttttgttgcttttcaattttcactaatggctgacgcaaagccagtgtattgcaggcctcgtccggtaccatacaacaccaagttggttgttgacgctgaattggaccgacttttggctgcaaatgtcttccgtcctgttgaccacactcggtgggcagcaccaatcgtggtcgtcaaaaaggctactggttcggcacgtgtgtgtgctgacttttcaactggtcttaataatgttttgctgtcaaatcagcacccgttgccagtgcctgaagacatttttgcgacactaaacggaggacaatttttctctcagatcgatttccgggatgcgtatcatcaaattgaattagaagagggatcaaaagagttgtgtacgatcgcaacgcaccgtggtaattttgagtaccattggttgccattcggagtgaagtcagctcctggctttttcaatccattatggattcgatgttggcagattgtccatttgccattgcttatttggatgatgtgattgttgtgagccggactcggaaagagcattggacacatttaatggaagtcttcaaaagaattgacaattaattttgtttaaacaataagtaattatttaaaaattaattattataaaaataagcccatagaactataaataattaatgcgtttcacaggaaagataataaagttttttgatattttgcagaataatagcgaacttatagtgctatgaactatttaagcaaggttatgataattttttatattacaatttagatataatgtattttcataccatgtatatttttatttaaatttgattttattgcatctttttaacatttttctattaaaaatttatgaaaataaaaatgaaattaaaaaaaaaattaatttctaagataactcaaatatgaaaaaacattaaaagaaattctattattaatttattttttaatgtttcgaggccaaaataagaagtaaatatattgtttcctatttattttcgataaatatttacattcatttttattaaatatgttcagttacaaaattatttttatttaatatgcacagaaaaaattaaattatattcagaaaatatttttcgatgaattaaacagattttattcgtcttaactcctatttttgtaaccatatttcgaaaaatgaagattgacgtctgctttaaaattttgatgaaataattctacgacagagctatagtttgtttattatcgttttttaattgttacttagttctatattttctaatatattcttgatttgactgcattgagttacgtagttgattgaagaccttttaacaatttttttataattaatattagttacaaattattcttttttcaaataggtggataaattttttatttaaaaatgaaattttataattctttatcttcttgagcagccaagtacaagttctttcacgaaatataatttgcttcacacttgacccttggatatgtttattcatcagtatttattatgtaattttcaaaaaaaaatcttttcaaatatatctattgcttttcccgctacatttataaaataaaaattaagctaattgcagttatgttttataacaaattttactaactggaatttaataataaatataatttttatttaataattataaactttcattaaaaaaaatgaaaattgcgctcgataaattataaaattttattgtatgaaatttaaaatacaaataattagggatgcgatttttaggccttctccgtaatgggaattacaaaagtaaaatagtcacaaatgtaaaggataatcagattaatttaatattcataaatattattttaatccgtattttaaaaattaattttatttaatataaatattaatttaaaaatttattcattatatgcggaataaataacaattaattacgacattttacctttttttaaaatataaaaataaattaaataaaaaaacaaaaaaaatgtaaagtttacaaagtgtaaattacattgacattcctaaaaagacaattcattgatggctgtaaaaactggagcagctcaaagtctcaatgtattatataaattttacgtgaaatacaaaattaagaatttattttaagaatttgatattaaataatttaattaactattgaacaataaaaatatacaaaaataaatgaaattgatttttttaatataaaattcatcaggaattataaaatgatcaaatacatattatgggactcagttttttttggataacaaaaaaaacctatttgttaacacaaattatggacaaaaaaaaatttttttaaattcaaaatgcaaaattatattattaaaattgaaaatttctaggtaaagtgataattgttaatttagacaaaatactttgataattaattttttatatcagcaaatgcttgtttatttatagagttgcgtgcactataaaattatatttgtttttccaaggatatatttcttttaaattattttgttaaaaatattggttaagttttattcctgtacatatgttttttattagtttctttaaattttttaaatttaaagctataatgtaatgatttaatttgtccaagcataaacattttccaataaaaacaaaacttaataaagttaaagctcaaattcactttttggttaaatatatggtatctcgtttaattactttcaaaactccagtattcgaaacatacaatttaataaaatttgatacattatttttaatttttatcttttaattagctcgttttctctaacatgcttttaagagtattatcatatttataacaattttaatattattttattaattggttcaggaattgtaattgactcattccatttattctcgtttcaagcttccattcgattgttgaagcttatagtctaagatattttaaatatatatttttagtatgttttttatttttcattattttctttacaattttgaattttaattattaatgaatggacactctgatttaaaatactgtttttaatgaaaaattattaataaatattttttg

SEQ ID NO: 6235 - DNA, 2543 bp, Heterodera glycines
actagagatcggaattttgcgaaaatacggataagtatcagtattacgtacttgacatcgatacggattacgtactaaaaatacggaaaatccttagtacgtaaaaatacgaatcggccgaaaaaaatacggactcggatccgtaaaagtacgtatacggatccggtccgtatccgatctctagttagaaccatagaatgataccaaccaagagtggtttaatgttcgagatcagctttttcaccattttcccatttcttttaaatgacatttttgtttgctagtgcaatgtcgtcgacatttccctgttcctcttctgctgcacttatacaaaaggcttcgccgttggcttcctctcactgttttcgatttgatgcacagtcaaaaacaggttgaaaatccatctcattaaaatccctaattgtctaatattttgaaaattcatcagagtttttacttatgatacaattgtacttgcaatccgagccaaaatatcgtgaaaattcgcgcgcattattcgccgccattgaacagaatgaggtaaaagtttgtaaaaattaatttatcatgcaaaaaaagggcatagacttgtacttctggtggtccttaatgggtttttttatgtgacaaataatcaccgacaatttaacaaaatgtgcttgtcatggtgctgttcaatgactccctcctttcagaccattccctttcgctacgatgtgaatggaatttcgcacccgcaaagtcttacgaattatgtgagcctttttcgatgctttttcttttcaatatttttgccataattccgcgctctgttcagctcagttccgtcctcccttttgccgcctctttgcccactctcatccaccaattgagtcggctgcagacagccgccaatccctcgccggtggccaactttcttcccgtccgtttctttacctcgcgccgaaatgcactcgaccggcgtgcggaaggtcgaacaaatctgaaacaaaaggggctaaaagccgggagaaattgttcaattttgttgggcggacacagattagttgtatttaaatatgggctgctttcactgtccgtacctcttgctcattgtcagaggttacgcttattgttagaaaaaggtaaaactcatttcagaaccagttcgcagcccctccaaactgcacaccgtggtctcaagacggccgacaactgacgcaattcactcaatccatccaattatgtaatgatgtcattaatatggctacccgtacagcaagggcgtagccagacccttggcgggggctaattctcctctcaagcgacgtcctttttttactccggcctcaattttttgccacgattttccgaaatttttgaagcgtaggttaaggccaccggaaaaatttggaatttgggagcgatttttgagtcaattttgaaaattttaaagcaattttgggtccggtggtgtcgataggcgaattatgagatttttgattacattttttaacagggcttacaattaggcttgattttgaaaaactttgatgtacgaattgccatttatccctcctctgttttcattggtgcccccattttgttcagggcattgcaaagtcgtgaaattggtcgctgtgtgtcgatgacgccgcgcactttgtttcgcaaggagttgtacaatttgcatccgcacacgcgcatcctcggccatctctcctccattttttgcgtggcctttgaccgctccggacgatttttgttcactggggccgacgacaatttggtgagcacggaggggagggggcgggcaataataattaagcatattgacgaatcccatcaaaatgaattattgagtaattaatcaataaaaaatttaagaaaaaacattgcaatgttaatttttctttaattaacaattaaccaattgtttttcaaaaattcaggtcaaagtttgggatgctcagcggtgccttcttcgtttcacggtactgaagtaaaaaaaaaaatcggtaacatattaaaatggcacaaattatctaccaataaattatttcataagccgcaacagagacgaaaaaaaaatccaaaaacttttcagttccgcggccacagcggtgagataacggacctttcggtttcgtacgacaacaatttgctggccagcggttctgtggacaaaacgatcaggtgattttgagtgtttgatgtttttttaaatcacgtttcagagtttggtgtcttcgcaaagggaccgcttttcgcatttttcggggccacaccggcacagtgaactccgtccaatgggtccctttgttggccggtccgatgcgctatttgctttcggctggaaacgactgcgctgtgatgttccaacgatacaatgcagaaacgcttgcatttgaggacccacccttcaaattcaacgaacgtgccacggggtgagcgcatagcaccaaaaagccaaatacgacggaatgcacaatttatggggggggggggggatcttttgcttatcataccactttttcggcgcatttttcaaaaaaaaaaatgga

SEQ ID NO: 6236 - DNA, 2201 bp, Heterodera glycines
  misc_feature (30)..(31): n is a, c, g, or t
cgccggacccccttgtcccccaaaaatttnnttttggaacaactgcgccacataaaaaacgggtgtgaaaagcaaaaaaaaaaaaaaaggtcgtcgcccggggggaggtgccccccccccctcaagccaaaatcctgggaccgtccctggtgttgagcaaattttttaaagaaaattaaggattttggggtcctgctgtgtcaattggcaccacctggaaaatttttttaatagatttttcatcgattgatttttaacaattttctccaaaaaattctaattttatgggtttgcgtaaaattcacgcaattttttgggaaatttaggtggtaccaacaaggaaaatcaaaattttcataatatgtttatttcccttacagatttcgagtgtttctttcagcggtgctcggatcatttccggcagccatagcccgggggtaatttggtgatcatcggcgacactcaccagtcactcatgatgtacaaactgagtgcgcaaggcgtcgcccgactgtacgagttccaagcacattcggtaaattaacataatttggttgtttaatttcaattggcattttacattttgattttttaggatcgcattgacactttggtgtggtcgcaccattcactgcgttttgtcagcggaagcaaagacggcaccgccaaagtgtggagtttggacgaggagggacgctgggcacccgtcgaattgaatcccttcccgacggtgcaacaaacaccgcgcgtaacagcgacaacgggcgatggtgaatcaccagcagcagggggtaaaattggcactagcaggcccgtactccgaaaaaatttcgggatggcacttttttcctgaatttgtaacagttttgtgtcaacaaatttttgcaatttggggttatgttctcaaaaaataatggtaaatggggtccggcggtgccggggatgtgcgccttccctggatacgggcctgggcactacaaaatgagtttttgttccttcactttacattttttgctgtagttgcattgccaccgtcgcaacaatcgaccaacagaagggcagccaacgcaaacgccggggcgacaccgaacaacgggtacaaactgacaatgttgtgctggacattggacgacgacatggtgatcagcatcggtgtgtgtttttgtgctggtttaaatgttgttccaatcaaaaactgctgttggggtgtgacgattccctgctgtttcctccctccccgagtttagggtccgactttttgttgcgttgttgggactggcgaaggggccaacttttggccaaatatccgggccatcagaacgacgtgttctgtctgaacgcgcatccgattcacaaagtgaacacacaaaacaattacttggtaaatttgtcaatttaaggaactgattgtgagcgcaggccatgacggattagtcattgtaagttactttttttgaatgtaaataaggcttttgccaattttttactccatttcaaggtttggaatgtttacaatggcaaacaaatgtccaaacatcgcaatgaaaacaacgaccgcgaggcggtggccattttcgacaaccaaatttcggcggacggcacaacggtcgcgtgtgtggacgccatgggccatctgtccatctacggtgtggaccacaaccaggaggcattgaaacggccccacgagcagttctttaccaccgattataagtaagtgtgatgctatttaaaaaaaacaaaaatgaggagtggaagatttttgttttgactgcaataacacggcaatagaattatttggaaaaatactactagtaattcatccgaaattttctaaaaacagaaaagtttttcaattccatttaactcaattttcacattaaaatcaaaatgcatctaaacaatcgaatcgttggatagcaattaaaaaaactcaaagaacattcggtaatactttgatatctccatgtgttttcagggtcgctgaacacgaatccggcatccatttcgctcgatttcgaaagccggatccggattcgaacaaaaagtcgaaaatttaaaattttcaattttccatttttagcctaaaaatggtttaaaatgacttttttattgaagtactaatgatttttagttcgtttccatgtatttaaacaaagttgaaacaaaaatgtgaaattcaaaaaatttgagttttcgacttt

SEQ ID NO: 6237 - DNA, 2062 bp, Heterodera glycines
gggagcagattcttcatccagaataaattttaataaaaatttaatcaattttacccaattttagccccaattgggcgacgaggtggcctactttttgcaagggcacaagacgtacctgaaagagctgaaggaaaatgggatacaagttaccaaagtaatgcagccacggtcagtgctaaaaagaaaagaaaacaaataaagaaacaattgaattcgtcaggcccgatctgaacgcgatggagttttgctttgtggacaagcttgagtgggttcagcattccggcattcacatggcccaccttcggttggcacggtgccagaatggacgacgcattggctcaaccttccaaatattgtatttgcaaattgcaaaattccttcacttcctcttcaaaaatttgttcagtttccacgacatgcaaaatgtgctcgactttctcgttctcaagcagcattttgacgccagcaaacagctgaatttgcagccgggcaaccgagtggagtcaattgtggacgacaaattctacacgggcaaagtgttgcgagtgaccgcggcggagtacgactcttatccaaagtggggaactccaaaaataatacagcaaaacactaacagacaatttttataatttttatttttcttaaaaatttgaattttcaatttcggggagggggtcattaagactttttcctcttccagctctgattggtgcgccgtttgtgtcgagtgggacaacggagaggatgaccgctattcgccttgggacttgcaagcgttgaccaaaggcagaaagtctggtgcgtgcgtaaccgtaaatggatggagtcattattacagccaaacaatatgaaaatgggggcttagaccgcctttggcttattgtcgatagaaaaaattttagggtcttttttctgaaaaattccggttttagtaaattttaaaaaactttcggggaggcgagggggagaccgtgctcatgaaaaaatattttcttttcagaaagtccggctaccaaacatgacactgccaaattgggcgagtaccatccaatggccggcgaatggctcgtgccagaatgggcgcttgccaacgcgccgccacgtgcctccagcagcgccgtttcgtcacggccgtcgaattcgttactgttagcccaggagttgttccagcagcgcatttccaagctgatcgaacagctcagccatgtaaaagaggttatcccttggatattgtttttaaaaatcggtagaatttttgactgtagctaaaagatatactatacattgaattgcttagcttttcgagctttcaactagtaatttctcggggttttccggtaaaattccgttttcaaatggcgttttaaccactactaaccttttggtctgtcgtttaggtgctcccctttttggaaccggtggacctgcacttgtaccaggactaccccacttatgtgttttatccgatggatttgacaacaatccaagagcgcattcacagcaatttctacaggtggggagagaaataatcaaaattaagaattaattaaaacacataaatgttcaggagaagtttggccattctgtacgacgtgcaaatgttgggcaaaaatgcgttggcttacaacaaaccgaagtatcccatcgtgcgccatgcttgcgctctcgtcgaaaccatttttgtgtttatggagtaagaaatatcctgttttttgaattaaaatgggttttttgccatcttttccagggattggaagcaaaacgatcccttgccgatgtttcggcattttgtcgaggccggcaccgaaggcaccaaatattggcagttggatctcctggccacgtcgaacggtggcggcattgggtcaacttcgactttgttcaccaccggctccggcagtgtttctgggtcggcattgagcaacggaaccgccaatcaccaacaaaatgccacttctgcacgtcttcaagtggcaccggggccatcttcttcgtccgcaactgccggattgccgctgtgggcttctgagtgttctgccatggtggacgaattggtgagtga

SEQ ID NO: 6238 - DNA, 4591 bp, Heterodera glycines
acagcgaaaggagggacgacgggtggggggggggacggtaggtgtcaatggcatttggccaactgcgattctgagacaattttaagaagccatcacttttctctttgaagaaaaaagttatggattctttaagttggaacagacgcgcagtcgcatgattctggagggggggggagaagtgaataattaggttactggtaaagcagcggtgtttcaagagcagaaaatgaatggggaacagttttagacagcagcgaattgtcgaatgtttggaataggtaaatgggaagaatggtaacaaaagggaaaaaacagcgcatttataaaggaaaatcgtggaagaaaagggaaaactgacaaaaaaaaaaaaaaattttttttgaggcgggagggattataaaaggtcgactcatgatctaaccattgccattatattctgtattgggcgccggtacgtttggcgccagcatgtttttggctataacttttttctttgtctaccaaatccaacattgtttcctctccctctccaaaaactgtaccgtggcgcgcaaacgatggatacgttcgacgggaaatgcaacgccagcacgagcagagcgcgtgttcttcgatccgctcgcagcaatcttcacttttccaccctttccgcccgccttcacttttccgtccgccttcgctttgccgccctttccgctagccgtcgtcttcgtagtagcttttccggctttcactggagacgccacttgagactcctgactgttggtcgtaccggtcgaagcaacggaggcaccacggttgtcagacattgcgttgttgttgttgttggttgagatagagagagagaaagcaaaatatcagtgagatgagctaaaatttgaaatgacacgaaagtgacgcgcggtaccattacatcactgttgggtggtgggtgaaccatgtatgtatgtttcccaaacggtaacaatttttgagatattttcatttttaaagatatgtttaagagagaatccgagatccctacttatctatgtatgtacaaagaaaggatacaataaatgttttattcatttgtagcagtttagaatttagctagaaatcataaaagttacatcagaatatctgcatatttactacctaatttaactgcgattaaaaaaaagcatttttcatcattgtcaagggtgggggacgcactttcgaaaaagctgtgttcacggatcacgaaaaaagaaatgaaattcacattcgcagagtttgcactgacgctgtttcagtttggcgaaaaaaatggtgcgaggcgaatgagaaattcagtgagaaaactgttcttttatgcagtcggttccaaattagagcgccaaaaagcgaatttttgaaaatttggattttcgactttttgttcgaagtcgagcaaatatgatcgtggaaatgaaatttggaaatatgaacattgaaggcattggcaccatttcaaatgtatcattttagaaattttcagacaaataaaaatgctttttcggtgggtggacccctccccgattctccaatattgtcacggatttttcgaccctgaaaacccttaaaatgtggtttctcttggaggaaaaagctttgtttcatcaggaaattcattgatggacccctaattctccaatattgctttggattcgggttttacaaccttgaaattgcttttcccggggagaaattgaagaggcaaatcaaaaaacaacaacaacaacatgaattgtgagtttatttccatttattttacaagacgactaatatgaacatacaatgcaatacaaatacaatacatattatacagagcatacacacacaataatatcaattggatttcgagttcatccgcttgtagacacacaataatatcatccgttattctcttcgtcgctcagcaccgaaggactcgcattggcattgttgtcgcgctcggctttcgagttcatccgcttgtatcacgtggctttcgagttcatccgcttgtagtacagaaggaatgcgtgcttgctctaaaaaggggaaaagaaattattatttttttcatttgaatggtcgggaacgaaattctcacaacgggcgaaggagcgctgccgcacggaatgcatgcttcgtcgtcgaaactcagccactcccgatcagtgctgatcaaattgatcacggacgatgtgtaatggccactgttcagccgaccgctgtgatcctgaagggggaatggtgaaacataattagtgtgattagtgacaattttaaccaaatttgatcactcaccgttatgccgtagagactgagtgctgtgttgtgatgcggagacttctcgtggagaaagggcgccaggtccaactcggccacatcaaacgttacttcgacctgaaaattgtttaaaaaatcagtgaaaattacgctcaaaaaaaaccccgacggaaacttacgttatttttgacgtagtgtccatcattcagcgaaaatctcttcaaatggacgatcagcaccttcgggatctcccaaatttttgtgctccgtgtcgccggctgtttgcttttgcacttcggacaatcccatttatcctcgagactctgaaaaagggaggggaaatgggatcagacacaaattcaggctgaggtgctgctcactgctgatgaaaagtgcgcctccaggcagtccttgagcgtcaggtcgtcggtgttggtcggcaattcgaggctgaaaaattcaaagggaaattcaaattatggaatttcttttgggtctgtgaaaaactcaccttagttggttgacgacctcgaagcgaacactcgtcgtattgcacgtgctgcattggaccatggagatgtttgtcagctgaacaaaagggaaaatgattagaaattggcggcggacaaacaaaatgaatgatggctccaaactcacgttgaacagatcgttgaccggcgacgaagagaacagtttcgacctctcattgaaatccgaagcgctggcgcccaaatcggtgtcgtcgtagttctgttcaaacgattgtcgcttgttgacctgaaaatggggaggggggagggtgaaaaatggaacataaaatcgcaaaactcacccggttggtgtcctcgtgaagcgcgtccagcagatagagttgaaattcttgggcgtcgtgctgctgtcggtcggccatttcggtgttgacacggcgagcgaagaattcctgggggaaaaaggcaaaaatttgattagaatggattgatcaaaggcacagtcactcaccaggaaggtggtgggccgaagtgcgttgaacttgccagaccagatcaggtcgatgagcgcagagaatgagccggagatcatcccattcgtgccaaacgagttgttcctgaaaagggaaacaaaaaatgaattttatgaaaattcgaagacggcgctcggctcccccctcctgacgcacccattgacgaatcgctgcgcgctcttttcttggaacagttgagaaaatccgggcgtatggaacagtggctgaagagtggcgttcatgaagcacgtatttcccatattgaagaggccagtttgtccgaggggctgaaaaaatgaaagaatgaatttaagccaagttttttttttctggccaagtcagtcccccgaaacccaccgttttcttccactccgaatcgctggcgatcctctgcgctgacatggcatatgcgctcatgaagaagttgccggtgccatcatcagtgctgaaagaggagaaagggacgcgattcatcagacttaaacacaacaacaaaatggggagtgcatgcaattcactgacagaggctgcgctggttgtcgagttggaacaaatggtgctggtgacatggtcggatgagttgttggctgttccgtcacgtcgtccgaagtgggcagtgcctttcgtctgcgcggatggggagggcctgcatggttgccaaagttgccgtccggaagcggtcgcccttgactcgaggcagtcatgtcttattggctacagaaaatgtgaaaaaaatgcgttacaaatacacaacaagtggtgttgaatgtaaagcagcaatagggtaagaaagaaaacatggagtttgaattgacagcgaaaggagggcacgacgggtggggggggggacggtaggtgtcaatggcatttggccaactgcgattctgagacaattttaagaagccatcacttttttctttgttggtcaaatcaaacaaacttggtatcatccgaaggctctaaatgtttcgaaaagatatttgtaagcagttttggaagcgattaagcaacccaccaaaagttaaagcctgaaaaaagcagaaaattcagaatttttttgtatattttttttacgaaatgttggttgtgaatttggtttgactgttagagccggttaaggtctttagaatgatgccaagtttgtttgattggaccaacaaagaaaaaagttatggattctttaagttggcacagacgcgcagtcgcacgattctggagggggggggggagaagtgaataattaggttactggtaaagcagcggtgtttcaagagctgaaaatgaatggggaac

SEQ ID NO: 6239 - DNA, 1048 bp, Heterodera glycines
  misc_feature (57)..(57): n is a, c, g, or t
ttttaatgagaattttttgaaattgggcaaacttgaaggtgtttttgatacaacgancaccaataaaaaaatatgcatttttaagttttaaaaccccattttttggttgtttattgtactttttaggtttatttaagcaaatattaaatatgcacacctttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctatatataatgattaaaaaattaacagaaaagcacaccaatgcgaagaaatctttataaaataaaataacaaaaagaaagggaaataaaatctaaaattgttcgaatttaatttccatcggcatcatcagtttcttcaccactcttggcttttgcagactctcaagtatttcacgtacagctggcatttcttactaaaatctgaattacctttttgtttggttagaaaagaacttataaaaatgaaaggaatacttaagctttgattgatgcaattctttcgtctttttactttttttctttactttttttgactacttggcgaaatgtcagttggcgaaatgtcagattttggttaagttggcgaaatgaatgtttttgactgagttggcgaaatggcatccccacaaagtgtccaagccacgaaatgtccaagccacgaaatgtccaagccacgaattgtccaagccacgaaatgtccaagccacgaaatgtccaagccacgaaatgtccaaaagagtaaaaaaccacgaaatgtccaaaagtctaaaaagctcataaaaacccggaaaacgggtctaatttagggttttcggggtcactgagtaagaatacgacctttatataacccatttcctaatcctagacccacacgaataagaaaaaatctcaaaatttgtttaaaatttatgcttttttttactcccagatttttctattcattg

SEQ ID NO: 6240 - DNA, 1785 bp, Heterodera glycines
  misc_feature (1336)..(1337): n is a, c, g, or t
tatttgtattttccgttatttctttattccttaaatgctttaggcaattccattttatttaaatttggcattatggcattctgaaatctttaaaaaaaagtcacccaaatgattggagattttatgttctcatgtgatttgtaagcaaatttttgtgaaaatgagtcatgacaatgggaacaacgcttttcccgccgcctcgtccatttacccctcccttccgtcggccctttgcgatgaaaagccttcccccgccgccgttttgtcccattgcgatgatatggaaggcatcagtctcttggtaaaagctgcggattttgcagctcgtagacaccgtttccaaaagagaaaggacgagcggacgccttacataaatcacccaatcggagtcgcttttctgctgataaggtaaaacttttaccaggccaattcgaacaaagcgaagtctgccgcttttgcagcgttgccaaagtgtacgaccccgccacattggctgctgcttatctgcacgatttggtggaagacaccaaaacgacgtttgaggagttggaacaacttttcgggagagaagtggcggaaattgtcagagaatgcaccgacgacaaaaacttaccgaaagatgtgcagaggaaaaaacaagtggagaaagcggccggttcatcttacaaagtaaaaagaaagtccgaaaggagaaagaaacattgtgctgattaaggcgaagttggtgaaattggcggacaaattatacaatctgagagacttacaacggacgctgcccatcggatggagcaaatcgagggccagggaatacaccaaatgggcaaaggaagtggtgacccaactcaaaggcaccaacgaagcgttggaaatggcattggacgatgtgatcaaccaattactcgacaagaaataaatgatttcaccggcacattccgactgatttatattgcattcctttcacttagcataagcggatttaagttaccaacgccataatttgactaatgagagccacttttacggagaaaaaattttttgggcgctatttgcaaagagcgctcttttgaattctatcaaaaacaaaagggggaacccttttgttttgcaaaaattttttgagatacaaatccatgaaaatttgatatccggggttttagaggccgctgatcacgaaactgacacctaattcgaggttatggaccccaagaaccccagggaataaattttcatgactatatattaaaaaattttgcaaaacaaaagggtcctccccccttttgtttttactttttgataaattcaaaaccgtccttcttttaactagcgccagcttttnnttattaattgagtccgaacaatgaaccttaaaattccggattggactcttttcgactccgaagccggattcgaacaactcagtttttcaagattgtgcgggatccgcggatttttttttttttcatatattgcaaaagattatgccaaatggcgttattttttaggcgcaatttcaaaaaaaacactgataactagagaccggattttgaggcatatgccttttttttgctaacttgctacggcctaatatgcacgaaaaacgagtttttaacttggtttgaagcttctagcttgaacttttttggtgcctttttttgccttttttgcgattttggtgccttatgccgggcacgtaattttggtgccttttttgccttttggtgccttttttcatgcctttttcagcattttaaaaaaatgggaaatttttaaattttttgcaatttt

SEQ ID NO: 6241 - DNA, 3910 bp, Heterodera glycines
aagcaataccgaacttgtttttattttatattcccctccaaattctattgtctgctaaaatattttttaaataaaagatcaacaaagcacgggcttaaagaacacgattttaataaatttaccattaactaaaatctcttggaactgttttttaggttgtaatgtgttctttctctggaataaaaatggaaatattcagattattgcacaaagctacagatggagttttttaaaagttaagttgaagtaaatcatatagaattaaaatttggccacaagattcaatttcaatatgtgtgaatttatcacttataatcaatttgcctgccaataaaacatttatatagcagagattatatgattgagtgtaaaacaatacatattgcccacgcaacccaacaaaataaaatttatgtgtgtgtatttttagtaatgagaggagcaagcctcaacatagcgtaggcgccaatcattaatacctaaatttcaagattataattcataagcaataccgaacttgcttttattttatattcccctgcaaattctattgtctgctaaaatattttttaaataaaagatcaacaaagcacgggcttaaagaacacgattttaataaatttaccattaactaaaatctcttggaactgttttttaggttgtaatgtgttctttctctggaataaaaatggaaatattcagattattgcacaaagctacagatggagtttttaaaaagttaagctgaagtaaattatatagaattcaaatttggccacaagattcaatttcaatatgtgtgaatttatcacttataatcaatttgcctgccaattaaacatttatatagcagtgattatataattgagtgtgaaacaatacatattgcccacgcaaaccaacaaaaagcccgatgttaataaatttgtaatctcatggccctaattaggagaccaaatcgtcatattggtctatgtttgagaatgcgtcttcttcctcctctttgtcttccgttgcttttctgtcatttgcttcgattggcatgccaatttcatcggtcaaaaaggcagaaggaaattcgtcggaatcgtcctaaagtagtcaattaatgaaacactcaacgttatgtaattgtacaatttacaagtgaaaaaaaaagttcgaatcccaataattagaagtacctttgttggaaacatttaaagctagtaaaagatcttaaatttgggcatttcccttcccatttttggctttttctttttttaagccgcttttgtttgaactgttgatgaattgctaccaaccattcctcccgtggatttcttccattcgataatgtgcagaattacgtattccatcacttttttggccgttatttttccctccgtccgtcgctcacttcgcaaaagtgttttgttaatgtccaaaatctctcccgcctcgcgaatgtacaaatccaattcattttccgcgccttaacaaaaagttcggtcctttggccattccctcgccccgtcacatcgatttgttagctgtgccaattgaatttcgtgggtggcgaatgcgtcgtccaaatcgaacagttccaattgaagcggtgccaactcacgaaattccggcgcaaaaatctgaagaggtcagcgaaggtcgttgtcagccaacgaacggtgaactcacggcaggcgcaaagggcggcattggcacttggaatgccggagagaccaaagtcagaggctcatgcttcagtccgattttgtcatacaaactttgacaacagataaagagaaagaacgaacacagagcaaagccccgcccaatacggtaaaaaccgattcatactgtaaaaattcattcagttttgactgttatcgaacaaactttgagagagaacttaaaaattggacactttaacaaataatgaattgatacagtagatgaatcacaccattcgacaagggtgcagtccgctagcatgtttttcgtccctgcagtacacctaccgtatggcttcaggccaatgctctaggctaattgagctgagagaagtgtcgaacagtttggtgatgtcgccagtgaatgtttgctctatttcactttcctgcaggcacattttcggttggccttttttgagttgtttttttcgattgttcccaaatatatattttttactcgaaagttgtaaattgtcggggatttggtggaagtccgaaatgttcggttcggcggcatcgatttgattcaattcaaagccatcggaaaggaatttgacaatcacttcctaattatatttttgttaatgcttttgcggtttagaatattacaaatatctttgcattatcttctttgccaaagaaagggtcggtgaacatttgaacggagcctaaagaaaaaagggggggaaagtgaaaaatgaaaggcaattggaaaatcggggaaaaagtaccgacaacagccaatttgccacaaccattctcctataaatggaaaaacaattaacaactaattatttgtgcttgatcatttatttgttagtttactttttgaactttgtgaaatgcacaaattggtcgtgaaattgggtagcacacagtgcccgtggacagcacacaaacggagcgacggtcaacgctcaaagtgcagccgaaaggataaacgaaagtcaatgccgaactgagaaaggagggcaaaagtccgcatgagtgagtggtattggatcaattacattaattaatttatttaattagtccgctttgcccccccccaattaattatttaattgatcaacattccccgccccctcccgcaccgaatgttcgtctcctcgtcgtcgtcgtcgtttccgtcccttctaagcttttgtccaaatgcgctgctcctcttttccgccttttgctgttgcatttgctctttcggcaacccttttctgttcctttcggcttctcttccgtggctaattgccttttgaacgcccgcggccgaagggattgcgcgattaatcactccgttgggcaccaaagcctctttgggatcgaaatatttgtggaacattgtccgaatgacgcaatctgacggaaaggcacaaacaatgggcagggatcgacgcatttgctacccgaattaaatgcaatgccaaactcttccaacagaaaattgatgttggtgccattgcgctgctccccaccctcggcacacattacaagcacagagccacccgagtgtatgaatttccgtattaaatcgaactatgaaaatttttggatgttcaaaaagggataaagccacctcaaactcagtgaattttgcacgagggcatggcaacacaaaaatgcggcatttttcaaaggcagattccaccaactcatcgccattgaaactaatttaaaaatgattgtttttttataattagtgaattttaataagtagggctcgaaattagatggactaaaaaacatcaaatatggcataaatatggagtaaaaattcctggaatatggattaaaaagctcaaaaatggccaaatattgaccaaaaactgccaattatccaaaaaattaccattaaaaaaaattttatttactatttggggggtttttgtacatatttcatacatattttagcatttttttttacatattttatttatatatttcgcgatttttcttatataaaaatggaatccctagctattatcctatatgttgatttatagggctgctaattttatgtaacaaaatttgcgaattatgtaaataaaatatgtataaaaaatgctaaaatatgtacggaatatgtacaaaaatccccaaatatgtaaataaaaaatttttttttaatggttatttttggaaaaaattcttcgtcaaacctaatataagaacttaatgccatcgaagtacgcaacataggctta

SEQ ID NO: 6242 - DNA, 2305 bp, Heterodera glycines
cacctcagtgcacacaaaaattggctcggatgttagcaactcagcaaaaatacaaccaatagcccaaatatcaattgcctggggaaaatgaaattaaaccagcaaaaaattacccagttaaactgttgtatagtgtttagaacaaagcaatagctcgggcgcgcgataccaaaaggtgacgacgacggggtcgagctcggacagaggctgaacggccaaataagaggagaaattaaaagataaatgacataaaaatattaattcaggattcgatgcgcaaatgattaatttatttgcaaatttcctcgtaacttttcttggttttattataatgaataatggaatagcccaacagtcattacctttaacggattgtgaaaaactctggcaaacctaaaaccgagcgaaaaaatcaatcaaaggacaaagccactcaccccatgtccgcaattttaacccttccgcgttcaatgcccgtcccctcacccatcacaagaatattagcgggctaaacctataaaggtaattgctaattggtcaattcaaaggactttaaggtcgcggtgcattatccaattgttgtgcaaataatgaatgccgtcgagaatttgatagagcaaacttttgaccatccctttaggcacctgaaaaacaacgtcaaaaaggtcgccgcctgagggtggcaccgcccccggtaggatttgataagtccctgggggtgctgaaaatgggaaatatcagaataaccatcacgggttgtcgcctctgttttgcagatcgatgatatttgataatgtgccaaagatcatgttcagcgtaatcaaagagtagccaaactcttttttcagtggtgagaaagacgcgcagcaatttgatgaggttgggatggcttaacaaaagttaaagtgaaaccaatcgttggaatggagcgcaacttcaattcccttagaagagccacttctcgacaagcagacatcgaaaagccctgacctaaatagtcagggaatttaggaaacaaattaagaaattaaattcgtcattctaattgtaagaatacgaccagaaatcaatgcctgatttagatttagaaatgaaaattcgtatcaccttcaattagtttcagtgcatatgccttgccatccatgccagatggagagttccgtaaaattgctttgtacacatggccttaaaaatatattagcttgaaaattttcttttctgaccataagttccgcgaccaacctgaaatttcttttaaatttaaaattaggaagtaagaattactttgtttccttcatatgtgtaaatgtcttctactttttctcgaattctggaaagctcttctcgaaagttcgtatcaatcatccgttttggaatagaaacaatttaagattcttagaattagttgcgaaggcagccacaaaaaagtgctatgaaattacaatgataaaaaattttaatgtcataaaaagaagtttcctgggcttttcgaggtcgctgatcatgaatccggcatccatttcggccaattccgaaatttatgacattaaaattttttcaaaaattttttcgaaaaaaggggggggggcaaagcacagtattaccttctttctttttagtgatttgtgattttgaatactttaagataaaaagattcaatctcgattttcgcatttcgatccaaataaacgaatcggggtaattcggatcaaaaacgaggcaaaggtatagattattggtcccgaaaattatttttaaataaagtttaagaaaattattttaggggtaatcctgaggcgccgagcacgaatccggtcttattttggctcagtctcgaatcctgaacccggactcgaacaaaagttcgagaattcaatttttcatacttcgcagttttagttcaaaacccggatctataccattgcccaaaaacgaattggggcataatgaattgtgaattttttggtcttttctatcgaattctcttttgttatttgaaagtttcttttctaactcgagatcggctcttccatttttgagggcacctcgtttcccccttcggtgacaaaaaccttcaaaaataattcccaaaaatcgtcattttttacgattttggacaaaaataaataaaaacaatcatgttgcacaacggactcgaacctccgctctttatccctttactatcttacaaaaaccatttccgccacacatgcaacaggagctcatttcctgggtgatatatacagcaggcgaataaaagacctaaatatgggctatagcatagaattgggccattaaaaaatcg

SEQ ID NO: 6243 - DNA, 1742 bp, Heterodera glycines
gaaaaaacctcaaagcctcatttcaaaaaaaaacctcattgacctatcaaaataccacaaaatgaggctaaagcctcacatctgggagccctggttatatgtatgttttagctatggatgacgcggaaaaaccgttagaaattatttcactttgtccgaactgtcacgaaaatggtacaaccaaaatgattgttatcaatattccgttttatcaccgtgttattgttatgtctttcagctgcaatcgtaaacatttattaattaactaatttattgttttcttttagactgtggacatcataatagcaatctccaatcaggggaacaagcgcaggttattaataagatgcaatcccgaaaacccgtaaaacaagtttctatgacattaaaattttgggttttttattcgaaaagggcgcggagcgccatcggtagtattacggttaatttattaaggtttttttatttgtctttaattaaggaatttggtactgaaattgttttgaaagtacaaaagctcgaagacctaaacagaacaattgtgcgttcggagtacggaactattcaaattcctgaattggaactgacaatcccagctaaatcacgttctggaggtaaaaacaaatgacattattgttgggaacatgaaaaaatatttgctgcagatttaacaactgttgaaggagtcgtacaatcagtgagagaggacttacaacattttcagcccgagaggaagaaaacggagccaaatacagcggaaaaaattgaccattttattgggcgactgtccaaacttctttccttgcagtcaagttggaccctggtaagaaatagaaaatgaccaaagtgcgggattttaggcaaaggtcacgaattggtgttccgacgaaaaaagtgttaaaaatttcgcagctattttttctgggcttaaaaaatgcgctgatcacgaatctggactcagattttgaaaatcattgatttttatctatgatttttcatcaactagttaatgtttcgcatttttaaaatttattttacaattaatttgggttagaaaaatgcgctgatcactaacccatttttttaaattcgtattttagttgtaaaactgatttaaagaaacaaaaataattagacacaaatcactgcaaaccaaaattttattctatacagattcgaacataaatatgaagtggtaagcgacctaaaaataacctcaaaaactttaagaaacttcgtgatccctctgggaattgtttcatccaaaatcccgacccgttccacgtcgaccctcgctgcatcacaagtcattattatcggcgattggaagaggacaaattactgggactgatcgatgacgatgcatatgaaatacaaagtgcaaagctttcacaagatgaagttgatgaccgggaatggaagtcatatgaagatgtgaaggctgaagtccttcacttctccactcaatgctcggcttgtggcgcttcttgtgacacgaggatgaaatcgactggtaatttttatggttttcacttggtttgccttcacttgaaaagcactaaaggaaatgaatgaacctttagtgccgtcatgaaggcaaaaaggaaatgtgacgcgtaaaggcaatggtggataattgtagcaccattgtctggtaccgtttcaacattcttacgatgagcattttggatttttttttgatttttctaagaaatttttcattttgtcaaacttttgggggg

SEQ ID NO: 6244 - DNA, 3066 bp, Heterodera glycines
tttcaaagagtgacgaatagtttgtgaattatactatatcactctcatattacaaacaaataatgccaaattcttttttgatgggaatcatataaaaaagcagacattcatccgctttgggttttttaaacacacttttgacccttcttcattctccagcttattgggaaaaaagagggagcccatcaatgaatgcatttcataaatgttgtccagaaaattgagggaggtaaactcaacacttgagggattatggttaacgatataatcttaaagatcatagggatgctttaattttggatggaagatttagaatggatgttaaaattaatttttaaaaatgaactaaaacccactggtctaaaacagcaaaaatatttcttaattttttagacattcctcacttccaaacggtcataataatgtctacggattgcgatatctgtggcttcaaatcgaacgaagtcaaaagtggtggtgcaactcaggaaaatggatgtaaattgatattacgcattgcagaggtaaaacgaccgcgttttatgtaaaaattctaactccaatttttaaggctgccgacctttccagggatttgcttaagtcggacacatgtcaaataattatccccgaattggacatcgaaatgggtcaaggagtactgccaagcagattcacaaccgtcgaaggtcttttgattgcaataaaagaacagctggagagacaggcgcctttttttcttggcgatagtgcaacagaggaagaaagaacaaaattccaaaaattattggacagattaagagatgcgattcagattaaggagccgctaacgcttgttttggatgacccagcggggaacagttacctccaggctcgttttcttgcttattcatttatactttttgctttatttcagagcctaactgaccacgtggaagataaacgtcttcaaaaagagttttacaccaggacaaatgaacagaatgaggaattgggattgaatgacatgaaagtggacaattatgaggagttagaaacattgaaggaagatgatgaaatggatgacagatagcatttactcttaaaccgatctttgttttttgttttgatattgatgataattaaaaacaaattagtttgtattatgtttcacagaatacacttatttatccaaatttttaaatctccattttgtcatttcatttttggatttagccttgccgtttcaatgttaacattctggtaatcattaatcaacctcttaattttaaagtggttaaatttagtcccacctgtggcacaattctgactctctcagacggtaaggattactgcaagcagttcagctgtggttcttgctcctatacattgccaatttccaagaaggttttggcttcatttattccttttatatatatttttagctgacaagcagaatatacagcaaaaagaaagaagatgagaagataattgggggcaccgaaatgtgggaaaacgcccaagtgacaaatggtctgttaggctcaaagcagagaaaatgcgcatttgtgtgttcagagcgatgcccaagttgttctcatgacaaggcctacttccagcagatacagacgaggagtgccgacgaaccgatgaccattttttatcgatgtgccaattgtggacacagatggaaggagtaacggatgaaatccgaatttaagtccatgttttttagttagctgcttgttgatcaaatcaaataatattgctataaagggaaatccaatttagcgcttggtaaaatgatgttctaacccagcctcattttttgccattgttaaaaatgcctccaaaagaaaccaatcatatattaattggtaatatttgaaattgattttccgggaaaaaaaaattctttttggttttggggcaaaaatactgctttcaaacctgagctcagaattttgaatttttggtctgtttttggctctaatgcactttatgagtccaaacagagtttatgagtccggtcaaatatttgtgaatccaataaattttaaaattttgattcaactttttgaatcattttattttacaccagtataaatttcactttgtttttcgcaagcgattactgtggggtaaaccatcggatgtacttcgttgatccgaatcacccaagaatgcaggttaccacgcattgcgccccagacatttgcgcttatgtctaaaatcgggttcaaacctaaattttttttcaatccagatagacaatcactttctatcatttgtttaattgcatttgggctattagtttgaaaaaactcagacttgaacccgattttagacaggcgcaaatgtccggggccaatttttgggcactttatgcataccagggatgccatcctgagccccaaaaattttctgacgtcgcaaattaataggttggactcataaaatatctttggactcataaagctaagtgcattagagcctatttcatcaagtataattttcttttatttttcatataaggataacatggaaacaaatttcttaacttttattttccgcagatacatcaattctccggtattacccattaatagggtgaggatttttaggggcgaaaaagtccaaaataggggcaaaaaattcgcgaaataggggcgaaaaagttccaaattttgggatataattttttaaattgcagttttttatatgaaaataatttcaaattaaggcaaacaattttattcactgattgcagttacaaataagatatattttagaaagttttcatttcttatgggtctatttttgaaaaatttagtgtcgattcttaggagtatattttttcgaaattttttggatcgattcttaggggtgtatttttcgtttttattgcatttttgttaataaattttggacaaaacaccaaaataggggtaacttattttacgggcgaacactcaaaatatggatttctagggtcggataggggcgttaaaacgagtttttcgaacaaaaaatgtgtttttcgtaccatttctcgtcgtattaaagccgcggaaaaaataagtaaaaacc

SEQ ID NO: 6245 - DNA, 3758 bp, Heterodera glycines
  misc_feature (3648)..(3648): n is a, c, g, or t
  misc_feature (3678)..(3678): n is a, c, g, or t
  misc_feature (3714)..(3715): n is a, c, g, or t
caaaaaaattttcaaattttttacgtttaaaatttaatacttttcatttaaaattttaaatatttttattttaaaattgtccttaatgaaagataattttaaaactttttatattttagcttccccgcaacaattagtggaaagtgccgccaacaatttgccgcccgcggcgatgaaaaagccaccacattttgtgccgatcaaaccaaatcaccatcatcatcagcagcagcaacagcagcaccctgttgttgaggagaagttcaagcagtacatgccgtcttcatcatcatcgacggcttcctccgccacttcgtcccctgcggcgatgccaccaccagcggtgacgccgaataatgacaacaacaacaacgacggcggcggcggtcggcaccaaacgaacgcgacgacggccacgacggcactggccatggtggcggacgagtacgtggacgtggtgggcgacggagcggagggtcgcagctcgctgatgcgacaccagcgcaaggcgcacatcgaattctacaggtactgtacgggtggtacggtatggtacagggtacagtagaatgtacacgaaggttaagagcagcagaatacaatagaatatgtagaaatgtgcagagtttagtaaagcacctgaaggacacgttacagtagaagaaatagtttgtgcggtaatgaactactgtacattaggctacaggagtacatatgttgaaaaatttttgagttacatttattataaaattgaaaaaaatttccaaaaaaaaactaacctagttttccctctaaatttcctgcgtcgcggatactatatgtggttagaaaacaggaatattatactataagtatgtgattttatgtgatactgtaggtgaagttaatgtcgacctttcccccccccccaaaaaaatatccagaaattttaaattttttttcagaaagctgaaaggccttcgcagtcgaggctccacgctagactgccaacagtgtggccaaacggtggcaaacacggacgcgtgcgcacgctcgcatttgcacgcgcattgcgacgtcgcgcagttcgtgtgcaagctgtgccagcgcgggttcaccgaccagcacttggtgttcgagcacatcaacacggagcatccgaccaaaaaagtgtgtgcttgggaccaggcctggcctggaccaccggaccgtaaactgatggatttccaattacggatgtccatgatccgtaattaaaggcatttttcaattacggaatttcgctgaagccgtaattacggggggcggcaaaaatgccgtaattagagattttgcgtccagcccagcttggggacaagagtcagtcggtttgactcgagaattttcgattagagccccaatactgagatttcagcacgagaatcgagaccaagattctcaaataatctcttcttagcaggccaatttgatcaaaataaatgaccgattgaaaaatcggtctgatcaatcaaaacacaaaagagattgtttgattagcttctgatcaacaaggaacaagaaatcgatcagaaagatgattttggaaaagttctgatcagaggactgatcaattagtcttacaattagtcaaaaaggcctagggattaggcatttaaaaaaataaatatatttttacaatttaaattttaaaaaattttccagaatttaaaaaaatttaaaatttttaaatttaaatttttaacttttccagaatttaaaaatttacaatttatattttgaaattttccagggcacccaatgcattgaggaccggcgcgacatggtccagctgatgcaactgctcacggactgtttcccgcgcattgtgtgcaagaccaaggacgcaatgcaggagcatctagagcgtttgctgagcgccgacacgcagaaacttgctgctgctggtgatgccgtggcatgcacagccgctgcagaaccaacggtgtgcagcaacaacagcagcgatgtaaacagctctactgttggtggcacgtcgtcaatgcagtgctgccatctttgcgtgagttgggcgcgcataaattttttttctacatgaactcattaaacgccttttatagaaagcggacgtgccatcagaacgcacagcactgcatgcacacctgaacgcgcatcccgcattcaggtagcagcgcacactgctgacttgcacaatcacgcacgcatttctcactcttttcagatgcaaaaaatgcaagtttgtctgcatgtcacacgcagagcaaaaagaacaccaacgggttgagcacgggctggacgatgaagtgacagcaaattcgagtaaaaaaaatttttaaaaatatatttttttgaaaatttttcttcaggccaactgccctactgcgtgtccagcgcgcttgaggtgcagtacgacatgctgcgcgcatgctttccgctccaaaaccggcaacagcagcaaagccatagcgcaccaccaccggcgggtgagcatccagcaactgcagatgcttctgttgcggtgtcacctccagcagctggcgcaaagcgcaggcgcaagacgctgaagccggacgactcggcaagtgcggcgtgcggtggcaaacaaaagcggaacaaaaagtgcagcaccgcctcctccatcgaggattaagcagcaattaaaaaagtaatgctaatgatgatgatcaacgaaacgaatgaagaatgctcggctcagggaacagaattattaatcactgattttttgatgagtgcactaattatgaactgatttttgaacaaatttcccccaaccaccttttttaatcatttttaatattttcccccatttttttattagggttggttggtcaaaaaaataaatgaaaatttttcaaaaaaaaaaatatggaaaaaattggttgacatatctcctcggcataatccttaaaattctgtttaaaccgattattaaattggactgatggagaattttttttcaaaatcctgcaaaaaaaattttctttatttataaggaaaatgccatgccaaaatatgtcaaacattcatttcttggacttaatttgtattttcttgagatttatttattatttttatttgaaaacatttttctaaaatgtctgctacttttttgacctatccaattacaaaaaacactgatcaccacctaattttacaaatataatttcataattacctctctaaatttgataaaatggaattaattcagcccacttatttttgggagtaatcaaagcggaacacagatggatattcgggatcataaatttgggtcgagaccagcaggggtagggccggacagaaaaccccgcggtccggtcgcggcttcaattttccgcggtcgcgaattgcggaaaaaacgccgcggatctcgcgcatcgcggtcgcgtcccatccctggtcgcgactcggaagcgaagctaaaaaatcgggaaattctcgaatcaaacaacaaaaaatcccgggactctctggcagtttcaaaagaatgcaaagaaatgatcgaagatcattttgatcagattgatcagctccagaaaaaaactttaataacgaaaagctttgaccagcagaacttaagtggccagacaaattcaattctcattatcattcatacgataagaatgattnggccaaattaggaacgaaattacagacaanaataatataaaaaataaaacttagatgtatacatannttattattcactggtgagccgaagtgacaaagtatcaaatgat

SEQ ID NO: 6246 - DNA, 1221 bp, Heterodera glycines
  misc_feature (1021)..(1021): n is a, c, g, or t
aattttaattttctttgtattattagatagtccaaagatttctctattattcagttaaatttcgaaaaattttattgaatttcaaaaaaagttaaggtcaaaattgctgagtccaaattttattaaattttttggttacatctttttgtaaatttttgctaaatttttaaaaaattataatatagtagaggcacttagagtgtcgcgaaaccgcgacgagagttggggtgaaggatcgggccaattgtcctttacccggggctcggacgggcactacaatgcccgtaaaatcgatgaggaggaggagaaccgatgggccaccccaggcgcatggtttactgcacccccacgagtctcgggcccgaagaagaagaagccgtggtaccattgatgatcgggaacattcccgttggtcggtcggtcggagcagaagatcggagagatgacgaaacccccgccaatctggcttttcccttccttttcgtccccttcttttttctccctattatttaaatcatcattttccattttatttctcattatctaatttgtctaccatttcacatctgcatttttctccatcttttcttcgccccatttgcattttttccatccattcacattttcaaattccttttgttcggcccgattgggcatccttttctcaaaatgtttaccattatctttttgcccgccatcccctcttttcatccattttctgtactctgatccccccaacatattcagcgatgcctttttccctttgtctctcaaaaattcccacttttctccttattcacgtgtttttgcatattttgctcgggggctatttaatcacagcgcccccctgcttcttgcttcttctcctcttttttctgcgtccactttttgttgatccccaattttgccttctgttgacctatttactcttatcgccaattttttcccctttggcaaataaatttggttgtttggtttgctgtctcttttcggcctaagggacggtcccccccttttttgnggaaactcgccaattctcgtcgtttggggcattcctcgccccagggtccgcgtcgtcgagagcagccaaattcgtacggggtcggatcaactcctctgatccgaagcccatcccctcccttcgcctccccattttggtgattggaatcgggaccgatcccggcgtacgagaaggaggttcactcacttcaaaactgagtg

SEQ ID NO: 6247 - DNA, 2359 bp, Heterodera glycines
aaaagtcaatttaatggctaattttaaaaaagtaaaatgatcgtttttatgtttgatttttttaaaataattttaaacacttagttactaaattaaattgttgagaaaaatagcaaaaaactgagaaaatgtggaacttttattttataataaataaaaaaaataaataattttacattaaatatttcaaaaattaaataaataataaaatactaatggacaattttaaaaatgggaattgattaaattattgtgcgacttattctaaattagttaactaaatagccaataaatgcaaaaaaaacagagaaatgatagtgtggaacttttttataaaaaattaaaaatcaaaaataattattttgaaaaatattttaaaaaataaataataaataatcgctttttgcatgtgaatttcttctttatgaaataaaaactaaaaaaaaattttttcaaatagaaaagtcgattttaaagcaatttcgctcgaggcgagatttggccgggattcgggatctttggtctcaatcccgcagatgattatcccactattgctcactctgaccagttggtggcaatcccactggtcattcaaactgctaatcagtgatcagttgatggtgatcattcaatgatcacctgtcaccgctcccgctcctccaccgatggcgtcgggccccacggcatttgctgttgtttttgtgttgtgccgtcgtcgttcgtcggcaccatttccacacgtatgccgccagcacaaccgcggcaacaccgcctgcaacaccgccgaacagcaccagcacggacagcacaattgttgttgatgatgatgataatattaatgttgctggcagtggcgacggcgtttggacggaaacggcggcgcggagaattggcgacaaataaaaaatgccaattgggcaagaaaaatttgattaaggattatgatgaaatgacaagaaaaattaagcggatatgtttctttattcatttatagggatttcggcaaattccaatttcaaaatttgattgccaatttcagaatttttggagcaaggacccgatttttgaaatttttcagacacttaaattccggatttcaattatttttgggtctctttttgccataaaaaatgcttatttgttagtttcttttttgtaattacataaaataaatttaattaactttttttaaaaacttggtctcggaattcgaacaagaaaaagcacaaaaaattctcaatttgttaagccaaattcctgagccttgtgaatttctttttgaatttgagcaaaggccaaaaataaatttataaaatcaattttttaaataaatagactgaagtttttgaggtcggcccttaattgccactattgtcttggataaaaatgaaatgatggctttttgttctgagccaattaagaggatttttccgattaaaaaagaatcatttataaatttgttaaatgctattgctaaagagcatattcttgtagaaaaccttttaatgagaaaaatataaagcactaaaaataattaatttaatttggaaataatgcaattaaaaaaataaaaaaacaataaatatgccaaaaaattgattttaaaattcgattgccaaatttcagagtttttggcgccgagatccgattagcgaaatttttcaggcctcgagaattccgtttagcgaaaaaataacttaatttaaaatttcaataattaattattaataccccaaaaaattttaaacattatattttatggccctttttatcagaaaaaattgctcattattattattattttctttttttaatggcatggaataaatattatttaataagttaactaaatattggtaaaaagaatattttctcaaaacgtgactaaattaaaaaaaacatggaaccccagcagaaattcaagaaaaaattttttggcatttgcccaagaaccaagcaaaaatttttaaaaaatctatacggttggaaaacggaaattaaaaaaattcggaaaatgacaaattttttcacacaaaattacagtccaaacttgaaaattgtcattacgcctcattgagaaacaatgtatgaccatggattgtgggaccattccgacaaaaattggccaacaaattttttgccttggcaatttgaccaccgccaaaaaagtcaatttgtcatccatcagctcatcagagagcggccaaattgtcctccacttcagcagccgtaaggtcatgtcaaaagcaatcattggcacaatgtttccgcttccgttttggtagtcacagccaaaaaaattttaaaaattaaaaaaaacggggaaagtttgcaaaatgcgaaaaaataaattaccgta

SEQ ID NO: 6248 - DNA, 2194 bp, Heterodera glycines
ccagccaatgtaattcaacaacatttgcgtgtacagaaaagtctgctccgaatggcatgagactcttttcaattcgcggaaatggcgttggtaagactaaattgcgggaaagtcagtgagtccgttatttagccaatgccccgcgggaggaatgaatccccgcctgatgtgtttgaaaagcgtcgtccattgggactcacttcggcccgctgatcgccgccggatttgacgtattccgtcaacaaagtttcaaatgaggcgagaaaaacgcgcgagaaaatgtccagctgaatggagaagtgtttccattagtttggccttcgcttcggccgatgatcacttgctgtgccgcggtgttcacattgctaatttcgtgttggaagcccgcgtcactgatcaatttgatggcgaaggtgagcatcagacagtgcgggaactgctcggccagttcaaagacgagtcgccgccagcactggacactgatcagcatcggaatccaatcgatggtccccgtctcgtccgtctcgaaaatggtgtccaccgcctcgggcgaaaagcgtcgtttgatcatctgacaaatggtcgactcgaaacagtcctttaccaacggacagccactgaatgacaaagcaattaattgaccgcttagccgaaaatggacgtaaaatcggtcactttattttgctctgagcgttttccaagagattggtcatcgaatgttgggaagtgttcgccgcctcttcgccgtcgtccgtctcaaggtcgacgagccaacacgctgaagaagtcgcaaatggcaaagggaagcgattaaaacaaaacggtcactccgtaccgaacaaattggcgaattggccgaagccctggtaattgttggacagaaggtcaaccactctttctgagcaagtgaatgaatgaattgtcttgggtttgggctggacaatttgcctggttggccacccgtttggaagaaggtcaacattgtggcgaccacttcgggttccatcacaaaatcagtcacttaacgagaaaaaacattgacaggacaattgggcgaaagggtggccaaatccaatgaataatccgacggataattgggcaaagggccaattttgacaattctaccgccaaaaagcccataaagcgtggggacggactcgaaaacagctcctcgcagtgtctctgaatgagttcgacgtcgctgggctgtgtgctttcccccgcaatgtccgccgtcgcttcgccttcgttttccctctcaaattcgactccaatttcgtaacttggattcatcaagaaatttgaaaaattaagctttaaatcattttctatgcacataaatatttctaaatgaactataaaattataattaatttaaaggaaaatttaatacgcaaaataattattcgaaatgaaaatgaaacaaacaaacaaaaatagggtaatacatagtttggtttgttcccccccccctcctttttcaaaaaaataataataattacaaaaaatcatgcaatacaactttttattaggttttcattgtcagcattcactgatcggtgttcggtttttgctggcgattgattcttttttttttatttatttccttttcatttgatttttacgaggcctttgtttttttaatttcgtttttctctttcctcatttgtttttctgagaatatctttttcccttctccgatttttatgattctctgccgaccaacaaaattattattctcttttcgcttattttattttgttgattaatttgagaaggtaaacaaatttcattgaagagaattacattgaaagcctaaatattctagatcgtgataactctatgaatggcgtatgggcgaattaattgataacatgtaccgatattcttcctgttctagttatgcgaccacacgcacacaacttgcgtcataacagcgactcacggttccaccgcgcgcaaccgatttcaaatggaagaattccaaaacttccgtgccaacaatttcttcgaggcattgctcttcaactggctaacacgcaacatgaacttaccagccgaagagatttgggcggcacacgaaggctacatccagtcagacacaacagtggaagaagtggcgcaaatgttctaccaagaacaagttgcagataacggacgacaaatcacacgagatcagtatttgaccgaggtc

SEQ ID NO: 6249 - DNA, 2176 bp, Heterodera glycines
aaaaaaacgtacgcggaagttgtagatggtccggatgttgaatggcgagttgaggtgaatctcacgtgtaggcaccgtggcgacatcgtcaggaatgggccctcgggaagcgttggacatgagcgagcgaccgcataactaaaaattggaacaaatttaggtaatactaccgatggtaggacaactcacgaggccggcaccaaaggccgccgctccaagaagcataaaatctcctctcctaatcgatgtcaaagagaatggcgaatttttctcctccttctgacaacactgccccaaaaaaatttctgtccgaccttgaccaactacaaatccccaaagaaatcgactcagacaactccattcccgactactccaagttgcttatcaagcagcttcattcccttttaagcaccgccttcgtcctaattcattcacaggctgcggctgtcgacgcggtcgaggaggaacgacgactgagaactgtcgttgtgacaaatgtgcccgaaagcaaatcggacaaagcggtggagagagcccgtgaggaccgtgcccgttgtggacgaaattttgaatgccacggacgtcgaccaggcatttccctctcctttttttctagaaaatttatgagacaatgcgcaaatgtttataaaagaattgaactttctaccaatgtttgagtaagtgttaaccagcagagaatggggaacagaactgagcgaaactcggcttacaatttgcaaaccaaagcccaaaaacccgaggttttcgacgcccgaagaatttttcaaaaacaaattcccctaataaaattttaatagaggtaaaaaaagaaatgaacgaaaaaaatcatttggggtgtatttttcctgaaacttagggtaatttacgcaaagttcgaagctcataaaaccctaatttgtaagttcacccagctctgatggggaagggaaaggagagtttttgctgtccaacctttgaaatgacaaacaaaactcaaagttggagcaaacccatcggaataagccaactcgtatttgatcagcaaagatatgaacgaacgaacggaaatttgatgtacaaagaaggacaattgacggaatacccaaagaatgcattcgaaccgtgagaggggcgggggaagaaatatcagtggaaatgaaagagaggtgcccggcaaagggcagttgcgcaatgccaagacagacacaattaagagggttattggcaattctctcagcttaattgacactttttgtttggatgaaacaaagtaaaggaaagaagcggagatatatttataaaggaaaattctgagtttacaaaatgagctttaaaagagaaaaccgatggaattaaattgaaataaaatgacaaaataaaattttgttttgtgagtgtgtaccgtacgccatttgtagatatctacagtatgaggagggaagaaaggagtgaacacagtgatcgattgccattgtatttgcttacttatgctaaactggctgcagaacataaaagagacatttagagaaaaggagcatcgcaaatttttgttattatcatggaatcaaaatatacaataaatagagattgtagtgaatgtctgttctgtgtaattatctattgtttctatatgggcagagacggaccatgaattagggcgaagattagaacttcacaagacatttggcggattagaatttaaagatggaaaaggggggagggggcgatgcctccaattgtgagaaggacgcacggaaacattgtttcgtcagaaattgattgccatcatgccattttaccttgattcgttctcgggtggatcattgttcttccgttggattgctcccccttcgatttctcgtcgttcccgcaatttttccccattttgctcttcatttacgggagggatatttgttacgggtgtcgttacatgctctgttaatgcatggtcaggagtccgaagtttggctgcaagttctgagtattggtcgaaccgcccgaagagacctgtcaatccgagtcaaattgatttgaagaaaacccgaaaaattagacaaacggttgagctgctgtttaatgtccgacttcgttttgatgggtcccaatcgtttttcatcatctgtcttttcaacgcgatggctcggtggtagaaaatagagagaattccctaaaaaaa

SEQ ID NO: 6250 - DNA, 1056 bp, Heterodera glycines
  misc_feature (965)..(965): n is a, c, g, or t
cgtgaaatttggcccatttttgcgccaaacattcgccattttaaatttcccaatgctgctcatttggacaatttgcgtcgtcacatttcaccaacaattctcactgatcttgatcagttgaattcaatcgattcctatgctttgttgcccaattcatttgctgatgatggaccaaatgcaactgctggccaagcgctgtccaaatggttgcacactctgacaaaaaatggaaagccaaagcaattgagttgtgattatacgtcaaaaaccaaaagaatgatcaacaatctcaaagaggtgtgacccaatttcgtaaatttggaaaaattgcatttaatttcggtttccatttgttcaggcatttctctgtgccaccatttcttcggccagctacataattcgccttgcgctttatgaatcaacggaaattgagccatttgaattgacgaacgaacggaccaacgaaatgctaacattggagaaagaagaattgggtgagtggcaactgcttttggcatttttaaactgttcaaaagatttaaattgcgcttcatttaggccattgtttccaccacagccaggccaaattaacgcaaaagatcttcttgaaatgaatcccgggcccagcggacagccgaagaaatgaatgaattattagggaatgagatattctgatcgatcattatgaatggtattggctgataattgctcctcatttatttgttccttttttcctttgaatgcatttaattcgttttgctatttgtgacttttatagcggaaatgattagtttaaaatgagtacgatttattcgggtgtactttagtcaacgccccgtaaaaaacggcacaaatgatatacccaatcgattcgtctcgacgagctatgcacgaaaaaataggtctccagttgcggaaatgccaaaaaaccggtttaaaactcgaaaatttgagtgaaaaagtgngcccctgaccctttaaatggtcaaattcgatcaaatttggtatcattcgaaagctcttgatgagttaagtctaaaaaacaaggtctaaatt

SEQ ID NO: 6251 - DNA, 3376 bp, Heterodera glycines
  misc_feature (15)..(15): n is a, c, g, or t
caaattattcaaaanttcgatacaaaaataaataattctcttttgctcacccaatgcaacttctgcgggcatcgttaagccaaatttcgacaatgttcaaatcgtcccgatttttgtctccccagtgaaccgtcgccgtctccccaattggacaccgtttcatcatcaattggaaaattattacatcttcgcttttcatagtcagcttttcttgcgttcgatcattcaccaattcaaatggcacaattgacggtggcgcctcatgaacaggaaaaagaatttcataactgacagaattggtggcatggagaaatttcgaaacaattggaagcgaagagaaaatggcaatcaaaatcagtctcagtcatttgggaaaatgtggcaactgaccaccttgaaagtgttgacccactcgaagtctcgttgtttgttctccataaaaaacaaccgcttcgactgtccatcttttcgcggggtgtgcagccatttggacagcatttggccagcagttgcatttggctcatcatcaaaatcaccaattgcagctgggaaaatattgtcgggattgattgagttcaattgcttgagatcagtgagaattgtgggcgaaatgagacgacgcaaattgttcaaatcatcaccatcgggaaagtccaagtgacaaatgtttggcgcaaaaattggccaaatttcatggaccaaaacattccaaattggctggacaatgtcgttgtcgttatacttccacacattcaaaagcaaagcggtgtctttgtcaaaaatttgcttattggcacggagaaacgcgaggacgaaatgatcgatgtagctgaaagaggaatacttttatcacactataattcattgaattttgatttactcaatccaaattttggtaaagcggattttgttgggcaacggacgatccggcaatgggaattcaacagaattgggatagtcgataaacacacgtaattttggcacttctgcgacacggcccttgtcaattctaatgtcattccaaattgtcaattcgcttttgccgtcaaaatgtttgtcaattaaaacattgaaacgaggcgaaattagtgccaatttgaggccgagttgggcatggtcaaaaaatgggaacatgtccatccaaacatcgttgcaaatccaactgaaatgcgggaaaactaatcagggcaaaggaaaaatttgtctaaatgtccttttaccgtcggttcattttgtggcaattagtagtgatgctcgagagtctcggtctcgagtctcgcctcgagaaaaatctcgggtttttttggtctcggtctcgagtctcggtctcgggttttcaagtctaggtctcgattttcgagactcgagaccgagacttttttacacccctaatgattgttggcctttggtaaacttctattttataaattttaggttcttttttgttcaagttttttaatatatgtgtggtccagcgggttgtgttcttagttttgttacttatttttgcgttggatcgttcccctccaagtattattttttcttctcatttttcaaaattaacaaacacaattttaacaattaaaatcgtaaaaatgtcatttttggactaaatctattaacaaagtgcactaaaaatttcaaaattttctccggcggcgcctaacggcaccgccggcacccaaaactcttacttttattttaaaaaagtagctcaaagacgcaaaatttggtcattttttggaccaaatccgttaacaaattgcagtaaaatttttaaaaattttcccggcggcgcctatcggcaccgccggacccctgttcacgaaacatttttttgaaaaagagcaccacaaaaaatggtgtaaaaaagtcaatcatatgaaaaggaaaaatgtatggtagcttaaataaggaaaaaaacaaaaatttttgagaaaactcaaaagattgatttttttcgatttttaagtgtgtaagaaaaaatttttgaaaaaagtctcgggtctcgggtttttttggtctcggggttttgggtctcggtctcgagtctcggggtcgagtctcggtctcggggtcgagtctcggtctcggtctcgagtctcgggaaatttttggtctcgagcatcactacaaaacatgggcatgaagtatttttgaagcaaaatgtacatttattgtcgcaaatttaaatttgaattcttttggatttttttaaggggggggggggtcaaattcagcctctatttcggtaaaaacccaactcggtttttggccaacgttttaacgtaagaaaattttaaaggctcaaattttcaagtatgcatcaattgcttatttgtcagcaacatgcataaaaaacattctccaattcgaatgataccaaaatgtctttgatggaggcttagaaataaacgaaaatataaatattttctattaatttaaaaaattcagtggttttttattcttgcaaaccaaactcattagcactagtaaaactcgcgtttttcatttaacacaaaccattgatcacttttattagatcataattggtgggaaaagagtaaatgaataggagcaaaattgaacccgaatcggacaaaagatgacattaattatctttgttgtcggttcataatcagagttccttcaaatgaacatgccggatgcctattcttcacaagggatttatatgatccgaacgggcaaatcgcatttgactggaacaacaagcgcactggaagggtcggtaaaccagtgtgttgtcggatacggtttgttagtgcatcggccaaccgctacacccacgcggtccatccttcgtacatcaatgccaaattatcccaatcagtagcctcttggaccagtaaatccaccttaaatatatatgattattgtaaattaggttttgccttacctgttctgctacattggccgtgcctatttcttcccaatcagtggcagccgacgaaggttctttcccagggcactctttgctcgcttcgccctccaaattgagaagtccgggcgatttccgactgcttatgttgcgacgacgtttcagctcaaaacccgagagttttcgaccaattccatacacaagaaaatcaacaagttgttgtcgacttttattgcgcagctcagaattgctctgaaaattaaaagaagaattaagtctctaaaaatgtggagagataaagagaaacgataagggagaaaaagtgtgaaagagagaagagaggagacctgaaggaaggtaaagtccaacatcggatcagatttgagagtgtccataagctgaagcaataagtgtttgtccgtccttagcatttcaatcacgcgttcacttgacaaacgaaaaattccctaaacaaat

SEQ ID NO: 6252 - DNA, 1169 bp, Heterodera glycines
agtttgcagttattttaaaattaacgactaatctaatccttttgtcttaggctacaaaataaaaaacgaaaaacatgcaaaattattcgctgctgaacaattttggctaaatctgaaggcttcctgcttataggaacccaaaggcgcgttcaacacgaagcaaaaaattcctttattttattccaaagctgggctatagtaaatttaattattttttgtatttttacatgaactcagccattgttattatgactcaactgtttacttgcaaccgtgacaatcatttataagataatattttgtcaatatggatctctaatttatttatgaggacatcagagataaaaagttagctgcaacaatgatatccataaatatggccgaatcggaaagtataaggaatattgtcaatagacatcgtagtttgcagttattttaaaattaacgactaatctaatccttttgtcttaggctacaaaataaaaaacgaaaaacatgcaaaattatttgctgctgaacaattttggctaaatctgaaggcttcctgcttataggaacccaaaggcgcgttcaacacgaagcaaaaaattcctttattttattccaaagctgggctatagtaaatttaattattttttgtatttttacaggaactcagccattgttgttatgactcaactgtttacttgcaaccgtgacaatcatttataagataatattttgtcaatatggatctctaatttatttatgaggacatcagagataaaagttagctgcaacagtgatatccataaatatggccgaatcggaaagtataaggaaattgtcaatagacatcgtagtttgcagttattttaaaattaacgactaatctaatccttttgtcttatggcacccctccccatccaatcaaaaattatcgacaaattaatacaaaattaatttgaaaattcaagtgaactattccgagattaggcaaatgagcggattgaattactgaatagctctctgctgatactcttgcaaaacatcagcagcaaattggatcggtcgggggttccgtttttggtccattgggtaattaaatcggtaaatgaatcatacatgtacaaggggtgcgccggcgcatatggggggtgggcgggtaaaagaggggggggggggggggg

SEQ ID NO: 6253 - DNA, 1917 bp, Heterodera glycines
agcaattaccaacgagtgggggggggtgtcgacggaacaatggagaaaaaggggaacgaacgaacgaaaaacaaatgaaagaggggcggaggaggaggcgctttagaaacatttctaaaatcgaacatccgataaaagtttggcgaagtgttccctccgccgatttgcattgtctcaagccgtcctcgcttcaatatgatgggccatgccgaaatgagaatggcaaaaacggcacgagttggagtgggggtggtcggatgcgagcagcgaattgctacgagtgagcggcggctccatttggtcgatgtatttgatcagacgaatgtccgacggaatgaacgggatgatgtgacgctttgacacgtacaaattctgtgtatttgacaaaatataccaacggttttatggccattaaaattatcaaccattccgcccccccccctaaaaatcacttttaccccaaaactaatcacacattgttccacttcatctgatcaatattccctctccgtaaaattcttaggtccaatcactgatcagccccacttatccttctcaccgccatgagtgcccgggattggctttttcttttacaaattatgtttgaattaggcaccccattatcctccaatttcacctcaatgataaacgcgtctctcagtgtgttattccgttgtcttttttggacgagatttgtgtacagttcggacacaagaacaacctgaaaaacaagaagtcacaatgttcaagctgtttagctctcttctttagacctttccgccgaccacagccaacgcggaacgcgcgtcttggattttacggccaaaatagtgaattttgcggatgtattggatgccgacaaggtcaatgcacattgtggtgatggccaaacctatggcggaagggcatgaaaagcaatggaaatgccaaaaggacaacaaattgtgccatggaatttggcatttggcggtgtaaggcaaatacaaatgaataggatgacttcgttgcgaatcttacctaggacgatatagagaaggatcagtgccgtgtaatgctctcgacgtggcattaaatcgccgaaaccgacctttggcagagggaattttacggtgagatacggtaatgaaagatttagcaaaaaattactgtagtcattgtgatgaaagaccaatagaaggaagtgaaaaaactctaaacataacattgactgtgcgtggtgagaaattaaattcgtaagatagtgaaactgtgcctacccatggctccaattgggacatcaaaacgccacctaaaccggaaggaatggcattcatttggaattcgtaaattggcaaaaaattcaaaaaaaaaagtgccgagtgcggtgtagaggaccaaaatggcgagcacaagcagcgcaggaattctaagaacaaaaatggagtgatcggaagaacaagcgaacgaatttaaaggaaaaagcaatccaaaaaggcaaaattaacccgagaagggggacaaaaggaaaggaattcgagagcaattttgaggcttgaacccgtgtcgcaaatcggcacgcacttgcgctcctccaccaattgaatgccgccaccacgcactgtgctgagccctctgtggcggcactttccacagatgcgatctccgtcccgtgccaatgccttccgttgcaatttattggccacaaaatgctacaggaagaaaaaagtttgatcagaataactagatcactctttgaatggccattaggtggcctggtagggtcaataaaaattagtcaccttaaagcacaaatatttgccgtacagccaaaccaaatgttcggagaggaatttgccaaggtcggcaatggtgaccagcgtaagcggaatgccgaacagagagaaagaaatgcacgcgattcggcccagacgagtcact

SEQ ID NO: 6254 - DNA, 1078 bp, Heterodera glycines
tcggaaacgaataaatgaaaaatatcggactgatcagacagactctgatcactgatcaggtcgctttctgctgggcaatcaagggcccaaggcccaaatcccccgtttttcccctcttcccctttttttgcctttttcttaccaaattgaaattgtcacgtttcgcttcacttcagtggcggtcagaaagtgcttttcgaaagcgttgaacaaattgtcgctcatttcgtgcagatgactccgtgccaaatgttcccattcgacgcgcactccgctggcattggaaagcgcgagacgaagcagcgcggaaacgaactgaaaagggtggcgaccaaatggctggcgttggacaaaagagcgcgataccaaccaagtcctgttgacggttgatcaaatccaactgatgtgatcgattggaaaagttatgtgtgcataatggggatgagacaattacggcggaataaggctaattaagcacggagaattttaaaattttctaacttactattaaggcagaacaaatttgactgtatacgagacccattttgggactcagttggactggtgagagaatatttctcgacgcgtaaaggtatttttcagtcccaatatgagtgttggaaaaatataacaaattcaatgtaaatttattaatcaacttgagtggagtctgtttgtgagtgtatggcgatgaattggcttttgcccctttctccgggactgacctgtcgtcgctttgaggcaatttcgtgtgggtgttcaactgagtagaaaatggaggcaccaaagattgtgtaggcgcaagtgagcaacaccagcgccacatggggcagaattagtttggcatactttacaaaggcaataaaaatagagacaggcaaaaaaatatacgggagccgggagcgggattcccgtaaaaatccgtccatttttaacgggactcccggcgggagcgggaataattcgtaaattaattaaatactcacaaaaatatatttaacgctcaaataatgaagggaagcccttttttaagaaaaaagaaatgtaaaaatttaataattagaaatttgaaatttta

SEQ ID NO: 6255 - DNA, 1230 bp, Heterodera glycines
  misc_feature (1181)..(1181): n is a, c, g, or t
catcgatacgtttctggagaagatcacacacatacctcttcgcttctgcgacgagaacggcatagattccaattctcctttcgtgaaggacggcaaagtgtcgtcgttaaacgacgtaaaggttggcaccgaaagggtcccttcacttttgttgtgactaaacccatcaaaggcgtgccgcttcgagctcggctttctcgacgacaatggctgtggtaagaaagacgactacgggttcaacaaaggacagccgtgtgtaattcttacggtgaatcgactgatcggttgggagccgcaaaagtataaaagcgatgccgacacgccaagcgaagtccgtggtaaattccacgaaggaacggcgatagcattcagttgcaagggaattgtaagtgggcgtttacactgatattcaggagtttctcactattcaattgtttaagtctgaagcggacgaacagaatgttgggcccgtcaaatacattccggacgatggcatccacggacgttactatccctacgccaaaatgaagaattaccatcagccttttgtgagtcgagtccatcgaccgttccctttgagctttccctttgttttgcaaattgtttctccatatcaggcagtggtcaaattcacaaagttgacgtacaaccgcgtcgtgttggtgaagtgcagtgcgtttgcgaataacatcgttcaggacgaggagagcaaggccgggatggtcaccttcgaattgttgcggcagcgctgagcgatctttgttaggctttaattggttcgtccccttcacttcatcttacataacaagttcattcattatccatttaacgttcatcatttaatgtaatgctctgtgtgacttcggacatttctctgtatttatacttaacgttgttttgtacacataaatgtattgtaatagctgtagccagtgctaaatagcgaccgccctcttttttgcccgtatttctattttggactggccgtttcactcaacggatggccatgccaaatgccggtccatttgctgctgatgtgtcctctctttcgtccctaaaaatggaattcactgggttaggtttcaaaggagcgatacgacaatttgggaaaacgcatttaccggcactggcatcattaggtggaccgtaaattcaaaatcggtgcggttttttggaaaaantgattaagatttccacgctatttcaacgtcggttgccatgaatgcttag

SEQ ID NO: 6256 - DNA, 2521 bp, Heterodera glycines
  misc_feature (43)..(43): n is a, c, g, or t
  misc_feature (868)..(868): n is a, c, g, or t
  misc_feature (2340)..(2340): n is a, c, g, or t
  misc_feature (2385)..(2385): n is a, c, g, or t
  misc_feature (2444)..(2444): n is a, c, g, or t
aagtgcgtcgaaatcctttgaccgggcaagcgaccgcccaatnttcgaaatcttacctaaagaaactcgcattcattggatctgtgccatttgggcatcgaattcattaatacatttgtggaaaagcaaaaggtgggccccatttgggttaaattggcgtcccaatttcactaatgccaaattatgttttcaccggttgccttgtcaatttggatgacgtcgccggccgtgattcgctctttgatgacggattcagtcattttgtttccaatgtcgtaaattgcttccatgtccgttgttttcagagtcaatttcccaactcgtggcccggcacccgactggggacggtcaatttcgagttgtacgacctcaccgcaaaggacctgcaaaggcaaaaaagaggttgtgtctgagcgtccatgccattgtcacctcagtctcctctttgattcgaactccaattgcctttcggaatgactgagtcaatgcttcgggtttactcagatccatggaaaacacttcactggccgaaatggaaatgaagggcgtatcgccgccaattgacttcgaaattcccatggccaccgccgttttgcccgtccccggctcgccaacaattagcaaagctctgcccgcaatttgtccatccttaagcaatcgctgatgaaaatagaatttaaattataaattcgactttaatcatgcgaacaatcaatccggctgccttccgtgccgcacattgtccgaccattccatcggaaataaaaattggttcgaaatttgcctttaagccgagaccagtgatatgggaatgtgcaccgatacgttcgactttagacacatttcttatttcgaaattaccaattcnagacatcggaaagaaaagacagaaaatctacctaattaaatgacaatagtagaaatgcataaaataaacacaaaggaaggaatagtatttacaatttgaacgtaattgagcttaacacgcggtattattttaccgaataaaaaccacaattacagtatgaaatattatattaggtttagggattttgtaatttttttaaaatagcgcttgaaaagatgcgcatttctaaaatgtttctttcttttcttcacactattttctcctttattttcatgtttttccttcgctattttcatttttcttgtgatttccttacaagtgactgtctaaggatactgtattttctttgacgccattaatttcctactttcatttgtcattgtttgaaaaaaacgcgttcggtgcactgtttttttagaatttcggttattgttcgaaatttcgggtgtttatggttcgaacttttaaattccttatagttggtttcttactttcattttcaactttatatgattatattttgattggttattgtcctctaaatgtttttcagaaaatgtcaggctcatcatcagcatcaccaaaatccctcaaagttgagctcaaagatgagccaaacactgatgctgttgactctttgaacaatttggaccaaaggaacaacggacattcaaaaaacttgggtaaattttgaaaacgcaaaatttaatgttttttttattattagaacctggcacgtctttcgatgatgatcaatttaccaaaagcaatgaagcagatgctagtcactcttcacatgacgcgcattccgacacaatggatgttggcgagggattgcccattgagtcaatgattgacaaagacagcccaattaagggctgggaaactcctcctcaggcatccatttccgagtttttttgaaatacattttttcaaggaatctgtcaatggcatggttcaacctcgcgttgtgccacccgtcgggaaaccaacacgctggacaaatcaattagacttcattatgaaagacctgctcaaacaagccaaaaaccacaaacacgcatggccttttgtccgtccggttgacgcaatcaaattgagcattccagtaaaaccctaacactaaaccttaacaaactgcaaactcatttataggattaccacaaagtcattaaaagaccaatggatttgggaacaattgaaaggaggctcaaaaacatgtattattactccgccagcgagtgtcttaaggtaacgtctcattgtccacatgcttttggggcacggaatccttaaaattcttccttaaacgcattttgttagacattctcgattctaagtgttccgttttggtgtaactacgccttgcaattagagagaattcggaaaagtcctgaaaaggatgttttctttttataggacatcatgactgtcttcaacgattgttaccttttcaacccaccgcattttgnggtttataacatggctaaagaactcgaacaatttatgctgacganattgactaaaatcccacctaatgtaagttctttttgcaggattttgagcagatctttgncaactgttacaaattcaatcaatgtgaagatgacgtcaccttgatgtgcaagaatgttgaaaatttgtaccgcgatc

SEQ ID NO: 6257 - DNA, 2697 bp, Heterodera glycines
aaaccaaaagatatgattaaaggtggaataatttgttgtttagaagggagtaaagcgaaaagctgacacgaccacttcttttgatgaggaaggaccttcgacaaaacagccaattaaaagagaggtgcgaccgattaagaaaggacctgcgcctgtcgactactcacagctcaagccacttctcaaaggcaaattgaatgagaggatgaaattctgtcataaattactcaatgagctcattacctccaaaagatgcaaggtgagactgacaattgaaaacattgctaatcaaatatttccatcttcatccattagacattcaattggccgtttcttgagcccgttgatgccgaggcattgaacctcccagactatttcgacgtcattaaacaaccgatggatttaagcaccataaaaaagaaaatggatgcacgtcagtatatttctcccgatgaatttcggaatgatgttttattgatgtgccggaattgctttacctacaatcctgaggatcagcccgttcacaaaattggaaaacaattgcaggtgagttaagaactttcattaaattgttaacaacgtgtaaagagttgttcaaaattagtgagcggcgttgaccagatatttataaatattccaaaactgaagtttttagtcgtatttcaatgtgaaatggaggcatttgcctgcagaaatgccgcctgatactgcagaaaaggccgtgccaactttagcactcccaccaaaggaggaaaagaaggaaattctgacaaagacttcaatttccaataagccatcgtcggtttcgccgactgcgcttctacaaaaatttaagcctgtggacgacgatgagcaaattgactttcttattttgcaagtccaagctgaacatgcacgggttactgagaaacagacgcaattgcagcagtactcacacgacctcctccaattaaagtgcataaaatgttaaaaatagttacttttctttttatagaattaggcgccgagaagcacgaacacaacaacagataacgccgccattaagtgctgaatcgcatcaggccattaaaaaattgttgaacgcgtgtcttcccatttcctccattccgacatcgctttcgttgcctcacagcactgcttttttgccttctatcaatgcagttcaaacatccgtcgttgggttgcttcaaccaaatgttcagtcgcaacttcctcccgcaatgcctacgatttcaccgccgcagcagatgaagaaaaaggctgggcccgggcgaccgcgtgtgacgaattctggctcttcggcttttatcggtttgttacattttatcacttataagtagttacttattgtttactattttcttttcgatatttcaggacaaacttctgcagaatcgagcattagtgcaccttcacaaagtcacctttctctttttgatctcccacctgaaaattttattcccatttagctcaaagcgtttccgtctcacaaataaaccaagtccctgtgcaacaacagttccctgctgttgatgctccccatcccaatctgttgcctcagcaacccaatgcgaaatcgggtcgagggagaaagcccggctcaaagaacaagccgaagacggagtctcagaaggaggacacgttgacaaaggaatacgaattcaactccgaagacgagcactcctctgagccgatgacttatgacgaaaagcgacaattgtcgatgaatatcaacaatttacctggcgacaaattgaccaggtcactcactcattcccttcctttcattatgtacttcattcatttgtttgtttagtgttgtgaacataatcaaagcacgagaacaaatcaaagatttgaaccccgatgaaattgagattgacttcgaaacgttgaagccagtcacgctcagagaactcgaggcttatgtgaaggcttgttcccaacaaccggacaaaaaaccgaagaagacttcgacgacctcttaccgttcgttttatttactttcacggtaaaatcagtttaatttaacagcgaaatctttgcatcccgaacacccaaaaaagaaggacaccgatccccaagcacaacagttcaacggaagcgcaccgcctaccggaaaatgtaaatttttgctgccttatttaattaattcagcttgattcagtgcccaatggggacagtggtcaactttcggtcacaagtacgaccacggcctttgctggacgtacgacccaaggaatggtcgcgcagaaggaggacgaaaattcctcttccgagtcttcgagtggttcttcttcttctgagtcggattctagtgactcatctgattcagaatcaggttaggaaatagtcgtcatcttccgcatttactcacttgaaacactagcattaggggagtgacttacgtacgcatttgctccattttcattttctaaattaaagcattaatttgcattgtgtgaaaccgatctatcatttctttaaaactctcatccatgtgattttcttgtacagttttttttttaatttaattttatttgatctctaaatttacaccaactaaaactttgtctctttcccatctcgcaatgcaatgagtctacattttctgccacttgccaaccaaatttccatttttaattatagccgccattgttttttcttgtatgttttcatttcgttttcgttttttaa

SEQ ID NO: 6258 - DNA, 805 bp, Heterodera glycines
actcaattgattccgccaaaaccaacctcgcaaataggaggaggcgtgcaaaaccttgggactgttaagggtattggacattgaacaatttgaattggatgtttggttgcggggtttggttatcaatttgtgcttttagattcggggtcttttgctgccagcaaagtgccccctccggtgcctcctcctccgccgtccatttcctctgccgtcattcccccatccgtccccaaagcaccgagttcacacgtgcacagtggcgcggctccactccttcagacgaacaatcccacggaaattagtgcggggatttccggctccgtgctcgaccatttgttgccgagtgtgacaaacggtgaaaaaggcaccggaggagcggctattggtgctgggttgctgaacaaaaactcgtggagttcattagcacaaaaggcgacggagggcgtgggccaaatgggtcatgcggtcaacgccacaaacgcttatgaactgttccgaaagcaagccagggaaaaggaggaacgggtgagtaaggcggcaacaaataaaaatggaatgaaataaatggtttacaattagaagcgacttctgaaggaggaggaggaaaggaaaaagcagcagcgggagagggagagacaaatgcacacgggcggaggcggggaaagtatttcagcaccaccaaacgatggacaacagcagcagcagcaaccgaagatcaacccggaggaggttaaccgacttcgcgaacaggaaaaggtttcactgttgaggggagaaatggggacaattcgcttcatttggtagg

SEQ ID NO: 6259 - DNA, 1285 bp, Heterodera glycines
caaaaataccaacatttagatccccttggagaaaacccccttatcggaaaatgtcttcctgatcatttttgaagagttcgaacaatgttcggctttttcgaccttttgttcgaactcgttattttcaataacccagggctcccagtcactgtacaaacatttaaagtctcttttgaggtcttagaaatgttctgtgaccggaaatggttaatgaaatttgttcgaactgctaaaagtgggtctaaacgtcgttttggagcaaaaataacaacattttgaccccccttggaggaaccgcctgtctggaaatgtcttcctgatcatttttgaagagttcgaacaatgttcgacttttcgaccttttgttcgaactcgttattttcagcaatccagagctgtcaatcaatttacaagtctttaaactcttttctgaggtcttacaagtgctctgtgagcgaaaataacaaatgaaatttgttcgaactccaaaaagtgggtctaaacgtcgttttggagcaaaaataacaacatttcgaccccccttggagagaccccctatctggaaatgtcttcctgatcatttttgtagagttcgaacaatgttcgacttttcgaccttttgttcgaactcgttattttcaataacccagggctcccagtcactgtacaaacatttaaagtctcttttgaggtcttagaaatgttctgtgaccggaaatggttaatgaaatttgttcgaactgctaaaagtgggtctaaacgtcgttttggagcaaaaataacaacattttgaccccccttggaggaaccgcctgtctggaaatgtcttcctgatcatttttgaagagttcgaacaatgttcgacttttcgaccttttgttcgaactcgttattttcagcaatccagagctgtcaatcaatttacaagtctttaaactcttttctgaggtcttacaagtgctctgtgagcgaaaataacaaatgaaatttgttcgaactccaaaaagtgggtctaaacgtcgttttggagcaaaaaataacaacatttcgacccccctggagcaacccctgtctggaaatgtcttcctgatcatttttgtagagttcgaacaatgttcgacttttcgaccttttgttcgaactcgttattttcagcaatccagagctgtcaatcaatttgcaagtctttaaactcttttctgaggtcttacaagtgctctgtgaacgaaataacgagttcgaacaatgttccacttttcgacttttgttcgaactccttattttc

SEQ ID NO: 6260 - DNA, 3182 bp, Heterodera glycines
  misc_feature (3135)..(3135): n is a, c, g, or t
  misc_feature (3164)..(3164): n is a, c, g, or t
agtagataatattcccaatcaaattatcgatgatttttgggttcaaataattttgatggggttctactttttttttctctgacatccccttccacaaacccaaacctattggatggtctcctcgagagagagagagagagagagagagtacattctatgatttctctgactaatgaaatcgactttaatttaatttgttttttaaaatttattaatcgataattttatttgaccccccccccccatacctattggatgatctttgatcccttcaaccgaaacctattggatggacttgtgcgcgagaatttaattaatttaaattttaattaattaatttaaacgagcgagagctgcgcgactatttccgataaattgtggaaaatcaaaaacatggtcgcggtctcgaaccgttgagagtggaagcgaggagcttaaccacttggccacaggggcagttgaaaggtatgggataattgttgactttatgatgaaaattccgaaaaattgtgaaaaatcaaaaacatggtagtggactcgaaccgttgagagtggaagcgaggagcttaaccacttggccacagggtgagttcaaaggaatgggataattgttaactaaatggtgaaaaattttcccctttgcttctcattttataataaatattaattccttaattatattcgtttttatatattaattttctaatatgaaaaagaatattttcaaatgaaaaaatgcattttaaaattactttaagtaaaatgtattaaatcactttattacgctactttatattcatttttatttaattcagattttagacctaatcctgatcatttttgtagagttcgaacaatgttcgacttttcgaccttttgttcgaactcgttattttcagcaatccagagctgtcaatcaatttgcaagtctttaaactcttttctgaggtcttacaagtgctctgtgaacgaaaataacgagttcgaacaatgttcgacttttcgaccttttgttcgaactcgttattttcagcaatccagagctgtcaatcaatttacaagtctttaaactcttttctgaggtcttacaagtgctctgtgagcgaaaataacaaatgaaatttgttcgaactccaaaaagtgggtctgaacgtcgttttggagcaaaaataacaacatttcgaccccccccttggaggaaccgcctgtctggaaatgtcttcctgatcatttttgaagagttcgaacaatgttcgacttttcgaccttttgttcgaactcgttattttcagcaatccagagctgtcaatcaatttacaagtctttaaactcttttctgaggtcttacaagtgctctgtgagcgaaaataactagttcgaacaatgttcgacttttcgactttttgttcgaactcgttattttcaataacccagggttcccagtcactgtacaaacatttaaagtctcttttgaggtcttagaaatgttctgtgaccggaaatggttaatgaaatttgttcgaactcctaaaagtgggtctaaacgtcgttttggagcaaaaataacaacatttgacccccttggaggaacccctgtctggaaatgtcttcctgatcatttttgaagagttcgaacaatgttcgacttttcgacattttgttcgaactcgttattttggtctgaatagggctctaatccattgcgcaagtatttttgacgctttattttaatttgtaattaaaaaaatatatatttaaattaatttttgaatataaatattagaaataataattagcgaatgggagcgccgtagcatagtggttaacgcttttgattaaatgctttggggttctagtccgcacggcgctcccattaggtaggaattaacatcatttcatttcatttcatttcatttcatttcattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacacacacacatttttttataaagtttttgttataacaaccaacattttggtatcactacttcattttagtactaatcattgtcattaaatttacaaaagctcgtttttatttatttattatttagtttagattttattaaaaaatgaatcgttttgaccaaaatgatttcactataacttctgttcatcaaatgcgcaatcgccctcggaacacaattggagaaattgcggaagtgagttttgcgccacttgaagaagtagaacggcccgaccgcgtgcttgagcgtcttgtgcgacggttgtttgatcgagtgcttgatgggcgttcggcacctatgctaatcgggcttcaattacacccaccgacctttgaaaacccatttacaattccgcttcgtcctcccgagcagaacaatcccgccgcaattgccgatttaattcaaagacttaacgatcaatctgccgctggcatagatctaacagctggcacaactgtgacaaaagtacttgcggtatggccaatgcaagcagatcagagcgacgctggaagatcaggtttaaatcttttttcttttttttttgcaaaattttttaaataggtgcatgcagtcttgaggatgaacatcgattggtgaacactgttcgctctttgattcgcattaaaaatccgaatgatcgtctttgtttggccagagctgtgttgcttggcttgcatgattggcgggcacgaacaccaggtggcggtggaattcccgctttcaaaagctacgcgaatcgccagcatacccacgggcctgaggcacgtaacttattgcgtcgcgccggaaataccagaaacaagcatatgtacacaattgacgatgntcaaaaatacaagcttggattgatcagcngtatgggcatggagaaat

SEQ ID NO: 6261 - DNA, 889 bp, Heterodera glycines
aatttatttttggtcactcaatggcacagccaattatctgttggcactttactccttttttgagctggttcatcagcttggtcattttctgtttgtgtacaacgcattttctggccaaaatttcatggagtatcgtttgacagcaaaaattttatttatccctgtgattggaatgggtaatttataaaatagaattaataaaaatatgtttaaatttaggtggaatttttccggcaatgtttttcactggcattgatcgactgattgcaattgctttttgggaattgtataaaaatcaataattcctatcgctaattacagtaacttttttagtcacgagtatttggcactgttaactgttatttctgtgtcctatgctgtctgcgaatctgttgaggtgtaccaaaaagcaattatgcatggtgatcagatgaccaccggatcatatttagatttcatgaaagtaattatcgtattgggacatttataaattccgccaggggtaaaaatgaaaaataaaattatacataaggtaatatattcaaaatcttggtaatatttacccgaaataaaaaaatcaataaaaaaaaaatcttcaaatatttacaaaatataattaaaaatgaaagaaagaattcactaatttttgaattttattttgaaattatcccatggcggcggcgcaatttatgaaataccctagcatttatattttttacaaaatataattatttatatttttttagattaaatcattttcaaacataataaatgttttgcttatttcaatgacttgcatcatttatgtttttcttggaattgtggtaaattttcaaaagtcaggtaaaaaacatatccacgtttattgccttggattttgtattgcatg

SEQ ID NO: 6262 - DNA, 5347 bp, Heterodera glycines
  misc_feature (5241)..(5241): n is a, c, g, or t
  misc_feature (5247)..(5247): n is a, c, g, or t
  misc_feature (5260)..(5260): n is a, c, g, or t
  misc_feature (5273)..(5273): n is a, c, g, or t
  misc_feature (5277)..(5277): n is a, c, g, or t
  misc_feature (5280)..(5280): n is a, c, g, or t
  misc_feature (5284)..(5286): n is a, c, g, or t
gaacttttctttcatttttctatgtcagttaaattattttattttaatttgaacaaaaaatcccttgaagtttgccctttttgagttcaatttttataattcatttagttgatttgaagaaaaggtgtaatttcattaattaattggcaggtgtattgttgggattattcgaatcgttttcttttcattgctactttttagctttaattcattaaatatgatggaaaagccagacagaaagctcattcgtcttcgacattcgctttaaatttatttagaaaattttcaaaatgaatgttacaatgaacaatacggtcttatcattaattaaattaatttaaaatttttatttattttagttttatttgaccttcaaagatgtccctcccagctggtctatgattggttgcgcactgacttatggaatcatcaccacatttggcatcatttttaattcctctgtcattgctgcaacatatttaacaaagtgtgaaattaatgtcgatgaaaccatggaattttaaattatatattaatatttcaaaatgaaccctaattaaggtcattccgtggcaccgccaattatcttttggcactttgctccttttttgaactggttcatcaacttggtcattttctgtttgtgtacaccgcattttctggacaaaatttcattgagtaccgcttggcagcaatgattttattcattcctgtgattggacttggtatttgcacggagcaaattattaaataaacattttaaatacatttaaattcaggggcaattgttccgacgatgtttttcactggcattgatcgactgattggaattgctttttcggaattgtataaaaattaataattcctatcattaattacagtaattttcagtcacgataatcttcaaaagcgactgtatttggcattgttaacaattctttctgtggtctatggtttttgcttctctgttccggtgtaccaaaatgcaactagggatggtgatcagatgaccaccggatcatattttgattttttaaaggttcttgtgtgatcctgatccgataataattaaatatttctctgctttttagagcgcacctatttttgacaaattaagttttttgattacttcaattacttgcattatttatctgcttcttggaattgccgtacgtataaaagcttcaggtaaatcagtcgttcattaagcatttctccggaaaatggtcataaaagcagaccaggattttttgtgccattggcaaaaaaatttcggcatcttttttcttaaaatttgataagttttctaatttttgcaatttttgagttaattctctttttaaaacaatgattcacttgtgcaacattgctattaattacctaattaattgatttttataggtttgccgtccgccgattcgttcaatcgtcgcacttttcgcgcacttttttgcatcatttctgttaatattggcggctatttcttttcattaatttgttacattcttttaattcccaaaatttcgtctccgatcactgcgtggttttgcaatgtaattaccgcaattccaatgaacattggtgcagcgtcaggcggactcattttatattttaccaggtatttttaattgaaaaaatatattaaaaaaaattaatttcaattttagtacggaatatcggcaagcattccaaacagcgtttccatttgttttcaaacaaatttcgaatgtaaatcaagtaattccattgcaaaatggggctcaattaggcaccacacaatgttgaatgatgtcactcagcaaatacaattgccctatcaggtccatataaatggcactgaaattgatacagcttttattgatctgtgaccaagaatcacatcaatttttaaattcttgtatttattagactcatttcttgtaataaatagtaattaaaacaggccgccatttagtgcaattgttaaggaaaaaggttataacactttaaagcacactactgggaattttctctttatatatggcatgtttttttttgcttccatattggccttgctcgctttgtgtgtgtatgacaaaaatatgttggcgaaaatgccataaaataaggcccggcgagttgagcagcggcgagttggctcgcggcgagttggacgcggcaaactgattcagaccagtgtgcaagcactcaagctcttaagcgcaacacgctccagcgaaggggatgcaagtgcgacaaggcagcgaggttcgtcgtcagcaacaacaacaacaatagggcttcatgaatctgcatctgatattcacgaatattttttgccatgactgctttcacaaagccagccatcgctgtaattattggctccgaattcagtaacaaaacgaaatttttttgccaatggcacaaaaaatcctggtctgcttttatgaccattttccggagaaatgcttaatgaacgactgatttacctgaagcttttatacgtacggcaattccaagaagcagataaataatgcaagtaattgaagtaatcaaaaaacttaatttgtcaaaaataggtgcgctctaaaaagcagagaaatatttaattattatcggatcaggatcacacaagaacctttaaaaaatcaaaatatgatccggtggtcatctgatcaccatccctagttgcattttggtacaccggaacagagaagcaaaaaccatagaccacagaaagaattgttaacaatgccaaatacagtcgcttttgaagattatcgtgactgaaaattactgtaattaatgataggaattattaatttgtatacaattccgaaaaagcaattccaatcagtcgatcaatgccagtgaaaaacatcgtcggaacaattgcccctgaatttaaatgtatttaaaatgtttatttaataatttgctccgtgcaaataccaagtccaatcacaggaatgaataaaatcattgctgccaagcggtactcaatgaaattttgtccagaaaaagcgttgtattgtttattcataaaaaataaaaaagtcatcagaagggcgaaaaccacttactctgacgactattccggtaaatgtgtcgtagagtaagtgacaaaatatatggatgatcacaggaattaaaaaaagacaaaaatatgtgaaaataaataataaataaattgaggtcaaagtcaaatgaggtcgaaataccaaatcacttagaaatttgttacattcttgctttcccggtcttacatattaccctagtgaactttaagttttattttaaattgatttagagaatttgtttttattagttctttatcgagttgattccacaattttgttaccctcccagcaaatggaatgaattttttgcccagtttgtattttgtgttaaatctataaaaggggatgttaaagcgtgctgatggattaaaaatagaaaatagtttcagatctgttcggccataaacaattttatgcgccatgaacagatcaaatagctttcgcctattctcaagtgttggcagttgcaggtattctaatcgattttggtatggaattggcggaaggctacatttaaaaaatactcttttggtgaaatattaaaaagtagcaatgaaaagaaaacgattcgaataatcccaacaatacacctgccaattaattaatgaaattacaccttttcttcaaatcaactaaatgaattataaaaattgaactcaaaaagggcaaacttcaagggattttttgttcaaattaaaataaaataatttaactgacatagaaaaatgaaagaaaagttcctttttatgcaataataatataattttattttgctcatttcatcttaatcaaattttgcactttttgttatgtaatggcgtaattaaataaaatgcgactctgagaaaattattttgattaaattttgtaatggaatattaaatgaagcaattagtgaaccagcagcttacactttcagacgttaatttatctgaaaacaaattaaaaatgaattactaacaaatgaacatgaaagcgagtcattaattgaattttacataattccaaggttaaacacctgtattaaaggaaatattagccgaaattcccactttattttttaacttttcatttaaaattataaaatttctatgaaattttagtttctgaagcatttaaatatcaaaaatgaatgacaataacgaagtatgcgattatttgaacatcaccacaaccaccaattccgattcaaataatttaacggcaaaatgtgccgttttggaagcgtcgcaaaatgtgaccattttcgagtggtttttcagctcaatgacgcaccaatttgtggtggcaaaatgcgcttatcaattcaaagtggcgcaagttgcggtaaaattagacatttttaattatacgggtaattaattaattacaaatttcagtcggatttttatcatgacaatgtgctcattttctatgagaaatatccaattatttctccagtgaccgcatggattgtgttgccaaacattttcacaccgatttcgatcattttcaatctttccctcattttggtcacaattacaacaatgtaattaaaatttttaattagttttttcaatatttttcgtttcaggagagatcgaaaagtttgtaattggctgatcgccttcgattcgctgtgccaactcttcgttgtcgcaactttcggcgtcaatttggtcggcgtcattttccagcacagtacgattgactactgtatctgtcttgccactctcatggccgctaccgtagcatcatatgactcaattatggcaatgtttctgatctctgtggagcgattgttgatcgttctgtgtccaatcaggtgactctccttatatatggaatatttattttatatatatatcttttttagaatgaattcgatcaaaaaatcgacagtttgccaatgttcacttctttccgtcattctatgcaccctttttggcttggtaatgaatttggaagtgtttaatatttggacaattattaacatcccttgcgacaggtaattaacatttggtttaaataaaataaaagttattttgaaattatttcaatttgttacggtattcagatgggtttactgtaacagtgggctttatgcggatgttctgaactctgttccctcttttgtcatcctctcactgtgctgcgctaattacgcggcaatttttggcttaattttgtggcgcaattttcnaatganaagaaagaatcanatgaattcacaangttnggncatnnntttaatttctttttttggtttctaattttttgccatttagctgctgatcagtcagtgcgca

SEQ ID NO: 6263 - DNA, 3015 bp, Heterodera glycines
  misc_feature (3013)..(3013): n is a, c, g, or t
aattgccgagcgcaaacgacgcacgaaagaagcgcaaaaaaaccaaaactatctcaagttggacatagagcaatctgatcgttgcttcaagcaaaaggtgctgtgatttgctactttctcataaaacaatcagctgacaggggaaccaattttctacagtaatttggcacaaaattctgtagatagataaaatactgtattctgtagaaagatttatgaaaaagagcagaaactgtcaccctccactaccggtctcccgccccccacccatatcgtttccccctgaaaatttttaaaaattatcaaaccgaaatttaaaaaaatactctagattttttcaaaaagttaggatggctaattagattttcaaaaatatttccaaaagatcacaaagtatttttcaaatttctttattgaagttttctaagattttttttgaaaaatttccaactttagtaccgattttaggtgctattgtttagccacttttgtgctattggttcctatggcttaaaataattgcatttagtcggctgttaccgtaacgcaagtcaaaaagaatgcgaaaggctcaaagcaattgccaacctctgcttctacttctaaggcggtagatttataattttttttttgcactgtttaattacagtaagcgcctcccatttccaaatttctttagcatgaaagcgttaccatgaaaaaagaagtggccgaagttgacaacgctaagaacgatgagcatggcttagaagggtaagtaatcacttagcatctctaatttttttgcgtcgtaaaaaaattacaatataattgaattgaaaaggccaggattttaaagaggaaaaaaatcaaaaaacggtggtattagttaaggaaaaacgccaagccaaaatggggatgtcattattttaggggcgaaattacaaaacaggcatggacaaataaggagcattaaatgaaaattttattttcattgtttttttttatttaaaaaaaacaaacttcaaaagcctctccatgaccccattttatgaaaagtcgctgcaaaaaaacaaacaaaaatttcataaaaaacaaatatcgattaatttttgacttttttgcgggtaaaaaaattatttttgtctttcatttttaaaatacttaaatttattaatcaccgaacaaaaactattcggctccagaaactgccttattttttagaaatggcagcaactttgacgatgatgagaaaaaggatggcgacgaggacgattaaaaagagactgttgagaatggatttattaaaatgatgaaaatatttattttcttttgataccgtatttttgaattagagccccccccctttcttttaattaaattccttttgaggtgtttaaaaaatagtaccccgaggggctctaattccgtaaatgctgcatttttgtcggcattttccgaacgaatttagcaccgtcactttacggattctttaaaaaattgcattctttgccaaatgtatgagaagatgttgttgcgctcatctatatttttgaataatttatccaatgcttaaattcgttttgtttaagcaaaatgttaccgtaatgcaagaaaccgaacaaaaggcggacggtccaacgcaattctcggccgctgcttcaaagccggtaaattgacaataatggaatatgttccttaaagtagaaaaaatcacaaaaaaaattgatttatcaaaataaaaaaatccgtttcaaattagcatggaaatgacgtcacggaaaaagaagctgaatttgacggaacaaagagagtcgggcaaggctttgaacggtaattaatgccctgctaataacgagtcatctttaattttaaatcataacaaaagttctttttggccgaaataatttttaaactacagaatttaacacaattatactgagaatacaattcttatattctttacaacaactttttttttgtaattcattttgcaaaggtcgaacgagacggaagagccgacgatgccaccgccatttgtcccatgccgacaagcagcagcccatatgtctgattggcaccattttttgtgtttaacaatgcgtcatttgttcaactcttttaggactgacaatggcaccggcaattacttcctcagtgcgtacgaaaagactgcgcagagaattggcaacgattcgaagtggaagaaaagggtacatttttgggggcatcttgttgagaaaatttcttaggcttcaatttcatattttagccacttggtcagaccggtctcatcaacttgggcaacacgtgctttatcaatgccattcttcagccgcttttccatacgcctggcttttctcaactgtttcggcaaaagagtgctcagcgattcgttaatgggtaagtcgagacaattaattaaaaattataatagaatcatttgggtttttcagaaactatggaacgaagggagtcattgccggatcattctccgctctgattgatcagattttgtctggcaatttcaatgcaattcgaccccaagttttcttggtgatttctctgttttgctattttattgtattaccaattttcttgaaggaattctttgctaatgtgaatgccgaattggccaacggacagcagcacgacgcccatgaattcctaatttatttgctgaacgcgcttcatgaagacaccaacagagtggggctttttagagaaaaagcgattttgtgccatttttttacccaactttcagttagaaaagcaacagccatttgatcaaaattacgataacaccgatttgagggccaacgctttcgatttctttgagaagtcaaaactgttcttttcttcgccggtcaacgatctgttcaatgtgaaccgatcactcactgatcactccgtaatgaccgtaattttacctctttcagctcactaccatttctgagaccaaatgcatcacttgcaatgcgtcgagtgttcgttttgagtccgtcaatcaattaaggtgggttttattcgcaanaa

SEQ ID NO: 6264 - DNA, 5309 bp, Heterodera glycines
  misc_feature (117)..(117): n is a, c, g, or t
  misc_feature (145)..(145): n is a, c, g, or t
ttgtctaccaattttgactgtctgaggctcaaagactgtctcgaggcacatttctcatcaccagtatgcagcttacttttagagtgatccccgatttggtaaattatttttcctttntagaatctcaatgatccatgggattgcncaaagtgcaaaagcaaacagccggcgactcggagcacaaaaatttggaagatccccgaaattttgatcgtccatttgaagagattttcgcataatgatggcaactttgtcaaaaatgaggtcgctttccgtcgggcgtcgcattttgtgattttaattttattgtaaaataggctcaagtgactttcgatatgaatgagttggatttgtcgccatatattcacgaaaagtctctgcttcccaacacggcatttactctttatgccatgacggtgaccaaatggctaaaactgtcctaattacgctaattgctttaatgcctttaagaagcatatcggcagtttgcaccttggtcattacacatcgactgtggttaatctgacaagcactgatcagcaatggctaagctttaacgatgagtcatgcattccgtgtgccaccgccccatcgcccacagtgagaatttctccccattcattagggaatcattttgaagattttgtttatctttttcagagcaaagaggcatatcttctgtactacaaactgaccaactcaactaactcacaggccaagtgatattaatattattaatttattattattattatcattattattatttgtacctgtgttctgttcccgataccatccgattgtttctttaaaattaattacccatagttttttttaacctttttttagtcgccagtaatatttaaagacagcgccccctaatgatattaaaacaaaattttgttcaaataaccacttcttaaatgaaatgacaaaaatcttctttaaaatgtgatgaatttaattgagtgactcaaaaattgcattatttctttaaaattgcagaaacgaaggccagggcggcaaaaacgacgatgacgacgaagatcaatctgagatggaaatctttaacagacaaatcaccgatatttgccaaatgttgcttgctcatcatcacaatgaagttgagaaagttggccggctttgcgcacaaatgggcgaagcaattcgccaagtattggccatccaacaacaaatcccaaatcccgacgaagttgaacaacaacatggggaggacaatggcagggacaacagaaacaattgttctttcgacgaagatgaaagtgatggcgaaagtgatgaccccacggtggagcatccgttgccagccgctcgtcgtgtgcttcgtcgtctcaaattgcccacaattcttgacattagtgccgcaaccgaagcagatgtgcaagaatatggcacaaaattaagtgacaccattaaacaaatcaccaaattacgcgttcaaaacggcggagcactgacaagcgaattggaattgcggagcaaacagaaacaagcacaaaatctgctgcaacaaattggcaatttaatgccacaattggtcgttgaagaagaggaagtggcggaaatactcaatttggccgaacaaagcgccgatcgcttttccattggatttctgaacaaggaacagaaaaagcaattcgaagaagcaattcgacaagcaaaaaaggtgtgcaacacaggggaatcaacgtcgggagggagcagtttgacccccccccccccccctcttaaatttccttggctcccggacaatccatcaatggtaaatctctcagcgcaataattattttgtctggtaaatcttaagaaatatttaaataaaaaagtattgagtagctaaaaaagatgaaaaaatccttggaagatttttttaataaagtatttccttataatgtcattctaaaatatttttatcaattgtctgaaaaaaaatttttaccgacggattgaccactgagcgattgtccgaatacctttcttccttcaccatcagtcgagttaagcattttgaaaatgtagaaatccattgatcggctgagtcattaagtttaacaaataataatttgtcaaccaccacctgtaggctttcgagattctgttgaagcataatttggacagtttggtggacaaattttatgaggactgttacaaaaaactgcttcatgttggcaatgaaatattaaaacgagcaaaattgacgaaagagtttgaggccaatatgctaagtgcgcggatcattggactaaacatgcggatggagatggtgagttgagaagacatagatatagcttaacaaacaaaaaaatccaatgaatttttgccggtaatttatgaacatttcacttttttgggtgtgggaaattaacaaggcatgtgaaatggtaccttagacatatttaaacaataagccaaatgtgtggttttcaaagacccgggttttcttggaaaagtattaaaattagaagttcaacttttattaatattttttagttttcttttatttttttaaataatgaataaaaatattttttaaaattatttttgttcgctactgttatttttgggcctttaactttgagaaatgcaggacatgaacagctaaattgcctattcatttgacaggcgtcagaaactgcccacgctttgctgcagacactctcccacaaaacacgtgcggtccggcatttggtacatgaagcacagaaacagcttcacgacattatcactaatgaggcggcaaaagccaaagacgcggacgaaaagcccacgcaatcggcagacaccaccaacatggtgcttattatttagagaccggtgtaataaaaatttattttcgtggaaaaaattatactaaaatggcattattttttaaaaaatttaattttgcaatttacaggagaattccctggcaaaaattcaaccaccatatgcagaaaatgaggacttggcagcactttttgactttgattctcatgtcaaaaatgcatttttgggttttggattgtttaaatgtttggaattggataagtccgagttacgaaatgcctatgaatggctaacagaaaacagaaacaaaatcggaagtcgtcagcacattttgacgttgcaaaatgagtttgaagcaaaaatgttgaagtttcgtatgaacaaattgttgtggaaaatgaaaaggtgggtgatggaagaaagaattgttaaataatttgcaaaatttaaattcctttaaaaatttaaatgtaagaatttaaaatttcacatttttatggcttactttgccctacaatttttcttaacgaatttttcgtcggtttctatccacttttgattagtgattttcggattgtcatttttcgaaagtttgatttgaaaatttattaagatagaatttaaaaaatgataactaatttgaaaaatttaaaaaaaatgaattgaagtttgtctattcttttacgcttaaattgttgggaaaacattacaaaatactaaattaataatttgtacagggttgaaaatggtgaacatgacttttgcaagttggcagaaaaactggcgaatgatcggattcagacggaaaggaatttgaaagtcgaagcagaattgacaaagaaagcagcgatctctgcgcagaatttgggtctgccggttgttgaacacataaacggatatatcgacgcaattaatcgttcacaacaggtgaaaaaaagaaccgaaaaatgttgtgttcatgtactgtatgtattatgatgtacatacagtatgataacacaagagaactcaagaaaactcctgccttaacgatacaatttattagcgaacattagtggttttctttcatttgcgtttaaagaacctgaaaaattctggaaaaccctgtttctatttaaaaaacaggacagggctaaaaaactgctgattaattgaattgatcactaataaaactgtgcccccccccctctcctctctagagcttcgagcgtttgatgggaaaagaagtggtcagtgatgctgatcagttatcatttgaacaactcgtggacaaaatcatgaacgacggcggtttctatgccaccaccgaatgcatgggtaaaacaaatgatgatcaaaaagccaaattaattttaaaataattaatcgaattaaagggggatttttagcacataaaaaatattttttttttgaattttcgccataattttgtgtgttgccaaaattgttaagaaaaatgtataagcgtaaaaatgaaaaatttagtcggacataaaaaatcttttcttcgcgagatcacacaaatttttaatatttttacaattttttactttcaaaaatttatcgcaaaattatataaataattaaaaaaattttaaattttattctaaaaaatttacttttagaaatgtatgaaatttggctcttaaattaaacaaataccaaataattaattattttttaatcattctttatcgtttaaattattttaaatcccaacatttaatttaagaaagggaaaagctgaataaacacaatgcgaatttgcgcgaatggcttatgcaatcgcacaacgaatttctgaaagaaagcgtcgagttcgagcagttcgacgcggaagacataagcgactggtggaaagcatcagcaaacaaatcggaggaaacagccgttaacaaaaacttggcattggtcgcgaaaagtgtcgaagtgatcgcaggcaaattttattcaaattggcaaattaataattacaatttaaatcaattttcattataattgaaaattggccattttttactcaaaaactggtctttgttacaataggttataagccgcggaacacccaattgttggccatctttctgcggatgtttgtgaagatattttgtccggaaatgcgcggtttgatgttgcaagtgtcgaccggcgaaggcaaatcatggattgtcgcgatgttagcagtgattctgcatacgtttggcaagaaggagccactggctgatcagcaggaaggggctcagagtgatcaggaaaaggaaaagcatggtcatggtgaaacaagcactgatcagacggagaaggaacctgcccatggtgcatcagacattgataaaacgaaggcggaagagtcccctcatggtgaattccatgatgaatcaggcactgatcagacggaggaggaaagcattgatcaaacagaggaggaaaagcctgcccatgatgaatcaggcaccgatcagacgaaagaggaaagcattgatctgacggaggaggaaagcattgatcagacagaggaggaa

SEQ ID NO: 6265 - DNA, 1539 bp, Heterodera glycines
agcgtcatagtgtaggaaaaactatcgaggcttcgaatagcctgtgccatcatgccatcaaaaatcagcccgggatttggaacgggatcttcgaatccgtttggccggtggttaattgcggcattttggctgcagttttgtcgttggtgaatttggtggccactctgcatcagtgagtgggggtttggctgtgtccgcggaattagtggttgttggacctcattaaagattggccttccgttttctctatggccaatgtcctgttcgccgtgtctcgccaattctgcatttccgtcttgtcgcatcttgacttgaagcagaaggcgtctaatttcattttcatccatttcaattccgttgttttcgttggcgaattggacatttccttcatggacaatcgatgaatttgtccgactgcgaatctgctcgaaattgcgttcggtcatccctctaagcaacggcggtcgaacaatttgcataattcttgaagacgcgcacaaaagtcggcgattccaaattcaaagcgttcgcaacaatgcgttaaataccaatcctcacttctcgcagcaatgcgttagcagtgggacgaaatcggtgaaattcgcagcaatgcgttaaaaagcagaaccgcagcaatgcgtttgttctgtcagaagcaaaagacgaatgcagaaccgcagcaatgcgttttgttctggtcgcttctccaaatcagttttttagcagtccaaaatccactatgccggcacagctaactcttcgcctggagcgccacgtgctaaataatgctgttcggtcggggctaaatcactgcttctcctccacaaatatttccaagacggagacaaatcactttatttaaaaccgcaacaataaaatgggagaagagtcggaggaaaataagaacaaaatacaaatatgaaagtgcactgccaacagaatgaactgaagggcaaggtgggggaacatattctgctgggaagggagtggcaaatatcgatagatgagagataacaattacagacaattagacaaaattatgaagggacaacataattaaaaacaaattaaacgccaaatttcaaatactaacacagacggacgccgtgaaattttgacaattaaagtgcaatttggtactggatttcaccaaaaagtccaatttttgcaattttgagccaattggggacgggttttttcaccgcttttttgcggcacgatttttccaaaaaattttgtgaaaccgggggcgggggtccgacgagaaaaactttgtatttttaatgcgatctgttaacagattttggtaaaaatattgatcatatggcccagaacctaaaatggctaaaatatataccaatcgatagctctctgtctgtatggaagaatccggaagaattttttttgcggaaaccaatccctgaagagttacagacccgggactgaaatggccaaatggctttgggacggaaccgtccaaagccttaaactcatcgaattgcaacaaaatacatatcaatcggatcctctcggtttgta

SEQ ID NO: 6266 - DNA, 4659 bp, Heterodera glycines
  misc_feature (4650)..(4651): n is a, c, g, or t
catttcagtcccgggtctgtaactcttcagggattggtttccgcaaaaaaaattctttcggattcttccattatagaccgagagctattaattggtatatattttggccattttgggttctgggccatatgatcaatattttcccagatttttcaaaaaatgaccaatttgcgagtttgtgcttattttttaataaaaattagagtttttggtcctggaccgccggcgaaaaatgtattatgaaaattcaaaatatcatttgaaaattgagtaggctcggcccacttcgatgggctcttccgtggcaagcggtggctcactgtcgccctcatcaaacccattcaaaagctccaatttgggcgccgcactgctcaaaacgaccattcaggcaaatgatgacaagcaaaaaagagaaagagagagagcattcccaagttttgagtttaaggcgagggcaaaactaaagcaaaaagcgaatcgaaaaagctcggcggcagccgccagaattcgtgccaattcccacaattcgaccacaacaacggcatccgccgccgcggtggtaatccaacaaaggcaccagcagcagcaacaagagtttctgacggccatttcccaggcacgccaatcggacgcatctatagacacatttttaaccgaaactggtgaacctttttttattgttttcattgtccattttaaattcaagcaaaattattttaaaatttaaaaattcgagacgaaatatttttaattttcaattatttatgagtttgaatttaaatttgtgtgccgcccctcatcacagagcctccgttgcctccccgactttccaaggcgcattccgaccaaacagtgacaaatctgatgaggataaagaaacagtgataagacaaagaatcagtgcctctgcctacgcattttgtataaattaaattgtaatataatctctgatatacaaagctatccaacagatacagtcaggtgcaaaagtatatgaacaaaaaaatttatttttaaacccggttttccatgagatgcgtgattggatgggaatcttttctatgccaaaacaaacccccaaaaaaagtcaaaaatttgaccaaaaggaatatgtatataccttttatctatatttatttttgggtttattttgctttaaaataaatcgattcgatcgaatgcagcagaagcagattaggcggtaggggtcagttgcgtcttagtacttaagggatcagttgcatctcaatgcaaattgttttcaatttttttattgaaatttttttttttgaaatttttaagattttttttttggaaaatttctgtttgaaaattttttgacgcgaactgtagagtctatcttgaatttattaaaaaaccaaagggggtttgcacttttgataataaatcgtgttgtttctttaggctttatctgacatccgtttcaatgaattgcatatccttaacccgaaaaaaaaattcgaaacttaatcttaagcaattatacgagttacatttcttacgagttgtcatgacatccgaatgtttgctgagaaaaaatccatttttttgttcgagttcgggtattttataggtcaaaacggatgccatatccattttcagccacctcgaaaacccctaaaaatatatcttcattgtaatttatgaatttctaaaaacaaaggtcatatttgtggtcagcgccacaaattaccctagaaatgactttatttgaaattcattcgtacctaaaaatgtattgttaccaaatgcttgagacgcaactggcccgttccgagattaggggctaatttaaaattaaatttgtttggctttctgtttatttgttaaaattttggcttacagttgtttatggcccttgctttattttttcagctttacagtgactaattatgcttttgttgtaaattacctaattgtttgccaattttaaatatcattggatataataaggatctgcccttctaattatttaaattggaattggctttgttccaaaagaactcaattttcgtctgtgagttttctcattttgcttctttctctttgtaaattgctcctcctctgtccgctttcatcgtcgataaattgattttcccaaaagagaggcaaattgagacacaaaggaagcacatcaaacagtgagggagcagagagaggcaaaaaggagaaagagtgtgggaaaataatctgactgagaacaagtcgcgtgacattccctcctctcagtcagttcatttgctccatccctcctcatttctcccatttattcgtcgcgtagcgaccgattcaagcaaaagacagagcagccattaaatgtgcatactatacatagcatttttcttttcaaagcatactttattgagtccatgtttttgagggcggaatttttgtttgtactctataatctgaaatattgccatttttagcagtttttgtttccttacctcattgacaattttttcttcattttgtgctgttttcatcatgagtgacgacaactgctgcggctctgttggtgcccgttctccgactggctccatctcatcaagcggttccgctgactatgacgttgccctttcgccaacccaattgcttgcaatggccatcaagaaacgtcgtcacttgctcgaggacaagcagcgcgactaccaacgggagctgctccactcgcacctcatccagaacttgtgtaagttcctcggtgaaggtcgagcgcgagtgaggcgacaccgccgcagttcatcgcggcgtaagttggtgagacgtcgtcgttgggacgacgacacgagtggaaacggtgacgagaggggccagcaagtggtccctgacgatagccgatcgccttcctcttcccccaatccatcggggattgtgtttgagtcgacggttcagagcgatgccaattttggtggtgatggtggaggccggggcccacggtggctcaacaaacgctcttctcactctgacgacgatggacctccgatgaaacgaaaccgggcggactcttccgaggatgggctcacgttcattgatctcaaccaaccttgtgaggttgggaagttcgatggtgagttaattcattttccttttgcatattttttctcattgttttcctttctttttaggagaatttgcagatggtggacggatattctgatcggaatggcatggtcgtcatgatatgattacagtttctttccttttttctacgtgtatttttttttaccgcagataaataatttatagatcacagcgagcaaaataatcactggaaggtcttttgtgtgtagagcatttatgcgttctctcatactggcaagttgaacgtataatttaaacgatcaatggtgatttgtcatttatccaacgttactttttctagttttaattgcagaaaatcgcaactttgcgcggagttttaagtaatgagtagtttctatcaaatctgtttatatcatttctttgaatagttttgtaaacgaattggtgtctcatcgttaagaaatgctcaaacattgcacccaaattcgttcatttgccacccaccaaagcattttctacgacgtggtcattgtcggtggtgggttggtcgggagtgcgatggcctgctccatcggtttgtgcttggcattgcaaaaagcattgggggcggcttttcaggcacaaattcggctttgggtccatccacgagggtgctcctgttggagagtggacgactgcacagcgtcaagcagtcaaaagaagccgaaaccaaacacacttatagcaaccgcgtttccgcggtcagcccatcctccgttgaaatgttcaaaagtaatcctgagtctctcaaccaagtgctttatccgagaatatccaaattcttacctatattgttgattctgccaatccaattccatcctcttcccttaaaattagccattccttttttattcagaattcggtgtttgggatgagatttgctcgaagcgagttcatccaatttctgcgctttacgttcgtattatttttctggttcaacccattaaaattagtgaagaaaagaaacgaaaaatcaggttgaggatggctgtgccaaatccaaaatccatttcaaacaattggataagcgttcaccgattgctcacatcgtcgagaatgagctcatcgtcgccgcactgcagcaatgcattcgggaccgatgtgccaatgtggaagtgcgccaaggcgcggttgttgaccaaaatttgaggtttgaccctcaacgaattgcggcatcaaagtttcattttatgtcttaaattggtttatggatgcatcaaaattatttttgactcggtggttattaagagcttttaaatcgaaacccaaagactgttgtgctttcgaacgttgaataacaatttgtgtcgggtcggatagtttcatttctcgcattttttcttctatgttcacttgcatttctgtgtttttaaggacattcattcatattttcagtgttcctgacaatctcggccaaaatgtcaccattcagttcgaagatggcacaattgaagcttcattgatggtaatttatgcgctatgcaacaaattttcacttttgtttcttcactttcacaacctcagattgccgccgatgggtccaannaacctgca

SEQ ID NO: 6267 - DNA, 5602 bp, Heterodera glycines
atttacccatatttcttcgacttttaagccatatttctttgaaattttccttagtttgaagattctggctttcgtttttgcaaaattttcttcagctgtttttccattgggacatatttgaaaaggttttaagcattttttacaccctaaaagataactaaaaaaggaaaatattcaaatttataaccgtgaaaaacgcatccctaaaaatataattcagaaatatttattttaattttttagtacctgaaattctataatcgttttgtatttcccacatataaaatcgacattaaatccttaaaaatataatgaataagtttttttaaaattaattaacctccgatatttacttctcccccgtttcccgcatgtctcgcgttaaccccatttttaaacataaaccactcgaaatattttatggcaataaaactttgattgttctttttttcaaacccccccctcagggactattgctatgtgtttcgcctttaaaaatttcgcccgataaatttttatggccgcccccgcaattgtggtcgaagtctaaattctattttaaaaatgaaatttgttttctaaccttaaacacgtcgaaaccattaggactaagttcatcccttgttatttctataaaaattttacgcattgctaagactgcctttagcaaaatttcggtatcctgaccacaataaattttcaattgctcctctgaaattgtttatttaaaaaataataaaacttttttacctaataaaaaaggcgtatcgttattttctttataccatttttgaaatttttcgaattcatcttttttcattgagtccgggtaataatcttccatggggggtagtgttgggtttattttacctttaaaacataaaaatatttaattaataattatttttttaccataatttttttctgagttatatttgtgtgggaaatataattttggagtgcagtccaatccaaatgtttttggcaattcggataatttattctgtgacatcagccaaaaatctctaaaaaacaaatttcccaactttatttgatacatttttaaatctgaaataattatttcaggtatatatcccaattctgttaatgcgcgcaaaataaagtgcgcatcgtaacgccctaaaaatgtttattataaaaaatttaattttttgattttaccggcgaaatgagcatagcaaatggtttcgaaatgtttaaacgatagcacccatgttaaaaactcgaagacggggtcaaagttgtcaaccgtacaccatgtgtggtgcttaatcccctttggcccgcaaatataaaaaactactttatgttcaaaaatcccctcattttttccattttctattaaattatccgtctaaaattgctaatattttttgtttattattttacatactgaacactcaatgtcgtagcttatgatacgataacgcggcagatttttcggaatgatgattttctttatgtagcaacctttcgattttgagtgcttgattttacacacattacaaaattttgagcctaaattatcgaaaaaatttctattggtaatttattttttaccacaaatatgtttttcccgtgtattatattcgctatcacactgtatgcagcgtttataaagtttgcaagccaatttaaaatggttctgataacaaaaaacattaaagaaaaatctattgcattttaggcattcttttagtacgttttcctcatttttacatggaaaatttaaccctaaacattttatatttttttttatttctgtacttgctttaccccatccgccgcaccgttgacattttattatgcagttaacagaatgttttattttttcacgaaatgtttgttcacaataaacgcagtaataatgttttatatcaaaaaactgtttaacactttttaaacctaaaaaatttttggaactgaaattatattgaagaaatttaccgtcccaatgtccgttttcgagaaaaatacaaattatatatttttttggtccctgacccttaaacatgggttttaaactccattcctaaatcatacatataaagttaagatttttcttttttaacctttgaaaacgccacaataagaaatttccctggaaattcttggtcgtaatactcttggacagtcaaaagatcatctatgccatagtttgttctatttggatcaattcttgtctcttggattagttgcaaaacatggtttttttgtcgttttttgtttttgtaaattctccgaaactgatcatatgagatctcgaaagactcattggctccgattatttgataaaatctgcttagtatgatcgcgtaaaagagacaataattatcgtcatttgcaactgaaattctcacattttcttttattttaaaataattcgttgaatttaattgattccctaaaaacataaataaaaaattaatttttttttaattacttgtgccactcgggattgcgtatgtggttattattattgatatttgctcatttaaaagatcgacctcactaaagctttgttgaatgaggtaaaatgattccagcaccacatccacattattctggaccaaatcccttggggggataattaatgggtcggttaatgcctcacagtaaaggtcgtaagaaatttttttatttgccatcctttttcgtttttttccagtgcattttttgttaaatattatattatctttttgaaattcttttttgagtttttttctgtatttttaaatataaatctcacaatattttcctttatgccaaatttgctattctcttttatcgtactcgagattcctataacaattaaatgcaaaatgaataaattaacagatgaaaaggagaaaaaaccaaatctattgctgaatctgatctgtaaacgaggagagaatgaacgaaaattgtttttgagaagatttagagaaaaaaactaaaatttctgtatgttcgaaaacataaattgcgttttctcaaaccgaaaaaaaacaattttagaaaaaaaatgtgcaaaaaagggttcgttctctccacatttccggattatgggtcaagttggtcttttaacgttggccttatgcaccaacacccggcgggggtggatcatcatgacgatcgtgccatcgtcgtaaaacgggtggcacaggtggcggaggcagtcgggcaactgagatttatttttttattataaatatgaaaaatgaattttgaccaaattcttcgggatcaatttccaaaagctgacgtcttcgtttttgtagcctagggtcacgtaaagcaattcaaataattatttttatttggccgatttcaaaaaattttatacctccgggtgtgggtggacggtaacgaccgccgttgcgtggcattcgatcgccattccctcttggcggcgggttcaaaggtggggccacttggggtccgatcaatgctggtggtggcggcggcaacggcggaggaccaaatggtccttgaaattgatgattgggctgaaatatgataactctttccctttagttctactgaaagtcgtttgacatcgccgctcagcattgacatcctagtgatgcagatgacgccttccctttagctctactgaaagcagttgtgaaaccgccgcgtagcattgacaccccagtgctgcggataaccccttcccgttggctctactcaaagtcattgtgataccgccgcgtatcgttgaagtctcagtgctgcagataatactgaaattcgttgtgatatggtggcgctgcattgacgtcccagtgctattgataacccttaccattggaactactgaaagtcgttgtgataacgccgtgatgtattgacatcccagtgctgcagataactccttccctttagctcaactgaaatcagttgtgaaaccgccgagtagctttgacagcccagtgctgcagataactccttctctttaactctactaaaagtcgttgtgaaaccgccgagtagcattgacaccccagtgctgctgaaaaccccttcacagtggctcgactgaacgtcattgtgataccgccggctctactgaaagtagttatgataacgccgagtagcattgatatcccagtgctgctgataactccttcacattggctctactgaaagtcgttgtgataacgccgagtagcattgacatcctactgctgctgataatcctttcccattggaactattgaaagttgttatgataacggcaagtatcactgacaccctagtggtgcagataactccttccctttagctctactgaaatcagttgtgaaacctccgagtagctttgacagcccagtgctgcggataacgccgaccctttagctctactaaaagttcgtgtgacatcgccgcgcagcattgacatcctaatgctgcagataactctcgcagtgactctattgaacgtcgttgtgataacgccgagtagcattgatatcctatgctgctgataactccttcacattgtctctactgaaagacattgtgatgacgcgagtagattgacatcccactgctgctgataatcctttcccattggaactactgaaatttattgtggcaccgccgcgctgctttggtatcccagtgctgctgataactccttcccattgactctactgggcgttgttgtgataacgtcgagtagcattgacatcccagtgctgctgaaaaccccttcatagtggctctactgaaagtcattgtgataacgccgagtatcatttacatcccatgctgctgctgataactccttcccagtggctctactgaaactctgtgaccctgtcgcgcagtattgtcattccattgcttccgctaaaaccagatgatcgaataatctttggtttatgctacacttgctcgtgagtttattttattataaagacattttaaaagaaaatattgtaagtagctgtgaatttcagactcgtagcgtacaccataagtaaagctgcagtcacggcgacacacacacacacacacacacgccccgcgcgcacgcgcgacatgctgtcatcacatttctttgatttatcaaaaaagggttgcattttggtcttcttttgcctaattttgcattttccctctataaaactataacttcgaaaagttaattctgcaaatctttgttattttagcatttttctacctaaaatttgcaacgttggaccattaattttgtgtttttgtatcttcaaagcactaattttgcattttccctctataaaactataacttcgaaaagttaattctgcaaatctttgttaatttagcatttttctacctaaaatttgcaacgttggaccattaattttgtgtttttgtatcttcaaagcactaattttgcattttccctctataaaactataacttcgaaaagttaattctgcaaatctttgttaatttagcatttttctacctaaaatttgcaacgttggaccattaaattttgtgtttttgtatcttcaaagcactaattttgcattttccctctataaactataactttcgaaagtaattctgcaaatctttgttaatttagcattttctacctaaa

SEQ ID NO: 6268 - DNA, 1843 bp, Heterodera glycines
  misc_feature (1799)..(1799): n is a, c, g, or t
acattcatgcaaaagtgaaatgtttgcataacctagaaacattcgctgcgtaacattgataatttaataatttttcacgagtttattcaccattttcgtttcaaataaatcagaatcattctgtaggtgtgaatattcagaaaaaacttcaaacccatgatcaatgtgtaagaaatttgaaaaaaatacaatgatgcccacatgttcttgctaacgttggtataaatgatcattcttaatgaatcattttcctccttggaaaaaaattcctaacaagtgctgtaaagtgtattttcctactgtacacggacactgaaagtataattcacagacctgaagaactgtcataccctctttcttcacctcaagttattttcttctatttttcatatatttttcaattattttttcattgtcaattttctctctcaataccctttctcttaatctctctctcccttcattcaatctctctggatgttttactctgctcccaatagactccacatcactatgctcggcatactgcaacacgcttttacggaatactgcataaaagttaaccgcccaattcccactaagcttaggtgcgagggtgtggtatgaactcttaatcagattactgatcattggcgacgaacttaccacatctgttaacccaaaaaaagggcaatagctgttgcacaacatccttcaatgatggtgtctacaaaaggttagcagacaacagcagatgtttggcagcatttcaaagaaagttttctgaggtcaacatcaaaagactccctcacaattcttggctgtaaacatccatgcagagggaaatgcttgaataacctagaaacattcgttgtgtatccctctctctaacgtttttctctcctctctcgacccctctttctctcattttcctttctctctctctctctctcactgtcttagtttccctcccactccctcctttcacactctatctcaatcacttcctcactcccttattctcttatctctctccctttctttctcttttcgcacactattctcactctctctcctctccctctctctctttttcacttcctctctccctttcctttactcttaatctcaatctctcgcccataactcaatctctatttttccttccttcctcctcctctctcatttcctctcactctctcattctcttcctttatttctcttttcgtaacacattttcattttttttctctcccctctctcgctctctctcagtcacttcctctctcgcacgaaaaatagttcttgacaaaaaatggctatctctgaaagtcactattaaatcactaccgtgaattggacatcaacttttgtcttttgttgtagcgctgaataaagcactaatagtgtgtttgaaaacgcacgaaaaatagttattgacaaaaaatggctatctctgaaagtcactattaaatccctaccgtgaattggacatcaacttttgtcttttgttgtagcgctgaataaagcactaatagtgtgtttgaaaacgcacgaaaaatagttattgacaaaaaatggctatctctgaaagtcactattaaatccctaccgggaattggacaccaacttttgtcttctgttgtagcgctgaataaagcactaatagtgtgtttgaaaacgcacgaaaaatagttattgacaaaaaatggctatctctgaaagtcactattaaatccctaccgggaattggacaccaacttttgtcttctattgtagcggtgaataaagcactaatagtgtgtttgaaaacgcacganaaatagttctagacaaaaaatggctatctctgaaagtcactatt

SEQ ID NO: 6269 - DNA, 5569 bp, Heterodera glycines
caacttatataattaatttttctgaatcttgagtagcattttttatttattcactatgattggtcaaattcttcgatggaaatcacaaaggataatgatatgtaagcatttaaaggctttaacttgaaaatcccaaatttagtggaacatataatccgggacaactttcatgattacgacgttccgtccctgccgaccaatgcagttcgcccacatgtttgtgtgaattgataaattacttttagaaattaagaacttcaccctcatttagcaaaggaaacagttcacagatttgccatttgatcagcaggagaaggctttgttcgaagattttctgtccgtttgtcgcgtgggtccatttgccattggcaaaacaatcgtttaatttttgtttctttttagggcatcaatgggccattcattcaatgcgaacaattagacaataacgaaatcatttgggtatggacggcggagaattggaaacagaggacggataatcagaacattgagcggtggatgaacgtctgtttcagcaaggcaccactctttttgacttgcttttgtgcatcggacgtacgcctttttccggggggggggacgtttatttgggtacttttttgggcttacacctcaaaatttaaaaaaagtttcacattcaataatttaaacgcaaaactcctttatcgctactttaatttatgctatgttaatggtacgcaattgtcccttaagcgtgccctttttgacattttttaaaattttgaggtgtaggcccaaaacggaaaaataccattaattatttgttgggtgttcttgaaaattataaatgtttcgcttgacactttgtccttgtctaaatttggttttaattcattttaattgcctcctcttcttgccttttcccctttcgttttagaacttcgtgccgactccacccgtggccccacagtttacgctttttgttcgcttgtgctgaagcatttggagcggaaagtgtacgctgaactgcacgagttggacaaattggaggtgccaacttttggaattttgagggaaaaccgcccatttaaggtaaaaaatctgatgacattgcgaaatgtgtccaacgaactgagacatcgccatttgctccctttgctgacaattgcccgggaaattttgctggtgggaaaacgaatttttaattggccattttgatcggttgcttcccatacaatcaatccgactgttcccccaaaaattttaaaccaattctaaaaggcggatggtttgtcttgaaaatgggcctctttttagttaatttttcattttgtttctcctcaaatttcggttgtcttttcccttctcatttcgctgtttctttaggctgacaaagttggcggtgaactgatcaattttctgttcgaccaaaaggagcggacggaatgttatcacatcgtttcccttttggacgagatcatttccgtcactttgctccgctacaatcagaccgttttcgaatggatttcgcagtgttcgctgagcctggacatgggccatgaggtgggacagacaaagccatttcggtgccaaatgatttcattttgtggcacacgatgactaattaattgacttttcgtcattttcctttcttttaatgcccccccccccccaattctcagttttttatttgggacttgcgcaaacaaagcgtagtcaaacgatccgatttcaattcgccggccctggacaatttcggctttgaccacacttacgtgtccattcctgaactgcttcccaaagtgtatgagtcggtggccgacgaactgctcaatttgggccgctttttgttcacaatgaaaaatcaaaatgccggtgagtgcgctttttggtgagacaatcaaatttttattctttttcagacattgagcatctgtccactcattacgaattggaccaaaaccttttcaaaaacaaaacattgcgcgagttttgtgccgcgattcacagtttctacggaaaatgctccaccaacattctcgatctcttcaaaaagcgattcaacattttgcaatttgcgaggttcgctgtgcccattagtcagaatcggctgggcgaccaaatattatctatttttaaaaattaaattttgctttttattttggcaggcatttgccccatttctttgtcggcctcaattcagcatggatttacgaattcgttgtgctgctcgaaactaccggattaaatggccctattttggacaacgatttcgaaatggacgacaacgatcgattcattgtgaacacgcaactgcaacttttgttgcaggaggcgttccgcgtcagttggcttcagaacagcccattccatgacaaaattgggtaagttttggccataaaaatgctgtttttttcaattttggctttttcagcgtctcactgatgcgtctttctcccacgagtgacgaccgactggcggaacacgagaaaagacttgaacaccgacttaagaacccaccgaagctggagctgaacatcgtcgtccccaaggataatgcgtcgaacaagaacaaggatttggcactgagtttggcatttcccccagtcgtcgtttggtcgtaccgccaaatgttttaccatttgttgttgctgaaccgggccaaacattggatgtaccggtgagagaagcaaaggatttaataagcaaaatgggaatatatttggtcctaaacgacttttgaattatttgagtaaaagcaaacttttcggggtttggatttgctaaatttgtctctgcaaatttcagaaaatattttgcgctgaaagggacgaattgccgccgcgaagaatttgccactgtccatcagtttctgcgcgtgctcaacgtgtacattgagtacctttgcggcatcgcatcggccgcttatcccaatttctccaagcaattggattccgtaacatttttatgttttaatctcataaataacgaattgtttgtttgttttgggtttgcactttggaccaactcgtcgatgctcagatgaaatacactcaccaactgatgggacagatgatgttggaccaaggctttaagcagctcaaggaattgctggtccaattggccaccaaattctgcgaatacgcccgggattcaattgtgagtcattttgtcagtttttaaatttaaaaagtaaaacaattgttgttgttgtttttcaggatttccacactttgaacagagaggcgtctcccctcgtcggagaaatcaaaaaaattctgctccaaaatcgggacggaggccccaccggcctcagagacatgtgagttgaagctgttcacaatcagttttccgtttttaagccttttcggctgctatttcactgccatcggagggacagcggcggacgaagagccaatttggcgattgttgtgccacgttgacgacgaggcgagcattaattgccatcaccgaccaattttaccataatttgcaaattccgtcacttttttcagattgcttttgcggctgcgtttaatggctgagttttcttcacttatttattttttaaacgaaaagagaacgcggcgggttaaatcacttccatttgactttgatctccaaccaatttttttatctgtgcctttcaacttcattgattaaattatttcttttctttctcatttttgattttttaaatcattttttcattccgtttccaaatcggccgataaaatgcggaatgaatgaatttaatgggttgcccgaatggactgctgggttatgatgccttgatcaatgggaaaatgtttgaagcggagggggggggctgccaattttcgcatttgtttcaatgccttcccatcccagcggaagacagacaaaacatcgattgatcaaaaaagtgctgctggcaataaaataatatttaattttggaaaggacatttaaaaaacattttttgaacatttctccgttttttcgctattttcaaccattttctgttccaaaatacgacattattcttctcaacaacgaattggccataattgggactgttttgaccacggcggcctttgcccccccccccgaaatgtttcccacttttggtcaaaaacggcttaaatacacggaaacaaactgaaagccatcattcctgcaataaaaaatcatataagcatttttaggacaaaaaattcggaagttaaaatgtgaactttcgattttttgttcgaattcgggtttaggaattggggtacttatacagtttgacccacatacaaatttttttttaatgataaaaaggtgtttccatgggttttcggggccgctgatcatgaatatgaactctatttgacgaattttcgaacccctaacccgaaattcgaacacttgaaatttttttttccaaaaatggttttaaatgtaccaaaatcccttaactatatactaagtcagccgaagccccgcccctatttttgaattggcggttaaatgctgttttgttgtaataggaaaaagaaacagaaaattaaaaaatataattggagattaatagagaaaggatgggtagaagagagagtgcagtgtatgtttctctgtcggcgcggatgggaggggtagagtgggtaacgcgtgcggttgtcacgcaggattgaatgcgtgcgagtttgtttatgtgtgtgatgagtgtgtaggagtgcttgggaataaggaggtagagaagaagaggaaaacaatagagagagatgaaaaaggaagcgagagagtgtacagaatgaagagattctaaaggaaggggagagagagaggactgagagagaaagagaagaagagatagggataaagagaagataaaggagaaaaagcaagaggacaattaaagagaaagcggaagataaatagcgattgagaatggggaaatggtaacgatagaaaaagagtgggaagactgagagatgacagagagagagagagaaagagagagagagatgagaggatgggagagagacagagagagagcagggagagagaaaaagagagaagggagagagaatgagaaagcaaagagagagatagagaagagaaagagctaagagagaggtgagaggatgggagagaagagagagaaaaagagagaaggaaaagataaagaaaaaaagagaaagaaagaaagagaagagagaagcagtgagaggtagagcgaagagagagagagagaaaaagtgagagggtggaagagagagcagagaaagagagaagggagagaaagaaatagagagagagagaaagagagagcgacgggatagagagagagaaagaaagcgggctaagggagagagagaaaatgaaatatagagagaagagagagagagagagagagagctaaggggagagagaaatagtgagagaaagagaaagaaaatcgagcagtgagagagagagcaaagagagagggagagagagaaaagtggagagagagagagagcgcagagagagagagaaagagggagaaagaaagaaagagagaaagatggatagagagaaagagagagagagagcaaatggagagagaaagagggagaaagag

SEQ ID NO: 6270 - DNA, 888 bp, Heterodera glycines
aaaaatggattggatttgaatgaaaagtgtcggcggtggcatatccgccgaaagtccctcaatgaatattcaattcatttttgctgtttttgtttcttttggcggaaattattattattatttttttgccccggtgaaatattttaatggcatttgccaaaataattattttaatttttgtgggattttttttttgctaatttaccaaaaaaaaaaaactttattttattgctatgcttctaaaccattattttaataataattactattatttttggaatttttaaatgtctttcccatttttgttcatattccgtggtgttaaattatttgttttttctatttttaatttctttctatttttatgctgattattttggtatatttataccgttttcttaatgcaaatttaattattttcggcaaaattgaatttattccaatttatttttgaataatttttccaaaaatgccaatttctcatttatttctttgtttaaaattgtcttttgcatcataaaaatggaaatgcttcctaataatgtgtgtttttggatgagtgtcaaccaaatttattcgtccgccccaaatttgtcccccggggcacagacaaaactcaatttttggaagtgcccaactctctctgaaacaaatggaccttaaaatccgggggggggggggcaccggcggttgaaattccctcggccactcaaaagcgaatgaaataaattcgccgaactttttgaacaatttaatttttcaaaataaaaataaaaaaagtgttcggcctctctttttccaattttagcatttctttttcatttcgaaagtgctttctctttcactagtgctattgaaattgattaattaattaaattcaaaatttaa

SEQ ID NO: 6271 - DNA, 1408 bp, Heterodera glycines
cattccaattacttggactcaacccaccaccattctaatcactgggactcaattcatcagcattgcaatgaacgggactcaacccactaccattctaatcactgggactcaattcatcagcattgcaatgaacgggactcaacccactaccattctaatcactgggactcaattcattagcattgaaatgaacgggactcaacccactaccattctaatcactgggactcaattcatcagcattgcaatgaacgggactcaacccactaccattctaatcactgggactcaattcatcagcattgcaatgaacgggactcaacccactaccattctaatcactgggactcaattcatcagcattgcattgaacgggactcaaccctccggtgtgccgatcaccgggacttaacctcaacaatttttcggcatcccaatcactggaactcagtcctcaagcattcgaatcaccgacactcaatttcaccaattcttgggcatcccaatcactgggactaatttagcaaatactcaacattttctttttgggtgtcaggattttcaccgggcgggggaaggctcggccgcttcgcggcctcacacccggcacaacatttattagcattttactcttctttttggcattttcttatggccaaccagcggcactcattctccatttttagcatttccatctttgtaggcttaatcacaataatcttcggcataccaatcactgggactcgattctccggcattccaaaacaaaatcaaaaacacaccactctttaactaactaattcttttctctttaacaataacaaatcttagtaaaataacaaattttttttctaaaacaaaaattattaaaaaaagaaagtttttttgtaacaaaaaatgaatacgaattagtaaaaaaaaaattcacgaaaatgaaaaacgcgtataaaaaatcaaatctaaaaaagataaatttcaaagtgcactaaatgattcaaaacaatcatttcctttcttttaaaaatttttaaacaaataaaagatgggaaataaaaaagggaaggatgagagacaaatttactattgtctctccctttcctttatttttactcttgtttcttttctattgccatttactctccctttttcccctctcccacacacacgcacgcttccaacagactgctgctgctgcacagcagcacgcgtctgcctttccctctctctacttttttcaaatacatttttatcgcaaaattcaaacaaaacgccacacaaattcaaatcactgacacatgatacacacactcaactttaatatataggaaagcgtaaaatattgtcatttttggactaaataagttaatagattgcactaaaaattcaaaactttccccggcgacgccta

SEQ ID NO: 6272 - DNA, 4432 bp, Heterodera glycines
tggctctgtgaggttctccccccccccccccccgcttcttccaggccataggaggctaggcttttcagtccaattttttctatctgcgtctctctttgctgctgctgtttcctttgctttacatcgcgcattcattagcttaatgttctgaattttgttttttaattatcatttttctttataacctttgctcaaaattgaatgctatgaaatcggactttttgaatatagtagggatggtattccaagaccccacaaaaatttagaactcaaaatgtttcatcaattataaatcggaatttcgtgcctttcctggtagaacacagtcattttttaggttgattcacatatattaattaatttgttataattttgcaaaattttgccatttttatgattacagaaattaatttggcctttttggcaaatttataggtactcgtttatgtttatgatgtattgtcacatctattatcgaaagttttaatttgataaatcaattttcatgtagaaaaataagaaataattcttctaacataacttatatggtgaaaaaggtccattacaccaacttgatcaaataactccttcatggtgattatgatcgggacatttcaatttaaaattcgcgacacaatttccttttaaatggtgggtctgcgaataatatccgctgagatagtgatgtaatcaaaattggttgaataaaaaaaatgaattttgaatcattttccctttaaatacggttccggtacctttatcacctctttcctcatttaattattatacttgtagtcaaattaaatgctgttatatactgaatttttggtcttttgtcatttaaccttgaaatctggttgaaatagggatcgtattccgattcttgacgtttcttatctcatcggatattcgacgtggacataagaatataaattcaccaatttaattttattatgttggcattctgaattgctttgaacggctacccaccttgtttattataaaatgggaaaacattgcagaacattgaatttaagcaataagatgagagaaaatgagaatgaatttggtgcagtggaggagggtgtggggtggggctgatcaaaaaaaattctgtgggccaagtgaaggtgcgggggctctgctcggccttcttcactgccacctctatttactttgcacagacagcagggtagggcttttccattcaaaaattttttatacctgcatttctctttgctgctgctgctgctttcctttggcttaggtcctccattcatatttctgttttttaagcaaacagctaagccccatttcgatttttgtgttactttgcacagaagtgtaggcttttccattcaaaatttttttgtacctgcatttctctttgctgctgctgctgctttcctttgctgttttttaagcaaacatatacatttgctatttttgtgctcatttcgtgcttaaatatttgaattttgatacatatttctcattctagtgcttaaaatttcggttcttttatcatctcttttcctcatttaattattatacttgtaatcaaaaatgaatgctattaaatcctgaatttttggtcttttccccttgaaatatggttgaggccacaaattagtcgtggacataagaatataaattcaccaatttaattttattatgttggcattctgaattgctttgcacggctatccaccttttgagtacatatttttctttctctggctcttttttctttaacaccccctaccatttcgtctttttatcattaactctctcttttctttatatttttcaatttatccatatcccatccatctaatcatgctaaacaaacagtactaaaatctgtcccaattgtttagaaatgctgctatggtgggcctttttacttttcttccatcgtgttatctttcgcccagtcgattgtgggagtgagttgaagatttcggtttgtagttcatgtaaaaatttttagagtttgaagacgccaaggatattctgagcagctttaagtcggttgtggatgtgcccttatcaaatgacttcaaaaaaagccaccaattcattgcattaagcatgagcttaatgaaaagaaccgttccatttgcagagctgtttgcaacggctttgaaagttggtcttgaggtaattttattcaggtcatgccaagtcttctaaacatcatacaaaaccgaatcatacatacttaactcataaatatcaactcatacacatactcaattcctccgtgttcaactcatccactgcacgatgcagatcgtattcgtggcatttctagcgttgtggtgtttcccgcaccaggggcactctagcatttattgcatttgcaatctgcattttgacctctcttatgcgtggatgaatttgattacgggtatggatgctggatgagctgggtatagatgagtttggcatttatgagttggtttataccccggttattattttttaccacggtttgaaaaatggtacaggaagatgaattgggcgcccttttaactcttacaaaaggcatcgatgccaaagtccgtgacatcgccagtcaacaaaaatacatagcgtcatctaatgtttatcgtgaccttttgcttgagtacgaagaggtaggttcttaatcaacatcatcattgtggtacgattattgaggctttgatatttgataattcccacttggagaccgacatccgaggattaccaaaaacgtgggtccgaaatttgtggacccaatctttcataacatgcagaacccacaaaaaatgaactacttttttcatcagaataaagaaagaatgcctttcccaatggcaaaagtcaggatggcattcggaggcccgaaaaattttcgaaaatcggaattccgactccaaaaaggtcgaataatcgggtcggaaatttttgaaaaaatagaaaagtactaaaattttttaaaatattttaataggatacattttaaaattcgtaaacaaaaaaatgtgaattcaaaaatattttgtatatttatctatctgcttgaaaaattattcaatgatttaatcaaagtctttttatatcattttacaatttagaacatttttggaaagggactgacaatttacaccttttttgcgacgctcttttccaaaaaaatgccttctctggtgtgactgattatcgaaaatttttatttggaatctaagtctcccatttttcaaaattattgtgcatgacgcggtatagcaaagtttgagacgaacaagaattccataatcataatttgggttctcaatctcgtaaaaaccttcaactacatttcgtatagacaaatatttatctgaatatttttcgttatcgaattcttttcatttctttgggtccaactcccattttcccagaagaattggacctttatgaatgtctttaattgccaagctctttttatttggagagaaaacttagtttcacttgtttaggaattgttttatcctaaaggtcgggtccacaaatgttggtcaatcctcaaacctcggtcataaaggtcgggtttaaattgccgagtccttaaaagtaaaaatcctcaaaagtaaagatagatagatatattaatacctaatttagaaggtggatgaaaaaatcacttctttgatccgacaaattcggatcatgtcaagaatgcgatttaaagttgagaaatcggtaatagatgcgtttgtttatgattgcaacggcggagcaaattctcccggaagtgttgcagatgtgagtatataaaatctcttaagaataaataaattacgtaattcctaagtcctgccttaacacccaccggcactttatttggcacttttttattaattacatgtcattatttttttagaaatttttagatcctggaattttaaattaccgagatcagagccatgactggaaaatggacctgggcggaacccctggatcggaactctcattttaccgggtcccaattattgggctaaggtcatgcaacgaactttttccccaccaactttttccgcgatttcctttagaaattaataaaccgaaattttatttattgatcaacagttatcttaacatataagtattgttcgaattttataaaccagattttttgggttttcataaaaattaattttatgcagtgcctgaaatcccgggaaattttcgttttcgtatttttagacctaaaatgaatatttagaaatttaataaaactaaaatattatttattgatcaatgaaaagtcaaatatcttaacacataaggagattgttacatttttataacccatagattttttgggttttcataaaaattaattttacgcggatcctgaaaacccgtggaattttccttttcataattttagacataaaatgaatatttagaaatttaataa

SEQ ID NO: 6273 - DNA, 1176 bp, Heterodera glycines
ttttttcaaaaatttgaagaggtacgcaaaaattaaggaataccggaaaaaaatttaaaatcacaccaaaatgggaaaggaaatttaaaccttattttccttttcattctcagctggtcccctgcgaaaatttggtgtatttccgatcagaaccgcgaaaagctatgagtgcttgaattttcactaaaatagctaagcataaagtttttcgctcgtttaaaaagcaagtaaaactttctagaatttttattcatcgcccttcttgatagtaaaagcatcagagggctttgttaacttgaaaatataatttggtgcgtttcagatctctctctgaaaaaatattaatgaatttattttttcaaaaattcgaaatgtacgcaaaataagaataccgaaaaaatttcaaattccacaaaatgggaaggaaatttaaacctaatttcctcttcttctcagctgttaccctgcaaaatttggtgcatttctgatcagaacgcgaaaaactatgagtgcttgaattttcactaaaaaagctaagcctaaagtttttcgctcgtttaaaaagcaagtaaaaatttttagaatttttattcatcgccctttttgatagtaaaagcatcagagggctttgttaacttgaaaataaaatttggtgcgtttcagatcactctctgaaaaaatattaatgaatttattttttcaaaaattcgaaatgtacgcaaaataagaataccgaaaaaatttcaaattccacaaaatgggaaggaaatttaaacctaattacctcttcttctcagctgttaccctgcaaaatttggtgcatttctgatcagaacgcgaaaaactatgagtgtttgaattttcactaaaaaagctaagcctaaagtttttcgctcgtttaaaaagcaattaaaaatttttagaatttttattcatcgccctttttgatagtaaaagcatcagagtgccttaattaacctgtaagataaagtactcactcggccgcttcgcggcctcgtgggggggccttcgggaatttattttttcgagaatatgaaatgtacgcaaaagaagaataccgaaaaaatttcaaattcaacaaaatgagaaggaaatttaatcctaattacctcttcttctcagatgatagactgcaagatttggtgcatttctgat

SEQ ID NO: 6274 - DNA, 1543 bp, Heterodera glycines
atttaaacctaattacctcttcttctcagctgttaccctgcaaaatttggtgcatttctgatcagaacgcgaaaaactatgagtgcttgaattttcactaaaaaagctaagcctaaagtttttcgctcgtttaaaaagcaagtaaaaatttttagaatttttattcatcgccctttttgatagtaaaagcatcagagggctttgttaacttgtaaataaaatttggtgcgtttcagatcactctctgaaaaaatattaatgaatttatttttttcaaaaatttgaaatgtacgcaaaataagaataccgaaaaaatttcaaattccacaaaatgggaaggaaatttaaacctaattacctcttcttctcagctgttaccctgcaaaatttggtgcatttctgatcagaacgcgaaaaactatgagtgcttgaattttcactaaaaaagctaagcctaaagtttttcgctcgtttaaaaagcaagtaaaaatttttagaatttttattcatcgccctttttgatagtaaaagcatcagagggctttgttaacttgaaaataaaatttggtgcgtttcagatcactctctgaaaaaatattaatgaatttattttttcaaaaattcgaaatgtacgcaaaataagaataccgaaaaaatttcaaattccacaaaatgggaaggaaatttaaacctaattacctcttcttctcagctgttaccctgcaaaatttggtgcatttctgatcagaacgcgaaaaactatgagtgattgaattttcactaaaaagctaagcctaaagttttcgcatatttaaaaccaattaaaaatttttaagaattttattcatatccctttttggtattaaaagcatcagagtgccttaattaacctgtaaataaagtttggtgtgtttcagagcactctctgaaaaaatattaatgaatttatttttttcaaaaatttgaaacgtacgcaaaataagaataccgaaaaaatttcaaattccacaaaatgggaaggaaattcaaacctaattacctcttcttctcagctgttaccctgcaaaatttggtgcatttctgatcagaacgcgaaaaactatgagtgattgaattttcactaaaaaagctaagcctaaagttttcgctcgtttaaaaagcaagtaaaaatttttagaatttttattcatcgccctttttgatagtaaaagcatcagagggctttgttaacttgaaaataaaatttggtgcgtttcagatcactctctgaaaaaatattaatgaatttattttttcaaaaatttgaaatgtacgcaaaataagaataccgaaaaaatttcaaattccacaaaatgggaaggaaatttaacctaattacctcttcttctcagctgttagcctgcaaaatttggtgcatttctgatcagaacgcgaaaaactatgagtgcttgaattttcactaaaaaagctaaagctaaagttttcgctcgtttaaaagcagtaaaaattttagaatttttatcatcgcccttttgatagtaaa

SEQ ID NO: 6275 - DNA, 2295 bp, Heterodera glycines
  misc_feature (2144)..(2144): n is a, c, g, or t
ctcaacgattttattgcttattgaaagagctagagccgaatatatttttttaatttaagcctaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaatttttcaaaaaataaataaacagttaaaaactcagaatttctaaaaaaatttaaaaccaattacaattgtcattttttcaggttaagttagtcctgtaccggggagtatgcctataaaatttggtacgattttattgcttattgaaagagctagagccgaagaaatttttttaatttaagcctaaactttttggcatgtttaaaaagcaattaaaattttattcatctccctttttgatagtaaaagcatcagagagccttatttaacttgtacataaaatttgatgcgtttcagagcactttctgaaaaaatatttatgaattaatttttcaaaaaataaataaacagttaaaaactcagaatttctaaaaaaatttaaaatcaattacaattgtcattttttcaggttaagttagtcctgtaccggggagtatgcctataaaatttggtacgattttattgcttattgaaagagctagagccgaagaaatttttttaatttaagcctaaactttttggcatgtttaaaaagcaattaaaaattttattcatctccctttttgatagtaaaagcatcagagagacctaatggaaaaaaatccccgaaggagagaatttaattaaatccattccttcgggggtccgtgccgggtgccgcggggtaagcagtgctggtttcgtttcatcacggcccccatccttttgactagtaagccagcgttgcttaacttgtcagatcggacgggtacgcatgattccacttttccaagcaccccaccgaaagtagaacgaaataaccaaaatataaggaaaaaactttaaaaattttttattcttcacccttattcaaatataagcctaagaggactttgttaacatgtaaataaaatttggtgcacttttgatcagaacgcgaaaaactatgagtgattgaattttcactaaaaagctaagcctaaagttttcgcatatttaaaaccaattaaaaatttttaagaattttattcatatccctttttggtattaaaagcatcagagtgccttaattaacctgtaaataaagtttggtgtgtttcagagcactctctgaaaaaatattaatgaatttattttttcaaaaattcgaaatgtacgcaaaataagaataccgaaaaaatttcaaattccacaaaatgggaaggaaatttaaacctaattacctcttcttctcagctgttaccctgcaaaatttggtgcatttctgatcagaacgcgaaaaactatgagtgattgaattttcactaaaaaagctaagcctaaagtttttcgctcgtttaaaaagcaattaaaaatttgtagaatttttattcatcgccctttttgatagtaaaagcatcagagtgccttaattaacctgtaaataaagtttggcgtgtttcagagcactctgaaaaaatattaatgaatttattttttcgaaaatttgaaatgtacgcaaaataagaataccgaaaaaatttcaaattccacaaaatgggaaggaaatttaaacctaattacctcttcttctcaacgattttattgcttattgaaagagctagagccgaagaaatttttttaatttaagcttaaactttttggcatgtttaaaaagcaattaaaaattttatcatctccctttttgatagtaaaagcatcagagagccttatttaacttgtacataaaatttgatgcgtttcagagcactttctgaaaaaatatttatgaattaatttttcaaaaaataaataaacagttaaaaactcagaatttctaaaaaaatttaaaaccaattacaattgtcattttttcaggttaagttagtcctgtaccggggagtatgcctataaaatttggtacgattttattgcttattgaaagagctagagccgaagaaattttttttatttaagcctanactttttggcatgtttaaaaagcaattaaaattttattcatctccctttttgatagtaaaagcatcagagagccttatttaacttgtacataaaatttgatgcgtttcagagcactttctgaaaaaatatttatgaattaatttttcaaaa

SEQ ID NO: 6276 - DNA, 3849 bp, Heterodera glycines
  misc_feature (21)..(21): n is a, c, g, or t
tatcaacagtctctctgttgnaccatttttgtaacatcagtaattttttccacagtctgtaatgttacgtactcgatttcaccgtttagtgttttgattccaattttgactagtctcgatgaaatgaatttgggtttattttggttaaaggtggatattgccaataatttttcgtcaattgttggtaattgaagggaatcagcacattcgtccgttatataacttttttgtgacccattgtcaaagaaaattacttcgttttgtgttctgttttggtcgggatttaatactggtgcttccgtggtcataagcaattcttcttcgtcattttgtataatgttatgattttgatcggaatcgattgacataaatgtttgggtttcttcgaattcttcgggattttgcgtgacgtttacttttgtaaattgttctctttgattagattgatttgattttcgggtacataggagggtattgtgcttgcttttgcaattgaaacatgaaaaaggtgatttgcattccttcaaatgatgtccttttttcagacagtttagacaaagttttaattcgcgcgctcgattacttcttttttccgtggttgaataaattttgcattctttgctcaagtgattgtctctttcacagaatcgacaaaatattatttttgtttgtggtttgggttgcgatggttttggtttaaattctgccaaacggacgggttttgatttggttgttaatgcagaagtgatgggatagggcgagagaggcagattttgatggtttcggtggtttgcttttagctggggttgggaatagtttgggtatgattgcctttgtggtctgttttgaggtggccggtgaggggggaaatttcttatttgtctgtttgaatcttccattcgttctatgtcttcacgagcttgagtgtgtgaattgagaaaactcattaattcttttgtcgagtaaagtttgaatttttctctcagttttagtcggatattgaaggggagtttagtctcaatggattgcttgatttggggatggtttatttcttcgccttgggattgtaattgtaggataattcggtcaatgaataggataaatcgtctcagttcgcttgtggattcatttggttttcttaaatttcttaattcgctgtgcagattttctctgatcaattgtggattaccgtatcgggatttaagtaatttgatgattatgggataatttttgtttgtgagggggtaaggggacacaattcggtatggttcgtcatgtaagagtcctcgcaagtatttcagtttttgtatgttctctaagttttggtcattgtggactgatgatttgaaatcgtcccaaaagctgggccattgggagaattttccggagaagtgtgtcagagtttggggtggaagttttattctcgatcgataattgacaaaaggtgtttgtttacggtttatttggtcatttgaggtcaattctggtgaatcgtcttcctggtcactgtcgtattctttttcttcttcatcttcttcttccatttcttcatcttcctcttcttgttcatcagcatttgagtcagattcctggtcagtgtccgaaagagactttgctctaattgttttgagtcttcttttcacacccaaatttatgtctttcagagtgtcgaggatttcgtctgtttccttaattgtatttaaataatcatgtttttcgcgaaaaattttctggattttccattcggttttccactgttctttgtccatttttctcatcaaattttgccattttttatgcaaagtttttaatttttcaaagtttggctcaattttttgtatgatttcttttgttttattgaacacccgtgtgcattcgtccagattattttggtcaaattcaaatttgttttcctcgatttttgttttgatcgactgaatttcttttcttagcactcgattgaggagagggattttgctcctgataaaatcagacattttttcctttaaaaatgatttgtgttgtttcttaattttggttggccaatttattcctttctgcgattgtaatcagttaatattttattgaggtaaacaattatcacaaaattaaattgggtttgatcacagtttagaaatttttgatcacagtggtcatttttatcactgttgttcgtctgaggatttgcttggcttcgtctccgtttcttttgtgttggttggcccgaaaagtttgttgtggtggggttggctccttcctttctttagttttttcactccttttcgggtttggaggtgcgcgggatgccgttgggtggtcttttttcactgaatggggatttgtttgtgtgttgtgtgtgtgtgttttttgaactgtggggatattatcccttaatttcgagtgttgggcttggtgacccttttttgtgagttttttgggtttgtgaccgtgtttactttcaaatggagtccggtggtgaatggttgggcggccggtgttcttcagaaaagtggcgacgtgctttcgaagggtcggttgttgtggtccggtagaggcgggcgtgcaattgttcccgggtcgtggcaccacttgtacgctttcgatggcgcacaaatgggaggggtaggaatttggcgagatgtgggggtgctgatgagttcagtggttggtagagggccggcgctgcttggtggtgctgggctttgagttgtggacgagtagtgcgagtcggcggggtgggggcggctggcgcaatggtgaccaggagagggactggttgtggcgaaattttggggtggacgcttagcggtcaatcggggatggtggaattgctgggggtcaagtgaggcgggaaagcgattcaaaatacactttattggagtcctcaaacttgggtaattaaaccgaagggggaaatgggggaacggcacaaaatgggggacggcagacggcacagaaatggggacggcacaatggagggaaaatgggggacggcacaaaatgggggacggcacaaatgggggacggcacagaaatggggacggcacaaaatgggggaaatttggagaaaatgaaacggtattgaaatggggaaaacggcacaaatcggaggacggcacaaatcggaggacggcacaatttggggacggaacgggagtggtcggctcggcacacgtcaacggcacgggacgggcggcattgagtgggcggtgtgtcaaggcggtagtcgggcacggcagggcacggatcggcatggcacagaagtcggcgcacgaacggacagggccaagagtcgacggcacgaacgggcgggcggcgcagttgtcggcggctgttgtcggcacggggggaaggggagggaggaaaaggaggacgaggcaatgcctctcagaaaccgttggtgtactgattggtggggggtttgtggcctccttttataccggcagtttctgcttgaacaattgtttgccaacttggcatgtccaaatttctgtccctaacatttgccaattttactaaccttttctcattttccagtttgtgccactttagccttttccaattttcttaacattttacaatttctttaatatcattcacattttgtctcattttaacatttgtttaaaatctgttatttcttttaacgttccaattattcataattaaattttaacatttgataatttttcggatagaaaaaattgtgactaatatgactaatgttttttcccttctctcattccttcattttgttcacatttaattaattaatatttatctgtctaatttaaaattaatttaaatgttttttgtttttaatgtttttattttttaaattaaaaatcc

SEQ ID NO: 6277 - DNA, 1613 bp, Heterodera glycines
tgaggcgggaaaagcgatgaaaatgcactttattagagtcctctaacttgggtaattaaaccgaagggagaagaaatgggggaacggcacaaaatgggggacggcacagaaatggggacggcacaatggggggaaaatgggggacggcacaaaatgggggacggcacaaaatgggggacggcacagaaatgggggacggcacaatggggggaaaatgggggacggcacagaaatggggacggcacaatggggggaaaatgggggacggcacaaaatgggggacggcacaaaatgggggacggcacagaaatgggggacggcacaatggggggaaaatgggggacggcacagaaatggggacggcacaatggggggaaaatgggggacggcacaaaacgtcggcgacacggcacggcatcagtggtgcggggcggcggcacggaatgggcatggcacagaacggtcggcgaacgggtcggcttggcagtgaacgggcggcgcacggatcgggcatggcactgaacgggtggcgcacggatcggcttggcactgaacgggcggcgcacggttctgcacaacagtcggcggcacgaacgggcaggcggagcagttgtcggcacggggggaaagggaagggagggaaaggaggacgaggcaatgcctctcaggaaaccgttggtgtactgatttgtggggggtttgggccctccttttataccggcagttcctgcttgaacgattgtttgccaacttggcatgtccaaatttctgtccctaacatttgccaatttttctaaccttttctcattttccagtttgtgccactttagcctttaccaattttctaacattttacaatttctttaatatcattcacaatttgtcccattttaacatttgtttaaaatctgttatttcttttaacgttccaattattcataattaaagtttaacatttgacaatttttctaatggaaaaattgtgactaaaaatgactaataattttccttcatttattccttcattccattcacatttaattaattaatttttatctgtttaatttaaaattaatttaaatgttttttgtttttaatgattttattttttaaataaaattttctatttcgcgtggtcgcgacaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaa

SEQ ID NO: 6278 - DNA, 1607 bp, Heterodera glycines
tgccaaccaacgcaaccaaatacagcgcaacggccggcacaattaaatcggcagacggaccagcgaaacgataggccaaataaagctgagaattaaataattataacccaataattttaattcggaaatagcgaaattaaatttaattaattttcaacggatcttctaagctggcattaattggtattaatcccatttttgtatttttgaatgattgacaaataagtcgaagtttatttgcttctaataatttgagccgaacttaatcgacacttaattaagcataaaaaggcaaaaaatcattaaaagatgaaaagaggattaaaaattataaaattccgagaatatcaaattaagcaaaattttattttcctatcgtctgccatttttgtgttaatttggccaaatttttgttgaattttcgttggattggaaattatttaaatttttatttgccaaaatgtcatacaacattaacctttaatgaccatgacaaagcctttcgttgaattggctgacaaactaatgaggtcgtctgtcttgtgatttaatgtatcttttcatttttgtttgatttgtatttggaaaatttaatgagaaaataaaagtgggtaagcttttgttgtcacgacaaagttacaaatttcatacaatattatcactagggaaacgatttacaaattttaaattggcaaaatgttcagcctaccagtagagaagggtgttaaaattggtcaactcaaaaaatgacggattcctactgtattttaaggaaaatgacgacgatcacttttttgttatttgatggcttttggggaattgatggaggttccaattaggaattgacaatttgtagggcccggaggttgaaaaagtctgtgttgggaatcgggatggcagggccgggatccagggaaaatctcagcgggatcccgacccagtacggcctctacatcttatctttttggccatccttttcaaattttacaatatcgcggatcgtcgcgttttgaaattttatccactaaacggctatatcgatgggtggctgataagtgatcagcgcaatgtcgaggcccagctgaaaaggccgaccaaatcgaacacccgaagccatcgtcccactgataacgacaacggacataaaaaactaatagaatttttgagaaatttatgattcacaaataatattgcttctaccattttttctgcttttcaaatgaatgagaaatgaattttgtatcaaaatttttcatttttctatttaaaattgtaattagaaaatttcatgagaaaataaaattgggcaagcatttattgtcacgacaaagttacaaattgcatgccaaattatcactaggcaatgatttttaaaaatatttaaaagaggcaaaatgttatgcttcggggtgacttttgactggtgggaccggtaaattggacaccagaaagttgggtaccaagcggacacatggattttctctcgagaggggggcgggggcaaaggcaaagccaaaggacggcaaatgatgcgcaaacacagcaaaaagaaatcatcaaaatgaacattcgagaatggtgtctagctaggtcggtcaaacaaaaaa

SEQ ID NO: 6279 - DNA, 1945 bp, Heterodera glycines
agaatgccaaagtttttttgtttgtttttagctgttctaactatgtcatttttcactgttctttgaaatgccgtttaataaatatggcccttccaagatatcattaggaaatttaaataattagaagcaattagcaaggattcattcgaataaacttattcgaattcattaaaaatgacattgtaaaaacataggtgctaagtgaaccgaaaaaaagtatcattgcttaaatggattaaccagggaacattaactgatggaagtttccgagaagcgctttatgctcgtcaattcgcggattggatgtaattagagcaaaggggccaagtgggagagggaggccaattaagggcaatttgaggacagcagaacttaattagcctgtattaagaagacgaagacatatcggcatttaaagcctcaggcgcaaaagcgcggataaaattaatttttcttttaatttatccatttttttttttgatcatctgcctttttgaaatttatatgcaattttttttataaatgcaaataaattttgtctcaataataaaagcaaaaaattttggggacaaactacagaattacccaaaattcattaaaaagcctaaaaaattgtttattattttttaaatcaaaaaattatttcgctaaattatttatttccctttctccgaatcacaataagtcacccattttaatcagataatgtgaagcaaaaaatcattggtgcatttttacattaacattctttcatattagtagtcagcttgggagtgaatattaattcatttggctctacggaaaaataaaaattctgaccttttgcgttttcccgagttgaagctttttataatttttttttcacttcgtaaaagcttatcaatagcttttcgacatgtgtagctttcgaataacttcaaatttataaatttggacaaccaagaaaaaagttatgatgctttaaatttggctcagacggaatgacctcctactgattccctaatgacctcattaaagcagattatatataatgacacccattggagcattgggaataattctttttgcctacgggcttactatcctgctcggacattgctcaggtaatcaacaaaacattatcttatttaataagcataaatttaattttaaattgaaaggattgaagtgcaaatccggcgaggatatggacgagacggactattcaccatacataaatgccacaactaaagagtgcatatttgatcagcgatattgtttgactgtctactgttttactggtgaatgaatgactcgggatatgcacagtagagatcggataaagggccggagacccatccatttatacgggttttcatgggcttgtaacccgtcgtttttagccaataggctttttaggaggtatggcttttttcgcccgtaacccttggtgtcaaacgaaaaaccctcttatccgtggcattttttatgcggtcttggtcgtggcatttttgcattgagcggtctgcttcgtgccattttttgtgcatggatgagtatggtatatggataagttgggtataaatgagttgggtttacgtccacttaccccttactcatccataaaaattccgatctctattgcacagtgtgtttatattggaataaggaccccccaccttccattttttgtgtgacttttatcagagtttgccatgagccgacctagctaaaattttggctcccggaaaatgtttcagtaatacagtatttctaaaataagtactgtaacattaagtattgaattacaaaaggtcgttctgaattttttttttcttttttttttgtattaacattttaaagaggttttaaaataattttatccaaatacccaaaaataaatatatgtattaataaatgaatcacataagttggcccgtttttaaattaattacataaatgtttt

SEQ ID NO: 6280 - DNA, 1902 bp, Heterodera glycines
  misc_feature (21)..(21): n is a, c, g, or t
tctatagaattaatatttatnaggagataaacaaaaagatattcacccggtgggactcgaacccacgaccttcctttccgtggaatgctctgaccaactgagcttcgggcacccatcagcagtagggggcctgggtcagttcggcacataaattacacaacttcaaaattacccacagctttttaaaaattaagaaattagtattctcaacaaacaatatttattattttataggactttgttaaaaattaaaaattttgcaacaaattgtttctttattttaaaattttataatacatttttcaaacacatttttgttacaataagcaaatatatgtgaaaatttataaaaaaaaaactcaaaatatgttgatatgagtttattttattaatctccacttggcaacctgggtttttcctaaacctggattttcctgaatttttgcccagtaaatccaggtccaggcttttttcaaaatgccgacctctaattaaaacaatcaaagttatgaattgcaaaaaattaattaaagttatggattgcttgattggccactacgaccacaatggatatggcttggttaagaatggcacatgcaataaggaggacagttttgctttgtcgcacgttgtgcatcggtctccaactgtacaggtaaaacaatggtttacggtaaaatgccgaacatactactgtatgtgtattcaattgtatcttgtaagcaattttatttccctgtcacggcattcggtaccaccgctaatttcatcagtcggcaatcttaaactaattacaaaaatttctttatataattactttttccctcctaaaaatactttcaacagacatttcgttctttcaacattctaattacctaactagctaaataacaactccatattcttctagcaagaaaagtatgatggtttggagttgcgcgagaagcattcccggcgataaatacttgtgccaatgccaatttggtgagcagggcgtcaactttggcaacgaaaagcggcgcctgcccttagcgatgtataatatgtacaaataattaaaataactttataattaataaatattaattacataaaattataattgaggaatgtgtgtaggcatgaaaaacaacgcaatgaattattttgaggggcggcagctttttttaagccttaataatttttggttgttggcgatcggctttaaaatgggatcttcccccggggggataacgaaaaatgaactcggcttctgggcctattcccaatcttatattaattaaaaattttaactgtttctcctaacaattttctatcattttaagtagagaaaaaaaagtttattattattattatttttgttaattctattttttataaagcatttcgaatttttgtgatggcgggccaataaatgccatcgggaattgaaaattggccaaattttttaaaggatatttactcacaccgaaaacgccggagagtaaaagcaggaattttggggtccatttttcaaaaaaaaacgtatggaaaaatgggaatccagtggcggtaggggtcagttgcgtctgagccaagcataaaacatcataacttttttcattgttggtaaaattttataaatttggcatcattcgaaagctctacatgtttagaagcttttgataagatattgctaagcgattgaacaaattataaaaaagttacaacatgaacactaccaaaaagtcagaatttttgcatattttaatttataacttttttatatgtcggtatgtctttgtgatttttggatagccgatagagcttgttaagctctttcgaatgataccaacattgttggatttggtcaacaaagaaaaaagttatggtggtctaaacttggctcagacgcaactggcc

SEQ ID NO: 6281 - DNA, 1334 bp, Heterodera glycines
tttcccggttttggcagccaaaaattcccggtttttcaacccgaaaaggtcccggtcccggttgaaccttaaaattcccggtcccgctgcactctaactattattattaattactaggcatttattaaatatttttatatacttttgacaaaatatttttgtatttttttggtaatttatttttgtcgactatttatttcgggcttttctaaataaaaataaattttcatttttatattcgtaatttaggttatttgaacacgcaaataatgccaaggccggacgccgtttcaaacccaaggaaaattgccagaaagtgaaggaacgtatcgaaaatatggcgaagcgccaaatggaattgcttagcaacgactatttcaattacggcaaagaaatgtttttggaagattttgtgccgtaaaagaccgatggagatgacatgccatcggaatctgatcggccagaaatatatgtaaaaagtgtcaaaaatgcgctaataaagttaatacgatcaaaattctttagaatttatgtatatatccgtttttttctgaaatagaatcgaaaaatagaactatgggctttattgtatatccaggaacacggtggttttgtcaccccccccctgaaattttttaaaaataattttttaggcaaatttttgattgatctcaaatttggcgtttatttgggcctatttcgaaaaccggacccgaattcgaacaaaaagtctaaaattacattttaaaaattcggtttttcttctaagatagattaaaacaatcaaaaaataatcacgaaccattacaacatcaaaaaattatcattatgcacagcagaaagattcaaacataaatatgaatttctgaaaaatccgaattttcgactttttgttttaattcgggttcgggattcaaaataagccaaaatggatgcaatattcgagatcgcaacgccaaaaaacccttacaaatattttttcacgactttttaaaacaaaagtttttctgccgaaataggggggaaccacctaactaatactttttcgtcttcatgtcatgtgaatttttacgaactcactgtaaacacgttgtagctaaaaaaaatttcagatttgagatcactacattaaatcagcctagaaaaaaaaatttcaagggggggggcgtgacaaaactctgaaataccagtagttaccctccaggtttcgctgtagggtgtgaaaatgattaatgggttttttttccctttgatctttgccgccggcccggaggggggggggggtgattaataattaatgaggtgagggggggctaattatgaggggggggggg

SEQ ID NO: 6282 - DNA, 1501 bp, Heterodera glycines
aaaataaattttccctttcccattttagacaaatgttcgacgaggacgaaaccgacaggtatttttgcgaaccccggacccgaattcgaactattaccgtaataatttcccgctcacatttaaggtgttcaagctgaaaggcaatgttgaaatgaatgaagctgatcgaacagccaacgaagtgggttttattgaaatttttaaaaattcaaaattaaaatttttttttaaggaattggacaatgagatcaacaacagtgtcaatgccaatgccaacaatgggacaaatgccgaaacggtaagcaattgtaattaaattttcaaattttaatcatttccccattttgatttaaggtggcggcagcggggatgagcgacagcggtgccaatgccaacaatgggacaaatgccgaaacggtaagcaattgtaaataaaattttaaaatttaatcattttcccattttgatctaaggcggcgacgatgaccgagcccggcggaacaaacggtgccaatgccaacaatgcccatcagcagctgagaaagagggtcagttttggacaaatgatgttgaagtgtgggcccatgttggcccaccattggtttttggggtcctgattgggctcacccctgaggtgtgggcccagattgggctcacccttggggtgggggcccatgttgggcccaccattggtttttggggtcctgattgggctcacccctcaagagtgagcccaaactgggctcactcttggagtgtgggcccatgttaggtcaccattggtttttgggaccagattgggctcacccttggggtgtgggcccatgttgggcccaactttttgttttttctttggggctctgattgggcccacccctgaggtgtgggcacagattgggctcacccttggggtgtgggcccatgttgggcccaacttttgttttttgggatgtaggctctattgtgcattaatgttttaataaaataatttttttcataaaccgcgttcgggggcagccaagcgaagagcgaaggagcgatctgttgctcaaccaagagcacctgctgctacttgctaccaacatcccgcacatgccgtttccaatgatgatgccgatgatgatgccaatgatgatgcctttcaatttccccttcccgcctcctccccctccaccatcacaacaacaataatttttttttgcattttcacatttatttttatgcattttcatttatttatttttttgcttaccttcaataaatcaaattacaaaattcacgatcgaaattttgagttttgcttaaagtttactaataattcaatcaatgacagtgatcaaataaagatggcaaattttattggtttatgaaaaatgaaaatattaacgattaccgtaggcaatgaaaaaaaagtgatgatgatcaggtattactgttggagtacaattacacaaatattgtaaatacttaggatccaaagcaaataaatgtggcaaatttt

SEQ ID NO: 6283 - DNA, 1167 bp, Heterodera glycines
taagtaggacctctcttgtcagacaattagttataaatgagcattttttggcaggatcagcagcagatgcacggcatgaggctatcgcggattgacccgtcaaaagtcgcgctcacacacggaaatagcggaaaatgccggggaacgcggcgccagccacgtaggcgccgccggcagtggtcacgggtcagtgccgggctcgacgacattctcccgacgcaatcttcgcttcattataccgcaggtaaacgccgaaggaatgctaaccgccctccttagccaaacttttcctttgaatttgacttttttttgtgccaaaaaccattccaaatggttaacgtggcaacacttggcatttgccaattcagcagataaattaaccggaaaaagttggtttgtcatgtgtgaaaatttaaaacggaaataactttgccagtctttagcctttgctctttcatctctctccctctctctctctctcttcctctctcttcctttctctctttctctctcttcctttctctctttctctctctccctctctcctctctcttcctctctctctctctctttctctctctctctcttcctccctctctctcttcctctctctttctctctctctctcttcctccctctctctcttcctctctctctcctccctctctctcttcctctctctctctttctctctctccctctctctctttctctctccctctctctcttcctttctctctttctctctctctctcttcctctcttcctctctctctctttctctctctccctctctcctctctcttcctctctctctctctttctctccctctctcttcctctctctctctcttcctttctctctctccctctctctcttcctttctctctttctctctctctccctctctctctttctctctccctctctcttcctctctcttcctttctctctctctctctctctcttcctctctctctctttcatctctctccctctctctctctctcttcctctctcttcctttctctctttctctctcttcctttctctctttctctctctccctctctcctctctcttcctttctctctttctctctctctctctccctctctcttcctctctctctctttctctctcactctctctctcttcctctctct

SEQ ID NO: 6284 - DNA, 5978 bp, Heterodera glycines
gggccaaaatgaaaaaataaaaaagggaaatggggaaaaagcggaaatttgcgaaactgaaaaatgcgaaatgaaaaaaaagcgaaatgggaaaacgcaaaatatgggaaaagcgaaatgcgaaatttttttttaaaaattctaccaatgcttttgaggttgtgatgcaaaaaaaaatcttccggttcgatctttttctcagataaaaaatgacaaattctacccattttgtggttaaaatttcaaaaattaaggtaaaatgaaggtccggcgttgccgataagcgccgccggaaaattttttggaattgtaataaaatatggtaggaaaagttgcaaaattttcaaaaaaattactgtttttttaaaaaaataaatcgcaaaaaaggcaaaaaaatgcaccaaaaagttcaagataaaagcttcaaactaagttaaaaactcgttttcgtgcatattaggctatagcaagttagcaaaaaggtaattattagagttgcacgggaccgggaattttgacaaaaaccgggaccgggacttaccgggaccagaaaagtcgggaccgggacctcgattttcgtccgggactgggaccaaccgggataatttttgaaaaaaaatttgaaaatttgagtgcactttgttacgaaaaattgcctatattcaaaaatgtacccataaaattttttaattctcgtttgtggggagaaattcgaagaatttttccattatgcaattttgagtgtaatatgttaacagaaaataataaactgaagcattcgttttaaaaattaaattttcaaatatattcatttcttaggggtggaaatttcgcatttcgcgccaaaaagcgaaatgcgaaaagcgaaacctcggccatccctggtatttaccatttctttttaatcttttgtaaaactttctgctccgttttttatctttgtcttttctcttctgacttttttatttcaatgcgttttcattttgctttcatttatctctgaagaaatttgagccgttccgtcggtggccggcgggcgacaaatacaaattggaccggcaaaatggaaaatggggggggggcaattaaaatttaatcaacaaatatatttttgtaaaaagcaaattgaccattttgtttgaatttggcaggtgtcaatctgtgatgccgaaggtgtcccgaaagcagcgaacaaaaacagaaataaaaataacaacaacgacagggaggaggaggaggaggaacagaagttggaggaggacggaaatgagaagttgggcagcgaactgttcaacgatgaggacattgtgaacaacaacaacaacagccaaaagaacacggcaaatttagggggtatttgaaaaaggaaaattggtaaaatttgggggaaaataattaaatttaagtcaccgaagcggaggacgacggaatgctgacggagcaggacaaacagttgcgcaaggtgttgtccgacatggaccgaaagcaactgacgttggcacaacgccgtcaaagcaacatggacgtaaggggaaagcgaaattgtgtaattaggcattagcggcatttttagtgctattgtgaaatgttttgcattaattaatttatcacggagcgaaagagtcattaaaatgtttaaatttgcattaatttaaataccgttaattgccctcacgtcatcgtcattctctgtgcttatgccctcttttcacaggttgtccatcaggcgagcggtcgtcgcacttcgacaacgctaattccgttgaccagcgcccaaatccatctgatcagatcactgtggagacaagtaaaaaatggggaaaataattaaatgctaattaattagttttaatgatttcaaaattgaaaaatgctttccgtttgtttttgtcaggtgtatctgagcaaaggcccaacggtgatcggctcacagatcagtcatcggctgttcttcaaggaacccgagatgcgcgagatgttccgacgctgcgcattgccacaacagttcgccaaccatgacagtttttccaaggtacaaacagcaaaaataagttaattatgccgtgaattgactatttagtgctctaattaaactttttcatcattttttccttttaaggcgcactgtaagcaaatttcggaactgattgaccaggtgggcattgtgcaattgcccttaattaggcattagcgttgcctttatttgcccatttgtccaaaggttgtcgagagtctggacgatctcgagcaagttgggccattgttggagcaggtcggacgatgccatgcgcacatctccggaggacaactgtcaagtgaaacggaaccaaaataccaaattaattttgaaattgctgaaaatcttttcctacctgaggcaaaagaaagattttctataaaaaattatttaggcaaactttggaactccgtggccgaaacattcatcgactgcactttggagtggggcgaccgcagggcacgcagtgaaacggtgcgcaaggcgtgggcactgatcatcgcttacatggtaaaatggcacgaaaaatgaacaaatttggagaactattaattaactaattgattgacaattgaaaagaatttattttaatatcattttaattaagtgggaactatttattaattacattggccaaattgacaaattaaatcaattaattaataataattcactcattaattacaattaggtaaatagagaagaatttttatattatttacaggtggaacggatcaaacatggccatttggaggaggtatttattttattaattcaatgcttttaggtttagtcattgacaagccaagcaaaaaacatttaatttcgaataattttatttttttttgatttcattttatgaccgctcttttcgtttttgaattatccgccgatttatttcgctttttggcacttttcactctcttccgtttgtttcagcgtcgtcaaatcagtgccatccgctcgaccattgcgtcgttggagcgcgtggcgttggcgtccaccaccgtgcagcagccctactatgaagtgcagcagccgaccacctcgagcagcactcagctgcctgtgcccgtgtccagcttctgccacccgatccgccgcgtgtccgccttcgccaccaccggcaatttttcagacagtgccgccgcagcagcgcgagctgagcagcacggacgagcggccgggggagcagcggtgacgaccgtcggcacaatgccaaagtatccgatggaaattgcctcatctgaggcgtgctcactcgcaacatatgccaacgcttcgccctatgcaaaccgacgacgccacgcgcaaccgccgccgtcgaaggcgtccgcggagaagggaggtgggcaccaatggcacaatgccaaactcaaataggaagcaaatgccaatgccaaattagagagagagattgtttttaaagagaagaagcatcaccaccaccaccatcaccaccggcgcagttcgtcttcatcgagtcagcagtcgccaatgatcggatcggttggaaccgttcggcgcacggacggcggtgcacttgcgcaacggacaaagcgcacagacgcggctcggaagtcaacatcaaacgtaagggttatttacgcaacaattaaccctcattattaatttggatgggaattgaaaacggagcaaccgcatcatttggagtttgggagatgtcgtgtcatatttgggagggcattaaccaattttaaaccaaaatactattagcatgtttggcccttcccttctgttcggcttcatctctctccacccattctcgtcaattaattctcaacctcccccccccccccaattcccttttaggcggctcttcccctttcattgggcagtttgcggaagaaaatgtcggtgtcaaatgcgtcatcaatgcggaaacaaaacgccaaagaatcggccgatggttcgcggcgccaatggacggacatttgaaaaaaaaaacgaaaaagaaaaaacaaaaccacggtgaacacaagcggaaattgtgatttgattggtgaaaagcagcaataacagcccgttaaattaaaagtcgatagaatccgaattattaccattttgagagtattatcaaaccgcctattatcagtatcaattcaaatcgaactttattcttttcttttttattctgcctcattttccaccaaataaaggacgaccaaaatttaccgatgattttacgacttttattctgcaatttgcttattaaatattaaactcaaaaaacattacaatgaataattttatttttattttcattatttaaaaaaataaaggcataaatgagaagagaaatgtttgagttgatcggaatgatcaaatactatcagcagatatcaatcactataatcagagatagcagaagtgagagtttcttattgccatgcctttcagcgggaataattgaattttggcgatgccatggcatttatccatttcctaattcatgcaatcgaatttggccattttctatgtccactgatcagcaaaagtactcgcgtttagttgtctcatcatcaggcacgtgccgataatgccgtttctcctgctgttgttgttgttgttgctgatcaccacctgctgcagcactaagcagtcgcgtgtgcattagcgttggtacgcccgcgaaacggacattgccgcgggcggtgccgaattcgtcgccgttaccgtactgctgctgcttgtggtggtcgtcaccgtcgcttaccgtaccgcttccaaccggcacaaaagcgttgtgctcatgcgttttgtagacaccgtccggacgacgctgaatgtacagcaggaagacgcacaacgacaacaaaatgcaaagggcggaggcgaagccaatagccgctgaaaattaattaaaaagcaattaattggctattacgagtgattaaataaatgaaaaaacattaattaaatgggtggctattacgggtgatgaacaacagttggcgttgacttttcatcaaattggacgaggtcgcgtagatgtccgcgtgttcctccgccccattttcgcgcggcgaatcgcccgccattaatgaggacggcattttgcgatgttctctgaaaatgtgagtggattataaataggtaattgaaattcaatttaaattaacaggttgtcgtagggacagcttccgaagcgaattttgccggagtattggagacgcgacccccgcgggtctttcagcggaaatgcgtcgccgaccatcaaacgggcactaaatgagcaaaaaattggggggggggggtaattaggagcagagaaataattcaaataaatgggaaagcggttaattgggctatggcaattcacattttgatttccgcagctttgtgcttaataagcctaagccagtcaaattggatgactcattttgtgcagagtttggcacattaaatttgaaatttaccaataattgttttgattttttaggatgttaaaggaatacttgaattgtcaattaaattctgcttttatataataatctcttataaaactgacatgcatccggcaaagttttggtcgataaattgccacgaattgaaggcagagaaaaaagtgaaattgccctccaaaaacagtgcttgttcaccattaatctaaatgaaaagccaaatttaaagtgtgccattaaataaataattagcaattattattttattattattattacgctcatttcaaggccagtcaaattggcacagaagtgaatgtccttggatttgttgtccgcaaccaaaaagcgatcagacaaagtgacattatgcgagaaggaaaacccgtcaaaaatttgcacatttaattggcctaaaacaaacatttcgcagtttgatcagtagactgaaatggcacaacaatcactcaatcagttggcacgcccttccggcgccatgcgattaaaaaacaacaaaaaatgatgaaaaatgtgca

SEQ ID NO: 6285 - DNA, 1080 bp, Heterodera glycines
cattttgcgatgttctctgaaaatgtgagtggattataaataggtaattgaaattcaatttaaattaacaggttgtcgtagggacagcttccgaagcgaattttgccggagtattggagacgcgacccccgcgggtctttcagcggaaatgcgtcgccgaccatcaaacgggcactaaatgagcaaaaaattgggggggggggtaattaggagcagagaaataattcaaataaatgggaaagcggttaattgggctatggcaattcacattttgatttccgcagctttgtgcttaataagcctaagccagtcaaattggatgactcattttgtgcagagtttggcacattaaatttgaaatttactgacatgcatccggcaaagttttggtcgataaattgccacgaattgaaggcagagaaaaaagtgaaattgccctccaaaaacagtgcttgttcaccattaatctaaatgaaaagccaaatttaaagtgtgccattaaataaataattagcaattattattttattattattattacgctcatttcaaggccagtcaaattggcacagaagtgaatgtccttggatttgttgtccgcaaccaaaaagcgatcagacaaagtgacattatgcgagaaggaaaacccgtcaaaaatttgcacatttaattggcctaaaacaaacatttcgcagtttgatcagtagactgtaatggcacaacaatcactcaatcagttggcacgcccttccggcgccattcgattaaaaaacaacaaaaaatgatgaaaaatgtgcagctgttttttttgcaatggaagtacaattaaaaaaaaaattcaattttctaaattattaataatttaaaaagccgccttttcgctgttaaacccaaaaaatgtgttaattgagataaaattgtggctgaccaattgtgtcgattgtcatgttgaaattggactcggcgaacagtgcccgggcgcggattctgacaaaataaaatatttaaataaacggcgtttaattaaatttaattgattttagaaggaattttcttacagtgttatttcggggacgccga

SEQ ID NO: 6286 - DNA, 6261 bp, Heterodera glycines
aatatccaaaattgaaaatcgtaagttagcgttgataattaagacattgtttctagtttaaaaccattaacagaatataaagtaattcacttattgtgcggattagacaattccaacttttttttttaattttttaatttttgtgtctttttgtttttttattttccaaaaatagggtcaagaggtgtcgttttcaagaactgtccttgaaaaatgtacaatgtgagcaaaatatcgaataatgtcaaaaaatctcttaattagtttcaagcttcaaaccaaattcatgaaaaataataaaaagtacgtttgcttttttctttgtcaattataatacttaaattctttttaaaaataaaaaacattttcatttttggatggagggaatcctaaaatttttttttagtaatttaaataattttgggaaaatttctaaataaattattaataaaaattcaagtggcggataaattgagacatcgtttgaccagtgtcttctttttatacagcaatctttgccggtgattgtcgcgtcaatgttgccctgctattggctctaccgcgaagtggccaaatggatgttggcagaacgccaaaaagccggcggcacaaacaccgtaacacagtaccacgaatggattgacatgtactgtagtgaagagtatgccgaggcggtggacgaaatgttggcacttgcggatgaattagcgcaagaagcggatcagcggacacgcgcgaaaatggccaccgtttttgagcgcggcttccaactggaatggatgttctggaagtccgcctatcaaatgtgccaatgggaaatttgattttcactaatagctggcaaaaatggctaatgcctaattactgttgggtttaatttgtgtgattagagcatggaaaaacaaaataaaattgtgaattttaatcacttttttaccttactcaagcttagtagtttacgataaattatagattactgtttaattaaattgattcactaaatgataaaaaaagtggaaatttatatttttagtcaaattttggttaaaaattaaaagatattggaaaattttttaataatacttgagatatgtattttttgtaaatatttttttgttttcgttaatttatcacatggtaaatggaaattgaaaatacaatcgaatcaaaagacagagaaatatgtagatagaagagtgaatgtgataaaagggataggaagaaagagaggtagagaaaaaaagacaactttgtagtgatcacgatcatgacataacatgaccattgagcataaaaagcatcagtgatagagatggggtgggagtgtgtgtgtgtgtgtgagagagagagaagagcgagaaagagagagcgagagagagagagagagagcgcgagagagaaagagagaagagtgagagagcgcgatatggagtacggaaaattaggcggtggacagaacgatagatgtactatagatataacttgtttagtttttccaaaaatttcagaatcttcacatttgaacataaaaaattaatttttaataaattttttcctgaaatttaattgtacatttgttatatccatcatattgtccctgcctacggtttgtatttgttagtaaaaatgtatagtcgaggtggtggcatgtcataaacaaaatggaaaaatagaaattcgctcaaaaattatcatatattaaatttttcgactcccattatcgatttaataattctggggaggaaataagcaaatcgtatattcagcgaaatcgggaccagggacggcgaagctcggctcatcactcgaagccgaagccgaagagcgaagcccaatttttattcgaaggcgaagtccgaagttcgaagctcaaaaaacccgaagttttcgaagccgaagccgaagtttcgcccgtccctgatcgggacaaaaaaaccagatttttaacaaattttttgcggcggatttttccaaaaagacttttgggatggggggggggcggggtaaaaactatctatattttacgattctgagacaatttttttaaagaaatttaaggatttttagggtacggtggtgcagataggcgccgcccggaaaatttaaaaatttctagataaaatactgatattatgtcataaaattccaaaatttatgaatatttttaagaagtcagaacaaattgtgccactaccccaaaatcagaacatttcttagaaatgagaacagatcacacccctgctttaaacagacacggaaaaaagggtgagggaggggtcaacgaaatttttgcgaaggggatatgtttataaaattttggaaaataagggagtcataaaatatttatataaattttcaaatgtaacatttatttagcaaggactatttacgaaaatttgcaaaaattaataataaaaattgaaataccgatcaaaaccgaaaaaataacttgcacaaatactaaattgaatttatcgttttttaaatttttgtatatattttttgattgaaaaaaactcatttaataatttccattcttaataacaattaagggcaatttttattaattattttggaaaatttcgcttcttcatatccttgtcctgtatttaatgcattttcttataaatttttctattcattcatttattttattgatgattttggcattttctatttttgttttataattcctccacacctaattattattgcattgaaattcataggctcatcattttgtccattccatttcgaaaacgaggccattaaatcgatgcttatggcctatcctttccccaccccaaagtccaattcattctgcttttccttctttacgaggttattcatcggcggcttcacatagaaaaaaagaaaaatgatgatgcattaaaatgcaattaaaaccaataaatgtacggcccaacgaaaagcctttaaagaaaagccaatttcaaaatttcaaaaaattcccttgaaaaatttttattttctcaaaaattcttttctctaatgattgaaaaattaaagagtgaattttcatcattcgcatctcaatcacaattcacatgaaatgtttttgtataatttcaaattgaatttttatttgttagcaattttattttaattttaattatttctgaatttggggttttaactgagaatttctatggtccgccgttccaattcgattaaaatggaaaacaaattaattctccactgcaccgacccaatccagcagcccaaagcatgagttcttgttccttttttttcaagaatctgggctcctaatgcaaccaacaccataaacttttttgactaaataatggcattttggattcaaaattggtatttaatataaaattcttaaaaattaaatcgaaattgttttagcttctaaattcctacccatttttgctaatgaactctcctgcaacatcaaattcattgattttggaggcccaggccgatttttcactaaatttgttgcgcgaagtgtccaaggacggccgttcgtgcattgtttcaccgctttctgttgccatcgctctgtccatggtgtacgcgggtgccaaagaaagaactggccaagaaattggacaactgttggcagggggtgaaaatttcatgaaaattttaaattaaaattatttttatgtgcataattacagtgttccaatgattaggctagcccaggagtatatgataggaatattttcagtaatcattttaaaatataaaataaattattatcggcagggaagtagggtaattaggggggcgggggcggggtagtttaatcgaatttatacaatatcaacaataaaatattttgcattaagttgcgcttgagtcggaagtgcacaaatatttcggcgatttactcacatcaatcaaaagtgggcacaacaattacagcttggagctggccaacaaagtgtacatcaaggacggctttaaagtgttggatgcgttcaaagcgcaaattatggaacattacgggggacagtttgaggcggtggactttggggacaaagaagggactgcgaaggtcggaaaatatttgaagaattcttgagcaattcttgacagattctgtacaatttaccaacgaattttcagcaatatttcgatgggcaaaagttttgtcaaaattaaatttgaagagtttaaatttcttgtaaaccatcaacctccattaatttactcaaaatgtgaaaaaacaagagataaaatgtaaaaataaaacacaaaatttcggagttaaagattttttggtttattagcagctgcattttttttatgaaacgtgtaaaaatccttcagaaaatgatttagcagaaaaacccccaataattgataccccccattatttaattgcagaaaatcaacgactttgtggaagaagctacacacgggaagatctatgatctgatcgagccgaaccttcttggcgaaatgactcggtgtgctctttttttcttgataatctattgattattttccgattttccataaaaataaaattgaaaatttgtatttattgacactatcaataagttaattaatgttttaatttcagtttggtgttgatcaacgcagtttactttaagggcaactgggcgaacaagttcaacccgaaccttaccaaaaagaaaacatttcatgtggacgaaataaacaccaaagaggtggggaggaaaaaaataatttttttttatagtaattaaaaaatattttaaatttattttttataccattgagaaggtattttcgtatctaaatttattggccaaataatctatttttaaacattatgaaaattgtagtaaaattcaggcttatagagaatataatttaaatgtacaaatttagtaattttggcaactttctgtatgaataagtagggccacaaaattatacttttttcgttacagcatgtttgtgttttatgaatttaatgttatgtcaaaattttatttaaattcaaaaagttttcaaaaaaaatcgaatatcaatgactaattttccattgatttattttcatgccgggctcttaaaaattgtctctttattagctggacatgatgcacaagaaagccgatttcatttatttcgaagatgaacaggtgccatatttttaataattttttacttaaaattaaaaaaaaatgtttttcttattttttttatttgaatttgtgcatagctccaactgctcggcatgccttaccaaggtggtgaagtattcatgtttgtgctgttgccgaaggaccgctttgggttggccaaattgttggccgatttggacggcaaaaagttgctggaattaaccaaagaacggcgcaaaagcgaagtgcaagtaaatacaataaaacattttgccaagtgagcattttgcattgtgttaatgccagaaaatggtattttcagaaaggccatcagtaaaatcccggaatatatatccgtttgttcaatctaaatctggatttcatgtttgggtctgtattttgtggaaaaaacccagtaaaatccagatccagaaataaacagatctggacccagatacaggtggagcttaaacaaaatgatcattgacatttcatgcatattttatgtgcatatttgggcattttttcaaaaaatcctctattaaaagggcctcttctattaaagcggcccttttgatctctaatgaccgaaaattattcaaaaaatttcatttttttgctgttgttttctcgaaaatatttataaaaaatgtaacataaaaaagcgaaatttatgccaaaaataagtccaaaattcggaaattttcgattttttacttaattttcttcaatattaataaattttagctttattttgtatttttttctttaaaatgatttttctaccatatttagctattttcgagatttttagcataactttaacgaatgtgaagaaagcttagaaagctgttgtttttggtcccgaaaggatcggtacaataaaacaaaacgggaaatttaaattcgaaataaaattaaattgagagtccaattttcgaaagcttcggcaagacaaaccggcaaattatagaccatctcttactgtactttggcttcaggtggtgttgcccaagttcaagttggagtccgcacatgagctgaaccaaccgttggccaacatgggaatggccaccgccttctccgacagtgccaattttgatggcattgtgacggactcgttgaagattagcgaagtggtgcagaaggc

SEQ ID NO: 6287 - DNA, 3052 bp, Heterodera glycines
  misc_feature (2922)..(2922): n is a, c, g, or t
  misc_feature (2940)..(2940): n is a, c, g, or t
  misc_feature (2996)..(2996): n is a, c, g, or t
  misc_feature (3039)..(3039): n is a, c, g, or t
taaaaaatttaatttatattagttttatctttaccagttgaaacaaaaatcttttcggaaacctttttaatgaataattttagaaaattaatttttagcggcttttaaaaaatttcaaaaatttggagcaaactcattcagtctgcttgtatttcattcatacgtaattatgagaaaaatctaaacaatttaaaaatggcatatagttagtccgaatcaaagaataaaatgaaacttttttttggaacctttttggaaattttcaacactagtaccaaaaaaatcaatttataacgggcgccaaatagccgcgccagaaaagcaaaggccaaaaaaaccgcgccaaactgatccagacccactttggcttgatttggtattaccagtgaagaaagcaccttaatgtggataaaagctgtcccattgttcgccaaaagtgcgcctttaattgcgcaacacattgtttagcctttagatgcaaagtgatatgggaaatttttgagttccggtcccggtttaataaaatacaaaacacaaaaaaaaatatacaaaactctacttaataaattaatgaatattatgatattctatcgatgttaattaagattataataattcttttctgcatatacatatatttcttttttacaaaaatatttctcttaatgaaatgaatttatggaatttaaatatatattatatatttttttttataattgaatccgacaaaatacgaccaaattttgataaaatatttggagatggatatgacaaaatgtaattgaagtaaaagtgataaacacggaacaaaatgacgaaaatgaaaatgcactgatagatcaaatagatggagaaaatgaatcggtccaaatgatcaccaaaaaaagagaaaggattttaaaatttagagcaattcaagaaaaattaaaaaaaaatatccatggcaattcagttccaaaattgatacaaaaattgcaaaattcttaggcgcaactcggaaattaataccaaaatggaaaaatcaattaaatttaaattaaaacaaaattaaaaagcgattttatgagcacaaaaagcgcaaatttattgaacgatttgatgaattaaaacattttttagcaaacagaaagaatttgtgaaagaattgggcatttctgaagcaacattttggaaatggaaaaaagaattggttcaaaagcaccaaaaaagtgagttgatatttttttaataaaaactaattttaaacacaataataccaatgaagatatttagaaaaggtgaagcaatattttgaaattaaggaaaaaacgcaaaaattagcgacaaaaaaattgcagagaaattgggaattggattggcaactctgaaaaggtgaaaaaggatttttcttcaatttcaattttgaaaaatgaaatgcataaaatcaattcaagttatgtgatttatataggttaatgtattattcccattgtgattaagcctgaaaaatcattgcgtacataaagtaaaattcatatgaacattctgaatgctgaagttcggacccgaattcgaggaaaaatcaaaattccaaattttcgaaattaatgtttttgattaaaaatcggtttaaatacacggaaacaaactgaaatccatcaatccttcaataagagatcattcacgccgttttaattccaatcaatcaatcattgaaacgcaaaagcgtgacgccgaaaataaagaaacaatatcaaataaaaattacgtcactttttgagatggggtggcaaggaaatcaacaaatttaaatcagattttacaagaaacttgacgaattcatttgaatttaataattacgtctctttaggaaaatggctacatgtatagatgagaggttcgaataaagaacgaattttggaaaaacaaaaaggattcgttgtttgtttttgtaaatatattttaatttaaaataatttcggggaaaagttttaagtctattttaacctacaactcacaagcgattcttgattataaattattaacaattcagcataattagattgtgacaaatgaatgattgttaattttttaattgaataaaatttgaaacataaatttttttcagcagatcacacgggacaattaaatccagtaatttcgtcaatccattctttgtccagcggagtgtataaggatacaatgcctgttgagaaaaaaataaattaaatttttaaaatgaaaaacgaaaattgtctaatttgtaacaaactttggtttgaattggtgttgcatatcccagaagaaagcaccccaatttggacaaaagctgtgccattggaagccaaaagtgcgctgccactgtcaccctattaaatttgaaaaaacatcataattattggaaaaaaatttttataaattgaaaacaaaatttaaaaagtggcaatttttagttatttgttttttttgcaaataaaaactatacaaaatcaatgttaaatgtacaaaaataatttgttaagaatagaatatttaaattcattaaatttaaaatatccatttacatgctgaagaatgtttggctcgacgcaaatttgtccttttgcttcggattctttttgacaattaattagtttagcatagcgacccattagcatttttgaggtcgtagtaaacgttgcacagtcgtcttaaagaagaaaaaattataatagcataaatgaaaacaattcgttaattaaccaattaaaataatataaattcatttatttaaatttattccttgaaattaccctctaattatccccatcccgcaacaaatacagttccatttaggaatttgttagctgcaccgcaatggatgcaaattggttgaaatagcggagctatcaaaggacggctcaactttaaaaaaataaaaattaaaaaattaaattttattanaaaacaaaccttaattanagccaaatcggattcaaatgttttgtaattataatttggatgaatgaatacatttngtctgtcttgtcgatgttcagtgattctctgctttgcatccgntgcattcaaattc

SEQ ID NO: 6288 - DNA, 3210 bp, Heterodera glycines
  misc_feature (11)..(11): n is a, c, g, or t
  misc_feature (2402)..(2402): n is a, c, g, or t
tccctaagtanatcccttgaatgataaaaaaacctttgaccattggtgccattatgcttcaaattgataattggatcaattaatttggatattttcaaaaacaatttactaaaattaaaaaaaaataaaagttgagtttaaatttaaattacaatattaagttttaataatctcaatatttttcttcttttatattttaaataaattattctcattaagaaattccataatttactaaatttatttttttttattttgaaaaatacctcttttcttcccatccattaacaatttttgctccggtaatgagaataacaaataatgaaaaataatatttggacttcattttattgaaaagtattgggaatttgacaaaatgaatgaatttgtttagcacttttcatttttcagaatgaataatttgttatcgaacgaatgaatcaccctgagaaatttataatttttcaatgtgtgctgaatgcgaataagtataaattttcattttatcattaaaaaaggataaatttatttttgcggagccgacacttgaggaccctccaaattacttagcagaactaaatgccggaaactgttgtcaccgataatggcacacagtttagctccaacggtttcaaataattcgttaaagaaaatggaataaaccacctcttctcagcgccatacaatctcgagtcaaaaggacaagcggagcgctttgtcgacacctttaagtgaacatgtcggaaacagaagaaggagggtgcacaaaatgtagtgaatacatttttgacatcgtgtcgaacgtcgccggatgattccttgcacgacggaaaaaatcctaccgaactttttattcttcgaaaatctcgaacaacattggatttgctgcgagcaaaaactcagccctttgatcagaaacgagccgatggaaaagcaatttaatcgcgttttttacgatctaatctaataaattcaatatttagtttttaatacacgaaaatgcggtcagggtcgttttcgtacgggccgttttcgtacgagcccaagtttttggctataacttttttctttattaaccaaatccaacacttttggtatcattcgatagctctatgtgtcctctattagcctgcaaaattgcgaaaaatagttcaaaaaagttatggccagaaaaattcaaaaaaccaaattttccaacttttttggctcaaacttttttttaaaccgaacgaaattttttggaattctgcaggctaatagagtatcagaagggctatcaaacaataccaacaatgttgggtttggtttacaaataaaaaaattaaagtccaaaaacatatattcgtacgaaaacggcctggcccgacgaaaatgaaagtaatatatttaattttgataatcacaactttaaatgggaaaatttttgcagccgaaaatgaaggattgaaaagaatcacattatttttcaagaaatattgggaatgtgccggaccgaaaggaaaagaccgaaattcctaaatttattcccgaatttacccattttatttaccttttattgccaaatgccatttacatcattagattagttaatagagatgcataattttatttgcttccaatcaattatagattttctatgcatacgtaacatttcccatgtaaatattatttcatttttattttattataaaatttttgttttactatttatgataataatttaaatatttagcttttttttaatactcgaatatgaaagtaatatatttgattttgataatcaactttaaatgggaaaagttttgcgggcgaaagtgacgaaaatgaaaagaaccgacaggcctttaacatcttttcaaacgctgatggtcaagctaaataataaaaataaattaaaattaaactttttttcatgactttttgattggctgacacttgcggcgcccagtcaaggcgaaacttacggcgccgacacttgcggcggagacattttggcgctgacacttgcggcgtttagtcatagcaacatttgcggcgccagagtgacctaattgttttcataaatcctcattctgcacatagccattaggtagaccaatttttctacaaaactaattggtagaaatgaaaaagacgatgtttgaaaggtattaattatattgctaatggcatggcgataatcattttttgcaaaagggaaaatatatattttttattatgaaatgatattgtcaattagttgtcaatgatattgtcaattagttgtcaaagtgattttttaaaaatttgtaaatgcacacccataagtgcttgcaggattagcctcaaaagatatggggtggggatcgcaacgaacttcattaatgtatttacgggtataaatgaaaggaaattgggaggcntaactcaaaaattaatttcactaattgaacagttattttgtaacttaaggaattaatgagtcataaaagaatcaaaataaggtcagtacttgaaaatgtttatttaacgaaaaccgggccatgagaatgaaccttgaaaagtctcatcagctgatcattgaattaatgttaaattaagcacgcttaaattggaataattattcaaataagcattttgttttagtaaattgttgcaataattttggcgtcgtttaattatgcaatgcaaatatcgttttgagccgcaagtgtcagctttgcaagtgtcgacggcgcaattatcggcatcactgactttttttttactttttcgtaattttgggtttttgtgattttttggaattttgtcattttttaagtgaattcactccgggattaccagaaaattttgcttaacactgtggaatgtatccctaaatgagattttttcaaaattcattcgtcacatttattcaattttggtgactttttagttatttttgaatattcaaagtttttttttttgttaaagatgactttaatgaacttgttgacaaagtgtttgtcgataagccaaaccaatcagacgctaatgagaagccaaatgaacagattgtcaatgccgaaatgtctgatgaagacaattcgacggatttaagtaattaacaaaagggattaaaatatgttttttttttgctctttcttttactaaaaaacatcatgttaggcaatttttaggggtaatttattaaaaattgtaacgttagaatgtgactctagaggtccccgg

SEQ ID NO: 6289 - DNA, 1601 bp, Heterodera glycines
aaatttggcattgacatttcaaaatacatcttgttttacgtgatgctcagtcggcgatgaagcttggcacaaacatccttggatgtgattcccaggattgttttttacataaaatgcaacttgtaagtctgtgttttcttctagttaaaaatgaaaaattaagtcaatcggtgatggtattaaaatttactcggattttttaccgctttctgaaaaaatcaaaaaagtcattaggaaaataaggaaatcatcagttcaaagagaatattttcaaaaactgcaacaggaaatggatttaccaaatcatgttttaattaaatcaactgaagtgaggtcagttaaatgtctttgataaaaattcttaaattcattttaaagatggaactctgtttatcaaatgtgtgagagattttatgaaaacaagacggctattggactgtttattggaaattctaatattaatattgagccgttttcgggttgtttgtcattttattttttcacacatttttttaagaaactgattgggaattgattcgtacacttgttgaccaactcaaacctatttatcacataacaaaagaactggaaaagcgggactcaacaattgcgtcgattattccaatttttcggtctctcttgaacaaattgagaaaatttaatagcgcattttctaatcgtgttgctgatggtttggagtcgcgaatgacaggatgggagatgaaaaggtgaataaagttagcaataaattcaaaattatctataccagaaaacttatgattgcaactgtgttggatcccaattacaaaatggatttttttgaccgggaaatgcgcgatatgtataaacggtggattattgatgagctatcacaggacctcgatctcagccaaaattttgacaattctcagcttgtgaacgaaattgctgaatgttcaagccaagactcgaacccagtaaaaagtctattggatgaatttgttcaggtccaaaaaaaaaataaaatcacaatcttttacatatttaggaaaattctttcgggaataatgaaaatttgtatttggatgtaaacgagacagaattgatcaaacacgaagtgaatgcgtatctgaacaagcctcgcatcaactcaaatattttcaattattggtcgataaattccgaaaaatggccaagactgacaaacttatttaggttacaaataaagtaaacccatataaaattcattaattaaggcgcttcaactcggctcctgttggttctcaggaatctgaacgacttttttcaattgccggaataacacttactgatttaagaaatcggttaactgcagaaaatttggagaagcttctttttttgcatcggaatttaccaatttataatttttcttattgatttttaaacaaattaaaaatttgtcaattgacccgaaacccgatacccgaaacccggcctttttctcgacccgaaacccgacccgatgatttttcggccgacccgacccgaaacccgacccgatatttttctcgacccggaacaaccctgttatggatgagttgggtatggatgagttgtgtctatggatgagttgggtatggatg

SEQ ID NO: 6290 - DNA, 990 bp, Heterodera glycines
aaataaatgatttgaattaagattcgaaattgaaaattggcaaactctgatcattgtggcccaaaggattccgattttgtttccaaaattttttggggcctcggaattttaatttccgtaattttttgataccgcggaattcctgttttcgaattttgtggtctcatttaataaaccaaagaaaatcgcgtgcttttaaaccttaggctaatatgtattttcatgtgctatgaagaatgaattcaaaactcgtatttctgcgttaatgatgatgtttttttttgttcatttgaattcatattctgaaattttcgaaaataaaccaaaaacatatttcccattttgagtttttttttcatattttggcctgctttggaaatttttatttaaaaaaatcaaatataaacaaaaattacagccctaaaaattgttttttttttgaatttaaattacaatatttaatctttttttttcccatatcagatttattgcagaaaaacatattaattttagttaaaaatttgttttgttcctttttaaacatttttgcgtaagtatctttttgatattgtattaagcaatgattggcatttctctgtaagtcctagtcaagcaattaattatttattacaattttttaaaattaaaattgtaaactttcaatttgtatatatatttttcttcattttatgcacaattttctcgacaataattaaatggaaaattattgtttttcatgattgacagcttttagtgcgcgccgcgtaagattaataatataagcaaatgctgagcgtgcgtgtgtcattaattctttaattgaataaaattcaaaaaaattaattatcatttatcgcctgaagcaaataatttgtcaccccccccccattttttaaatttaatttaatttttgttttcatttctattttgatccatctggtacgcaaattattcttaattaaatttttgcctttttttgcttaaatattt

SEQ ID NO: 6291 - DNA, 3361 bp, Heterodera glycines
  misc_feature (26)..(26): n is a, c, g, or t
  misc_feature (209)..(209): n is a, c, g, or t
  misc_feature (242)..(242): n is a, c, g, or t
ccccccccccccattttaattaaatntaattttgttttcattttctattttgatccatctggtacgcaaatattcttaattaatttttgcctttttttgcttaaatattttgctttttcatcattaagatagaattttatgcgatttatttaaaaacctttgtaaaaggatattatttttttaagatttttttgtgtaaaaattcattnttatattataaataatttgaattccgctttttntaatcgattggatttttttgattattattaaaatttctttttatttaggtattaattcacctaaatttttttgctattcatcacaaatataaaattttatgcgtttattaaaagattttggtaaaaggagattaatcgttttggagtttttttgagtaaaataaattttatattgtaaataattagaaattcgcattttttaatatttttttttggaattttttttattgggtaaaaaatcaagtttatattataaataattaaaatgaattttttcttttgccacttcctattaaatttctttttgagaattttttgcgatttattaaaatatttggtaaaatgagattaatcttcagtttgggtaaaatttaagttatatagtagtaaatcaatagaatattcgcattttttaataattttttttttttggaattttttttattgggtaaaaatgaagttttatattataaaaaattagaattttctcatttttttaataatcttttaatttttttattttttgccacttattatgaaaattttctcagtttaaatctaaatttattgcaaataattacaattttaatacagaagaaaacatcgccatagcaactagcattggaagtggagcaaagaggcaattataagccggctaatgaactaattaaaatcttccgaattattagacaatagattcacaattgtttcctattttttttattaaaggatttttattcaaataaaattttgtgtcggaattcttaaattaaatttccattttaataattgttttttatttcctattaattaaatgggcttcttaattaattttcaaacaaaatatcatttgcaaatttttttattaaaattttttttgaacaaaattttcaaataaaatttccatttttagtattaaatatattattttttttacaattttaatgaaattccaaaaaaaaaataattcacaatttgtttctattaaaagatttttatccgttcaaatgaaatttccattttttagcattaaacattttaattttttgtttattaaaatgggcgtttgtcagtcgcaggaggaaattaaggcacgagaaatttccaagaaaattgatcgtgatctgcaggtggaaaagcagttcagacaaaaattgctatttttgggtaattttttcaaaatttaaatttaataattaaaattaataaaaaaaattaccaaatgataaatttaggaccagctgaaagtggaaaaagcacatgtgtgaagcaaatgcagtaagaaaagttgaagataactgtgttaattgcttaagtaattttaaaaaatgaaaaattttttgactctattgcactttaggcgtacaacaagcgccttttttcgttaagtgtctcatggatttttagaaatttctcatgtccaattttagtatatgtccattaggggtgtaaaatatcaaaatttattcaaaaagtaaaaaaaaaataggccaagagttataatcaaaccgaaagaaacccattttactgaagattgccattgattgaacgcctaaggtacaacaaagcccaatatttttaggtataaaattttttaaaataattaattatttaattaattaattttcagaattttacacaataatggcttcagcaaaattgagttggaagaacgaaaaagcatcgttttttcaaatacaggttaaaaataataattttatgtaaaaaaaaagtaattattcattcattttgctcatttgtcagttcgaagtatgtacgagcttatacaaataatgaatgaattgagcatacgatttaatgactcagcgctggaggtaattattattattatatccaattaatttattattcttatttttaattgttaaattattttatgatatttatttatttggatttaataatttttaaacatcgaactttaatccaattaaatatttttttttcattgtgaatagtcaaattatactatgacattttcaactattaatttattttatttttaaacattcttaatataacaaccaactattattgaattaatatttatttattcattttaatttaatatttttaaaccatttataatttagcgattattaaaagattcaaatatattttattgatagattaaagctatcacatttagatgttaaaaaaatctatttatcttctattaattgttatattaaaattaaaaaaatccttgagtttgtaaaataaaaggctggggatgcatcacattaaaattaattagttaattaattaattatttttaaatataatttttaattaaataaagaatgaagtcaatatcatacggttacatgtcgagaatggtcttgaatacactgagatcacgtcatcagtgaaattggcaatccaaaggctatggaaagattcggcaatcattgcggcagcgactcacaaaacaaattatcatgtcattgatagcgcatcatagtaattaatttgctaattaccgacagataaataaatattaattttttaattggggtcaattaatatatttttatattacagctttttcgaaaacattgaaagattaacagaaaagaactatttgccaacaaatcaggacattttgatgaccagaatgccaacaaccggagttgtaaagcttgtatttacgctcaaaaacatcgaatttaagtaataaaaaattgcgtaaaaattcaatacgaatttttgaaataaattttacgattaaatataaaataatttaaaaatcttttgaccttttcaaactcgctatcctttgaattaaatatataaaacagttaattttttataaattattttcactttttctttacatataaaatttttaaatttttttttttttcattttttttaaataattaaattttaaaaattattaacgtttattttgacataattcattattaataaaaatcaaaaatgaattttattttaataccttttctgaaacatttcagataaaaaaaatagaataaaaaataaagcaaataaattttatttctattaatttttttaatggtttttgacgttggaggccaaaagtcagaacggcgaaaatggattcacttttttga

SEQ ID NO: 6292 - DNA, 1855 bp, Heterodera glycines
  misc_feature (42)..(42): n is a, c, g, or t
  misc_feature (1802)..(1802): n is a, c, g, or t
aaaaaatttccaatctgaaattgacaagaaaaaagaaaacanttgggctttaaaattattgtagaacgagaaaaaaaatgtcaacaaaaaccacacattgacgagcaattcagtgctgccggtccaattgctgtgcttgcaattatggatatgacaaatgtaagggtggatggagtgcccgaatctgacaatttcgtcctgtttacaactcaatcaaaaaaagtgagcttgatcaccccaaaaagtggagagcaaaagccagaacatggtgaataccaagtggaaattgggattaaaaaagcaacaaaaattagattgcttgtcaattttaatgttgacacatttggcaacgcaatgacattgattcttgagaaaatcaacaaacaacgccaagaggcgaaaaggaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaagtgccagtgtatgtgagaagaagtaatgaagaactagagaaaatgttttttatgaatcccaatcatagtaggttcagtttgcaagttgaaacgtatgtcggcattttaccctgaaaatttttaattttagagaatcaaaaaagagaggaaaacgaatttcaacattttttgaaaaatttgttggatgaaagattgaaatttatgggcgtaaaggttaattttttggtactggcacctccgactgatttaactgcagtactattgaggaataaaaaattggcagaagcggttggggaaatactcatcacgggcgaatgtaaaaattgccaagatttacaaccaccgacaccgcttagcctgaacaaatttttgtgggaattaccaagggaacacaccaagccaacaacctacaatgttagaatggacgcattggcagctctgtatcttttcgaaatggcctcaaatggtgaagtgaatgtcctactagtttcttcacgtttacttgctgaaaagttcggtgctggggataattttgacaaaagatttccaaaactgaaattgataagcaaaaagacaatgggtgctaaaattattgtaaatcgagaagaagaatttgaacaaaagccacacattgaccagcaattcagtgctgccggtccaatagctgtgcttgcaattatggatataacaaatgtaagggtggatggagttcccgaatctgacaatttcgtcctgtttacaactcgatcaaaaaaagtgagcttgatcaccccaaaaagtggagaggaaaagccaaagcatggtggataccaagtggaaatagggattaaacaagcaacaaaaattagattgcttgtcaattttaatgttgatacatttggaaacgcaatgacatttattcttgataaaagcaacaaacaatggaattacaaaatttcgtccgaaaaacaaaaggtataggacaaattagaaaaaaattgttctcagatatgactcatattattcaataaccaatttaattatcctaattaggggaaagagaaaaaccaagatccaaatgatgagaaaaatactgcctccagctcaagtgtgccaagcgaaaaggaaaatcccaaaaacgaagaggcgaaaaagaatttggtgataattacggacatgggggtggatgatcaagttgcactggcgatgatcagcgcaacagaattggccggtaatgtgaggccattgggacgacggagcaaggaaangaagcacctttaacgcaatcactgggatttgagaaagtgccagtgtatgtgag

SEQ ID NO: 6293 - DNA, 1827 bp, Heterodera glycines
ttacaggcaattctttttttgcatacaaatgaagcttttccaacatattcttcgcttttggttctaatttttcagtgatattgattttcatctttactaattggctcagcattattttgtatgcttcaacaatttcagacattgcttcactgatttttaactctttttcattggcatccagaaactttggttttagtgccaaaagttttactgatctaaaattaaattagtgggatagagaagaaaaagaagcttattccaagtagaagattaataagtacgggctcgttactcaaaaaccaccaaaatggaaaatttttgacagaaaattattcacaatttcgctcaaaaaaagcaagttttcttgaacatttttggtattaactttcttgaaactaatgaaactttttgaaatttagcaggataatagtaaaaacttagggctatcgaatggtttaaagaattaaaaaatttggttactttgagcaaagttatatcaaaaattttttattttgctcatttttgagtaaattcatagcaccgattaatagagcatgaggcgacaattgatcctatataaacgagcaaatttagggttataaattataagagggcataattttgcataaatttttatagtaaaataaataaaaaacaatcgactttttgatatttccaaaaaaatttactccaaaaatcgaaagatttcagtttaaataaattccaaaaatcttgttgcaataaaaacaatcgattttttgatatttccaaaaaatatactccaataacaaccgaaagatttgagtttaaataaattccaaaaatcttgcaacggctaatggcttgaaataaattataatttgaggtcaaatttgtacttgttaatccgctctctccaagctaatgtgtttttgtttttctaaatttctataaatgtttaaaaatataaaatttaatgccctatattccccgctcatcttagccaaggtgcaacagtttgccaattttactgtatatgaataattaccgttttcttggacgggtttttcgtttttctgaagatagttgcaatattttataaactttttaatgcttttgtagctgtctttccatttggggaattccacattatactcatccggcacttctcgatggttatactttttcaataattgccaaccattaggtttatctagatctttgcataaatcgtttacctaaaaaaataataaattgtaaattatagcaggggaatttagatatattttttcctgtaaaacttcaacccatgttcagttcccttccagaattttatgattttttgggttttttgtatattattttgggtaaaagccccaacgccgagccccctaccccgacccacgacattccccggcccgaccccgacatcagggatgggcacggaattccggtttcctaaaatttttggggcctcggaatgccatccctgcacgacatgtcgccacccgacggtacccggcccccgacattttgcccaccggcccccccgacattagtcggggaatcggggacccgaacgttgtaaaaatttaaaaagtaattcaaccacgggtgggcaaagattgaaaatttttgaaattttgacaaatttctttaataaaattccgaaaaatttccggcggcgcgccggtcccccaagacataattcttcctaagattgtcccaaaatctcaaaaattgataatttttggttagaggtcaacttggactcatttgaaataaattattaaagtgaaaaaaagaaaatctacgagcatttttttggtttttatagattaatttttc

SEQ ID NO: 6294 - DNA, 4964 bp, Heterodera glycines
acaattatttgtaggagagagagagaataagaccatagagtgaaagaagcaaaaataccaaaaaaaagtcctggtagcaaacgaataaggaccaatttataaaaatatctgaacgattgagaagcaaaaaaaaaagagagagagagagagaagaagtgagacagaaaaaatagaacaattttttttgagcagagcaaaaaggcccgggctgataaccaatcaaaggggcactattttagctaattaaaaagagggaccaataaaaaaaagaaaattaggccctatcattttgcttacagtatgagatacagtttttacaaattccaaagttcattttatctctttgttttctctcagttttcacgccataagaatattcacgtaatcacgtgccgccgcatttttcattgggcgagatcattcactttaaacatttttgcggcgcctgagaattgttaattgttcttgttaggcgaagtttaaacggagatggagcagataagcccattcctggaaggcgttcgcatccattcgattacccgctatcattcattaatttttttttctctctcaattaatgcataatgggattaccaaataatttttttttttttagcaaaataaaacaaaatcttattacgaactgaacgacttcgaatgtctacatcagggggctcgtcaaatgagttcccatttggtacatcccaagccttcgggcaggaaacaaagatgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctacctgaatcgttccttgaaccaaaaagtcaattgggtgaaagatgtcgtggccaatacaaatgccaactttgagactctgaaagtccaattcgagaccttaaccgaaagagttgatatgttggaacaagacagtgatgggacgaattcaggtgggactgttagtattactaatctgaatagagcgtcgcgggcgccgtttgtgacgccaatgggcaatgcacagcccaaccaagttgtaccgaaccaagtgccaattcatcaattatcaagcgaagacgaagatgacgggccgactctttttggcctgaacatgctctcgagcggacccacagtggggtcaggtttggaaatgttttgtgaggagtctgtttttgcatttgacgattgggctgaacgtttcaaggattacctgtccgtgtcaggcaaggcttacactgaacaagaaaaagtcaccagactcaaattggctctgagggacactcctcgggcactgtttaaggaattattgccagcacaaaccgacactcttgactcagcattgagtgaacttcgacagaaattggactcccctcagcgtcgggaaattgcgaaacgaactttatcgctgtgcaaacaaagggaggatgagacagtggcgcaatttctgagacgcctaactcctttggtggatgcgacaaattcgtcattaaccggtgacattcgtatagagaaaatttgcgaggaattcttggacagattaaagccaaacataagctttcttattcgtctggtgggactgtcacgggcaaaagatttggacttggtaagagcacaggcagaggagctggaagctttactgctgatgaacaaaggtgatgaagcatcacgcctctctcaggcagtccatgcgctgagcaatcagtcaccacagtcgaattggtctacagaagcaaacccgaacaatgaccgtgctggacgatggtcgtcaggcaacaatgtacgtgggtttagacctttttctggatcaaatgcgacgagacaacaacaaagaggaagaggaggacgagaccgctctcgcaattggggaggaggccgccaggagcaatttagccaaagaaactggtcaagcaaccctcgatgccattattgtgaccgtgctggacattttgcgtacaattgccatcaacgccgtgccaatttcagaggaaattccaaccaatcgttccgtcaaggaagatggtcaaatcagcaacctcgccaatctcagggacaatggcaaaatcggcagaatcctgtcaacatgatggatgtgccaaactcttccaacacttcaccaggatttttcgagaacttggcccagtcgttactagacctcaaaattcaggacaatcgcaattacaaaaatgaggaaccaagatctggggcaatgaatgcgctcacacacatcaaacccaaaacaacaacaatggattgtcaggtcgaaaatgaattagcaaaaggatcctctagtgaatccccagcctgtgggcaggaaacaaagacaaacattcccaaaacgtcaaattgggaacggccaagcgtacgatcgaaagtcgcttctttaatgttcattacattaatgcttgttggaatgattttaccctttactactgctaatatgccccatctgccaatgcatccccttgtctgtcaaacccaaaacggaggaaaaatttggcaattgccggcagttactggctgttcaaagctgtcaattgatcattcaaaagcacctgttgttcgaactttcgatgtcttttcgccaaatttatttgagcactcggctgatgcttgggcttgccgaaaagtgagaaaatccgtgcgcaagtacacttcaatcactaatgttccgatccaagagactcttgaaccacttatgttgcaaatgactccgagtgaatgcaatcaaatggccgaaaatggaaagtgcagcttaggcttgctaattaatgactcgggactcttgcatatagacaataaattggatttctcaccccatatgtggctaattggctcttttagttggtcgactgtctcaactgaaaattgttatcattttaaaactaaaattatgtcaaaatacggaagctcggttatgcaaagtcccctcgggtcagtgaacaattgctaattcaaggcaggccaatgtgagatggaagacaagacactgcttatgtgggataccaacactacccatgcttgtgaattttcgaaaattggcacattgaaaggactacaacttgctaatatttgcagttcggatgaggtcagttttcgtttaacatttttaaacaacacaaagaaagtcaactcatgtggtctcaaaaaaatagggagcttgtgctttgcctcaaatctatcttgaaagaatgggttttatttttgcacttaaaatccttcaaaaggggggcaggtcctttgcctccaaaatccattcatatgtccttaaaccttggacccgtcgtgccctttattgtccttattatttttggcttcacttgtcttaaccaaacacgcagacggaccgcgttcatgccgtatgacttcatcaacgcaaacagatcagttttttgccattattgtcgagaaaggatagcccactcttttcttgctgtgtgacaaaactgatgtcggcacctttgtacacggcacaaacaaagccaaccagcaacaaacataaatggcacaaaagtgccaacttcaaagtggccattgtaactataaatttttatttgctggggaataatttgaagtaatttaaatgtcttttttttaatatacgccaaaaaattttcagacaaaagcttagttgaaatttttatatttgttcagttgcatttgaacaaaaaattgaaccaaacgatcaaagcaattgttacaatattcaatatttcataataaatcaactagacctttggcctacaaataattttctgttatttaatgtctgaaaactcgcaccttttgtttccccacctgatcaagggcgtagccagacccttggctttgggggggggggctgaagtcaaaaattcgatttttaggggtgtatctttctttttaagtcgatttttagggggtgtatttttggtttttttgaaatcccgaattatggggtgtattttacaaaatttttcgccaaaaaattaatattttttgtcattttgcctccatttttcaaaaatatgctaaaatggggtccggcggtgccgataggcgccgccgggaaaatttttgagtattttaatgctattttgttaagaaaattgcttaaaatttcaaaaaaatttactgaaaattttttattttttgggtttctgggaggggctttagccccctcagccccccctgcctacgcccttgctgtagtgtctgatagctggtcagactactttcaaccttttgtttctctgatcactgatttgtgagtagactgcaattaaaaactttcgtatctaatcactcaataaacgatggtatccaatcactgataaaattgcgatcgcctaaaatttgttctaaacattcaccgttttcatctccatcagccccagcaacagtccgcattcccacaggtgccgtgtctccgttttggcgtcgttgaacagatgcaacagctcgagcatcccgcgccaaacactgaagcgcaggtcgcacttggccgcgctgaagtgcagatgagggcatagcacatttttgaagctaacacggaagaggggcgaggaaaagccacctgctgtcgaaatgggagggggggggggggttaaacgatgtaagccaattaggactaattaatattcctttgaaagatatgcaaaaatggtcgagattagtggggtgggttagctgaaccggaggagccaattaattcttgaaatttttcaaaaatcttgagcaaagattagtaaccttacgatcagattacaacctttataaaccaaccaattgatcagaagagtcataagggatgaaatttgaaaaatatcgaaaaaattcgaaatttcaaaaaaaattttttttaaacagaatagattaggaataattttgagggtaaattagtcctgt

SEQ ID NO: 6295 - DNA, 2254 bp, Heterodera glycines
  misc_feature (52)..(52): n is a, c, g, or t
  misc_feature (55)..(55): n is a, c, g, or t
  misc_feature (2165)..(2165): n is a, c, g, or t
  misc_feature (2170)..(2171): n is a, c, g, or t
tcctcagcaagctcctgcaacacaacacgaattcttctcgggggtttccagntgnccttcccactttttcattgtcctctgtattcgtgtctcctcctcccatttcattagcttcttctgcgcggttttgtggctgtctccgtctcttcgattgctccgaaacattcatatggttaaggaagtacccaacgacgaaaatgaaaaatagtgttccaagcacacttccgaatggcaacaacttaaaaagtgaggtttaaactgcatccaaaccaaaaatgggtgacagatcattcaaattaagcgaaccgaaaaatgtggtccgctgatatttaaattacctaatttgtttttctctaataacaaaacatacaaattgagaaatatccgtttgttttttccttggaggttggggccatctgacaaactgaaactgatgctgctgttgttcgcgaaagaattcctttcgcatgccttcaaattgctcatctgtgaagccgaaagtatcataagcctttcttctctgagggttcgacaaaatctgcttatgcaagatgtgaagcgtatttgcactaattgtaagacaaacacaaactttataagcttgattgacatccataaaccgctgattggactcgggattcttgtttttgtctggatgccttttaacatttttaaattaaatttttaaaattttttaatttattaccattgcaaggctaatttcttataagcatctttaatgtctttttgactggctgtccgacgaattcccaaagtattgtacggattgagctcataagcaattatattgacgagaagcagtagaaaaacgaagaaaatttttgagtttgagatgtatggatttcggctcggaataaatgagaccatttgcaagaaacagcttaatcttaaggagaaacagcttaatcttaaattaaatataggtaggtacatttgttagttcatcagatacatatactaaaaaaattgcctccggcaattctcgagcttctacgtagttttctgaaggaaaaaataagggcgagagcggaaacaatgtacatatcgatttcattaagatggagaaaaaatgagagaagcgatacatacaaatttgttattgaagtgaatagggagagagaaagagagggagaaaaggaagaaaattataaaatacctaaaaaagaaaagaatgaaaaaaggaggtcgaagaaaggcattatccataaaaattcagccacgtcttcttatgacatggaaaaggtgcccaaatgccttcataaaaatgtaatcatccgtcaaaatgcctttaaattttattcatttttaatcgaccattctctacagctgcagcgatgataatctttctatctgtatttgtacaacttctcatatttgcagtaagcgacaaagaagaattgcaccacgaaagggaaacttttgagcagaaacatatgaatatgggcaaacacaacatggaaatggaccacaaagccattttaggtaagttattttattagtaagaaatattttttttattattaattaattaggatcagaaaagaacacccacgaatttgatgaactccctacggaagaatctaagaaaaggctgagagtcttggcaaagagaatggacacggataaggtgaaaaaaggagagaatacaataatagtgattgatgtttgtcacccccatttttcgaaaatatttttggtttacaaaagtcgtgaaaacctatttacgaggctaaacaattcttactgttagaccaaaacgcgaaattcgaaaattgaaatttacattgttctaatttgggctccgggttcagaatctttttcgaaagatgagtacaaatagcagtatcgaaaatactatggctaattattataggacggctttatcacattggaggagctgactgattgggtcaaaaactcgctgatgacattggaccaagaagagacaaaggaacgatttgacgaaatagatgaaggttggatgctgaaggaatagcaaatgaaccacgtgaatttttaagacaaagatggggtcatcacctgggccgagtacactcaagaagcatttggcgttagcgactcggagggcgacccgcaaaaactgttgacggacccggacgatatgaaagtctgaaagaatatcncattnntcattaacttattcacaatcagcttttcgaagaggatagacgatattttgtggcagccgatctcaacatgactcgctcttgac

SEQ ID NO: 6296 - DNA, 1573 bp, Heterodera glycines
agcttttcgaagaggatagacggatattttgtggcagccgatctcaccaatgactcgctcttgaccctggagagttcggagcttttcagatccggaacatgctgaacacatgcgccaaactttgatcgaggcacgaatattttagtccatccttttagttcctgactgggtttacacctaactcattgtcagaatactttggcggaaaaggacctaaacaaggacgggaagatcgacctcggagagtttatgggagacatggctcatgagcagtcgcagtccgagtggtatcagacagaaaagacgcgcttcggggaggagtacgacaaggacggggacggctttttggatggcgacgaactgagggcgtggttggtccccgacttgagtcagacggcaaaacaggaggccgaacacctaaccgaaaatgctgacaccgacaaggtgaattcactacattcaactttagtttaagccgttgttcaaccgctagttaaaaaagacattttaatttctcatgaataaattgtttctttggacataaattttgtcccttgggattgacctacattttcatattattattttaggatgggaagttgagcatagatgaggtggtagaagcgtacaaaatcttcgttggatcagaagccaccaactacggagagcatttgaccagcattcgccatgacgaactctgattcttattcaatcgatggggaaaatccgattatgtaaagcgtagaagagacttcggattaagggtaaaggtaaagcatttgtgcagctcttccattccttcacttggaacaaatttttgagttacaaaaaaaaaatagtcataattaaattcaacagtttctgatttaaagaccaaattattttttcttcgaatatccattcagttccgtcttcaaattccttgtattgctaccccttttgtttccttgattaattttatcgctggcattgaatatattttcgtggaattttcttaagaagagatttttctattttttgaatctcgcgtttacgggtaagcgttaaatcattattctttacagtaatgccatattcatgattaaggaccctgtaaaccattggggacatgttttcgtgaccttttaaaaccgacaaaaaataagcgaattattccaataatgaaaaagtatcgaaaattccatatggcggcgatatgacacacatttctcagctttttctttgtttatttattccctattccatcaatttttaaaatgatttttaatggtattattcccacttcgatagctttatttatttggattaaaaaataaatattactttctattctggcagaaaattatagaattgggcccgcaaaagaacaaaaccggttccacaatcgcaacctctaatcatcctaaaaaatatcccagagtcgaaaaattaaaatttaaatcgtgagttggcaagtcgtctgttgctctctctgtctgtgagagcattgcgcttctttcgcttttcttttcgtgtcttcttcgccctttccttggcactgcctcaatttctctttgtatttcccttttcaaca

SEQ ID NO: 6297 - DNA, 2761 bp, Heterodera glycines
gcaaaaagaaacgaatcattttttgctcaaatggaggaaattgttaattttgcacaggaaaaaagtcaactttcatgctcattttatttttcaatttaaatattttagctcaaatttcgtctcaaagcgacattaactccgaatttaacgaattccttacttttgagagagcaccaatcagttctgacccgtttgaatggtggaagaaacacggaccaaaatttccaatgttatcaaaatttgcgattaagtacttgtcagcccctgcgacaagcgtaccgagcgagcagactttcaaagtggcgagggatgtttatgattatcggcgttcgagtctgaagccgaaaaccgcagaaatgttgattttttgaacaaggcaatcccaatgttgaactacaaatattaattgattttgttcggtgataaaaatttaccaataaattatgctaacttttacattaaatatgttttaaccaatacagaagatgacgcaattttttcgattttttactcaaaaattttgaaaaagtcccgggtcccggcgggatcccggcccaaaaattgggaccgggaccgggagtcccggaaaaacgggagtcccggtgccgggatcccgcccgggtccattttccaagtcccggtcccgatcccggtcccggcaatttcaaaattccgggctctaataacaacaaataaaaaattcaacgtttcctttgattttcataccgaccaaatggaaacgtcggcatggaaatgggtcgatcccatttttcggggttagttaaaaagtcgtatattttgaattttattaaaaaccaaagcgtgttcccgtggtccctccccccccccccttagatttaataaaatttttctttgaattttgttaaggaattatgaacattaaaaataatcatttttgatgaacgaaaatagaaaacaagcagcgccacttcactggaccctaagagattatcaacaaccacaaatgaaaagaaaaggaagtcccatttaaacattctcttccggcaaaatgttggtgaaggaatatcgagttttgatgccattgtccgtggaggaatatcgtctggctcaattgtacatgattcaggcaaacaaaataaaaacacaaaataaacaagtgaaaacgatttaagaaaaagtcaagattggagagttctggggcaggcagtggagtggaaatcatcagaaacgagccctatcagaatggacccggtggcagcggacagtacactttcaaaatctatcacatcggcaacagaataccgcgtatgtcttggaccaatgggaaaaatgctagcacaccaacaaattgtcagtttggatccgaaatgtgttgccatcgtctgccttggaagcgcatgaagaggcgtggaatgcttacccggcaagtcgggctattactaattgtaaggatgactgtcgatgagtcagtcctattgaaaatttaaagttaatgtttaaagtgagtgattcctgcggttggttttggaactagcaataagccaaatgagtctccaaataccgtagctttaatgtttgaattctcgtttttaatagggaacaaaaacaaaatcgttaaaatgttctgaagtaaatgagttgaaatatgttccccgcaatccaaaaactgccataataccataaatgatttttcaacttaataaattggaagatgaagggcacgctgaattttacaaatactttctcatttatccattcatttgcctaatttaattttcaacaaaaattttcagtacacacgaactcgctattcatgtccgttgatttcacacttcaatgttgaggttttaatgtacattattaaatatttccgaacacttttttctgttattcaggtggacacgaaatatttggacgatgccggaacatcggaaaatgtattcgaattgtctaatagcgaattgaaaaataggacagttggtaagccgttcgaatgaattccatcggaaattggagaaaatttcgcagatgtgctcgattttgttagtgatccaataccatcgcatgactatcttccggaggaggacccgaaattgttcagaagcacaaaaacacagcgggggcccttaagcgacaattgggtggccaattttgtgcgcgaagggaaaccgattatgtgtgagttcaaatgggggggggggataaagggaaattgggggcgggaagtgcaagcatagccaagggaactggtaacccatgtgtccaaataaataccaaattattaataatttgtgaaaatcggaattcccttgcggcgctttgctcccatttctccatggattttgccaaaaaaaaagtgcgccaccattttgtgtttgtttttaaattaaggcgcctacaaactgtgcaaggtcgaatttcgctattggggtcttcagactcgcgctgagcgatggatccacgagttggcactccgcgggactatgctcagggcacacagacaagcctggtaaattgagggatttgattaaaaagcaaatgcaaattaaaacttggtactttcctgttttgaaggcacacccattttttaaaaaatgcaacaaagaacgttcaatattaatagatttattttggaggcataaaagcaacaatttctgccaaaatttcctcaaatgcgtcgacgttacgtcgcagtcctcgcgccaaagaaactcgcataaataatagtccaacatttttttaaaattggggtgtgccttcaaaacagtaaagtaccaaa

SEQ ID NO: 6298 - DNA, 2744 bp, Heterodera glycines
  misc_feature (2700)..(2700): n is a, c, g, or t
aaaatgggggggtgccttcaaaacagtaaagtaccaaacttttaagggcttggcaagacgaatgggtcggggtggaaattgaggacattcgccagttggagaaggagacgcagcaatatctgaccacactgatgttcccctcagcaacgccaatgaccaacaaaagatccgtcagcggaaacattgccaccgatgggtcggttgaggaggagagggaaggcaacggaatgcgacgagggacggacgatgaggaagagcagagacaggcggaggaggagggccaggaaaacgacgaggacggggacgccctccttcttcttcccactcggcctatttcgactgttgtgacaagatggcctacgttgagcctcaacaacggaccactttgatcagatggagttccgaattgctgatcggcatggataccgttgagttggacaagtcaccgcccatcacacccaaagtgtcatcctcccgctccctgctcatcctcgtgttccatggcgatcttttccccaaagtattcgcctcttttcatcagttaatcatcggttgactcatttcagacttcggccgactccaaaattacggacataaacaccttccgttccactctcgacactttgatagccatgcattgtccccaacttcgaggccaaatacacgtccaggtgtttttatgagccgtccatttggtccttatgcgttcctcttggaaatcctaaataatggggggggggttctaatttatttggttattaagccaaaactggtatcttgaggtttccattgtttcgatttatgagcacgaattttgaaaatcatttttttcaaattttaaaatttgtgattggagataaacgacaaacgacctattttacgacaaattgtctgtcgttatcgttcgtaattgtgattggccctgataccaatttaagtcaagttggaactaacattgtcttcctttttaagtgtgtgacctgtggggctgaactgctccaaacttcgcaagttctcagcggcgttttccccagcggattgggcacatttcacccaagttttgtgcctctgatggcagccgatgcgttgctcttcaatgatgttcgttccctttcctttggtccgtcgctaatcgattggctattttgaggctgtccaaaatgccactctgaatgctaatcgagtggtcaacagtttcatcgcttctcaagttgggaaatctgatgcctccgacttggaaatatttgtcgttggcgactttattggcggcattttgatgtacgaatcactggcaagaacggcactgacaatggccgaccagcagcagagagacggggacggctgtgccagtttgacttcaccggttgcggtcgaccagcaaaagtcgcccattccatcgctttccaaatcgcctgcatccacactttcttctccgttcatcactcagcgaccaaacaaagacaaagtaatgtcagtggagaaaactcattggggctgagttggccgagggcaatgcccccttaaataatgaaaaattgggtagttttgaaattgcgtgtaggctgtgtccggaaaataattaaaattctgtctttaaacttattacttttcaaaaatttataaaattcgaaagacttccgacaatgtagtgccgatttgtccccttttatccacttaataatttgttcgcttctcagaatccctcgcgctctctccagtcgctccctgccggcgttgaagttcccaaattcttcagcttcgatgaccagaaaaattcatttgctcattcggagtcgccctctccaatgccatcgtccgacttcaccaaaaacaagtgaatttctttttttctcgctcgtctttgggttgcttttcatttgccacattttcctctttccccctctcttccacacacttttccctttctcttgccaggtccgctcctccatgcgcatgtcgccaattgtccaattcttcggtacaatgagtgtttcccaatacatctaattttctgacttccaggattcctccctttctgccatcagaacaaatcgttctgcaaccgctgaatcgctttcattcaaaccgtccgctgcttttttgctcggatgtccactcgcgttgttgctaatgcaacgcaaattgaacgaaggtttattaaacattttagcaacaatctttttaattactcgctttgcttgcttgcttttcacacacttttctccccccccccttcagttgagcaacaactgtcgctgttctgtgggcagttgttcaatctgttctaccccctcgacctctgtgctgcccgtttggagcctgttctgaatccctctctaagtgctctccccgccctcaaagttccccggtgattattttattttccactttttgaccctctaaaattggcttttctcctcgacttcagttaccaactttacccgttgtgtgatgagaatgaccttcactttggcgactccgtcggcgttccgacggtgtggggtcagagcagagttgaccacgagttgtactgtccccctgagatgaactccttgccgaccacggcgttgcccagcattttgcacgcttcctactgggagagcaaagatctgtccgccttcattctccgccaattccttcgctccgacgagctttcctcttcggcagtgctttgtctgaattccctcaatgaacagccgnccgtttgagttccaagtgccactgacagtgtggaacaggaaaag

SEQ ID NO: 6299 - DNA, 1425 bp, Heterodera glycines
  misc_feature (1362)..(1362): n is a, c, g, or t
caaaagcctcaaaaatcctcaaaatttctcaaaaaaccacaaaaatcctcattttccaaaaaaatcctcattgatctatcaaaaagccacaaaataaggataaatcctcagatctggcaaccctgattatttgcaacttttctccattgggattttgtcactttttcttttcttaattcacattttaaggtataaacggcaaaaagaaaaaactccgttggtcggattgatggaaagcgctttgccactgctccaagaacgactttcaactttgttacccaaccaaagccaaccgtcctgcatcctccaaaaacaaattttaaaaattttttactgcctaaaccaagtaaaaggctttatatatgttaattttttacacggttttttgtttagttcacgataaaccttcaaatcctatcaatggaccagttcagcaaatggctccatttgtttttggccattttggagagggaagtgcctaacgaatgcaacactttgccagaagatgaacgggccgagacgttgtggtggaagtgcaagaaatgggcgataaaaataatacaaaggatttttgaaaggttcggctgggatggcgagagaggacattcatctctcatttcattcttataggtatggcaacaaaggcaatgtggacttatcctactccgatttcgcaactcaatattccaaggacttggtccttccggtgatcacctcgttgatggtgcatgttttgaacaatttcatcaacgggcattttgtgtccgacgaagtgctttatttcacactcagccatttgtcggatgcgatgaatcaggcgcaagtttggcaggcgttaaagccgcattttgaggtaatcattttgttaaaactaatatttttgttgcgacaaaaaaacagattacaatgaaatgttacctttcagcctttgctcaaaagtgtcattttccctctcctccaatactcaaaggaagacgagcaaatgtgggcggatgatgttgaggagtttttgcgctttaaatatgatgtttacgaggtcactttccattatatcaaaatatgttgttaaaagggactaattgcaaaagcatttcttaatgctttttgtcttcattttataggatttgcatcatccatcttccgctgcctcaactcttcttcaaatgctttgcaaacgccaaggaatcatggactctctgttggtatttatcattgagaatttgtcttcaacttccgacgttcgtcaagccgacggtgcccttcatatggtcgcgattgtttcctctcagttgcttaaactcaaagtcagctttaaattcgggtcgactttttcatccttcctttagagaaatacagaaaagncgtcgaaaaattgttggacgctaaggagattgcgcgcactgcacatgaagtgggtcttcttat

SEQ ID NO: 6300 - DNA, 3703 bp, Heterodera glycines
  misc_feature (2165)..(2165): n is a, c, g, or t
tttttgataacaaataaaggaaaattaaacgatatttttgtttagtggtccaaattgtttcgccctcatatctccgatttgctcataaatgtgttgaaattggtcaaggagactcgcgtggaagatttgcctgctgttgttgacacactcattgaaaactttgaggaggacgtcattccaattgcctacgacgttaccgttcaattggtaattgaagaaaggaggggtgaaaatcgccatatgaagcgaaatttttacccaattaagcactgacaagacagcataatgtagaggagtccatttatttatgtttttgtataaattcaggccatttacctaacaaataatggcaattcactgttttaaaacccaattcccggtcaagtaaaactcataatctctaaacaacttttattatatcaaaggtacaaacattccatgcaatggttgttggtcaagaagatggaaatgaagaggaccgaattgctgaggattacagcgttggggtggccgggattctatcgacgcttgagacaattctcggcctattggaggagcacccggacattgtgaagcgagtggagcccgttgtgcgaagttgcatcacaacaatattcgatgcttattgcgaaagtagggattttttgggaatgattgtctacttttacatctttattttcatttagcttattttgaggaggcgctttctctcacccattccctcgttttggtgcacatttcgcctgagatgtggacggtttttgaccatatttacaaggcttttctggaggaaggcacttcatttttctcaggtaaaattgtatagtctttagattattcttccctactcgatgtttgacagtttttcgccaaaaaatgtccaattttgtgcatttttgattttagtggtttggggttttcctcatccacctttgttacggcctttgctgttctaaaattcttattgttactaattgattgaccgttccgtgtttaattaggtcttttcttacatttcttattggcttcttcattcactaagattgtgcaccagtgctccacgcttttttgaccaatgacactgacaattttctgtctgtttttgaccgagtgcaacattttctggcgatgtgtgaaaaaacattgaacgatgagggtgaggacggctgtgatgagagcacaaaggcacatgcggcaaaaatgctggaggtatttaaaaaactatttaaataattaaaagtatacagaaatgcacctaagtgagtaacataattcgtaatttagataacgagaaaaaaaattcatgtacttattttttaggtttttgtgctccaatgtcaaggacgtgcaagtcatttcatcccggacatattgcgtttggttttcaatcaattgcagaaagagtcggccgatttaaaattgggccaactgaagccacaactattaattgtaatatatatataattacttattattgtaattgcttttgtccctttatcagattttgatcgctgctttgtattccgattttcaattatgctccaatttgtttggtcagctgcaattcaaaacggagattggcactttcgaatggcttattcgtgagctctattcaaatcggaaggactttgagggtgtgcacgaccgcaaaatgctcatttggttgctctgtcgcattttggctgatggaaatttgcccgctttgttcattaatcagcctgaaaaggtggttttattctaaatgctgaagagataccaaattaatttggtttagtttatggaatggcttctgactctttttgaggaactccaacggtgcatcaaagaaatagccgaacggagggaggacgactcggactcagaggacgaggagtccagcgaggaggacgacgatcggatgaacggagagttgaaagactcagacgacgatgtggacgaaggtgagcacattgaggaaacccttagcaaaagaggaaacgtcaaatttcaagagaactcgcaatatctgatggcattggagcacgaacgaaatgagcgaaaagaacggaggacgcgaaggaagtcgagcaccaacaaaagcatggacgatcagacagagggcgcaccgggcgacatcctttcccttgcatcggaaaccaccgactcggaagagcaccaccattttngaggtgtgtttattcaacgcaaaaaaagcacagaaatatccttttcaattaattcggcattttaggaagagactgaccttgaggcattttctacaccactggacgaccaaggcgacaataagccatgtctgaatgtgtttgttttgttcaaacacacattggaaggtcctttgtcattctttgactgattgaaaactttaattaacaatttcagaaatgaatacccgcaattcgcctcttttggtcagcatttctgatcagcaacgaattggcgaggcacgagttgcaaagcttaaccatttgatggaaatttgcactagagaggaaaatttggagaggtcaaagcgcttggcgcaggccggcggctattcttttgacgccaatgcgccggtgccgacaacattcagcttcagctgatcgaagagagagaaagaattctaatccattcattcgtttgtctttgatcactttgggtgtaaaataattccattatgccttttacaccgcaccacttttgaataccgctcaatgttccaattatttttatttttcgatgaatggttcgactgttgaaatttgattatattgttgacaatgagtggggttttttccatcaattcgagtatcgtattaataccttaatgacaattaagccatgttaatttgtaataagcaaatcacccgagaatgaattatgctaacttcagatgcttttcctcgcctatagggcaacattatgtaggaatttacgcagaagtgtcgtttcgaaagcagcaaataatgttgcggaacaggggacttcttcagtttcgggaaataaggagaatctgttaaatgcctatttacaggtcagtgagaaacaattggggggggggggaggaagaagccgttgggagcagttcaatattttttcaacttctgcggatatttgacccggaatttttaatgtacgattttttatttaataaaatctgtttttcagctctccaaatgccgtctcaccgcattgatcgcttgcacttccgtcagtgggttagttgaaacacaacgctttagctggaaaataacttttgggttgggcttcttccctcaaaattatcttttccttgggacggggtttcagtctcaggacgggttgatcagtcagctaacaataagtcctctcagtatgatcagttcttttctgtaactcacgatacaaatgccctgtccgttcagttttctgatgtcccccgccctctcttccgccccctcctcccttttcttctcttgcgtcgttggcactgcgcttctttcggcttctgccagtacatgcaacaacgtaatcgaacgtcagcacgataaacagatgaaaagtatgttcagaaagaccggaaaagtggcggaatgagttgctcactttctcgacagggacgcgttcgagagtgctgcccgtagggaggttgacgcccattcacgctttgctcttcgcgcggtgccacgggaactgccggaggaggcatcctttgcctctagtgtgttttctgttggttttttcg

SEQ ID NO: 6301 - DNA, 1389 bp, Heterodera glycines
tttaacttttttttaattttaaggttgtaatcacctcacctccgcccttggcttcgtaaatctcgcgctttacgccggtgcctatacgccgatgaaacgaatccatcccaggtggtcgtcttcttcctctacacctaaataattcccaacgaatgtgttttccgactttcagctgcacttggatcggtgccattgtgggtgccatcccgccactcatgggttattcagctgccaccggtcagtgtttattgttagtagggttagcgggtttaaaacatcgacctttggtgtttaactgtttacatggtcggaccccttcgcaaaaatttctgtttactcccacttcatcctatgccaggtcatctcgattcggccgcttttgtgctcggcgcactgcttttctcctggcaatttccccatttcaatgcccttagttggaatttacgtgccgattattcggcagcgggatacaaaatgatgtgcgtgacgaacgaaggattgtgcaaacggacaacattgaggtgagaggaacttcactcactccctgccctccctttccaaccaaaacaacgaaattgggtctatttcagttttacccgacaataatggataatccttaagcttgggtttttacttctctgactatatgttagggttttcttctgttaattaaggcactctgtggcgctgctttgtctctgctcttttgctgctcctttcacacatttgaccacttggaccttcgctttcacttcactccctctaaacctttcaatgctttacttggcgattcgattctatttaaatacagataaaaagtgataatattctcaattttcaatgacatttatttcttcgcaggaatgccaccaatctgttccgcttcacacttctctacctccctattttaatggccttgctgtacgcatcgaaagatggatgccaaggcattgtcgttacaaagaaatcgcaaaaactattagagtttgtagagaatatgatgttaggcttaggcttatagaaaactttgtttttgtatttgttgttaatacatattacgtaccattgctttagttttgtttttgctcatatcccatcttgggcttttatctgaataaataaattaggtaaattcgatatattaagaaaattcggcaatcctgaagaatgggtgtcccctaattttttttttattttgagttcaaaatctgttttcgagggtgtgattacgaatcagaacttggatttgcccaattccgaacctcggacccgaattcgaacaaaaagttgaaaaaaaaaattaccaaaataaacgttataaccggccgaactttggcgtaaattgtgtctttttatctaattaacaattgaagcatatttttacatcaa

SEQ ID NO: 6302 - DNA, 1292 bp, Heterodera glycines
gtacaaacaatgttagaactttcattctgctggtcgttaattttgtaagtagtacatagtatttctttaggtgagttttcaatcagttcgatccatgacgcgcccgtggcgaattcttcggcgaggaaagacgctaaatcttgttaattacatcggcctcggaaaaatgaaaaggaaggagagagagagcgaggggtgagagatagaaatggagaggaagagagggggagagacgcaacaaaagggtgtggcgacagaggaataattgatggacgaagggcgtgagaaaacgggggatgagtttgaaagaagtcacctcacctcgtaaaccgcggggatggccttagtgagttgttggtaacgcagcagaggacgcttctgcgtctcagcaattgaagcttgcttgttgaattcccgaacgtgagatgacttgaaacgatcgtcttaaaaggaaaaggcaaataaaaaacagaaaatgtatgttttctaacacgccgaaatgttcggtcgcgcgggagtggtgggtttattcggcgaacggcccacggacttcgctctttcgtgtcggacgacgatcggatgcttttccgccgacttgacgcatcgcattttgacaatggcctttagcttattttttggcctgttcggagtgagcgccgcaaccttttcaccacaattctctccgtttgtactttgcaatgtttcctccataaaaattaatgcaaatgttttgctaaattatttcctaaataggtaaaagacggagattatgatttatggtgaatttttaatgcaaaaaataaatatagctatcattaaggtcaggattttgaagcatatgcttagaatttttactaacttggcgaggtaaaaagcatgaaaacgtttttgaaacttaaaataggcatatgtataaaaaaaaattaaattctatttttacgccttttaaattaattttaaaaacgaacaaattgatacataatttgtagggctaggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaa

SEQ ID NO: 6303 - DNA, 821 bp, Heterodera glycines
tcttttgatgatggcactgttttagaagcagtgttccgcttctgacacacactttgtcctattacgattcccgaaccaaaagcctaattaattgtttaaatatttcgttttttgcgttacttatgacaaattttatttctatacgataacctatccaaaaattaagagacaacataaacttatgcaccaaatggaaatcacttcaactttaaattttaataatttcattatttttcagggctctcaaaccgttgtgtcacttccgtctacttggaagaaaccaagaaagaaaaccaaaaaagccatcaaatttgcgcctgaagatgtgatggacaaagggttaggctacgatttggaggacgatttcattgacgacgaacaagcggtgagttgtgggttattttatgttttttttttaaagttaaaccgaaggaaagtgtgatttttatgattattaacaaatttaaaaagattatttttatcctccacattaaatgttcttgatttccctttaaatttagtacgatgaatgggtgcctacgacaatggacacggccaagcgaggtcattacgtgaacaaaggaccgttggagttccgacaaatcgactttgaccagacgacctcggaggaagacgaagagaaggacggggaggaggagagcaatgggacgagacgagagacgagcattttggaagcagacgaagaggaagcgatgaatatggaatgatcaaatttctataatttacattaatttattctgtattttcatctttgtgattatttaattgctaaatattacattaaaaatcacatgcattct

SEQ ID NO: 6304 - DNA, 1437 bp, Heterodera glycines
aatttgaattttcgagtttttgttcgaattcgggtccgggatttcgaattggtcgaaatggatgcctgcttcgtgatcaacgatgccgaaaacctatggaaacatgttttcatgactttagaaaacaaaaaaaaattttgaaaaatgagttagacaaactccttttttgtggaccaatgatctaggcgattgccaaaaaaaaattgtcattgatcctactttggtcgcagtttatttacatttcaccaatagtttgcttccccgtccctgttcctccccgaaaaaaaaattctattttttgaaaatttgcagggcgattttgcggttgtgtgcagcgtggacaattccggagacggcaacgtgtcagcattgggcagtgaagtgatcccgttggaccaatgccgtcatccggcaatgtgtatgctaattgatgccagctcagtgaaacagtgcgccatttcggtgccggacgatttggtcaactattttgtgcatggcgaagacacatttaaaatgttgttggaggctgtgtccaaggtttacatattttttccatttgcgatgtaaaaatggacgggggcttttacgtttttatgcgccaaaaaaattaaaaaatatgtcaacaaagacctaaatggatagaaaattattgaaatttcaatgaaaccaaaaaaaattgtaatactattttttgtgaaattttttttattaaactatatttcttaaaaaaatattttgtaatgctgctgacttaaggttctcatcaaattcgaccaggaaaacaagcagattgttgtcaaggttactatatatatatatattttttacgtaaatttgccaaaattgttttgggttttccagtgctaaaatagcctagtatgcttttttacacaaccaaatgggtattgggcgcaggtgtttttatggaaaaaccaaacacgtgcctacttttagggtccgtgacggtttttgagttttggccatgacattcatgctcacttgccatatttttaacttatttttagtcatccaattgtaatacattttaaatgcttccggtccctgtattttttggcggtgtgtgtaaaatttgcacttttttcatgggtcaaacattttaaaaaatggattctccattcagagttttttcgccggtgcgctcaagaaagtgcagattctgaaggacactttcctgctgcacagcagacagaagatgctgttgctgaaccgtcatgaggagaccatgaaaatgttggccgcccaggagccgcccgacgagttcttcgaggagtttgaagtgcagaccgcgatgatgggacttggttggtagaacttgcgtttttgttttctgtcggaatcaaattttatggatattgggcaagggctttgtagtaaatttccttaaaaaaaatttttttttttttgtctaacaagtac

SEQ ID NO: 6305 - DNA, 6133 bp, Heterodera glycines
cacccagcggcgcaatttccaaaaccaatttctgatcacactttttgggaaaaaaatcattaattaaattagaaacaatgttcgcggaaaaaaagtgaactgtccttgaaaaacatttcgaaatttggattattttgctaaaagacttgttttataaaattttgtaatataatttttttataaacttagaatttgaatcaaattgatacaatttaaattaaatttttgtcctcccaaattaaagacctaattaaataaattatttatccaaacagaaaaaattatggaatttgcaaaatgcaaaatgaatctgtgttttgcgttctctgacataaccgttgtttgatcaatttattcacttttttcggaaaagaaataaatccgaccaccccccccccccctcgggcgacagacctttttttcctttttaatgcgatttgttaacgaattttgcgattttgagtcatttttaggagattttcataaaaatgtcgcttttttgaaactagtgaaattttttggaaaatttgggtaggtctgggggtgggggggtaccaccaaggaaaatataaaattttttactcgtttaattccacaggcctcaaaaaaaaatcaacaatattagatctatgccatcaatccggagattgctgaacaggcgcgcaacatgcttgagtttttgcaaaagcatgtcaaagtgccgcatgacaaagttgggcagatgatcggcaagcaaggcaaatcgattcaggtgagttggaccaggtggttggggtgtaaagtgacgattaaaaattttttttaaattgatttgtaaaaattccaggacattgtggacaaatcgggtgtcgtacgcgttcagattggcgaagaaaatccggaagtaaataaataatttggacacacaatggctgacttttccgggtgtactacgtccccccaccccacccacgaaattataaaatttttaatagaaaaaattacgacaaaaaaattggttgaatttttttaaaccattttgtgagttttttgaaaaaaaaaacaacagcataaaatgtatgctctgccttttcagcatggccttgtcgacttcaccttcaccggcacgcgcgaatctattggcaacgctgaactgatggtcgagtttctgctgaagcacatcaaagaaatggacgaaattcgagagtaagaaaaacacaaaaaagccatgcccccccattcattgcatgttcaaaaataaaaaaatgacgacgactattactttttctcgattatggttcggaattggtcaagcaaaaacaaaaaagctgtttttaaagggctcactcggtttatttttaaaaaatggtcccacattaaaagtctaaggaattttgcttcaaaaaaaataaatgtgtgtttttccacatgttcagggaggaggaggagtgcaagcgaaaattgttcaactctcggcactcgcccttcacttacccgaacaatgggtggcagtcccatcagcagttgaacgccagtcagagagcatccatcaatggtggtggtggtggtggtggtggtggtggtaatacaaatacaaaatgctcagaatttcagcaaatcaatacgcattaataatgaacggctttttggggtgctcggaaaaaaattcattcaagttttctcctcggattgatttttaagctgttgtgacagttttcagttatactgtcggttgaagactcccttcaaaaaaaaaaaaaaatttttttttgagataggttacggattaccgggctttaagaaatcgatttgacgccccattcattctaaatcaaacccgtttttcgaacaacattcatatttccaccaaataatattaattctttcatgaaattttctgaaatttcgaaactaccccactaaatgtaaatgttttaaatttcaagtgacgaatcgccgggttcaaggctccaaatgggtcgaaagagttcagccgatgtcgggccagcccgtgccgtacaatggcggcggcaaaggcgggggcggtgggcagaagcatcgtgctggtggaggcggtggtcgaaggtctcaggcgccgcagcgcaaccgacgggacaaggcgagtggtagtggtgcaactggtttaaatgtggggacgccccgcccagcagggcacgcggcagcatatttaagtgaatggttgacggactcggtatgttttttgtttttttgctgattgtgagattattatttctcgttgatttttttaaaactaggggtggaatcttttttcggtatttttttgtcgccggatttccacgcaccctagcaatttttatgccaaagtttctagcaaaagatttgcaatttttattttgtttttcaaaaattaatttcccggctgcgcgtatgctaccggaagtcagcattccgacactttttctgacttgaggaaccacccttgtcatacaaccactctccctggtcatacacataaatgccaattttgaaacttaaaatttatttaaaaaaacaatttcattcaaaatttttaggctgatgacgaatgaaaagagcaaaggatgatgatgcggaggaaggaagagtaggggaagagagcaatgtgtgggcgcacaatgtgtgaacaatgaggggaatttgactgatttttggcgccgaatttggacaccttttgttttatttctataatggtttcgtccctttctttctcttcttttgtgcgtaaattatgatgcaaaaaaaaaaattgttttgtttcctttgcttttcaaatttttaattaatgcattgttctatatatgttctctaattttttttctctctttttttgtgtttgtgttgccatttttgacattaaaaaaccgagaaaaatttttttatgttttactttttgtgatggaaccgcgccatcgacgaagcatccgtgaagcgaacaacattggctggacaatcaggttctgttcttgctttttttcttagcattcaatgttggctggattatggccgtcgttataggcatcgtttggaattcccatatgtcagttgcattcagtttttatcggaaaattggcaaatagtcttttttattaagcgaaaaacgcatacaaatccctataaaacgcctaattcgggatttttgatgaggagaaaaatatccctgcaaattgaatgtttgaattcagccgcccaccccaaatccaggggtcggattttgaaatttgttacaattctattctctgaccctgaaaacctataacataaaaattatttccggatatctcgactcagttcgaacaaaattacattcggaatttgtttaattctcactaaatgattcacatttttcaattgtcagtgaccacccagaagatcatgatgccaccgctgctgattgtgagcagcagcatttgctgctgaccagcaatgggaccttgtcagcagcgtcttcgtcatttggtgttgtcgatggttgcggcggaggtggtggtcgtatttatcctggactgtttgctgaggacgatgctgctgaacacaagggcaacaccagacggagtgcccaaaatggggctggtggtccagcagggcgcagcaataacattggcccaaaaggcagtggttggcctccaattaaaaggtttgtgcgtatggttgagtagtgcttgctaattagaggggattcggcacggccaagaaaaatcggggaaaattgatgccatgatcaattagtggttatgcgccggattctaaattggttgttgtcaaacgatcaaaatagcaacctttttgcgcgccggttttgaagtgtttgaaatgggacacggaaaataccacaagaatttaaaaattttcagtgtaacaatggaagaacaggccgaagatgatgatgatgtcaacggtgaccataagactgacgatgatgaggaggaggaggaaaatgaagtcgctgaagaagagccgctgtatccaacccgtggtggtaccatgaggaataataatgccaattccgtgcctgctgttgcgcaaaaaattgtcagccgtcgctctttgccaggtgaaaaagcattctaatacttacttactgtttttgtgggccaagttaaatttggtatatacatttatttttagtatattggggtgtgctaatattgaaacgaaattttgaattaaaaatcgtattttttttatacttttttttcatctggacatgtaagacaccaaattctaaacaaacatagcaaatctggacattggctagtagaaattgggtagcttgggccctgttttttttttttttgctcgtttggccaattttttggtcctagaaccggggtttcgttcttgaattttcccaaattctcatcccaactaaatatttacacgaaaataccaaggaccttgttgtctcgctcctaatacacttgtaatgtaattttttttagcttcatttcaacatcaaccacagctgcaaaagcgatggtctccccaacaacagcagcaagccgtacagcaaccatggcaacgccgtcgacaccaagccgttgttgatgatgacgaggaggacgatcaaggtggaaaaagtgccaccgatggtggaactagtgccggtttctggcagttcttcgactcaaattttgagcaatttgttgctcgaggtcacggtcaccggcggcccaccaatggtggtaaatgggaaattatttaattagaaaaattcaatttaaatttgaaaattttatttatttatttttttttgaaatcctatccgtatctgtttttaatttttggaaatttgttcagcgatgttaaaaaagaaattttttgggctaaaataataatatttctgattttctgtttcaaatgcaataaaaatgggttattaatttttactccccgttttttcagcgctttttccccgtcaaaatttgattattttcctcatcggtttgtctgttctgctcctctttgttctccctcgattttgttcacattgttctcctccgattccaatcaacagcagcagcatcagcaacatttgtctttgtccgaccgtttgcgcattttccgagccgagctgcaacagatgctcaaccaaacacgttttgccaatgtacgataaacaattctatgacaaattgaatttgtacaggcttttagccggaaaaaactcggtgggcggaacgcgaagacttttttgcttttcgggccaaaaatgttttttttccattattatttttaaaattttgattgacggggagaaaaaaacagtaattagtagccctttttcgcctaggaaaaagacttttttgccatttttggggtcagattaattgcttacaattttaattttcataaaatttcttattcttgaatattttttcatcggtcccaggaacctggaattattgttaggcaatgggtgccctagtataaaatttatcatcattaagttctccaatttcaagtccattttcggttctttttttcctacattttgcttattttttgaccatatatctttgaacatctaaaatggattgttttgaatgcctttcctccctttttaagtccgctccacgcaccaaatacaacattgaaaggacgctcaattacttggccgaacaaatgttgcgcaggcgtcgccaacgacgcaactcgctgatgaatggtgagtggatgaatggtgagtgggttcagtcccgtatccaaaaaactatttcgtggaggggcaaccggaactggtgtcgtccggcaccgccggggaaaattttgaatctttggtcaaatttgtcaagaaagtttacctaaaaagggaccgatatgtgtgtttggagaggggagtgggggtggggcggtgtacgatgtgcacccttggaaatggcgctcgacaacaaattttctattttggattcccacagcttcttaattatttatcaaattacaggctttttcatttttattttttttttgtaattcttaggtggggccaccgaagaagcagccagtgcaggcggaggtggcacatttggccaataccatccggcaccgcttgtgctgctcatttcatcgccttcctcctccaccccatccccacgaaggtggtggtggtcctccgattgttgaccaagcggcgacg

SEQ ID NO: 6306 - DNA, 5131 bp, Heterodera glycines
gtcaagtgcctttaattgttccattgagtgcctttttccacttaattctattgaaaatgcttttctcgactcccgtccactgcccccaccccgcccccgctcggctgccgaaatccgcttttagttttttagagtattttttgctacccattctctattttcaagcaattgttttttggcggcgccgccggtccgccaaagcggcgtacacaaatgaatgaattgggtgaatggaaatatttcgactgctgctgatgcatacggaaatggagaaaagtgcaaaaggcagccgcttgagcgccttccctcctgtctcatttttttgaaaatttctctccgcatgataaattgtgtgggcgcgttcgtggtggcatttcgggtcagatcggcatcaacaaattaaatttttcttggcattttatttgcggcaattgctagagatcggcgggaacggattcccgtggtatgattctctgccgaaaaattcagatgggatccccattaaaaactgataaattaaaggttgaaagagtgggagtgggagcgagagataggccaaaagacaaaaagaaagtgagggagagaaagagagagaagagtaatggcgagtagaccagccgcttgacgagagggaaatagtgaaatgaaaagatgagagaatcaaaagagcgagagatgtgaggctaaaatgataaaatgagggattgttattataagattctctacgtgttcaaaaatgaggccataaccgccagggcgccaatgactaagggtttcttatttaggtaaatgccgaaaattccgatgcgcttgataggcacaattaaatacgaaaaacgcgttttcctttggttttgagtatctacgatgactttttaatgtagtttttgcctattttaaggttttatgctttttgcctatttcccatttttggcgctcggaaaaatccttaacaaaaatgcaataaaaacgaaaacacgatgaattttcagaaaatacaaaccctaataattgaaaaaatgttcccaaaaaattagaaattttggtttaaaaattgtccttgttataaaaactttaataatttaataatttgttttacaattgaaatataattaaaattaaattttaagtcttaggtattttgctacctaaaaagcattatttaaaaaatttatttgcatgtttttgtgcttatttattgcctattttgcgattttttctttttaggtgcctatttcgcgattttttgtgtctaaaaaaggaagacagacctacaaatggcaaatttaatcactaaaatttttttgttagccaccatcttcataattgccgaagctacactggaggatgatgcttcaactggtatttaacggattcatttttcgtattagggcgcggtagcaatttgaatcctcgctctacagaattatgtaacccataattacgggaccggaaatcgtcaaaaacgccgtaatttccaatctctattccgtaaatgagtggaacattgacatttttattttttgaaaaatattttgattatgtttaaagaaaaaattaaatatttttattatgtttaaagcgaaaattaataaaatttaatttaattacaaaaatttccctggcggcgcctatgccatttgtccttatttctcagattttccttattgtatggttgggtcttagaatgccgatgaaatgcaatttaaaagtttttcaccatttttaggcattattttattaattattttgggttctttgtcactaaaatttctcactttaattattaaactgataaattgctaaaaattgtgttcgatctccgtttaggagagacttctactgcatgccatgcaagtaaaaatgacggcacgagcctgtttcgagaagaacacaaggaggccatttgtaattttttctaaataattttgaagagttttttggacccttaaaaatgattaaaactatagtttgtctgggcagtgccaggcactgtcgaagctccaattaaagcccaatctttttcgaagcttgaagtttgaagttgaaaaaatgtgaatgttggaagaacaagttttcaaaatcaatctttccaattacggacaaaagttttttcataaaattaaatgacggagttaataaatatgcaaaacaaaataaaatctttttttttgattaggtcatctagcaaactttcatgatgttgccggattatttttataaaactcatataacttgtttataattagtaaattttgcaatgaatttttataatgttatttaatatgtaaacaatggccattggtgaatatttctagcgataattcgcgttttctttattagcttatgctgttgaagctgtggttgtccaactgagggagatgacacaaaatgcaaattactcgcaactgctgtttgcacaatgctcccaagcaatggtggaggtgaaaatgttccagtttaaattatttagttttttttaatttttaaaataattttcgataaaaataaaattattatatagtaaattcttttaatgttataaaaataaataatattatcaaaaaaattaaaaggcgagttatttttaaaaagaaaacactatttggggggggggggggagaagcgcgcgtctgaggccgagaggaggtttctaaccatagttgtaccgattctaattatgttgtgttgtttatcttctcaccatgattgcgcctcttgagaatacggttgtaccttttctaaccatgggtttacctattctcgaccatagctgtacttataaccaatgttctacactcacccaaaaaatctcgttccaaacattaaaaatttattcgttgataattttcgcaaaataattggccaattaaatttgttctaaaaaattttataacccaaaatctgccctgttatcatacaattatgtaaaattttatcaataaatgtttgagatatttaagctgaaatggaacagcaaaaaactggtgtgcctctgaagaccaaagtgttaccttttccagcacagattgtaccttttcgaatcattgttgcacctcttacacctgtgatacgtggttgtaccacttacagacatggtacctcttccaaccatggctgtacctctctaaccatgattgtacctttttgaaccattgtttctcctcttccacccgtggttgtatttcttctaaccattgttgtacctcttctaatcatatttgtgactcttcacatccaaggtgttaccttctcgaaccattgtcgcacctcatccatccatggttttagctcttctaaccatggttgtgcctctttataccacggtagcaagtcttccacccgaggttcttttcttaccattgttgtacctgttacagccatggttatacttgttccgcccgcgattgtaccttttctagccatggttgtgcatttgcagaccaatgtgttatctttccagtcaatgttgtaccttttagaaccttccgtggttgtacctctataatcatggtggtgtctctgcagaccaaagtgttaccttttacagccaatgttgtaccttttcgaaccattgttgtacttcttacagccattgttctacctcttctaatcatgttgcacctcttccacccgtggttgtacctcttctaaccatggttgtgcctctttgtaccacggtagcacctcttcaacccgaggttgtacctcttcttaccattgttgtatctcttccagccatggttgtaattcttcctcatggttgtgcatttgcagaccaaagtattactttttccagccaaggttgtatctttcgaaccttccactcgtggttgtacctcttataatcatgttgttcctctgcagatccaagtgttacctttttcagccaaggttgtaccttttcgaatcattgttgcacctcttccacccgtggtacgtggttgtacctcttccagccagcttataccttttctaactatggttgtacctcttccagccatgcttgtacctcttctaacagtggttgtacctagagcccggaaatttcaaatttgcggatcctgttgcaggattggaattcaaaattttttgcaggaccggatccggccggattaatcctgcaaatcctgcaatcctgcaaatcctgcatttaaaatttgccggatcctgcgcaggattgcggatttttggaaattttgaaaaaatttcaattaaatttaaaaaatttccaaaacgataaataagtgttccgatatatttttagacaaaaactggtgaaaattaatatgaaaaattgacatcaggaatagaatgaacaagcgcgtcctcatacctaatccatatgtatattataaaaacaaagtttctgtatatttggcattgtgtcttagaaattttttttaaaatcaataaaatcccgcataatcctgcacaaaaattcaaatttgcggatcctgttgcaggattggaattcaaaaatgtttgcaggaccggatccggccggattaatcctgcaaatcctgttttttccaaaaaatgcaggattgcggactgggattctgcaaaatcctgcgcaggatccggtcctgcgcgcatttcagttggcgatccttgctacacaaagtcactatttctttttggacggagaaaatgaaatcaaagaaaagaaaattaatgtgatcgttgttcggtgtgaaaacgaccgttttggaagggctatccaagcggggcagtggtttacccaaacagttgaaaaccaaatgaaatacatgataaagtaatttttatttaaatagctattagtagggtcgctacttttagtgacgaaaatctcaaaatagttaattaaaatagtgagtgagtaaaaatgccaaaacagtgggaaaagtgacataattttagccaaaaattaagcaaaaataattttattatcttgttgcagttgcaaatgagtaggactgggatgtttaaagacaaaaaccctaaaaggtacctaaaaataatttttaaagttaaaagttcttgccaagaaaatgaatttttgagaaaaattttcacttcgtaggagtgtttttttaaaaattttggatcgatttttagggtgtgaatttttctgaaatttttaagt

SEQ ID NO: 6307 - DNA, 2127 bp, Heterodera glycines
  misc_feature (62)..(62): n is a, c, g, or t
aaaaacaaaaattattttttcgttttgatgaaaaaaaataattttaataatataattaaaanttaaaggttatcatgaaaaaggttgtggagaaatattcttttagttgttttcaaaaatttttaggttgatttttatggaaatagcattttgatcgttttcgattgaaaaaaatttaaccaaaatgccggaagtaattattagggatgatatttttatgcaaaagcattttttttcctgagctccccgtggattttggcagtttttaggtatatgttcgagtcaggtactagattcatgagtcatgactagggttataaattatatggattaacatattttttctgcgcatatgctatgaagaaagggactcaaaaatagcatttgccaattttgcgtttttagtccatattttggccatttttggcaaattttcataagaaaaatgcaaaaaaagcgaaaaatacacccctaaagatcgacttttttggaaatttttaaaaaacacacccctaaaagagaatttttcgatatttcggaattttttttagttattttgtccacttccgaaaattttcgctgaaaacagaatgagattattacaaaaattttgggttgtatttgattcgcaattgtgaagctagaatttaataaaaatcggcattttttaaatgttaaatccattttttggcagtttttagtgtatttttaagtctgttttaacaaatattgaatataaatacattttcggaattttataggggttaaaagttatattttggcagtttttagtctatattttggtccatattttgccatttttgaggtttttagtccatatttcgggcttttttagtccatattttatgtccatatttggcattttttagtccatataatttataaccctagtcatgactaacaatgaccagatcagaaaatatttatttaaagatttatatttgcatcataattttcaaaatattgaattttttaaacgtgtttgtaaaagtttgatttttttttcatctgaaagattctaatgaaattttttcaaatttaaatgtattttccactgaaaaaggaataattttttgaagattagaagaaaacaactacctggattgttaatttaaataattaaagttttatctagcaatcaaaaagcatttaattttttaggatttttagtgcaaagcttccatataagtttgattgccttagaactcatatttgaaaaaatcctagtgagatgaaaaaacaagaacagcattgtccgaatgaatatcatatatatgatcggcgaactggaaaagacctaccattttccgcattttcgcaaatgccaaaatcgaagcgcgacagagttggtcagcaaatcttcagccaaatttacccataattttttgaattttttttcttacagtttctgccaacattcaagcagaattcgcgggttttcttcgtcaaaaacaattttatgaccgtggcattgggcaaatcggcacaggacgaacagatggagagggaaatttgaaaaacattggctttaaaagacatggcaaaacgcccaattataacgtggaccattgcagaaaaattataaaatttttgatttgtaccctcccaatttgggtgaatttatgcagccagcatagtttttatgattggcagaatcttttaaatatgagactgcagactgggacctctgaaattggagacattaaattctcaaccggagacataccagaaaaaatgtgcatttggccgttttccatcactcaaaaatgccgaaatatgggaaaattttcaaatttaatttgccaagacaattccgcccttttttaccattaattttgtctaaagggccattttcatattaggcaataaattaaaatgctaataataagatagtttttgaaggaatattcagaaatttcctccccccccccttcggaagtaaatttaaatttaaaaaaaataacgcactccccaatttaggcaaacgaattgcacaaagtgagcgcacttttgcggggccaaagtggactgatgttcaccaatgcgaaggcaaacgaagtccaaaggtcgggcgcggataattcaattttttcgtaaattattttt

SEQ ID NO: 6308 - DNA, 3587 bp, Heterodera glycines
  misc_feature (431)..(431): n is a, c, g, or t
attttttaattttactttattacctagttcttattcatttaatggagcgtaagcattcatcgatggaggtcagtaaacaaattctatggtaaattatgcattttacggaaaagattacattcgttggttacaattacacacatttttattgtttgtttttggataaggcaaatcccgattattttttatgcttttacactttccttttgatagaatctttttatctgcgctcaaagtgccaagcccaactccgttttgttgttggattctttttctggctcatcgagatggtcgctgcgaggttccgagtttcaacagggaaatttacaaacggcagagccaaacggtaagatttgacaaagcaataaaaatatggacttttgtttcctgagaatcttaaaaatcaattagtcacctaaagttcaagtacncattattacccccccccccctcccacctcatctttacagtgccatttcatttccagggagtcatccgtcgtttctatgcgcggcattggctgacaagcccaacttgtatataatcccactaattcctccgtcgaagaaagagaacgcctcatctccccgctgtgcgcctatccgttcaactttggcaagcaaagcgcgtttcatccaaacgcacccctgcggtgatttcatttttatcggcgccgaaaacaaattgctaatttgggaggtattttaacccaagcgaaattgattttcatttttcacttatttcattttcagatccattctggccaattgctttcccaggtcgaggcacatttgcgagatataagcgcaatgcgaatttcttcgtgtggccatttcttggtgaccgcctcattggacggagatgcgaaggtcttcatgacggccaagtaggaatttatacatttttttcatatgttaatatttctctccagggatttataaatccccgagaaactaatctttcatttgatgtcaaaaatgtatggttcgactaaataagaaaaaattatgacctaagaaactgaagatgcgtctaaaatcgattttacagagaaaaaaattcttcgtaaaattttctgggttttccttggaattttaaaaagattgcgaaacaaaagggtgcccccttttgtttttgaaattcaaaatcggccacttttcatatagcgccaaaaaaccttcgagaattagaaaataaattttcgtttttaaattttttcaagtgatggggaaaggaatgaaaatagtgtaccctgggaattagaggttgattttgattttttttttctttgctcttccaatccgttctcctcaatcagtcttatcactgaacgtgacctcggcctttccgccgccaatgtctctccgttcgccgtttattcgccccattcgcttcccatcacagacctttttctgtctggtggtgctcactcgtcacttcgaattctctccatttcagctgatcacagcgcggcacttttctcactgtcgacccaacaggttgggaaaacctttttaaaaattaaatagcaaaataacgctttttctccagattcttctgcgtgtcactgctgatcggccgttgaccgcctgctgtatggactcggccgagttgcgcatttttcttgccgctgattcgggttccatccgttcgttggacatttgtgcgcaggtcgttcgtttcgttgactctgtgctgatcagctttgcccctgtcttttctctttatgctcctctttcttcagttctctgatcattttgtgccattttcttccgccccaaattcgtcctcttccctcgctgtttcttcgtatatccgtcgttttgaccaccaacacaatgcccaagtctccaaattgtcagtgtccgcagatggcacgcgaatggcgtccggagatgaaaagggctgttattcggtgtgggacacggcaaatggccaatgtttgctgagcggcacaatgcatggtagcagaccaacaatgaatttatttgtttgctaattcatccccctttttagggccaatctccgcgctttccttccgtcgctattggccgaccatcgatgagtcatcaaataatgatttgtacaacagtcaatggaattctgtggcagttctccagcgaaattttccaacaaaacggagcttaaaaatgatcagacattggggagggactgacaaagagtcggctgtggtcggacatgcatttgggaatccatttcatttcatcaattcagaacgatgttggcgaattactcggcaaattggtcaaacagataaacagcggcgaaagaattttggcttcttggggtgacggcattggcataccaattgggaaaaaagcggtattgatcaagcaataattgtgtattagcctttaaattggctgtgccaattcagccttcgtcaaagatcgatggcaaaaggcggagcatttcaaatgcgaaatcgccgctagcaaaagcattacacaacggcgacgtcaatggaaatattgaaactgccagcgaacgcgagaaactgttgtcgaaggaagtgcggtgcctgcgtcgagagttggcgcgagttgtgcaactgaacacagaactgtacaattacagtacaaacatggtactggaagagagtttcacggaaaagagcacgaggagaagcaacagctgacggaaaaagagaaaagccatcatttattatcactattcaatatgaagtttgttaactgttttgagagaataacaaatccaacattccaattttttgaaagaacagccaattaaataattttgggagtcgggctcttttttagaacataaatctgggtaacatttttcatcaggatgattttgttgttgagttcattgaagcagaaattgtagtcagagaagagccgtttatttttacgctaatgttttacttacgttaaagggaaaaacagaatgagaaaaacaaatgaaatgatttactgaaatcattattacagcatggttggcaaatgagaaagaagacgaggtgaggaaagggcaaggagagaacatttgcttacaatgggcgagggatggacgacaaaagcggcaaaagggaaagatcgactgctgtaaccgccccctcacaaccaaatggaattgaatttaaaatgaaaatccaagagaaaataagtcgcgaattagatccagtaatgcgcatcagtatttggcaagacaattggcaattagaagaaatgtatgacaatctcagacacacccgcaatcattgtgatggcccaacgccaaaaaccaacgcccgcgtgaggcgtccgccgtctgttggcaataagcgagcgcaactgcaacaaggtgtccgagttttgattttttcctgaaaaatccgatgaggcgtatgtgccaaatgaagtgcccaccatgcacatatttggtggcaactgccaattccaaactcggcacttcgtccgtcgcgctaacactgcgttcattctgtcatggaagcgattaagcggagaaaatgaaaaatcctaaacattctcaagcagaatccatacgagacgttctccgggcgattcaaatccataagtcataaacacaaagtacgttttgcg

SEQ ID NO: 6309 - DNA, 4542 bp, Heterodera glycines
  misc_feature (3867)..(3867): n is a, c, g, or t
  misc_feature (3869)..(3869): n is a, c, g, or t
  misc_feature (3872)..(3872): n is a, c, g, or t
  misc_feature (3889)..(3889): n is a, c, g, or t
  misc_feature (3893)..(3893): n is a, c, g, or t
  misc_feature (3904)..(3904): n is a, c, g, or t
  misc_feature (3909)..(3909): n is a, c, g, or t
  misc_feature (3967)..(3967): n is a, c, g, or t
  misc_feature (3971)..(3971): n is a, c, g, or t
  misc_feature (3973)..(3973): n is a, c, g, or t
  misc_feature (3976)..(3976): n is a, c, g, or t
  misc_feature (3985)..(3985): n is a, c, g, or t
  misc_feature (3994)..(3994): n is a, c, g, or t
  misc_feature (3997)..(3997): n is a, c, g, or t
  misc_feature (4002)..(4002): n is a, c, g, or t
  misc_feature (4009)..(4011): n is a, c, g, or t
  misc_feature (4015)..(4016): n is a, c, g, or t
  misc_feature (4018)..(4019): n is a, c, g, or t
  misc_feature (4025)..(4025): n is a, c, g, or t
  misc_feature (4031)..(4031): n is a, c, g, or t
  misc_feature (4034)..(4034): n is a, c, g, or t
  misc_feature (4086)..(4086): n is a, c, g, or t
  misc_feature (4144)..(4144): n is a, c, g, or t
  misc_feature (4189)..(4189): n is a, c, g, or t
  misc_feature (4203)..(4204): n is a, c, g, or t
  misc_feature (4246)..(4246): n is a, c, g, or t
  misc_feature (4253)..(4253): n is a, c, g, or t
  misc_feature (4261)..(4262): n is a, c, g, or t
  misc_feature (4280)..(4281): n is a, c, g, or t
  misc_feature (4294)..(4294): n is a, c, g, or t
  misc_feature (4302)..(4302): n is a, c, g, or t
  misc_feature (4311)..(4312): n is a, c, g, or t
  misc_feature (4324)..(4324): n is a, c, g, or t
  misc_feature (4327)..(4327): n is a, c, g, or t
  misc_feature (4329)..(4329): n is a, c, g, or t
  misc_feature (4335)..(4335): n is a, c, g, or t
  misc_feature (4338)..(4338): n is a, c, g, or t
  misc_feature (4341)..(4341): n is a, c, g, or t
  misc_feature (4356)..(4356): n is a, c, g, or t
  misc_feature (4370)..(4370): n is a, c, g, or t
  misc_feature (4373)..(4373): n is a, c, g, or t
  misc_feature (4377)..(4377): n is a, c, g, or t
  misc_feature (4380)..(4381): n is a, c, g, or t
  misc_feature (4395)..(4395): n is a, c, g, or t
  misc_feature (4405)..(4405): n is a, c, g, or t
  misc_feature (4408)..(4408): n is a, c, g, or t
  misc_feature (4410)..(4410): n is a, c, g, or t
  misc_feature (4414)..(4414): n is a, c, g, or t
  misc_feature (4416)..(4416): n is a, c, g, or t
  misc_feature (4423)..(4423): n is a, c, g, or t
  misc_feature (4425)..(4425): n is a, c, g, or t
  misc_feature (4435)..(4436): n is a, c, g, or t
  misc_feature (4441)..(4441): n is a, c, g, or t
  misc_feature (4444)..(4444): n is a, c, g, or t
ttcatcaggatgattttgttgttgagttcattgaagcataaattgtagtcagagaagagccgtttatttttacgctaatgttttacttacgttaaagggaaaaacagaatgagaaaaacaaatgaaatgatttactgaaatcattattacagcatggtgggcaaatgagaaagaagacgaggtgaggaaagggcaaggagagaacatttgcttagcaatgggcgagggatggacgacaaaagcggcaaaggcaaaagggaaagatcgactactgtaaccgccccctcacaaccaaatggaattgaatttaaaatgaaaaatccaagagaaaataagtcgcgaattagatccagtaatgcgcatcagtatttggcaagtcaattggcaattagaagaaatgtatgacaatctcagacacacccgcaatcattgtgatggcccaacgccaaaaaccaacgcccgcgtgaggcgtccgccgtctgttggcaataagcgaacgcaactgcaacaaggtgtccgagttttgattttttcctgaaaaatccgatgaggcgtatgtgccaaatgaagtgcccaccatgcacatatttggtggcaactgccaattccaaactcggcacttcgtccgtcgcgctaacactgcgttcattctgtcatggaagcgattaagcggagaaaatgaaaaatccccaacattctcaagcagaatccaaacgagacgttctccgggtgattcaaatccataagtcataaacacaaagtacgttttgcgtatcccaaaagtggcaggatcaaaaggcgtcaatgaccaatgtcgcaattggaagccatttagcggagtgatatgcaatgacaatttgtcagtgccaccttggatggcgatggttaggttcagttggtttccaggtagatgttgacgctggacgagtcgcactgacagagggctggcgatgggcggttgggtgggcagcggcacccaccgagaacgccttggggagaaaagacatttcaaataaattacaaaaagtactcctcgacatactctggagggaatagttcgtggatagcggtgtagtaagggagctgacaatactcatccgaagtgtgtgagcagtccggctgaccagcaccttaaaaatgaacggcgtaactttttttcaattttatgcacttttaccttgcaaaaacgtatgttctggaagatcgtccggaccacgatagtcaagagtttgaacaaaaagaccagaatcggtagaatttaacgatgaaattcgattttcaacaatttttttgtcaaaattataaattcgtcttgtggcatgctaaatgagaacaatggcatttaattgaccaaatccgacacagaccaaagcaattagtcggcgaatgcgtggctcatcttccgaaaatttataaggtactccaacactcgtagtggcaacgaccagaaaagcgaatgcaaaaacagcggtcatgcatttgatcatgaaattcaatcggcgactcatgtaaaccaaattgttctgaaacgagggcaaattgttgggtatcccatgaagaagagacaaacaaatttaatgctaaaaacaaagaccaaccgtaaacaaaacaaaagtgaaagcgacgagcaaagaaaaggccatcataacctgaattccaattacatttccctattcatggccctttaaaatcacaagttcggggttaattccgttcccaagtcggcccattgttgggacgaaaaagttgaacagcatttgtgtgtgactactgcacatggcaatgatcggagtcaaacatacaatttgagcagtcagaagagcgcgtggggaaaaggctttaaaaaagagataaagcaaaaatgaaaaaaaaagttgaaagagacctttgaaaaggccaaccgatgtcatcaaagagacgagagggtcccgaagaagagggaaaaagacatggatgaagaacaggaaggagctggcggtgcccagccaggtgagaagcagcagcaccaatgcccattggatgacggtgaagtcgtaatggaccctctccaacgaagccatgtgagcacccttaaggggacgagcaatggaaaggcaattttgaattgggcaataaaaaacgcactttgcgcctcgcacgttgtgccattgcgttgtgcacagcaatggacgcggtcagcatgggcagaatataaagggggaaaaccaactcgggcaacgcgtaccaagacatggtcagattgaacacgctgagcacacaaacaacgaaagcaccgacggcaaccatagcgaaaagggcgagaagctggtgccaaaaagcagcctgacaatgcagcaggaaagcgtaagtggagggagaaagtggcaaagaaagcaaccataagtccaccaattgtgtaagtgccgtgctgaagacgacgccagaccaaaaaagcgacgaccaaacagacggaatagtgcagaaaaacagctaaaacagatggataactgcggtaagtccgttttgcttggtcgaatcctacctatatgcatgctgaaaaatacggtgaacaggccgaccacgtcgaagaacacccaattgctgccctcgttgaagtcggcgggctgtttgagatagggtgagcgtatcagtgccttggccagggccaacacattgtcgccagaacgttgaatggcgcccggttcgatccgctgtggttggtcgaactcagtgtggtacacccacccgtttcgaatgtaagcgatgtcgaaccctaaaaaataaaaaataaattacaaattcctgagaaaaaacccgatattcggccatagtcacgaaaaacgcgaaagtccgtgtcagatggaatcactccaagctgaaatatttcttggcccatcacactgcagtgcgggtacggagcgttgtcaagataagttttgatcaaccaagattcaccgggaccagtctgaagggggaggggggaaatattacgatgtttttatttggagtaataaaatggtctttcccatccggctgtcctcgggtggtatttctgaacctgaaacaccaattctcggccacctgccccgcagccctcgaggttaatgaatgcccgaattgagtggcgccaagggtggtccgttataaaaccatgcgacgcctgcaggaaattttcttcagctgaaaatgtaaattccttacaaggagaactttttcccattttgctgattcaaaattttataccaaaaactcaccagcattgaagaggaacagaatgtcattttccaaaggcttttccgagtgtgccaacacttccaaaatgtcgaccataatcgcacaggacaccgcgtcgtccgttgcgccgggcgtgtcgggcagcgtgtcataatgacaattgatcagaatggaatgatcagtgggccgttggcctcgcggtccaatgcgaacaaccaaattggtcactttgtggtagcaaagagtaaacacagacagaaattttaagtcgaaacagccgcttggcctttggacgtccaattccttaaattggccaacggatgatcgttaattttgctactgtcaaagggaatgttcaaagagaaacgcatttaccaatcgattgacgccctttcgctcaatcaccgttctgagctgctcgattttcgaggtcaaaattcggaatgcgtgaatctaatagtaaaaaacaaaaagttgaaatttaagaagtttcgatttgagtgttttattctttcaaaatcaaattggccattcacttcacaattgtcggacccactcggccgcggtccaagatctgtcagcgcattgagcacaactcgggcacgctcttccgaaaaattacccttttcagacgaagagacaaccgaaggcatncnctnttcctaccaaaccactnaaanacaattaaatnctatnaaatttaaaccaccatactcattccttatacaattcccactatacataatactataanccantnaanaaacccaanctaaactcncancctcnttaacannnctanncnnattcanttaaantancctatttccatttcacaatttcctttaaaattcctaattttcattaaaaacnataaaaatttatatccctaaacttccaatttttatatcctaattttacccatccaatnttcaatttctttaccccataactttattttcttacttactcaatncctacattctttcnntcctcaattctcctttaatttttaataatactcaaaaaaacnaattttnaaattctnnacataaattctaaaactnntcacatatccatnaaaactcncctcattcnntcccccatttcnatnantcctcnccntcntttcttctcccccantcctcccatttctnttntcanttnntccttccggggttntttctttctnttntntttntncccttcntnatctcaattnnccttnttntcctccattattttttaaggataaaaacatctttataaatatttaccacgctctatgttgggggtaaaaatgacaataagtatagcggtacttttata

SEQ ID NO: 6310 - DNA, 1653 bp, Heterodera glycines
ggctggggatggtgtccagacatttgcgtcccggacatttgcggcccggacatttgcggctcggacatttgcggccacagccaaatcggacatttgcgttccggacatttgcggcccgacatttgcgtcccggacatttgcggccccatttcttaagggccattttcggacatttgcggcccaattttttgctgaattttgcggcccaagccaaaatcggacatttgcggctttgccctactttcttcatcataatatttaactttttcaatacatcaattaacacacaaaattcttttattttctaatgatttgctcaatgtttaacggtcttacattttcatccaaatttttaaaatcgaaattcaaaaaaacaataaaccaactgtgcataattattttcccctattatccaattaacccaaataagtatcgcctcgcagaggggcttcatgaatggggtgaaatatgaaaaaatgatgctcgttgggccttgagcaagccattggaaatataagaaatttatgtgtgttaattggataataggggaaataattatgtacagttggtttattgtttttttttgaatttcgattctaaaaaattggataatgaataggttacacgaagccgcaaatgtcgggccgcaaatgtccgaaaatggcccttaagaaatgggccgcaaatgtccgggacgcaaatgtccgattttggcttgggccgcaaaattcagcaaaaaattgggccgcaaatgtccgaaaatggcccttaagaaatgggccgcaaatgtccaggacgcaaatgtcgggacgcaaatgtcgggccgcaaatgtccgaatttggctggagccgcaaatgtccgagccgcaaaagcaggggtaaccgctggggatgcatatttgattgaattaagaatttaatggctcaaattttcagattctcgtgagtacatcgactgcgaaagcggcgatctgaagacactcgaaggcgcatttcaccaacttaggacggagatggaaaacgttgcgttcatcgactttgatacaccgaaatgaacgaattcccattcgtgtgggcgtataagtgtgatcagttgcagcagaagacaattaaaagattaagagcttaatttgttgacaatttagacaatcattttgtttatatatatatatatatattttttttttgcttatattttcttgtaatctgcataattaagaaattcagcgactgttttaaaattttaaagaaatcggaggttaatttttgcatagttcacctcccggtctacttaaaatggccaatttcctaaaagcccaaaaaattttatttttcgaaaaaggaggcaccgtcatccccaaggtcaattgttaatggaaaatttcttacaatttttcatactgacacaaaaattttttacctgccatgatgaattttgtaaaatattgtgttacgaattttgtaaaaaattgaatttttaaattgttgaactcaaatactgcaaattataacaggatttgtaataacagttaagaatggttaacacacgctcaaacgcgcaaaatggacgcccgaaacgtgaaaaatttgaggaggagttggaaaatgccatcgctggagccataattgtgcacgcacatcgtgccacgaagc

SEQ ID NO: 6311 - DNA, 1683 bp, Heterodera glycines
ttaatgaattgatggaaccgaacaatggattttatgccttctatggggacaaaataccagtgacaatcaattttgctgtgggcgaagcaaaagtggataaatccatttctgattcaagcaaatcctatggacacttttatggatattgaaaaagtgtcggaatttgcgagggaaattattattaatgaacgtgtaaatgaatctgtcacttatataaagggattgccatggaaaatatgggcacaaataaataagaaaatgaaagcactgacaataatgagaaatgtttggccattttcctttattgtgcggctccaaaagagggtgcaaattaatgttaattgataatatttaataatattatttttagatataaattggaattgcaaatgttcggcaactcttcgaattgtgtcgcaaaagagcgaagtggcggatttcaagaaagaattcagggaagaaataaatttcaacagcgaacgatcgccaggggattccctctttttatgtcatttttttggcaaattatgttaacatattccactcaaaatttttccggcggcgcctatcggcaccgccggaccccccccccccaatgttcctaaaaacttttttgaaaaacagcgcaacaaaatttcggtttaaaagcaaaaaattaaagaaattgttaatttattaaaaaaaatccagaattttggacagaaaattccaattttatgggtacatttttgaatattggcaattttcgtaacaaagtgcacttaaattttcaaattaaaaaaatttcatttgggaacagtcccggttggtcccggtccccggttttttcgcggtcccggtcgaaaatcgaggcccaggtcccgacttttctggttccggcaagtcccggtttttgtcaaaaatccgtcctgctcagctctaattttttattttcgttaagatgttaattatttaataaattgtccattaacaaaaaatgcaaaacgatgaccaaaaaaatagggaccaacggtgatcacagaaaaattaatttaaatgtatttcatatttttctaataaatattaatttattaataaaaataaattttgttaaagtcaaaagttaaatttatttgtattatttatatatttggtaaattagttcagcttaatatgactgcgcgagattctcgctcctcaattgcattttgatgatttttggctgacactgactgaaaataaatgcgacactcgccaaaatgacagtttttcattgaaattcagactctattaaagcaactccaacatttaattcaataaatttttcacctgtttttgcttctttcactgtgacatcgatggccaaagtcactttgtcctcgctttggtcgtaaaagcctttttccgggtccaccaattccttaattatattaatttaaaattaaaaagacattttaaatgccacccacagcaaattcaatggaattgctgaattccaagtgattatattcattgtttccaaaatctgaataaacttctcttctcaaatcagtcacaccattcttttgcgagacaattcgaatggttgccgaacatttacagctccaattttctgctcattgcaaattaatcagttaattcatattaattagcctttaatttgcaccttcttttggagcagcgcagaaaagaaaaatgttgata

SEQ ID NO: 6312 - DNA, 3334 bp, Heterodera glycines
tgaaagcatgcgtccggagcttttcaaaggtcattgatcacgaatatgacaatcctttttcatatgtaacgagatttaactagagtagagcgggaccgggaccaaaacacggacaactgagtacaactgagtaccgaggtcccggttttgaccgggaccgggaccagtcccgggtttttcccggttttcccagccaaaaattcccggtttttcaacccgaaaaggtcccggtcccggttaagcccaaaattcccggtcccgctcaaaaaaacgaacagaaaatttatttaaaatttataaaaatcttgtaaaagtaaaaaggaaaatctgtttttcgcgtactatataaaaacaaatttaacaaggcaaagaaaattatcagaaatcacgggttcatgacaattacgcgaaacacagcgatgaaattccaaataatatgcgccttttgctttacgtaataaaattttttttattttataaatgaaattaccgtatttgctctttttatatgccatggtatattatttttcaacctcctcagaagggggtagataattggagattggtagactaatggagactgggagattatttttcgttgatttatttagtggaaaatttttgaaatttattttaaacatgtcgccaaaaaatgtcatcgcgtcaaaaaaaaaacatttttattgcatttatgttaaagaacttctgaaaatgactccaaaatgacaaaaatctatcattttcttgcttccggtatgcataaaaattggaatttttaatggtgaaagatggacgaaacgatcacgaagaagcctttttttattttttttaatattaattttaattttaaaagtttttagttttttttggcttttctgatgattagtgtcgctacttttagtgatttaacgaatttttttgctcaattgttatgaagaaaggagctcaaaaaacgtattttttcgttgaaatttttcgattctgatgtcactatcgggcactagaaatcactacctattttggcgcttcgtactaaaatagtgaaaatttactatttcgacatttttaggaaaattccttaacaaaaatgcaataaaaccaaaaaaatacacccctaagaaacgacctaaacattttttcaaaaataccactaagaattggaaaattttcttaaaaattcttcccacaatttttttttcttgacaaattttgattaaaaatgttcagtattttgataagggaatagttcaaaggaaaagtacctcatttgcaactccaattagtgaataaaattattttggcttaatttttgactgaaaattaggtcactattcgtcactatttcggactttttgccactattttggaatttttactcactattttagttaactatttcgagattttccgtcactaaaagtagcgaccctactctaatgatgatgcagggctggatggagtcggagatgacaacgaattgttcatttattagccccttttactgttgaatgattttttttggaaaatgtgccaaataaattattaaaaaattctatttatcccccctggcacataaatggagactggtagattattttgcaacctcctcagaaaggggtacataattggagaccggcagtttaatggagactggcacataaaaagagcaaatacggtaagtcaatgacttttttttctgctgattcgaaatgccataaattatttaaaaatctacactttgtttaaagcttctaactattatgcatttttttttctacttttaagaatttttttgcaactttttgattttttcgtaaatttttagttgacttttgatgttttttcgcatttaaatttctatccctacttttcgttccggcctaaaaatacacagcacagttaccagaattggtcgtccaaatttgaccttttttccgagttcgggttacgcatggggtcaaaatgggtctaaatggatgacggatttatgatcagtggccttgaaaacctatgcatttttaatttaaattaaaatgaaaaattgttttgagttaaactgcataagagctgccaaatcgaaaaaagagagtgaagaaatgagaatgaataaattggtactttactgttatgtgactaaagccaaatttcaaaaaatcaacaaaagggcgcgcaaaattcacacgataagctgatccatttgataaactttatcagcgatttttacattttttcctcccaagtgatgctgctgtctgctgtgcgattttcgcgcccttttgttgattttttaatttcgagttgtgaaagtccgggctttttgtttatgatggaaaatctctttgctgatgaaatgctataaggaatcactcggaaaaacaaagtcaattatataaaaaagcttagaatttgcggatattataaagcaaaattatattaaatttacgcctaattcctcccttttaccttttgggaaaacgagcaaaatttcaaaaagaatgaaaattaaattctatttatacctacttcgatggattatttttttaaatgacaggtctatgaccacgatgttaaccggcaaagggtcagccgtgcgcaattgcccgcggtgattgacgagatcatgaacgaagcaaatgaaggcgccagggcattcattttggcgaatttagagaatgtccgaaaggttaatatggggttaaacggtcgggaaggctcggtcaaaaagaattagtaactgtatcagccacgggtcgcagtcgcagtctttctgagaatttttactaaagttttttattttttgaattggcaatttgcgtccaggtcgacgctgttggtatcaactagagtagagcgggaccgggaccgggccgggaattcccggtcctcagaggtcccggtcccagattttgaaaagctcaggttccggtcccggtagggcaaccgggaaccgggaaaaacaagcactggtaagaatggggtctgagtgaaaaattagtgaagaaaattggagtcaacgggaaaaataaaaaataataattaatatattctttaaaagtaaaactcctaagtgtgcaaatggcctagtggctagtctccttgactttccttacttctttcccctggttcaatccctctacagaaattagattattttcaattttttttttgtatactcgtgggtttcctataaagaaaatatgattcctcatagttttttttaaattgatacatattttatcattttttaaatgaaaatcctaccaattgagcttaataatcgcaaaaaccaacctttttttgttgaaaatctgttaacaaattgcacccaaatttt

SEQ ID NO: 6313 - DNA, 2727 bp, Heterodera glycines
  misc_feature (53)..(53): n is a, c, g, or t
  misc_feature (2664)..(2664): n is a, c, g, or t
  misc_feature (2667)..(2667): n is a, c, g, or t
agagtaaatgaccaggcagaaaagtgtaaatcaaaagcaaggaggaccgatgnaatgatgagacggaacagaacacagaacaaggcacaggacggacagaaggaaagggccaatgggggaaaagcggaaaatgggggggggggcacgggaaacggcacaatgccaaaggacaaacaacgaatgaccagcgagaggagtgctaaatagtcggttaaactgcttgaagacggggccaatagaagtgcattttgaagtgcgacatttcaaagtgtcaaatgccccatcattaatgaattaattacctaattaatttgcgttttccttctctcttttttacatttgctttgaacaactgtcgcatttgttaaagaaatatgcgattgttctgctcttttccctctttcttctcttctgtcgcttttctttcaccaaaaagtgcaataaaacataaaacggtggtcaaatgaaggaacgaaacggcgggcgaactgatggatttacaaagggccaaaaaagcataaatcccgaacagaaaaaggccaatggcatttccaagtgataatttgcgagcgaccaaatgaaatcgctttcaaattgttgaggttcattcattacgcaatcggttaatttcttttagtccttccaatttggcactgatcatttcccattttaattgattgaataatttatgattgcctccgttttctgccgagattcccttcactccctttcccccatcctttttttcattttttttctttccatctctaatctgttgcgcttcttcttgcgatggtttttctctcttccgccgttcgttccttcgtccgcccatccgccgcattttcaaataaggcgttgtgtctgtttgctgtcgaagaactatataagcgaatcaatgaaaatctacaaaactgaaaaacaaagtttaaaatcagcaggcacaaaaacattctcttccaacttgattcctcaacaaatatgggtaactgacagggctcattgtgtgcacattgttgtggagtgtgacttgctcatttcctttctgacgattgtttagctccatatatgcggggggcgggggtgaaattatcgttggcaataggtcttcgtcctcgccctgttcttctttgcctctctgacggtttctgtttcgacctcctactcctcctcctcctcctcttcttcttccttgtctatgaataatggccgaacccaaagctaatctttctccccctcgttggttatcactaattcgtgtttcaacgacacttcttggacctccgcttgcttcagcttttgcacgggcgtcttcacctccacgtgccattacgacgacttgctggtgcgcgccatcacgatcatcattattatcatcactcgtcttttgggtttgccctttgttggctgcagcaactgcaacaccgccttcacgttcactcaacgcttccgctcttacaatatggctgtcctcctcctcctcctcctccataccactgccttcctctcggttgacaccggtttcagctctagccctggagccttccccggttgcggcgactgctgcccatgtacccttttcgtgtcggtcaggccatttgaaatctctggcattgtcgtcaatcgatttcagtgtatccccccatggttcaggacttctctttgacgctattgagtagacaacagaataaaattggaatagaaaaaacgaaaaaagcatttttttattcaaagttatcagtgatgaatgaagacaatagtgaaaaggccttatttatatgctcaacagaggcgagtccagtgataattgctttgccagaatgataaacaatacaagttgcatgaacatcattatcagtcagtgagagtttgcatcgaagtgctgggaatattgttgggtcataacggacagaaaaaaattctttgcgagtgtacaggacaggcaacaggtgaacaatgggtattcggtgtgggaatgtgtgagaacatacaatgttgaccactcgcaaatttatcaaagaaaatttttctgctttgttggtagcatgattataagcatgttgtatacgtcgaaggacacggtgggcaactatctttgcaaaacttggtttccttacaccagtcaaaacaactcgtcctgattgaaaaataaggcacgcaactgttctcccagcgtagcgaagccgcataattattgagtgaaaacggcgtgtgttcaattcaacatttgctccattacgagcaatttttaaaaattcgtctttgctcaggcgtcgccttattattttgaaagtaacggtgcagttttgaatgtttagcataattttatggctaaaaatttgttacaacagtaataatcaatgaaaaaaaagaattatccgtcattgacatgtaattaaaatcaattcatcaatcaatctttctgttatccttctcttaacactctctctctctctctctctctctcaattctgcttcacaacattcaaacactcgagcgggaacaggtcgtaatgttcacctccacccaaacgcactacacatggaaggtttgggtgccgtaggcggagtccgtgtttaacgtaataatagattcgcacctttaatttttctatttatacagccaccaaatgcatgagcaaacaaaccgtaataagcaaatanccncgcattgcaaaagcatcagttgctgaaaaaggggacaaatcactacatttacgacaaagt

SEQ ID NO: 6314 - DNA, 4699 bp, Heterodera glycines
ctttcgaactttgtttgactgtaaatgcaatgaatctcgacaatttctccgttcctcagcagcacttcgagaggagcagcagaaccttcggttggtcggcaaatgccttttctgtgccaattgaatgaacagcctcatcggccgcccttttgagatgcccttggaataataaatcggccgaatttgcataatttgcgctaaaaaatgatgccgacagcagcgaccattcagcaaaagccgaatactcttcagttcaaaagtgcagattcatccgccacttcatccatttattctgcgcaaaaataaacggaaggacggacggcactttttggaggaaaaggacggcactcaaagaaaaaagggaggggagacaaaagcagacgaaaaaacaatggaaaactagaaaaatggagccagaaaaagtaaaatttggaaaaatggcaaaagtgcgaaaaaaggaaccgaaattatgtattaagggctgcaaattttgcataaaatgatgaataaccgtgacatgcgaaagtgcacttgacctttcagcagcacaattaagcggaatttcggcacggagccaaagggaaagggaacgaatggtggggacagaagagacaatccaatggcatggtaattatttgcgcgatgccatcccaacgacccaatgggacagaataattggacggatggcctattgaaagaagggggagagaaaaactgatcaaagaattcccgcacataaatgaaaaaagggagagcgagaacagaaggaggggggaagaggacaaaaaagggaaaaagaaaatgccgaaaagtatgcttaaaaaaattcaaaattacatcgatgggtcagtgccgtggcttctttttttgagtgattcgatttcgcacgccgctcttctccaaaattcatcttgacccttccatttgatcggtttgtttgtgaatgttccttctctcgttggagattactcacaaaatgccgttgtccatgtgaaaggtcgcccccccccctcgcccattcgattgcccacggcattttgccaacgcttcaatttgaatgcaatggtgcactttttaatcggagaggacgcgaaaagcgtcggtgaatgaccaatgggcaacgtatgagcacagaacgggtaaatgaggagaagagcgatgggcgatgagcagcactcctcaattagacaattaattgcccaattaacctttcccccttcgtccgtttaatccgccgtccgtttgttgcgtttgattttgtccattgcccggcgaatgaccgacggaccatccgtataaaaggggaacaaaacgaagccaattcattccgtcaactttcactccaaccccaattcgtatttttgtctcctcataatatttcgatcccaattgattgctgttttcccagtttttccctttaaattcctttccctccttctcttctcttttctttccctctcccatttcaaaaatggcatccctttcttttttttctttgcccctcctcaaatttaccaacaaaaattcgcttcaaatttgttcgattctgcagctgttttttgtccaccgttcggatcagcacatttctcattgtgaatgtcaaggaatgccgagttcattcacatgattgaaatgtgctggtcccatcggtggttcgtttcggcactttttcttcaattttttcccgtttcggcatttcctcgattccttcacaattcttccgtcatcttctcatcctttctcggtttgtatatgcactcttcggtggactgaactgctcctcctcgttgttcaccgggtgttcatatgcaaattgagtctgcgatttgctactttccacaatttgccgtgctttggtctggcggagggccttttcgtgagccaaatccgaacaatcggacggcgatttggcacgagaagtcctttccccagcaccaagcaaaaaaaaattttcgaatttcacactttggtcgctaccccattgtgaacttcgaactcgaattttattttttctgccttttaaatgaatttttgaagaaaacaaccgagttacataaactagaaaagtgccatacaaaaaattgacatgataaaatttacgtgcactgccaaacattttttccttcaaaaaatgtttcaacgaatgcccaatattttaatgagaaaaaatgaaatttaattaaatgagagaacattaaaatgcaaacaaataataaaacgttacaaaatatttatgcataaattaatgattaaacattctttgggagaataatttaaaaaattgagacgcaaagattcatttaacattaattaaaaggacttttaaatttatttctccacaaaaattgtctcaaatggcccctctttgcttctgtttgctcattttgtccctattgtttctgttcaacagttccgaaagtacggtgacaaaactttttgggaggaaaataaattgggccgaacttttgccgaaaaggcggccgagcaaagaaaagaaaacgaaaattgatctaaattggagaggaaaagccgaacagaaacgaggggaagaaaagccgcagagtttggagaatttcattgagtgttggacgggaattgtggcggagagattgggcgcagatggccaaacggtggccaaattaaaatcgacaaaggccaaacggcggtgttcgagcaacaacaacggatgcgcgaaaatcacatgcaaattcggtagggaaaaaggaaaagcatgccattcattggaagcattgttcccaatgactttagacggaattcagatttgctttgaaaatgagtgcgtagcaagcgaaaaattaataaaaaatggcataaaaatgcaattattaattatatttgctctttcaaatatttttttagatacaatatctttaatttcatatagatatttttttattattatttttgttaaaaaccgtcatacaaatttgagttttggttccttttgatctctttaaatgtatgaatgtaaaattactttttaactaaaacctgtagaagatataaattcaaaatgcacgaaacgccaaaataaatattcgcaaatattcaaaatgcacatacctatctcatggtccgggaacttcgatttaacgatttcctataagcgaagttatacacagaatgagttccgcttcttcacctgtgccttcacttatccttaactcgggcttcccaatgtctcaaattgggtttggcacttggatgtgcaaaccaacagaggtcaacgaaattgttaaaagtgccattcgtaatggatatcggcatttggattgtgcattcatttatcaaaatcaatcggagattggcgcagctctcaaagacatgctccaacacggagagattaaggtgggggggggagacaaattcaaatctaattctcgcgaatttactaaaaacgcgtttagcgcgaggatttgttcatcaccagcaaagtttggaacacttttcacagctttgacgccgcattggcaaatgtccacaaaagcttagaacagctcgggcttgagtcagtgtgctgttgttcaactgctgatccgttctgttttgttccttcgtttttagttatttggacctttgtcttatccattggcccatgggttacaaagaggggaccgaactcttcccaaaggacgcggagggacagaaagtgtttttgtcggacgtggactttttggacacgtggcgggcgttggaaaaggcggtggcccttggcagagttcggtccatcggcgtgtccaatttcaactctgcccaaattcaacggatcatcgacaattgcaacatcagaccaagcgttttacaggcaaaataaaaaagaaacagccaaagacagactttgttggaaaatgttggcacatttcagacggaatgtcacgtgttcttccagcagaaaaagttgcgcactttctgcaaaaacaatggcattcatttcgtcgcttcgtgccccctgggctcgagtgccgacaatgctttccgcaagtcggaatacccttctgtttttgaacatccgaccatttctgagattgcttctctccttcaaaaggtaggcacagacagaaaatgaaaaactgtcaaattgtttattgttagttgactttagagcccggaattttgcaattgccgggaagagaattggaaaaagaaaggggtgagatccccggaactttaatgaaatttgttaagaaaattgaggaaagatttcaactattgtaagattcatgacagaatggttttgaattatgccatgctgcaatattttttagtcccggtccaaattgccggtaccgagacttgaaaaatgggcctggacggggccccgggactcccggccctgtgttttgtccaaagaccgggaccgggagttccggcgggatcccggttctatccgggctctatttaatttttagccattaacaaataaatgcacttatttccaagatttttgtaagacaaaaacgcaatattacattacttttcaaataaagagctgttttagtcaaatgcccaagttgcgctgcgtttcttaacccaatttggcgtcgttgtcgtgccgcgttcgtccgatgcgcagagacaacgccaaaatttggacattttcggattttcgctaaacgaccaacaaatggcgcaaattgaggcgttagacacgggcaaacgcattttgtattgactgtca

SEQ ID NO: 6315 - DNA, 2680 bp, Heterodera glycines
  misc_feature (49)..(49): n is a, c, g, or t
  misc_feature (62)..(62): n is a, c, g, or t
  misc_feature (64)..(64): n is a, c, g, or t
  misc_feature (106)..(110): n is a, c, g, or t
  misc_feature (114)..(114): n is a, c, g, or t
  misc_feature (128)..(128): n is a, c, g, or t
  misc_feature (139)..(139): n is a, c, g, or t
  misc_feature (143)..(143): n is a, c, g, or t
atagaatttatgaagcaaagatatgaaaaaatctcctaaagggggaaancccgcaaacgaancngaaaaacccatcttaaaagccacaaacaaaaaagcccagcannnnncaanacccaccgaaaaancaaagaaaaanaaanaattattctgaaaaagaaaggcaattgaaaccatcgaagagagaaaacagtgcgccaaactgtgactgcccaatcgaatttgaaaaaaaacaacaaccaatcattcattcattctttaccatagtaatctttggcttttttaaaccttcttgaagaaagtgaacgtggtaattatctaatctaattaaatgcaaacaaatcgcaaaatatgcatattatagtgaaaaatatgcacacgaatttttccaaattaaattcattaaatttaagctaaaatatcgaaaatactaaatatgaaaatcatttttaagaaaaacataaaaaggcgctaaaatgcacaaagatgcaaaatatgcatatggaaatacgtccttgaagcttcaaaacgaaccaaaacatattttcatacgttcgaggcctcccataaaccaggaaacaatgcatgtgcatataattacatacccaagtgatttttatggtaaaaattttgagaaaatgtgcagaaaacaacaattaaaaaatatattttgttgaaatttcgcaaaaaaaaaatcataaagcattttggccccataaaacgaatataaagcaaaaaaaaaaattaaaattaaaaaatgaattaaattatcttaaaatatttcaattttatgatcaataaaattaaaaaagaacgattgacacgagccgggttcgaaccggcgacctcgagtgtgtgagactcgcgtgataaccaactacaccaccgtgccttattcccgctaattaatttcactttcattttctgaaatattttgcttttttaaaaattattatacattttttttcatgtcacttaaattagcctttcttcgtccaataaaaaaacaaatgtaacatttaaatgtttaaaattctgtttgctttttgcttttacataaaattgcgattagcaaaatatcgaacatttgaaggaattcgagatttttcaggctttgatgcaaaccgaagaaataatgagtttaatccttgcttttttgaattttatttttgtttacactttcccaattgtttttttgtgtttcttttgattttaatttattcgctttttaataaaataacatttaaaatattaaataacttataattataaagtgagttaaataaattcgcactttccttcgcatttccattgtttctcttctgtggcttgtccatgtttaatttcttcttttcccggtttcaattgcccctttttccattttcttttcccccctttttttcctcttaaaagtcgcgcacaattttttacaccattaaaaaaagcgcaaccattacaaagggacaccgacgacagaacaaataaacaacaaataagcaaacaaaagccataaaatttattctgtcagacatcgcacaaaaagaagcgaattaaataaaattaattgccgacaaaaaagtgcaaaattttgtggttatttgggcaattaataaatggtcggatggaatgattgatgggaaagggaatgaatgattgatgggtgaatgggtatattttggtgccaccccaatccatgccattatccgacccgatcactttgggctgatcattatcaccgatcactcactcattcacccattccctttctaagttttccgtacaaaacgtgttttttctcgcttaattattattattttatttttttgttttttttaaacaatttccgttttgcattttttcgttattttaaggaaagaattgaaattttaattgagaaaagcttaattaatgcgccattttcacttccatcaaattttcattgttttttcgctgaattttctgaaaataaaatcaaaggaaaatgaagaggtaaaaaagtgaataaaataatcctaaattattggaattgccttttttctgttcagccgattggcccaccgattcgaagccgtccctccgaagtgatcgttcatctccgtgccaattcctacaacatcagcgcatttgtgccaaaccacccgggcggagaatccgttcttcggctggtcaatggtcaagacattgagcaatacattgagggacgaaagtgcgttttgggcatttgccatcggcatcgatacgcttatcaggtggccaatttggcaaaattaatttatacattggataaattacactcaaatttgttgaacaaatgccaaagccgattattgttagcgaatctttgcttttttcgagattgacccaccggaacttcaaaaatgaaattcatttggtacaaaacaaaacctaattagcaaatgtctttgattattaattgccttgatttgaggtgctcagacaattcgaaatgccttcggatgttatcgttggggtgaagggcaaattttacaacatcagcgcatttgtaccggaccatccgggcgggtcttttgtgctcagagcgatcaacggtcagcagaacgtggagcagtacctggaggggcgaaagtgcgtttttggcatttgccaccggcacgccaacgcttacgaagtattttatgaattcataaaatttggtgca

SEQ ID NO: 6316 - DNA, 2806 bp, Heterodera glycines
  misc_feature (19)..(19): n is a, c, g, or t
tctaatttacaataataantttgtttttaaatatatttacttattttttgaaaacttgaaaaaatatcggtcacttgaaataataaattctaaaattttgtccaggaaaatccaggttttttcctgttttgcctggacctggacctggatttttttcacatttgacctggacctggatttcctggacaaaaatccaggaaaatccaggtccaggaaaaatccaggttgtcaaaaaatgcctggacctggatccaggaaaaatccaggcctggatccaggtccaggtcgaactctacaaaggagcagccgaaagcttgtaaattcatatccaatttggaaattgtacagaaacgcaaaaaacaattacacttttatttgtacaaataaaaatttcgaaaatattttttatttgtaaaaacatttgacttttcgtaattggtactttataaatttttaattcagagcatcggaagcagcacaaaatgttcttcgtttctcttcgcatgggaaaattaaaacctttaaaaatcaattataaatataagtgtcattttttaaattatttttttattacttatttaaatttttttattttcgttttatttttgcctgttttttttagcattgtccgctgttttggcatcggttctttttcagcgctctgtcatacgctttttcctgctcctcaaatggcattttgcgcagttcgtttcggttctcctcctctgattccaattgtccttcgccattttccgtcgtttcgttggcgccaaaatgtgccaaaaagagaaataaaaacaaagcgaaacgaatggaagcgaaacgcatcactttaaagcagaaattaattaattaattgaaataattagttgtgctaatgaatgactgattggttaattattcgtcctccgtttctctctccgattgattgcctccgtttaattttgctgcaaatttcgttttgatgaaaattaaatcactcgccaaaaaagccagtcatatgaatcaaggtcataatcgtataatcattgtctattaaatgattttccaaataatacaaacaataaaaagtgctcatggaaaatgagtcagaaaaatttatgcaaaaattaaaattgaagtgttttacggacaatgaattagcagcttatgtcacagggcataaatagaaaaacatttgctgaaaatatcgtaaaaaataagcgaaaaaagagtcatttttagtgataaaatattcacttaaaaatagccgagagattagcagaaagacaattcagcaaaaagaaaatacttaacacttaaaatttttttaataagggattggtagggagcaaaacacgcaaaacttaaccaaataacttaattttggtcatttaaataattattaaatgttttataatgtttttcgaataaggaaaaatttttaagcctaaaattttttacaagaaaaaaataaataaattttggtgatcaatttttgagaaaattttttaattcttaggggtgtattttcgcgattttattgcattttttatggaatttttcggaaaaaacgccaaaaaaggcaccaaaatggaaaaatggcaaaaaaggcatttaaggcacgaaaatcccgaaaaaggcaaaaaaaaaaaaggcataataaaagtcaacgtagaagtctcaaatcaagtggaaaatgtgttatttatgcttaattatcgaaactagtgcgcaaaaaaggcatgtctcaaaatgcgagctctaattataagccacccaaatgtttttgataaattttctgacggattgtccatatgacttaaaaaagtgcaattaaaatataattttgcataaattactaatcaaaagtatcagacgattgattattaagtcccaattttgtgattaatcgtttaattatcgctttacaattgtaaaatgaatgaatgattctgtgcatctttcgttcgctctttccttcaccatttgtcctcaatttgcttctctcttcgtccatttctctgctctttcatccccatggtcctccgtacccccaatccgaactgctccaactccatttgcgcttgcaacggacgcaccgccgcgcgatgcgttgggcgcggcttaacactttcgaggcgggcgccggcttcaaatcgctgaaagattggggggggggcacaattagggcgaggaaaaggtaatcaattaattagtctactaattaataacgggaaaagggaagacttctgctaacaaaatgagtgactgactcttgggaaaaaagacaaattcgaattgccaatcaaaacgattgaatcaattagcaaggcaaaagcaaaaaactaaacagactcaaaaatgtaataaataatccgtaaattaagggattttggatttttaatggcaaattcaaacgacaaaatgcagagtatgttcgttttctcacagtccttcctcgtcaatgccttcgtccaccgaaagtccgtcagaaaaagcggcaaatgccaaaatgaacagcaaaaaaagggcaaaattgtagcgaaggttcatctaaatatttcttgagtctatcaaacattcttgagcaattaattcatttctacaaagggagggaatgttttacttttgggggtaatttatgctcttttcattgggtaattggcgaacaaaaagtttacacaaatattctcggtaaaccaaaaatgatcacatgaaaaacgaatgaccgagaagaacggccggcgaatggagggatttgggggcgccaaggacgaaaagcgtgaaaaagggggaggggagaaaaagggagaggggggggggg

SEQ ID NO: 6317 - DNA, 1811 bp, Heterodera glycines
gttcgactctgatctgatcggactgtgtttttggggccgatcatttggccgaccctccgctgctcaattttgatcaccaccacccgcgagtttttgcttcttttggtgttgccaatacttcgacaaaatgcacggaattgcttttgaatggcttttttgtattcaaaactaaaattgggggagatttattgaattaaattagcaagtggggaacgtaaataaatgttccgtgctctcattatttaattacctaattaatttgccctaattattttttaattgtgactgtttttttcaattttcacctgcaaaaatacaaaatgggcccattggttgcggttgcgatgatcaaaatgtaactgaacacacaattaattgcccattttgtcagatcggagagcgaagcgatggcgaacaaattctggaagaaaaacaacgaaagggaattggaagtccagccgaggagttggaggagcatcagcacgaagatggagcggaacagactcagctgactgagagacaaactttgagtgttgttgttttctgcaatgaaaagggagaggatgccaaaaaaagaaggaaatgccatcgaatccccggccaaaaagcgggaaaaaatgccataagaattctcgtcgacttaagagtcgaaaaaacagaatctcattgtcagactgattttaggcttgaatatttgaatccatcaaatgcgtaattcgcatttaaaataaaacagaatcagaaattaaattattttttgtcgggcgaaaattttttaaatcttatttaaattatttgttatattttttgaactgacttggccttcggacgtataagcaaattgccaaaacgcaatacacagcaggcgacacacagttcagaattaaagttgaataaaaggaaacaaaggccgcctcttgctgagtgacctccgaagcggcacacatcacaagactaacaataagaccaattaaaaagggacaaatcagtggaaatggcaaatacattaattaaatatctaactaaataaataatcaattaattagttaattaatcggcagttacttttgcggaattcgtcgcataattcgatagctaatgaaaaggatagaaaccccaaaaagagcagacaaaataagccataaaacagtaaaatatttttggagatgcgaagaaatgcttaaaaagaggaaaaatgaattaaaataaaaaataaaatgaaacattaaaagtgtcaaattaccgtgggaaaatgacaaatttaagtcggtccaatccgatggccaccatcaaagcggaggaaacattcttagaaaaaacggggagaagcattggccaaaagcactggtccaagcgaatcagattttggccagtcaaaacgatgaaaaacatagggaaaaagccgaattggtaaatggcaagcgaaagagagtcaatggcaatcaaaacattggtggagccgtgcaattgcttaaaaatggggaaaataaattaaaatattttgaaatttataattataatttagcaaagacacggaccgatttgaaattgtgacaaaaaccaaaagtaaattcaacacaatgccaacggaagcgatcaaagtacgaacagtgatcagaatgaccagcaaaggcacaaagccggaagaggagagaaacgagtaaaactgaacaaaggcaaaaagcaattagcagtggaaattaataaattaattattttattagggatgcgaatttaaatcaaatgactttttttactgcctcaaaatgactcaaaagtattttactctttattttaagcttctaacactt

SEQ ID NO: 6318 - DNA, 1084 bp, Heterodera glycines
taatgagtaaaattaaaaatctcccattttgccatgagacccgcgattcgatgattattgttcttgttttgaataaaaaaagtacaaataaacggggctccgccgagattttatcgggattttgttccctgctctatttatttcaaaatttcagtctctgattttgtgcttatgttcttcactttttcacacaaaaagatccccaggcccagcccttcgaaacattggtgtattctttgcattaggaaagaaaatcaataaaataacaaatgtttgaatgaaaatgaatgcaatttgtctgtctgaccccacgggaaatgttaatcgtcttcatttcaaattgcaaaacacaggaaattgccagtccagcagcagagaagtcttcttttttgagaatcctccttttcgaattataaacttttcgaaaaattccactcaattccttagtaaaattttcgaaattttatcagttgctttaggcacaaattggtaataaactaaaaatttccaaaatgtaacacaaaggctcaaaatttcttgtaaatccaccatcctcatttcttgtcgatgctttttcaacaagatttgtttttacattttgcggatgaattttgtcttcacttctgtctgttgttttcatgttccaccagcctttctttcttatctttagtattttttcgtctttttcaatttgtatgtcaacatcgggaacaaaaattgttgaaaaatcaaacaacaatcagaaattattatccatcctccccaatcaatcaatccattcttcgttcaacaaatcaattaggttaatcagtgttcgatcggtgctcttttgaattgatgcgtgaatgattgaatgcgacgactgtttcacggtgatttgaattaacactgccaccactccaacaacaattgttgaaatcggcgaggcgactcatcacacaacacaggcattgtgagaagagagatgaaaaatgcgatggtctccgcttcttgggcttttcaacttcctccgatcgatgcctttttgttcaacattcttttcttggttgcttctttcaccacaacaacgacagcaaatgcgcaa

SEQ ID NO: 6319 - DNA, 4280 bp, Heterodera glycines
  misc_feature (3237)..(3237): n is a, c, g, or t
  misc_feature (3265)..(3265): n is a, c, g, or t
ttataaatttcgaaactggtaactttttaatagcgcccttttttgttctgtaccgcttaaattttttcacccactttttactacccccccccccccccccataaataaataaaattcagcgccgccgtttggccagaaagcgtcttccgcgctcgtacctcaaaaaaataccgactaaaaagtatcgaaagggcgacccggaggagacgtgtgccatctgtctggaggacttccaggaggcggagaaactgcgcgtgttgccatgtcggcacggtacaaaaggggctaattaattatttgaaatgagcgtttaaataaggaaaaataattccaatggcaattttggaatgagtcgttttaattacttttttcaactctcgcatcacttaaccccggctgttcagcgtaccattgcaaatgcattgacccgtggctgaccaaaagtcgcaaggtttgcccggtgtgcaagcggcgggtgggcccacggaacagcgacagttcggacaccgatgaaacggacgcggaggttggcccggacaaaacaaacaaaaaaagagggaatcgaacacattttgtccgtccagagaacgccctcaacaaccgccggacgcgctgtcagtggcggtggactgaccgctccgtcgtccgccccactgttgtccagcagggacatcgactcgttgctgcgaaatgcacaaccggtgagtctccgcgtttaattggtagaaaaggctggattttttgataagagagagtccatgacaagagttttactgcgcatatgatactttaaagttgtgtttttcttgtataatcccaaacgatggaatttttctattgtagaaattttttcgaaaatgtctatttttcctaacaattttttttaaaaatgggaaccgacggggcagagggatgaaaacccatgtacgcccggtaggtgcactacataacccgcatatcgtttcccccggatttttaaaaaaattttaaacagtaatttaaaatttttaaacaatttttttgaaaaaatagtaattcactataaaattttgtaaaatttctattttgaaaattaaaaaaattcattgttcattgtcagatggcgaccacctcttctgccagcggcgccggtctttccttcgcctccgattgcccttaccccccaaatgtgccgacttcgcatggcactgccaccatcaccagcaccaccagtggaggcagcacattcctacgcacggcaaccacaaattatttggcccatctcaacaacattttccgccgtatgtcgcgtgaaaattacaattttataaacaatttttgccggaagaaaacggcaggaattggtgggggataaaggaggaaattcaaatgaaaattttccatatttccgttcccaaattgtcaggccgagcagcgccaccgtcagctgccgacacttcggctgttctgcaagccgacggcactgaccacaacagacgggggacagcagacccatcggtagagaaacaattttataaatttttgcaaaaaggatagggttgctcactaaacgggtctatttcttcctcaccaaattctattacccattatttctctcgaaagcggacttctgatgcccaaaatctccgtaaaattctttttttttaatcgaaaaattgccttttatacacgactttgttttgtattcaaaatgctactttgtccattttgcagagcaccgctgcccaactgttgttgtcttccgccgcattggacgacgcattcgcaaccagccgaagtgtcggcgatgttcagcaccaaccgttgcctacgaccaccgccacttccgcttcaaatgccgtgcctgcccagccgctgcaccaattggtccgctcccgttgggccggcatgcgcgccacgttggcaaacatggtaagcacataattagctaatctacattagtcaaaggcaaatgccgtacaccaaacatgaaagcgtcatcggaacagaagtgcgggtacacagctataacttattatttgtcaagcaaattttgtaatgccaagaactattagcctaaaaacccaaaaaatatatttttttttccgctgccccacggcttaacaattttttacgcctgaatgaatcgtggtcgtcttgataaggaaaaacttatacaaatatgttaatatttctggcgccgaaacgtccccgagggtcgcaaaagtcgggacacgactcaaatcatccgggtacaccccaaaacgtcgccgccgtaacgtcgccgtcgaaacgtcaccgccgaaacgtcgccgcaaaaaaaatttaaaatttttcaaaattttaagaaaatttaaaattattttaccttttctgaaaatctaagtgttaataaaaactaaatttgttgatttctaagaaaaaaatcgaaaaaaacttgaaaaaaaaaattttttcccctgaatttcttaataaaaattttttttcgaatttttctagaattttttccgaaccaggctaggtaactaaaaaatttttgataaatttttagataaaattttaaaaaattttgcggcgacgttacgtcccggcgacgtttcggctggcgacgttttgtccggcgacgtttcggcggcgacgttttgtcctgctcccgtcccatccatcatcaacaattgttttgaattttcagttggccgacaaatatttgtgcattcgtttgttggaccatcttctgcagagtgggaaggcgagccgtttcatcaccgggcacactttacgtctgtttttgccgcttgtgctcagtgtgccgaccgttggcgacggcggtggactatcggttggtgggagcagcaaattttcaaatttggttacattcttagattttttgacgatttcagggctcccggtttagcgctaaacctgggttaacatcatttttatattgcactgctcgagcatgagttccaagaaatacaatccgaaaatttcggacatatttaaaaatttggacggggtggattaagggttggtgaaagcaaatttgcacatttggttacctaaccattttttacgatttttaattagaaatccattttatataattgctgaaacttattcgaaaggttttatggcgatatttttttccggcagagtttgatcgaaaatttgtatttatacagaattataaaaaccgaaaacatttcacaaaaaaacgaatttctaaaattttttctttttaatttgaaagcgcgaggnggaggaaataaagcgccattctgtccanaaatgtctgttcataattgttgtccgcagaatgtgtgcgcgcttgtgctgctccgctactgcaccgacacgcaggcgctggacgcgctgcgactgttggccgaacgcgacgccgactgtgcgccggtccttcaacgaccgtcgcgccggcgtgcctttgcccccgcgctttcgctgtggactcgctgtgcgacgcgctgcgcgcctttgtgcgcccgttcgccgaactgacgacgccgcaagcgcgcgcgagggccaggcgtgacgcgcgagtcgtcgctggacacgtccgccctactgggacttcagctgatgctgatttgaagaggatgatgatgatgagatggtggaagggaaattgtacaaatttcatgggaagaatgaaagtctggcggtggggccccaccgttttgtttgtctgttttttgtggctaccaccccataagcaaaactaattgtactcactcagcttagttttttttttattattttcgcctaattgtgacatcttggtatggattgaaatcgggccctcggcgagactaaaaaaaaatcgggagtcccggcaaaaaaaaaacagggtggttttcgtttttgtttccgtggtaattggttgtttgtgccttcccttttccgataccctttgtagcttttttggaaaataaccagtgttcggtattcttaattaattccattaaaaaattccaagttttttgggttcggcctacaaaatataaacgtgtctaacccgttctcttacacccaaagcacgcattgttgaattttaagggttccaatttgttttgtttttgtcaaaataaagagatccttaaatctaaataaaatatgctaaacggtgacacgaaaaagacaaaaacattttacaaaaaacaatatacatatatacaatatacacacattccgatcacatgcactagttctactggcgccttcttcctccttcggtgttcgcaacatccagtcgtacaccgcgccccattgagtatcggttgttg

SEQ ID NO: 6320 - DNA, 1606 bp, Heterodera glycines
atttttttgaaaataaatttaaaaaaaataagaaatgttttcaaattacccatttcttttttgttacgggcctgattactttgaacaatttttcactggaatttgcattactcaatttttaccatgttccgatgtcaaataattgtccatttctttttattttccaaattttagtgatttttatgcataagtcttcttcctcttcgtttcatttcatttaaatttctttggcgaataattttttttccattttatgcaatttcagaggctgtcctccctaaagacaaacaccataaattgtttttatggtataaattagtgctttcaggcttaactgggtgcttatagggactgtctctctcattggataattttcttttgtctgtttccatttcctttgtttatgtgctttttgcgtattttttattcatcagctttttgctttttctcgctgcttggtatatccgtcttatgaataaacatgtgttttaaatattctattacactgcaattgggacttggatggtcggaattttctaaatgacactctttggagttagattttagaaaaaaaaattgttaaacaggctttgccaaaaagcaccaattccgaagatgacttggacaaatttttatttatttttgtctatctcttaaccaaaaaaaactgagtcagctacatattgtcagaatgagccatgggataaacaataatgtttgcttgtcctggatttttgtccagaaaatgcaggtcaaagtcccaattctttggttctgagacttgccgtgaacatccatttccatggtcggaaaatttaattttgcttttacaataatttcattttgtgttttttgaaggacagacttaaaattttgggaacacccggatttaagtgactaaaaaatattttttcgatctaaatttgttttagcctaggcaataaattacgtaattgagtaaaaaagaaaagaattaagtttatccataagacacaaggaaaacataagcgaacaagcaaaaaaatgagaataaagaataaaatgaaattaaaatacgcagaaaatgagataagttaattgaagtttaaaaggtaaagcgcaaattcatggcattgtcttatcacgtggcgaaattcagaaagggcggtggccgcccccaccgccgtgcccaaacttgggcaattctttgtactgtccaacgtcctgtttttccgttgcccattgactcgtagacgatgattgaccttccgttgcccattggaacgttgactgctcggcaatcgaggcatcgaaagtcggtgccaattgcggtcggcgctgatccgtcccggacagtgtcgtcccgtgctgctgcttctgcacatgagagaagagggaagggaggagagattggcaaatagcggcctttaagccagtgtacaaaattagggtgcaatgccttcgcctcccggaaaaattaaagtaaatttgtagaaagaaattttcatgcaatttttttaaaattttttgtagaaaaaccagcgattcatcatacacctttaaaaatctttatcgaagttttcgaatatcttttttctgagatattttctatttacaaaaattcagt

SEQ ID NO: 6321 - DNA, 1430 bp, Heterodera glycines
tgaaaaacattagtggtttgttctgtgactttagtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtcatgcttttgaaaaaacattagtggtttgttctgtgactttcgtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtcatgcttttgaaaaaacattagtggtttgttctgtgactttcgtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtcatgcttttgaaaaaacattagtggtttgttctgtgactttagtgtgagacactaatgtgtgtcatgcttttgaaaaaacattagtggtttgtttgtgactttagtgtgagacactaatgtgtgtcatgcttttgaaaaaacattagtggtttgttctgtgactttcgtgtgagacactaatgtgtgtcatgttgtgccataaggaaatgccacaagaaataagaaaagacgaggaaaagataagaacaagaagagatgatgaaaatgccaagaatgttgtgccatagggaaatgccacaagaaacaagaagagatgatgaaaatgccaagaatgttgtgccataaggaaatgccacaagaaataagaaaagacgaggaaaagataagaacaagaagagatgatgaaaatgccaagaatgttgtgccatagggaaatgccacaagaaataagaaaagacgaggaaaatataagaacaagaagagatgatgaaaatgccaagaatgttgtgccataaggaaatgccacaagaaataagaaaagacgaggaaaagataagaacaagaagagatgatgaaaatgccaagaatgttgtgccatagggaaatgccacaagaaacaagaagagatgatgaaaatgccaagaatgttgtgccataaggaaatgccacaagaaataagaaaagactgcgccgaaggcgctgaccccgctagttcgaacaaaaagttgaaattcaatttttgaaaattcttacttttgtttctaaattgtcaaaacaatctaaatttagtcaaaaaccattgcaacatcaaaaa

SEQ ID NO: 6322 - DNA, 2212 bp, Heterodera glycines
caaagtaaattagatgaaaaattaggggctctgttagagctcgaaaatttcaaatttggggatcctgcttttaaattggaactcggaattttgctggatgtggcccgcagagataaatctcacaaaatcccgcatttaaaatttgcgggtttccgcgcgggattttggaactttcgaaaaattaaaattaaataaaaaacgccaaaaaactaaataaaaatacctgaaaaatgtttggtcgctggcggcaaacatgaaaggcggtgatggacagacaaatatttttcaataggggggtccgacagtttgagaggttgtaggtcaaatgggagccggaaaatccgacactggaaaatccgacaccggaaaatccgacactggaaaatccgacacaagcggaaaatccgacaccgatggaaaatccgacaataacttaaattaaaattttttagtttgtttgaattaatatctatctgcctaagcttagcaagttctcgaattgaatttaccgagaattatttttttttttgcgtctttttttcacgaatgatctgatcaacttctgttgcctggagaggattaggtccaggtgaattctcatgaatttcgcctcttcagaagacattaacaaactcaagggatggggtagaaccgaattattcgagaacagaggacggaatagcattcaaaatggagaattacctcacccatatgttaaaaattgttaagcctatttacattgacgtttcacaaggatcacagaaattatttttaactattttttgagataatcaaaaaatggcatacgaaaaatattcatatgcctacctagatagaatatgaccataaaaatatttttttaaataacttcagtactgtaactttattatatgtattttaaatattaactcaaaatatcaaaaattatttttaaaatttaaagttggtgtcggattttccagtgccggattttccgctagtgtcggattttcaagcggtgtcggattttccgcttgtgtcggattttccagtgtcggattttccggtgtcggattttccagtgtcggattttcctagagccggtcaaatttggatttcggcttggggtgggggggtaactcccccgggcgacgttcttttttttgcctttcgcgccattttttttttgcgtcggtttttccaaaaacttttaaggaacaggagtccagcggtactgataggcgccgccagggaaatttgttgtattttttaatgcaattcgttaatgaattatgtccaaaatgataaattttgcgaatctggagagaggtactaacgaataaaattatccaaaaaaatcctatcctggatcccgcaaaatcccgtgcgagatcctgtcccgcaccaatttaatacaaaaatacataaaatgtaatatggatttataatttaaaaatatataatttatataaattcacaatcagatctccgcgcaacaaattcatcatcagcaaaaagtcttgtcgaagcgctgcaaaaaacaattaacgacaattccgaaatggagtattattttacatttatattcagtaaacagccagaagatttcaaaaatctcccctagcgattttatctattagttcagtattttttaaaaattttaacaaaaatgcaattaaaaatgaccaaggaccgatattattaaatttttttcaaaaaatggtaaaagcgacaaaatttaagatttttgaagaaataattagaatttctctttaaattgaattagaaatgaaaaaagctcaaaaatcgaagttcttataagaaaaactctatgcttttattcaaaaaatgaaatttaattcttgtaattaaaaggcagagcaccggatgcatattggatgccatcgcagactcaaacaaatggcagcgaccggttatttatacagcaattaatacaatcaggctccacaccatacagctcgtgggtgttatttaaattttaaataatttttggcactgatattaatttaaaaatgagacttaatatgttatttgatttttcttaataatccaccttaataatttaaatttttcatttataaccttaattataagcaaattataattcaggctatattgcaaggtgcgtgcatcaacatatcatcaaacggaagtccaaaagaaactgaacgtttatttaaagaactggatgcaaaccttttagggaacattc

SEQ ID NO: 6323 - DNA, 653 bp, Heterodera glycines
  misc_feature (402)..(402): n is a, c, g, or t
cttcaataaaatatcatttaaactaattttagagtaaattcgaagattcgaaatttagaattcaggatcttgcgttgagaattcgagtccgggaattcgtacttggccgaaatggatgccgtattcgtgatcagcaaccaaaaaaaaaaacttggaaacatgttttcatgatttttgaaaacaaaaaatattttttccaaaaaaaggtggatacaatctaaagcattacctgtattacctaaatattcatattttctgagtgtccgggaggtcgcttattagaaatttctttaggatttttatcgtcaattcttccacaaaaaatatacatttgagaaaatcggtatttccctttgtcccaaggcttttgcacctcactgtatatttgtataaaatttttanattattttaccaattctattctgaattactgtaaaaaggtgcttaattaaatgctgtttgttttcttcaaatgtccctttaagttacgtacacaccgtaatcattaccgagaacacatataacggaacacagtggatttacaatattccttcatgtgatgcgcaatcggcaaggtgcacaacaatctcggattatcagggtgtcaacatttaaagcttccgttatttgttgggatctaacgacaaaatcag

SEQ ID NO: 6324 - DNA, 914 bp, Heterodera glycines
  misc_feature (875)..(875): n is a, c, g, or t
agaaatgaaaagcgtccctttgttatcaattgagggattgccctcatcagtgacactcccgcccccttttgagctgagtttgtcccccgactgatcagtgataattgcctgatcagtgggtgactctgatcagcactcacatgtgtgccacactgttgatcagccaagtcgcgtgaagtgtgaaagtgtagcgaaacactgcggcggtgtaaaaggcgacgcttgacgattcattccacaacaaaacggggattagcttaacgaaaagcatggaaaaaagaaaagtgaggggggaataccgtgggcaacagaaaacagaagagaaggaccaaagggaggtaaaatctgaaaattgacaattattttgccgattcatttggccgactttcgttggaatgccaacaaagggtcggaagtcaaatcggacaaatccaacgtggaccctttggctttgacttgcgggtgctgcaattagcaaatgtttgccattcattcgctgctcgacccacctttttgaccaacagccagcccatgtgggagaagaagaagccccggttgatattgtgactgaatggcattgactgatcaattagtcaaccaatcaattagttaattggtcccacgggtcagcgtcggtgtccgtccatttgtggtggcatcggtggtcgcgcgaccattcgatcacatcgttttggaaggcgacacagttcagaacgaccaacagaacacgaagcgggaaacgagccttgtaagactgagaaatgagaagggagcagtcaatggaaatgttcgctttcgctcgccttgtgcgaccaaaggcggtgggcccccgccgtaatgccaacgcccccggcgaaccataggaaaatgcctanaacatcggaacaatgggcgattgattgtgaaggttttca

SEQ ID NO: 6325 - DNA, 3502 bp, Heterodera glycines
cgtccatttgtcccttagtgttcactctgtcctgacactttggtatcactcctccaaaactgtcctgcattatttattgtttgggaatattctttttcatttacactttttacctttgtaggcgattaggtgtcgagcctccggctgagcggacgacgggtcgaagaagaggcgacggaaaatcataaaatcagtgagagacaattaattaacaattaattaacgaaagggggcggggacagaccgctcgcatttggctggggaagccgagagagagcggtcaaattgagtacggaaggcggcgcggcggacggaggcctttgcctttggggagggcgaagcgaatcagaagacggcccgatcaaaagcagcataattaattaatgcaatttgttgtttttcacgcaataccttttcccgttgtggcggaagacattcataaaatgggacggatttactgaaacaatttttgttggccgcgttttccgcggcaatttgggcaaataaatgggacgaaaatgccatgtcgggaaaagcaaacaaatgaattaaaattgagaaacatttcaaaatgagtaaccattggacgaatgaatggaaaattggcgggtgagcgcggggcgttgcgggcgaagctaagtcaaaacaatgaaaaagcataaaaatggtcggcatttgctaaatgccacatgaggagagtttgagaacggcactcggcggacggccattggcgcgccggaagagcaaaaaggcggcggtggcgacacattggcctccacccgtgccgaccaaccgccaaaaatggcactcaaacggcgaaaccttggcaaaatgtttgctttgcttcgcttttgaatttgcgctcactttgccattgggctgtgcagcggcgacttttgctcattttgttgcaattgttggacactattccgacgcatttttagaggtgaattttcgcacattcccttctgattttggcaggggaaagtgccaaaaaatgaaaaatgatttaaggtgcgattcgcctcataaaatgcgcaaaaatcaaaaaatcactttgattcgcctgtctctgctgaggacggagtgtctccgcaatttgtgagggaaaagaaaagtcaacgcaaaagggcggcactgaatttattggaaaatatttcagttcaaaatgcccgattttacccaaattgctttccgttttgcctttgtccgttaattcgccttggaaaaagttttttaagcattttataaatttattttgaatatttattatttttttttactatttgtgccactaattcgtgccaatgctcgcgcggatttgaaaagcctcaaaaattccaattcgatgttctgctcattttcctccatcagcacatcgaatcgattcgttactgctttttaaaattaattaattttcgttgttttattcgttttttctcatttaatttttaaattaccgtcctccgattcggcccatttcgtcccttttttgtctctatgctggcggattcgttgcgcaattaatttgaatggcaaattcatttgctgttgcaaatgcccaaaatccgtcttaatttgtcggttaattaactctaattagtcttctgctgctgcttcgtcttttgttgtcactttgcacgattaaacttgccatttgttccgccaacgattgcccgtggaatgatttcgggcgacggctcagccggcgatcggaagcattggccattagcagcagaggacactgaaggaaaggcacagcgaatggttggccaattggccaacattggcacgggtgccgaccttaactcgcagccattcgcagttcgtttgggcgagcagtgcttgcgactgcgactgcagcgcctccaattccaagttgaacagttcggcatccctttgtggaagaaggcaatggcataaagcaaacggaaacccgttatttagtccaaaagcatcattgtattatttatttttccacttttccgccactctttcgcgcatttggcccaattttcggacaatccccgccgcaaaagcgtaaagtgcgtcgtatgagctgagtaaatcgtgcagttgcgtccttccgtccgcgtcgcgcggccgcgcgttcgcctgcttttgaagcaacgcgcaattttcatgttgcaatcgttcaatctgagagagaaaggcagaagagaattgcaacttattttatcttttgacaaatttttgcttctgctgtgttttattgcgttttgtccgcttttctttttgttacgttttgtctgtttttgctctttttgttgcttttgtccgcttttccttgcacacctcggccatgctcgcccgcagcgactggcggtcgcagcgtgaagcgttcagtgccatttgctggtgccgttgggcttcgagtcgcagcgattgcaattgtccacgaaaagagttgctcaattggtcctcaaaggcacagcatataaaagcagtgccgaaagtgtttgtttgggaatgccttcagttcgctgatcactttctccaccgatttggccattcgcacgcaattcgcccccagcgacgcgtccaatcgcttctgtgcccgcatttggtcgagctgaacaacccatcccaaattggcatttgccgtctttgtgcttcacctcccggcccaatttgtctgcgcgtgcctcggccattgacaattggcccgacttttccctcagctgtccgatcagtcgcgcgtttcgcgcccgcagcaattgcatttccaggcaaagctcctgctccagtgagctggtcctgtcctcctttctcattccaatgcttttccttctccttttacctttctttcgtctccgcttttttgccgctttccgtcccttcccttctttcgttcgtcgtccaatcgctttgaaatgggccgagaaaacagctgcgcggtcggcccttccgctgcttattggggccaatccctgcgccggccaaaacactttcattggatttgtgccaattctttaaattccatcttccctttaaactcggcatccttccgttggcattttgccattttcctccccacctttagcagattcggctccgactccattcgtccgtcacctaatttttgcctttgccccattttcagttttgtgcccattttggccatttctccagaagaatatccatcaacgaatattggagaaacagccggagaatacggtggggatggctgaaagtggatactgtagtcgcaaaataaatgcgcgacagacaaatggccgacaaatgacaaagtatcaattgtttgggtaataaaaaatcaattgaatataaataattttctaccgataaaattataatcaaaaatctattttggctgatcagtattttataatcccagggaatgtcagtcgatttgtgagttttggtattttaaattttcaaatagagttgcctacacgtacttcatcgccgaggtactgtaattgttgcgaatgacgacgatttcccctcgagacaaaca

SEQ ID NO: 6326 - DNA, 2449 bp, Heterodera glycines
cgaatgccaaaaggtccaaaatggaggagcaacgagagacactcattggcacgtcggccgaagagcgattggcatcattttgggggcggcaggccaaagttggctcaacggaagagcaggcggaggaggaggagccggcgggggaagtgccgctggtcacggaagcggacaagcacaacaacttcatttcagcagtgattattcaaatgaattaggcactaattgcccgtgttaattgtgcaatttacctgttttccctgctcccccgtcttaggcggcttttgcatctccgccctccgtgccatgccgcgtcgtggcttcagccctttgggcgcttcgtttctgccgccgccttcggcgtgccacccaaagggttcgctttgtccgccgccgtttccgtcgcccccaaaattcgaattcgaatttttgtgaagggattcttaatcgaaatgattacaattagattttgacaataaaaacttgcctcccaaaattctctgtttgtttagtgacgcgtcagaagacaaatcggccgaataagcactcactgtcaaaagacttccgattgattttttgggcatcggcggcggcgaactgagccgttccgtttgctgcgtttgggaggtcggacgtccgaacattttgcacaacggcggacgatcggaaccgctgaacaaagaactgacagcggaggaacaactggcggaagaactctaaagaagggcaaaaagtgatcagagaaagagaaaatataaaagtgatcagagaaatacaaaagtgatcagaaagaatcatttgagaaaataggcagcagaaagattaatgggccaacaattgcctgaagcgggaagcaggaaaaggcattgctgccgcggggagcatttaggagcaaaggacgcggcaatgagctgactccgcgcgcatttttcggctgcgtttggttttcctcctaaaaattgggcaaaaattacaaatgaatcagaaaaactcaaaacattaattgaaactgctaatgactgactgtttgttgcacttcgaatcggcgacggaggcgccgattttctcgtcgcaatttgccaatttcgccgattaatgtgcacagagtgtctaacaaattgcatgacgtgttattgtactaattaattagtgccaatggtccagtcaatcagtttcctcccctaattaccgagcattgtcggcgcttcgctcgtcgcttcgccgccgtcgcgcgacttttgcccttcgtcgtttgaactcgtcgccgtccctggggagttataaagtgccttcccctttccctctcttcccatttccccctttttcaccttcgccgcattccgttcgcatcccttcgatttcagtcaaaaattcgtcttctcgcgcttcataacttttttgaatatttattaaattaagtcaattccgttttaatattcatttatttccctcaaaacctcgcaatttttgtccgaagagattggcgctcctccaaatttctttcgtcattctctgccacaatttctcccaccgtcgaattatttgtcatttgtccgccggcttctcctatcgtacccattgctataataaactactgtaattattctactcaaaaaattaacagaaatatttctgttccaaaaattcaaatttaattgaaaggaaagaaaaaacgatgaaagacggacaaatggacgatggaaaaggcggggaaaacttattttgtgtaccttttagcatttggaccttctttaaatggtggacagatgacgccgaaacggccaaatgacctgctggacattcccccggggcatttgtcagcagagggagggacaagcgaagaaatgccccgggggaagggaatccgaaccgacaaaatgcgaaagggaaatccctccaaaacagcaaataattcccattggaaagatggcaaatcgaaatgacaaaaggaaaggcaatcgaatgttttcctttatcacaaacattatcaactttatcaatttgagtgtatttttaattaaattaatttaattatcaagaaaccaaaggcacaagtgctcctattaagtaatggagcgagaaaagaaatttcaaatactccgaattttaaaatgaattccttcgtggttggtcaccgaagaaaagcacatgatttttaatctaattattagatatttattcaaaaaaagttacttaatatgtgtatgtatgtaaaattaatttttgctaatttcaaatgaagcaacagataaaatttgttagccattaataactttttaatttaattgtaattgcaatttttctaaatattgcgtttttccctccatgtgtttattgatcggacttcgactgatcaaatcgtccgtccgaaagattctccgatcagtcagccgattaatgtccgaatgaatgcacagctgtcctaaacaaaacatcgcttcgcttccgttcg

SEQ ID NO: 6327 - DNA, 2910 bp, Heterodera glycines
tttaaagtagagtagagcgggaccgggaccgggccgggaattcccggtcctccgaggtcccggttcccggtcccgggttttgaaaatctcaggtcccggtcccggtagggcaaccgggaaccgggaaaaacaagcactggtaagaatgggggtctagtgaaaaattagtgaagaaaattggagttaaaggataaaatttaaaaaaaattaatatattctttgaaagtgtaaaaactgatttatttcatcaaaatttatatttcaattgtagaggaaataataaaaaaaataatttttgaaaattttttcccatttaggcttaatagattttggctttgtccaacccttgttggctaaaattactctcaaacagagggccaaccacaccagaaaataatcagttaattttatgggacctccccaataaaaagtgacttggatttggctttgattgattgccaatttccccctccccctccccctcatccctcattatcattttgtttagtcaacagtgggcctccccatatttttatcatttctgtccccatttgctccacaattattaaaacgtttagtgccacgttttgtctgccatttcatttatgcaaattcttttcccacttcaaaaaatgggtacttgtactatttacagcccataggaattttttttttaaattttcaaaagccatgaaaattgtttccaatacttttcggaatcgctgatcacgaatccagcatccaaatactcagaaacgaagttgaaaatgatcattggttcaataaaagatcattaaactatttttatactaaaaatgtgaaatttgaaaaatttaaattttctactcttagatcggatttgggtccgggtttcgaaattggtcgaaatgaatgttatattcatgatcagcaaccccgaataggtattcatggaaacacgtttttatctttaaatataaaaaaatttagatttttcggtacgtgaatataaattaagtcataggaaatttgaagaaaaaaggcatatacctcaaatccgggtccctaatattgagatgaatagagactggaaatttacaaaaaaaaaaaaacaaaaaaaaaattgaaaaagtttaaaaattaaaagacataaaaaagcaatttggtcttgtcaacttaaaaattttcaggataattaattgcattaattgatttctgaaaacctgcggaaatgacaaaggtaattttgtgcaaagaaactcggccggcgctgacggctagggggtctgtgcgcgggagtttctctcccgtccctcgggcccaattcactcaaattgccgaatttgctgctgccgtcgggtccgtgcccaagggagtgaactggggagggggtggggaggacaaacaagatggggtttgcggttgttgctgtaacggcaccaccgactttttgaagagctgtcggcgctcccggttgaggttcgggagaagagttggacttccggccgcgaactgcgtcaaccgccaggaactggctcccgtcccttttttgctgctgctctgcgggggattgtcccccgcttcgattctcggggctttggctcccctttggtcacttcgtttccgagcgaatttttcccccctttctgccctctgaccctttcaacactttccgacaaaatgtttattggtgatgatgatgataaaatggccaaaaattggtggatgattatatgcgagatgttgatggattatatggtgaaaattggaggaagggaagggcgataaggattattgagggggtcaaaaattgggaatgattcagcaaaaagaaaaaagatggtgaggagtgaaacgagtgaagagcaagaggtgaatgtgtgtaccaaattagacgataaacaatacttaagtacccaaacattttcccccttggggggggcaaagattaagatgcaaaagagcgacccgaagggtacaaaaatcggcgggagaaaaatggccaacaaagggaaaaaatgagatgaatgcaaaaacggcccaatggaaatggcgatcggagaaagtgtgaaaaaaggaatcaaaatcggaggcagatgtgaatgggcaaaaaaattggaaagaaaaggcaaatggtgaagttgaaggaaaacattatgtaaatgagcaaaagtgaaaggaaatgaaaagtttaaataaagagagaaataaagaggggggaaaaatgtcgtcgaatttaaaaaatggatcgttcaccacggcaatggcctttatccgggaatgtcccctccggaattttcactcagcgccgtcctcctcggcgcttcttccctcctttgttcgggtcccgcggttgggcgggggggggggtggcagaagatccccccggcccactcattttcctcatcctctgacagttccctcgccgtaccgtcggcgttgaacaccaatattccgcttcgtcctcctctggccctctcgtcggcaacgaaattgccgacattatacccatattaaaattcatttgttgtaatttttgcattaaataataaaaaacaaaaattaaccaatttactaaaaaaataaaaaaaattgcaaacaaaactttttaattatgagccgacaattaaaagcatttctcttcggatttggaatattttagctgttgtggtgattaaaatattataagtggtctttgttcggcatttgctctttggatgccataaaatttaactgatgagtttttggaataaccctaaaaatcaaaagatgaatgaatgtgcgattagtagggatgggaattttatgtaagaaaaatcgcgaaatatgtaaataaaatatgcataaaaaatgttaaaatatgtatggaatatgtataaaaaaccccaaatatgtactaaaatatgtaaattaaatttttaaatgttattt

SEQ ID NO: 6328 - DNA, 3796 bp, Heterodera glycines
ccaaaaaatttccccccggggggcaaagattaagatgcgaaaaggccgctccgaagggtacaaaaatcagcggggagaaaaatgccaaaacaaagggaaaaatgagatgaatgcaaaatggccaaatggaaatggcgatctgagaaagtgtgaacaaaggaatcaaaatcggaggcagatgtgaataggcagaaaaggggggaagaaaaaggcaaaatggcgaagttgaagaaaacattacgcaaataggcaaaaaatggaaataaatgaattttaatgaaaaagacaaatgaaaatttaagtaaagagaaaaataaagaggggtgaaaatgtcgacaagaaaaaggggggtcgcttaacacggtaatggtctttatccgggaatgtcccctccggacttttcgatcagcgtcgtccgaatttttcctctttattcaatatcaataaaatagttggaaatttttacaattttttatggtcctttaaatcaaatttttttacaaatattcttaattttaaagatgatcaaacgcttttttttgtaatgtttgcatttgttaatagttttttataataattttttttaatttaaattttaattttttgaaatctccttatcccccatgtgagcttagattagcaggtcacgcaaaaacatttaccaatctccaaaggaaatttggtttttccgtctttagctcagaatctcatcctctttactaatttttagtgattgtccgttcaacgaaaacttatataattctacgaattttatggttaataggcaaacaatggaaaaagtcaatccgataaaagcaaaaaacatttataaatgggaaataaatggttttttggccaaattttaatgccatggaaatgtaaatttgtctgacattcttttggtaacaaatgagggttatataccataaaaatttgctcctctttcttctcttttcattcgttcctctcataattctgccatcttcggcttccgttttgtttgctcaatttggcctaccgtactctcttgctaatgagtcatcagtgtcgccattactgtcttctgtcccttctccttcccaattgatcggactttctgtcgtagtggtcacaaatgtctcttccgcaccaacaaatgtgtccgaaactgggtcatagtgttcaacttgtttacggtcatcatttccattgtcccccgtcggtggtgccggagttgttgttgttgtgatattctggctcctatctctattcgagcctaaaaaatttattaatttattgttctgtcattttaaaaaacgaaaatttaaaaaaagacgaattagttgatactgtaattatatgctttatgcagaacacgctataaatcttctgattgatccactaatatttcaatcacagtatatctttccttaaatacagtatcactggcaaataatccatgataaaattatcctattgccattttattcatatttcaccgacatttgctattcatttgatttctttcgtgcttttcccaacctgccgacggcgccgcggtgttggcacgaccattcattgcgttgaacattcgcagcatcgcatgcaaatgttgtgcccggtcatcatcccccgccgcagttggtcgctgtgctgctccgccaaatggcatgccagcaccaatccgcgtttgaaccacgggcaaaattaaattgaaattcagtgaaaaatgtatacttggcggtggcggttggcccggaatttgaacacgccaaatgaaaaacatggtaaaaaaagcggtaaacactgtgacccaatttgcatcgcttcgagaggcatcgatgccaactacggcgattaaagacatttgcacaatcagcaaaatcatcataattatattggaatgaatatgaaatactggaggtgcgcgtctatgacgacggtcttgtgaacggtcggcgccggtgccattgagttggggctgacaaataaaggtttaatggtattttcactattcttaattatgggcaatttagttccttaattgtatgtataaataatattaaaaaataaatcaatttatatgagtatcatttgggttattcgggcgtaaattttatgataaattattaggtacatttataaatttcaaatcaaagtaattttcatgaaattaccacccaaaatcttttaatttacctgcagataattgtatttttcttggccggcattagcaattcctttcaaaattgtatttgtccaaagctccatgatgatttgtgtcaattcacttggcattaaggttactgtatcaccatcgtccgaagctaccgtatgctttttcaacgttttcgtcagtgcatctatggttgttccaggctcaatttcttggctaattcggctcaatgctttcatcgcttgcgcatatagaagcagagatgcatcattcgggtactgttttgctcgtggtaaaatctcagccattgtaccgtatactctaccggtagaaattatttccgtcgtttctgtttttttcattgcttccacaatttttggcaaatctttttcaatgaaatccgttaaatgttccgttagtttttcaattgtgtccaaattttgacctgtctttttgtcacaaaattttgccaaataaccgttggtcgggtaacttgaggatgaatttttgctagcaattttggctaattggcattccgttttcaacaactcaagtaccaattccaaagatttgcttaaacgatcaattgaaataagaagagaagttagcgatacgttaaaattcgggtgccccgcttttaaggatgcaaatatgcactatttctttagctataaatcaattaaaaaaattgaatatcaaaatttccgaattacttaattttttttcaattctttgtattaattttggcatggttttagtgccaaatttatggtgccaactttttcggcattttattatataaaaatccaaatttacttcgcattgtcaatcttttcgccattcgtcagttcctctgtatttgtatggtaaataaaatgatatttaattaatgggtatttaattattaattttctattttcaccgttactttgttgcgacaatgcttcacttatttgcttcagagcaacaaattcattggcaatttgatgatggttgttgcgtttgttttggggttccgcagacaatgcaaaacaaaagtgataatttaccaaaaatacaataaaaagtagcaacttttggttatccattttctaaaatttttctcacctttacatacttattaatttaattaatttaagctattagagatgcgcgcaaattcacgattctcaaatatttcgtgattaaataaatatgtaaaattaaaaactctcaaatattacatgtaaatgaaatgttaaatgaatggagaaatttgtattgtattggtcgcgtatatgcatatgcgtatgccttagtcattgcttaattattggtgaatatatttacatgtgtaaaaatgaaaattaaataattatgtatattttttactgcctatgaggcaaggcgagaaaaacgcatcctttacaaatatattaagagtgaaattcagagaaaaaatgatgaaatggtgccagggcacacataaaattgtatttgctacgttgcaacatatgttctgacatttaaaatattgaatttttcattgatagaacataatcattgggttaatatgaaatttattgaaataagtaataaatttctaataagtttttttaattattttttttttaatttttattttaaaacaatgattaatac

SEQ ID NO: 6329 - DNA, 1280 bp, Heterodera glycines
  misc_feature (13)..(13): n is a, c, g, or t
  misc_feature (18)..(22): n is a, c, g, or t
  misc_feature (44)..(44): n is a, c, g, or t
taatttttttttntgttnnnnnattttgttaatgtttatttttnattttttgggtattttctcaaaataacaataaaatggaatttatgttaaaataattcaaaatgagaaactttggttttttacttaattttcttaaaaaattactaaattttagctttatttatatatatttttttaaatgagtttcataacagatttagctattttcaatttttttttagcttaaatttaacaaatttgaagaattttggaaaatttatttgaaaaaatacaaacattttcaatcaattttgatggcgccgctgcaaactcagcgacggcggcgccgggaggcacgggcgcgccaactgctcgcccagcaatatacattttctgattttttattttattttaaatttttttgttcataaatttttcataaacatttttgtcttcagagatattggcccatattttataaagcataaaataataaataattaaatgaataaaaaaatacattaatgtgtcatttaaaaaaataataattacaaaacatgaaaaaagatgaacaaaaaaagacatctccacaggcattaattaactttttaatttgtttgtatttaatatattttcgatgcatttaatcaaatttgacaaactttgtacataataatatatatatatatatttcttgtctatttaagtgaggatatttttgtactttttgccaaaaaaattatatagcacatgctggtggatgatgtgttaaaaatgcgtatagggctgaatagagagggactcaaaacactgacacctttaaaaaaagataaaaatttgctgattggaaattggccaatgctgatcagcggcagcagacagatcatccaatgatcactgatctttcccttttctctcatggatggccaacaaatggcacgaacacatggataagtgatgaagcattgttggccaaaaatggactcggacttaatttttgccaacggcgggcggctgttcttcgacttgcaaacttttcgactgttttggcactgcatcaactgcccaagcttgcaagcactggacttcgtccacccgaatgatttctttggtctccggcttactgtagccccaaaagcttacggtaccaccttcggccttctgtaaaagcagtcaattaaaacgggtttttgaaattagaataccaaactcacataacaaacaacatcaatacgagcccaattgtgtccaggatttttttggattagaattccattgaccttgagtttacaagtaaa

SEQ ID NO: 6330 - DNA, 2207 bp, Heterodera glycines
  misc_feature (2185)..(2185): n is a, c, g, or t
ctctagagtccctgtaaaacttcaaaaatccaagaacggcgatcgtctgaagggttttgccaagacttaacgcattggaaaggtcataaaattaagtaaccaagtaacattttaccccatttcgtccgccaaaatgccgttgattcggttgtgttccaattgaatcaaccaattcagtccacggacttggtagtcgcgcatttccccgtttttgatgaaaggtggggaattctcgaagatgaacggactgtcgtcgcttcgaacgctctgttgcagcagttgctcgtcttcctctttttcggtcattctgtggcggtggtcccctaacgcagccgactttaccaaggccccttcacgttttgctgtcggtgccgcctttaatttctctaatttgaaatagcaaaaagaaattaacaaattaccttttcttgaaaaacttgcttttgaacttcattttcgatctcatttaggaatttgtcgaactcaggcttcgtctaaattatttattgctgaaacaatcctcaatccaagcaaaccttttcatccaactgttctttaacttcctccatttttacgtcagaatcatcaaagctcttggatgaattttgtgtctccatctttcgtatacaaaaaatttaaaattaaattaaaatacctagtagattaattaaagaaagtaattaatttgacgcacgaaaaccgagtttttttgggcgttgttaacacaccgagtcaaaaaacgagacatgtgtcaatacactatgggtcaactccactgtgcagagaaaagcctagtactatctcgtcgtttctctttttctttataatttctctttctttggcgtactatctcttcattttaattatgtaaaaaacaacatttacttcatgctgtttaacttttttttctgctttttaaattcacaccaaattttgcacatcgatagagaaaaaatttttgaatcgaatgttctataaggttttaatgaatttctatcctattttaaagttaagggatgatgaaaattttgcatttcttttcctctaattttggcgtactattttcatgtctctaacacatgaaaaaacatcaaattcgctaattctaacaattttggtttataggctacaaaatcactttgaacacttagaatcaatagaaaatgattagttttcgcattttggttgaaatcagcagtttaggacttgagttataacgtgataaaaaatttgaaactctcacaacttttttcatatgacttaaattgcttagcattcgcttagaaaaagattccccttttcaaattcttattttagataccaaatttgttcactttagttgggaatgaagcgagttatggctgatcaaaataaaaaatacaaaaaaggcattttccagtgtaattttgaattagcgcgcaataatttacgccaattacgctatttggcgttatgagcaattttgtctaacactgggcttgggcgcgccaacgattcgtcaactcgacgattcgtcaactcagcgaaaatgcgacgattcgtcaactcagccaaatgtcaacgattcgtcaactcaacgattcgtcaactcagccaaaatgcgacgattcgtcaactcagccaaatgtcaacgattcgtcaactcaacgattcgtcaactcagccaaaatgcgacgattcgtcaactcagccaaatgtcaacgattcgtcaactcaacgattcgtcaactcatccaaaaatagtttaaaaagcagtttcaagagcttttaatggcgcttagcacaattatagcattcttttaggctaatttagaaacaagaacacataaaatcacgacccttccgatgaaatattcaatcaaaaacttgcataaacaaattttattaaacaaaaattcaaagaaaaaaacgaatcaaaatgatgattatcagggattgaggttaaacaaatttcaactgatattatagggtgaatgaaggtttaaaaatttcaatcaattgcaattggttcaatcttccgcttctgcatagtcctcatgttcttgtgcccctcgtgcacgcagcccgcccacatatccctgcatctgcaaactcagcagagaaaggatgttcaagacgtcttcgtcggtgttgtactccgcttcgtccagtgcatctccgatcaattgctccttcaaaatatatntgatgcgacgcttgtgtgggaa

SEQ ID NO: 6331 - DNA, 3042 bp, Heterodera glycines
atagctagggctgggatttttatgtgctaaaaatcctgaaatatgtaataaaatatgtactaaaaaacccaaaatatgtgctaaaaaccaaaaaaaggcctaaatatgtgttaaaaaatgcaaaaatatgtgctaaaaattggaaaaaccaatggtatttttgcataaaaattccaaaaaactcattctttatcatttttgcccgcacaattgcaaataaaaaacatttggaggtgtttggggtaaaattagtccttttttgataaattgtttttaaagataatttttccatcagttgagtaccagcaagaaacttcgatatccagtaacgaattaatgaagaattcgattttcggtacacgaaataaataaagaaaattttgaaagagcctataaaaatggcaagaaagttgatttttagtggtgcatttttgaattttttatgtttttcttagatatttttttcaaaaatgccaaaatatgtgcaaaatatgtgccaaaccccgaaatatgtgcgatatgtttttatgggtcgggggcgtttgggccccagtttttgggcccccgcgtttgggcccccgtttttgggccccagggtcgtttgggccccaagcgcctcccctcgattcgtcaactcaacgattcggcaagccaacgattcgtcaactcgacgattcgtcaactcagccaaaatgcgacgattcgtcaactcagccaaatgtcaacgattcgtcaactcaacgattcgtcaactcgacgattcgtcaacccagccaaaatgtgacgattcgtcaactcagccaaatgtcaacgattcgtcaactcaacgattcgtcaactcagccaaaatgcgacgattcgtcaactcatccaaaaatagttttaaaaagcagtttcaagagcttttaatggcgcttagcacaattatagcattcttttaggctaatttagaaacaagaacacataaaatcacgacccttccgatgaaatattcaatcaaaaacttgcataaacaaattttattaaacaaaaattcaaagaaaaaaacgaatcaaaatgatgattatcagggattgaggttaaacaaatttcaactgatattatagggtgaatgaaggtttaaaaatttcaatcaattgcaattggttcaatcttccgcttctgcatagtcctcatgttcttgtgcccctcgtgcacgcagcccgcccacatatccctgcatctgcaaactcagcagagaaaggatgttcaagacgtcttcgtcggtgttgtactccgcttcgtccagtgcatctccgatcaattgctccttcaaaatatatttgatgcgacgcttgtgtgggaacacccgggcagatcttgcgatgtccatctgtttgtcgacagaatccagaatagctgctaggaagtctgacaaagacgggtgatggactaaacctcgcttaaatgtgaaaagtgatgaaaaaaatcgcaaaaaatcacactaccgaaaattggaggtgtgacgcctccatagcattgttcgtcttctccactgctgacctcgcacggtcgtggacattccagaagtgcacggggtacagtggtggacgcacaattggcagctcccagcgcggcacgacggaaactgttgttgacgactgggttgttggcgttgatggaacaggtgaagggacgccgaattggatgaaattgtttccataaatatggtccaaatttactaaaataaagaaaataagaacgaattcaaaaaacaaaaatactcaccactactaaatgaattccggcgactgtattcggcatccccagtggcattggtgctgattgaactgcgtcggctttgatcagtgcccggaacaaacgcgacggcgccggcttcttgttcgtgtgcggtcagtccaacatataccctcgcaaagtaaccgaaaaatgcagccaaaccatcgggtgcatgatttactatgatcgcaaaactggtgccactttgaatgttccatcaaccgaaattttcctcgcccgcttcaaaacgtccaacagctgaaaataaaagcgaaaaattgaacatagaaattaatgaacttaacttcgggtgtgcaaagaccaagaccacatccgattctccttggcgacgcactcggctgtcatacaacaatgtgctttcgccatccttcataagcagggcatcgggtaggacaacattcagagggttgacacggtccatgttgccgtaaatctttcttttctgcctaaaaaactggaaataagagtgaaagaggaatacaagtatcaaaagagaataaccttctcattactgccgccagtgcgaggtcagtgcccatggacacaaatgtttcatccttggtgtttgcacggacttctgccaatacttttgatggcttttgcgcgggttttccatcgttgtcgtcttaattccgttgcgttttacctccgcgtggaagcacgctgggtccggcagatggttgtgctctttcttccgagcacaccattagttccgccttctttactcaatgctgcagttgcctcacagtcccggttggaacagcggtaccaccgccctctgatgcgagtgaaacggaaccctgcaaaaaatcgaagccattgaaaaatttaaccacccgaccttgatgccaaatgcataatgatcccctctccgtttttccttgttgaaattcgattagaggtctgttttcctcatcatcttcatctgatgcggtgtattcggcttgttcaatctgctctgcgtcctcgcgttgggtaggaaaaatgttgctgtcgtcgtaatcagcagacggctctccgaaccgctttggtgtttttcgtcgatgttgttgttcaatttgtttacgaatcgatttcattgatttgctaaaattgaaaaacaaaattgaaattgatgcaatgtcaaatgcgcctacaattcgcctggtaaagcattacataaagactaaaaattaaaataaattactgcatgcgtaataaatatttatttttttataaactacttgccgaatacgagttcga

SEQ ID NO: 6332 - DNA, 533 bp, Heterodera glycines
cggtgtcatctatgttactagatcggggatcgatccccttgcgggcgctcgagcaggacctgcagaagctagcttgatggggatcagattgtcgtttcccgccttcagtttaaactatcaagagagggaggagagggttggagaaggaaaggaaaaaaaaatgaaggaggagaaagggtgggagggagtatgagtatgatggtcaatatggagaaaaagaaagagtaattaccaattttttttcaattcaaaaatgtagatgtccgccggtgtcatctatgttactagatcggggatcgatccccgggcggccgctcgagcaggacctgcagaagctagcttgatggggatcagattgtcgtttcccgccttcagtttaaactatcaagagcggcgcgtagcgggggaggtgggtggcggaagaagaaaagggtggggggagtatgagtatgatggtcaatatggagaaaacgaaagagtaattaccaattttttttcaattcaaaaatgtagatgtccgcagcgttattata

SEQ ID NO: 6333 - DNA, 1670 bp, Heterodera glycines
tgagctctcaagaaaaagtgggcgaatggaagagaatgggagaggaaggaaagagcttttaaagcaaaaatgcgtcaataaacgaccgtttaataaaatcgtgtaaaaatggcaaaaaaattagtataaaagtggttgctcttcctccgccacgtttcattattttccattcgccatttcgtcgactttttctcgctgacaatgccttcaaaaatgaatttgtacgtttttcacatttttttcacaattttacgcctttccttcacattttttagtctgttgggtgtgttgttttaacacacaaagacaaaaattattccataaaattgaccatttcaatggcttttttcctcttcaattttttataatgaaattctgagcagatttaaataattttaatcttttttgctaagctaaattaaatcagtcgaagaaaattgtcttaataatttcccctcaaaaaaatgtcagacaatcgaaaagaagcggaggaaaagatggcaaaagcaatgtaaaatttaaaattaaaatgccaattttcaatttcaattttaaattttgtttcctttttcttcagcttcatctccggcgacggttggctttgtgtgtttgatttgctctctccgcgtcaacttggccttggaattgcgctgatcagccaccgctttgacttttatgtggacgaacatttcaaaacgcgcaaaagggcattggcatttattcgaattcgacgcaaaaatggagtgaatggcaccaaggaaatggaaattggcaaatattacgattggaaaccattgccaattccgcaaattcaattgccacgcaaagtcagcggattcggactgatcagcatagcgtaaaactggcgattatggcaaattaatgcaacatttcccatttcttttcagtttcattgaccaaaatgtcatcgcttttctccgccgttttcgccaacttttcgccaaatgtccaattaatttgtccatccgcaccaacactagtgattatcgcattttgaagtccattttgaacaacatttggccaatgctcaacaaaaacattcatggcttgcgattgtccgccacatttttccaccgtttgcgacaatttgtgccgtcaattctcaacgattgtccatcacttcgagttttctccatcgattatgacaatctcttcaccgaatttccatgcgatgacagtgccatggcatcggatggacaggcggtggccaaatggcttttcactccacgtccggacgatgtgccaaagttgttcaaatgcttgttgctttgtgatcgcgggcatttggcgtcgagaatcgaagccttcaaagcggtgattttcaatgatttatttggctgtttacattcttttggattagtttaaaaacaaaaatttttttgcctaaattgagcttttaatcttttgttttttgtgcccccctcccaatcaaaaaatgtcattcattcatttgttttatcaatggtttaggcttttgcctcggcttcatctcccgtcaatttcattgtcgtcatgcttatgccttcgtccgttgtgccatttgatctgaccaacaaatttactcgggaacaattggcattgaaaagaactgactacagcagccgatgttttctgctgatccgttgtccaattgcgcgagacgaaagcaa

SEQ ID NO: 6334 - DNA, 2989 bp, Heterodera glycines
  misc_feature (28)..(28): n is a, c, g, or t
  misc_feature (38)..(38): n is a, c, g, or t
gaagtcgtattccgaccccaaaaatgcnggaaatcganagtcggaaatcggaattccgacctcaaaaatgccggaaatcaaaagtcggaatcggaattccgacctcaaaaatgtcggaaatcggaattggcaaaaaattgaaaatttattggacttttgaaacttggagttgaaaaataaagccccaccacgaattagagcccccctctgaagtaaatcccgcccccctttgaggggggtggaaaaatagaacccccaggggttatattacaataaatacggtaaatcagtgggattgggttggaattacctaaaatctttttacaaggcatcaaaatttggtaaaaattagtataaaagtggttgctccacctccaatttcattattattcattcgccccttattatatttttctctctgttcgaccttttctccgtggcaatgtctttaaaagtgattctgtacgttttgcgcatttcttctcgacatttacccttttccttctcattttttagtctcatcgctgtgccaatgtttatgatctgttgtgccattcttttgaagtattgggaccgtttcaaaaaaccaccaaaacaacgaggccatcgtaaaattgaaaaagtgccggaaactgtcttgtcaatttgctccgacgaaatgtcatcagacaaccaaaatgaagcggaggaaaagatgcggcgacgaacatttcaaaacgcgcaaatggacattggattttgttcgaatttggcgcaaatttgaagcggatggcacacaggaaatgaaaattgtcaattgcctttggaaatcgatgcaaattccgcaaaatccgttgccaaagaaagtcgtcggatttgaagccatcacaataaggtgaagcgaatgattttttggtgtttcctctgtgtaaaacgattccttcctcttttttacagatacatcaatgacaatgtgatcacttttcttcactgttttcgtccaatttttgccgcttttccaatcaatttttccatcgtcgatacctttgtgtcgcaaaattgaaagagtgccggaaactgtcttaacaagtgaaagagtgccggaaatgtcttatgcctcgacgaaatgtcatcagacaaccaaaatgaagcggaggaaaagatggcaaacgcgatgtaaaattaaaaatgccaatttaattttcatttttaaattttgttttcccattttttcagctttatctccgccgattgttggctttgtgtcttcgatttgcttgagccgtcacaacttggccacggaattgcgatgatcagccaccgttttgacttttacgtcgacgaacacttcaaaactcccaaagaaagtcgtcggattcgaagccatcacaataaggtgaagcgaatgattttttggtgtttcctctgtgtaaaacgattccttcctcttttttacagatacatcaatgacaatgtgatcacttttcttcactgttttcgtccaatttttgccgcttttccaatcaatttttccatcgtcgatacctttgtgatcattaacagcactttggattccgttttgcgcaacatttggccaatgattgcgacaaacatttgtgccatccaattgtccgccgaagttttccgccgtttgcgacttctcgtgccgtcaattctcgacgactgtccatcgcttcgcgttttcaatgcgtataatgatggtttcttcgtcgaatttccatgcgatgacagtgccgcggcatcggatggacaaacggtagccaaatggcttttcactccccgtccggacaatgtgccgaaggtgttcaaatgctggttgcaatgggatgatgggcatttggcgtcgagcattgaagacttcaaaagggtgattattgtttgactgatttggcacttttacgggctttgagggtcgctgacaaaaatattttggatggcattaaatttgaatttttcagtttttaattgttttcctcattttaggaatttaccaatgcatttctcaactggcttctcattccacttccggacaattatttactatatgtctttaggataaatttgttgagaagtgatcgatcgatttaataattatgaaatttgaaatcgatgcgctcataaaaattgtttatttattgttggaatgatcaacatggttcttttttaccccattagagctcggaacgggccagttgcgtctgagcaagtttagagcatcataacttttttctttgttgaccaaatccaacaaagttggtatcattcgaaagctcttaacaagctctatcggcttcctaaaaatcacaaagatatgccgacatgtaaaaaagttataaattaaaatatgcaaaaattctgactttttggtagtattcatgttgcaacttttttataagttgttcaatcgcttataaatgccttgtcaaaagcttctaaacatgtagagctttggaatgatgccaaatttataaaatttgaccaacaaagaaaaaagttataatgttttatgcagggttcccagatctgaggatttacatattttttcaacgagtatgaaccaattgcacaattttaccgccaaaaagctttatgaaaaattggcattggctgatgatcagtttgatgagtggcttgtggaattaggcctattacatggtagacgtacatgtcctcaatgtggaaatgaaatgggacgccgccaacctcgcccaaatcagcattatggaaaatggaggtgcaaaaacgcacagtgcaatcgtccggaaatgggctgccttgttggcacttttttcgccggctctcaccttgctattaagcaggtgttctgggcgcaggaattgggtactcaggatcaaatgatgcgcgaaatcgatatcggaggttttgtaaattggtttattcaccgaattccctgccgatgacagtgctacggcaacggatggacaagcgatggccaaatggcttttcactccccgtccggacaatgtgc

SEQ ID NO: 6335 - DNA, 513 bp, Heterodera glycines
cccaaaattagacgattggcctactaataaaattagacaatttacttaatcctaatgaatttattaaactcattgaaaccgtaaattttgattcgcaccttttggcgtacaacggcaacccaaaaacaatcgctttttatttttcaaaatcggtttttttttttttgcaaaaacacaagttgatcagtccaataacagtaaaaagaacaatttttatgagcatgtcaataattccataattctaaattgatcgatcacttttcaacaaaatcattcacttcttctgatcacttgggccgggagttgcgtcaagaagcctaaaaataaaaatacttaataaatttgaatttagaaaaagcattcgcttacccatctccgatttggtcctcattattaatttgaatgccaattttgttccactgatcataaatttcccatccaagcgctttcttttcccattttgcccatttgctttcatctcgcgcaattggacaacggatcagaagaaaacag

SEQ ID NO: 6336 - DNA, 3428 bp, Heterodera glycines
ggcttcatctcttgccaatttcatcatttacgtttggtttccttcgtcttttgctgactccgttgtgccatttgatctgaccaacgaattgactcgggaacaattgacgctgaaaaggattaacaatagcaaccgttttctgctgatccgttgtccaattgagcgagacgaaagcaaatggacaaaatgggaaaaggaagcgattgattggcgaatttataatcagtgtaaccttcacattggaatttataatgatgataacatcggcaaaaggttaagcgaatgctttttcaaaaatccgattttatttggttttatttttaggcttctcaacgcaactcttggcccaagtgatcagcagcagaagtgaatgtttgttaagaagtgatcgatcaatatgaattgcgttgttggataattatttttgttgcggtgatcaccaattgtattatatatatgtgtgtatatatgcctctaggataaattagagatttcctgaaatcccaggctcattcttttgatctaatgataaagtcggtagtcactgttccttcaataactgggtcgttttaagtaccatttattaaacgatgttcacccgtttcgttttattgtgcccccccccctcgattttttagcaaagtcagacaaattaggacagttggctggatcagagaaatgtggacgattggcctactaataaaaattgagacaattgatcaactcataaaaattggacgattagcgtactcagtaaaaagcccatcgtacggtagcggaaaaatcgcaaaagatgcaaatggaatgaagatttctttcatttccattgctttcccagtcgtccgtcgttcacactttccatgaaatgcggccaaatccgtcctgtgcccttccccttggccattccttccacgtcaacccttcgttttcccatccaaaacattttcccttttagccaaacggccatttctttttttacacaaaagtatttatgcaacagtttaagcaaaagcaaatggaaaaggggagaataatatgttttgatagattttatctgcacacatatttcgcgacatccttaacattgaaaaaagcgcaaaaattgcctcgactttgactacaaaagggatgtgtacagtatgccaaagaaaaaggtgctgggtcgaacctaaaaaagtatcagttataataaaaataattaatttaaatgttataaagtgactaaatcctataaaattctaatttttttgtgcatgtttcataaatattttggcatttttaatacatatttatttacatattttgcaatttttcttacatatacctaaattcattccctagtaataaactttttagcgtttttttgcagccattttagcattatgtttacgcaacatttcttctcgtatttcaattcaaacatcgatatcaatttttatgagtaagtattagctagctagaaacttaaaaaatgaatgaatatatgtaaaaaaataataaacaagtgtaaattattttaaatattatcatcaacgaattttgcttcaaaaaattacatttattcttttcttaaattgcaaaatcattatttatttatgtgacataaaatgagtatgtaattgaaattgcttattacataatataattttataagatttagtcactttataacatttaaattaattatttttattataactgatacttttttaggttcgtctcagcacgaagaaaaacattgagtgagtcattgactaagggggacagatttaagtagagtagagcgggactggggcctggtactgaaaaaacgggacaactgagtacctaagccccggttttgaccgtgaccttggaccagtcccggttcctggttttcccagccaaaaatttccaattttgaacccgaaaaggtcccggtcgcggttttgcccaaaattcccttcccgctctactctatatttagaattggacgaaagcattccaacgggacggattctctttttggggagtttgaattggaaaataaaacaggacgatgtgacttaattaattcgtttgaattggcacggtgccaaaaataataccaaaaaaaaaactcctgctgtgatcgagatattaaaatttttggtagggaatctttgtggactaataaaggacactttgggctatcaaataataccaaaaatctgcaaaagcgccgaaatttttatgatcataggtcaaaatagcatcaaattcatttggcaattacataattcaattagatcgtatcacttcaaaacaatacaattgaatcaccgcaacaaaaaaagaacaattttctgaacatcaaattctttatccaacgccgcaattcaaattgatcgatcccttctcaacaaatcattttcattcattcattcactctgctgctgatcacttgggccgggagttgcgttgagaagcctaaaacaaaaaatacataataaaattgggtttttgaaaaagcattcgccttacccatctccgatgtcatccttattaatttcaatgtcaattctgttccatagataagaaattctccagccaatcgcttccttctcccattttgtccatttgctttcgtctcgcgaaattggacaacggacgaacagaaaacgatggctattgtcaatcactttcaatgccaattgttcgcgagttaattcgttggtcagcgcaaatggcacaacggaatcagcaaaaggcaacggacacgaaatgatggcaatgaaattggcaggagatgaagcattggtaaatgcctaaaatgtggaaaaattggttaagtagtaaatgacaaccacagaatgagtactaaataaataataagcaccgctttgaagtgttcaatgctcgacgccaaattcccgtcatcccatcgcaaccaacagttgaacattttcggcacattgttttgaagcggagtgaaaagccatttggccaatgcttgtccatcggatgccgcggcactgtcatcggcagggaattcggcgaagagattatcaaaaattagcgacacaaagcgaagcgatggacagtcgttgagaattgacggggcgatttgtcgcaaacgggggaaaattccaacggacaattccaagacaagaatgttttttccgagcaatggccaaatgttgtgcaaaatgaacttcgaaatgcgatcattggtcgtttcgatggccaaattaattggacagacggcgaaaagttggcgaaaacggtggagaaaggcgatgacattttggtcgatgaaactgaaaaaatggatgggaactgttggcaaaaaattttgacattggccaattttacttgatgttgatcccgtcgaatccgatgacctttgagtggcatttgaatttgaggaattggtattggtattccataacaattgacaatatccattt

SEQ ID NO: 6337 - DNA, 2496 bp, Heterodera glycines
  misc_feature (2470)..(2470): n is a, c, g, or t
ttcaattaatttcactaaaaatattataaaaaaattacctactagatttaaatattaaactattctaattatttcaaatgctaattgagggaagattttaaaataaatattaattataattataattttattttttttgaattttgtaaaattaataaagtgatcttaaacaaatttaagcaggatgatgacgtgtgtactaattttatttgttttaacccttttaatactttatttttctttaattcatatctattaaatattatttattttatttgttaattttatttcaattcaattaagaaaaaaattttagtttttaattgtcatcattttgtaaaaaacttttcagcaaggaaaacaacttttttaataatataacatgtaaaaattgaattaaaaattttaattacagatattatctactttaaataaaattaaacgttaaataattaatctttatgataaataataatgtcgatttttaatgtatttgtaattaattttattgaattaaaatataataacaaattaatattctctccttctcgatcgtgaatgcacattcgttgttccgtctttagtccgagttttttttcttcttttttttatattgttattaattttttttttaatgttttcgttctttttcaattagcttccatttacgtcaattctcgtttttcatttatatgctattttataaaatcaatttcaattcaattcaattaatagtttaaatatttaacttgagttttaagcaataaaaaaagagttttcttaataataaaatttcgagaatcatagctctttttatcgccccttattagtcatctaattttgtttaagtaaaataaaagtataatttagaataccaatatgggtattttagcaaaattagattgatttatttagaataattcctattcttttaaaattttatttgaattattttttatgaaaagttatgacgatttttctcgaaaaatctgtagaattagcagtttttacgaaaagttagttatttccttgtttaatttcctttaatgtattcttttaatgcccccgttttcatattctacagtaaataatttaaataaatacttttatcaatttttattattaccaaatgtatttaaaagatcttttttaattcatatttttttttgttttacaaaattaaatgtaattaaaattaattacgctcaaatacacccatttaatctaaaattataaataatatttaatagaacgtggatattatttattttttgctactttgtatttcttgtagttgtacaattgttttttattttttgataagaatataaattgttaacaaaatatcaaaaagaaatttacaaagaaatattaaaagtattttattcaattatataaaaatgataaaactttccattgcttaaaagatttttaataatttgctattatattaatggaattttttatttgtaatttcttgtcattcttctttggtccattcatttatcatcatgaaaaacgttgagaataagtaatggaaaatgtaagaacatttaatctgttttgatgtagttgaaaataaatatcatttatataaaagtttttaaaattgttgtattaaatcaaaatagaaaaatattataagttgtgatgtgaaaattcttaaatcagaacaaggaataataaaatggggtaggtcaaacggatttttgcgtaagagtttcaacattaaataacggaattttttttgcgttaaaaagattttttgcgcacttttttataccgaatttaatcccgcgggatcctgaaaaaattccgcgggatcccgtccggtcggtgctatgacattagtcaaaaaccatcataatgggcgttagtcaaaaaccatcaaatgaaaatattttttgataactttgttcaaaagcatctaaatttttaatatcattaaatagcactaagtgctttctattagcctacaaaattccaaatagtttcgttaagtttcaagaaagtatgactaaaaatgttcaaaaaaacttggttttttgaggttctcaagtcataactttttttaaacttaaagaatttttttaaattttgcaggataatagaaaacacttagggctttgaaaaaaatcaatattataaaatttgatcccttttagacgaaattatgaataattttctgtctaaaatgattcatttaatggtttttgactaacgtcccagcacctatgattcttcatagttttttttaattaacacatttttatcattttttaaagaaaatccatacaaattgagcttaataatccctaaaaccaacttttttttgttgaaaatctgttaacaaattacacccaaatttcaaaatttcccccggcggcgcctatcggcaccgccggacccccttctttccctaaaaattttttgaaaagcacgccgaaaaaaagtaaggtgaaaagcaaantattatttataataatattcaatcat

SEQ ID NO: 6338 - DNA, 2344 bp, Heterodera glycines
  misc_feature (44)..(44): n is a, c, g, or t
  misc_feature (89)..(90): n is a, c, g, or t
  misc_feature (116)..(116): n is a, c, g, or t
tcaaaatagaaaaatattattagttgtgatgtgaaaatcttaantcagacaagggaataataaaatggggtaggtcaaacggattttgnncgtaagagtttcaacattaaataacnggaatttttttgcgttaaaaagattttttgcgcacttttttataccgaatttaatcccgcgggatcctgaaaaaattccgcggggatcccgtccggtcggtgctatgacattagtcaaaaaccatcaataatgggcgttagtcaaaaaaccatcaaatgaaaatattttttgatataactttgttcaagagcatctaaatttttaattcttgatagcattaaatagcactcagtgttttctattagcctacaaaattccaaatagtttcgttaagtttcaagaaagtatgactaaaaatgttcaaaaaaacttggttttttgagcttctcaagtcataactttttttaaacttaaagaattttttttaattttgcaggataatagaaaacacttagggctttgaaaaaaatcaatattataaaatttgatcccttttagacgaaattatgaataattttccgtcaaaaatgattcatttaatggtttttgactaacgtcccagcacctatgattatttttatcattttttaaagaaaatccatacgaattgagcttaataatcccaaaaaccaactttttttttgttgaaaatctgttaacaaattacacccaaatttcaaaatttcccccggcggcgcctatcggcaccgccggacccccttctttcccaaaaattttttgaaaagcacgccgaaaaaatgtgatgtgaaaagcaaatattatttataataatattcaatcatttagtccaaaaaatgattaattgtttgaaataattaaagaaatttgtttgaaaattttaattaatttaatttagctttaacttgtggattttattaaataaaaaaacaaaattaaaatttaattttgtattattttcagttgaaaaaaattaaaatttgaatttttttgaattttaaaaattcccggttggtcccggttccggtcccgaaaaaaaatcgaggtcccggtcccggcttatcaggttccggcaagtcccggtttttgcaaaaattcccggtcccatggcactctagttaaaaatattaaatttgataaattttatcgattaataataattaaattacttttttaatttttctttcttatatccctaaaacttattttcaaaataattgaattgataataaatatttattggttttcaatataatattttcattcttgtgcagaactcctaagttgaatattagtgttttgtttatttatagaatttttattatattttggtataagaatatatatataattttataaaaatgaaattttaatgaatttttgcaaattttttttatgcaatggtattaataaatttattgataaaaatatattattatttttttttataaaaatgagtttaatagtctgacttacactttaacaaattattaaatattggtaattttattctttttataaattataaattataatataaatccattcttacattgtcgatctggcctttgttttattcatttttatatgttttcattaattatgataatcttttcttactttcttaatttcagaaaatcattaaaacttcgggtcaaattattgtataaataaaataaagtgaaagtctctcgtgcttgcagacttattttgtttaatattataacgggctttgattttggtaaatgcttaataaaataaataataaatttttaattttaatttgtattaaattttttatttaaaagaataaattaagatatatatattctttcgccgtcttgaacttcaaaaatataataattcaaaaaaaaattattatgtttttttcttggttgatgatcagcaaccccaaaaagcgtttcaggaatagttgaaattgaaatgcaaatattatttttttgataaagtttggcgaagtaactgacaataacttgaaataattaagcaattttctgcataatattataattatttaatagaagcaattattattttttaataaaattcttttgacgcacgaagtgcattagaattaacataataattaaaaaatttaaaaattattttgcagggctgccattttattaaagttaaaatttttgatttttaaaatttcaaattttaatttatttcagtgaaaataatacaaaatttaataaataatgaaaattttcaaccaaatttctttaattattttcaaacaattaatcatttttggactaaatgattttaattattccataat

SEQ ID NO: 6339 - DNA, 2086 bp, Heterodera glycines
aaaaaatttaaaaatttttttccagggctgcccttttttttaaagtaaaaattttgtttttaaaaaattttcaaatttttatttttttcaaaggaaaaataatacaaaaatttaataaattaaagaaaattttcaaaccaaatttctttaattttttcaaccattaatcattttttgggactaaagaattttaatattcgataaattaagggattcgattttcttcttgtttcaaatatttttacattaattgatttatttattatataaaaaacaaaatgtttttattggtttccgaaaacaataaaataataaaataaatatttcagatcttttccctacctattaagtaaaaaatatagtagtttaatgataaaacataattcaaaaaataatttttatagaatttaactccataattattttagtcttttgaaattacttttaaaatcaatttcaattgaattaaaaatgaatgtttttgaattaataattttttaaaaatataaaatataacgaaaactaatcgaatattaatttaatttttattcctttaaacatagaatgtaccgtaataaaattaaaatcaaaaataaatcaatttacttacttcactctggagttttcttacattcgaggctgatctttgttaaaaaatattttattaatttttcttataaaacatagattttttcttaaatttttttaaattataataaaaacagcagagtgacgaagccagtcatttcttaagctattagaattaagtttacattttctttatttttcgtttataatttcaaaacattttttgaataataaatttattttgactaaaattgaaaattagcgttttgttaaaattttaatacttaattttctttaaattttattcgtaataatgctaatgctaaactgagatggccaaaaaaccgttggctctgacgttgcgaccgattgccccccgccgtccccgcgagtgcggcggttggcttttaatggacggacgaaccccagcgcagcttcattaatattcagcagtgccccccccccccccaatttcacaacacttgcgggtgctttttccaaaaaatttttttgggaattggaaggggagaaattgttaataggtttttctaaaattgatcattttaacgtattggagtatctttttgaatcaaattttaagaaaaaacttgggaatttttgtgcaatttattaacaaattttcaccaataatgtaataagttaataaaaattttgtataaaaggtcaaataaaaattaattctttcaatgctctttttcaaagcatcttaaatttaaggatactttaatttttcaagtcagaggccccaatttccaggacgtccttgccattcaaggacgaatgcgaaccttgccatttagagtcaaaaaaagttatttgacttaaattcccttttaaaactataatttgatttcattctataattcctttgttcgatcagtatagatttggttggagcctggttaatgggaattatgtaaaattcctaaattaggcactaaatggggtaaaaggcccaaaaaagttcgaatgtgtataaaaataggtatctactatggatgttgcaaaaataaaaagcgaaaatacgaaatatttttctaaaatttattcataaaatttggttgcgaccccgatttgctttgttttattaagatttggcaaaatggttaaaaaattaaaattatttgcaatattaatgtttatttaaactcaatctttattgatgtacttttatttcgcttttcagccaaaaagcgaaaggcgaaaagcgaacgcaaaaggcctaaaaatgcaaaaatacaaaaggctaaaagcgaaacttgcaagatccctggtatctattataatttatcaacaattccttgaaaacccaattaattttacaagcttttaaacccaaacaatagaaccgaatatgcttcgaggcacgcgagaattccttaacccgagattggagacactcacgcaccttgatattcccagttttttacacaaataagtttgaaaccagcttttcggattcctgctttttcttgaa

SEQ ID NO: 6340 - DNA, 875 bp, Heterodera glycines
actggaagtcgtcaaccatcaccaccgaccacttccaccaccaccaccagcagcacaaccagcggaagggccacgtcggtccatcagacggcggccacggcggccaatccatcgacaaacgccacgggcagaagcagtaccagcaatagcagcagcggctgcggcggcagcaaattccatttgcccgaattgaaagttggccgagcgcaacagcagcaaagcgcggccggcgcatcggccggcggcgatggtaagggaaaaaagtgggagagagggaggaggacgaggagatgaacacatggccaaatttggttgggcatttgggacacgcacggcatgcccgggcgacaaatgccatcgatgaatatctctaattggaggaattatcttttctattctttaagtctaccccaacaaattttacgttttctttttggcgctttgtgacacaaaattcgccaaaaatgaaaaaaaaaacatttgaaaattagacacgcattatttcatttttttgttgatgccctaaatttgccaaaaaagtgtctgcccctaaaagatcaatcaataattttttctctgtcttccctgttgccggtttttgcgtgtctgtcccaattcaatcaatatttctgtcatttatttctctctctgttcagattgaggatgccatagcgtcggcgatcaatggcggtggaagtgcgaaggtgggcgaaggtggcggacattgcgctgctacgcaacgggcgactgagcggcgcgtcgtcgccgcgggcgccaacgacgactttgtgcggcgactggtggacgtggtccgacgcgagccggcactgtacgacccgagccacgagcactacgggaacagacacgccagcgca

SEQ ID NO: 6341 - DNA, 3938 bp, Heterodera glycines
tctagagtcacttttttttattgtcaaccaaatccaacaattttaatcattcgaaagcttatcttgtttgaaagctttttctaagctatcttcttggcaattagacaattaccaaaaaatgacaacatgaaaattgcgaaaaaatcgaacttttttttaaattttttcttaataaaattttttacaggatagaagaaaatctttttgctttttgtaaagctaatagggcaaaaaaattatttaatttggttgaaaattcgaaaagtttaatccaaaactcgggctggcgccgaaacgaccctttccccacggcactgctcattccatggccacacatactcatgtctatgctgtccttcattttagattatcacttggcaaacgtggtgctgccatgacggcgaagccggtgacaaaaaggcagcacaacggcggcggcgaatgcaccgccaatgggtcgtcgccgagcagttcggcgggcagcgaaatcagcgtcggctcggctgccgctgcgaccgtcgcatttggtggcacggcagcggcggggggaggaggacagcagcaacagcacccggtactaattaagtcacaattatattattgtacgagactggtacggagccatgggctgtggataatttgggaaattttggagtgcacctccgttcgatttgtcccacttcgaaatttttaacaaaaactcgaaagaaaacacaatggtcgagagtctcggctttcttgaaattgaatgaataaatcctttttttaatgttttcattttttcgctgcaatttcaaattcatcattaattgccttaaagccgaactctaattgctgatttaaattattgtatcgaaacgagggacgaccaattttccaaaaaagaaatcataaaacaattatttgtctctgtccatcgccgacctcaaacatttggcatttttctctattcccgttatttcacacagaatgccattttgttgccccaactgcggcatttgccgaccaacgtcaatggcatcaccaccaacggcaacaactctttcggctccttcaacggcaccgcgtcatctgccggcgttggccgactgttgcgcgctcggcacggcattggcagcaacagtaaccatgaccaactacaacaaattggaggaggacaacatcagctgcagcaccaattttgtggtggtcgactgtccctccaccaccaacagccgctgctgtacaagttgaaggaggaggaactgctggcagtgaccagcggtggtggcaccaacaacaacacggcacagactggaagtcgtcaacgcatcaccaccgaccacttccaccaccaccaccagcagcacaaccagcggaagggccacgtcggtccatcagatggcggccaatccatcgacaaacgccacgggcagaagcagtacaagcaacagcagctgcggcagcagcaaattccatttgcccgagttgaaagttggccgcccgcaacagcagcaaagcgcggccggcgcatcgggcagcggcgatggaaaggtaaaatgggagagggatgaggggggcgagcggatgcatggccatatatttttatttgttggatattgggacacgcacggggacaaattcccttcaacccaactgaatgaatcttcaaaaagaaaattcatatggcaaagaaaacaaacaaatagtcacgcaataatttatttggcctattttcatcaaacaaaagcaaaatttaatattttgttggttccattattttcgctcgattcagctcagcaattctggcaatttgaacactcatttcctccgatatgcttagtgatgaccgttgtgtccgcccgcactctccataagcacgaatccggcgaaaccccttttaaggcacctgaaacaatgaaatcaaaaaacatataatttggtaaggttattacaactgacattttgtaccgacactgcgtaacgatacaacgataatacttgctttgttcgaggttgcggtaccacacacaattattaatggcaaccaacggataaccgttggagcgctccccgacatgttccaagagatcccaaacgatcggtggccttaataagtgctgacttgtcttagctccacaaaaaccaacatttagtcatagacggtgctccccatcttttcaaggaaaattttgtttttttattcgatttatttcaccctggggttttaatggtcacagaatcaaatggtaatagtaaattttgccctgccccctttttggtaattttttctttctgttctagtcttgaaaacacgtttggattaccaaaacgtaacaaaacgaagaaataagacaaataataaccaacatttgtatttgaagtccgtcccagaaatttgcgcagacgacaaaaaggaatttgaaatccggcccaaagtacgaagacgacaaaaaggaatttgaaatgcacaagttgatgatttgactaaacgaaactgatttaggtcccattttgatgtgacctcacgcatggataagtataacgatataacggcatatacacgattaagaaaataataggatatatactctcatcctatgtatttaaagattcaacaacttgcagatgacggggccccgacatttacggcccgaagggacattaattgctatttacttttttcaaaaatgcatttgtctggggccgcaagtgccgggacaaacagatgacatcaaaaaaaaaaaattttttttttcttgttcaaggttgagcagctttggttctcaaatcggctcgacaagcatttcaaacagtgcgttgtacgtggccagactgagcgaacgacaattgagcaacagattttcggtgagcaaatggaacaaattcttctgattgattgcctcatttttgcgcctaaaaaagtgcacattttaaaaggaaaaattgtggaaatgaatattaattacttttgggtcgaacgacacaaaaaataactgagcattttcagcgtcggaatcctgatcaactcattgccggagctgatcattttgaaaatcacacaaagcgccttcttacgatcaaaagctggcacctgaaaaggggggaaagggcaattcgcgttccgttttaggcattaacaatggtactaaaaaaccagtcggatgtgccatatcaccataatcaaatttcaaccccctacaaatggcttaattgccattcaaattgcctcacctcctgcacagtgttcacaaagttcaacatgcattggaactcttcgtcccggctcacttccttctcgctgatatccgccgggacggtgttgaacatcagtcggttgacaatttgcaaaatgcatccgcgaatgtgcacaacggtcagccgatccattggttccattgccatttgtgccgaatttggcgccgttgtcggcctcaccacccaatagaactgcttgagcgtgtgcatcagtgtgagcacagtgtgcgtacgacggacaatggacgaagcgggtgaaagtagcgaattgttgggggagacgcagaacaaatcgtcggccaaaaagtcgtacagacgcattttgacctgaaaattgagaagtttttgatttggaaatttaaatggccaataaaaagaataatttggatgcgatttttcaagcatttttttgagttttagtcaaattttaccgtcgcatcggcccggacccaaagggttggggtcagaaagacactgtcgatgagctgtttgagcaacgggacgccaatagaacaattgagcaacgatttgtacacggaaatgaagccctttgaaaaaataattccgtgaataaataccgaaaccacgaaaaaatgcgaccaatttcatgtcaaaacaaaacatctacaaaaaaaaaacctccaacaaattcatggtcaaatgtcgactgtccgcattcgctattgtactggccacaattg

SEQ ID NO: 6342 - DNA, 3643 bp, Heterodera glycines
  misc_feature (3621)..(3621): n is a, c, g, or t
caaaaaataatatatttttaatggatcaattaaaaaccctaccaaatgtcattgtccacgggttcgtgctgtttggcatcaatttgagagaagagcggcaccaacacttggatgccgccgatggaatgcaacgagcagtggacggaatgcgttttgaccaatttgactccctgaaaagatatttgatgagtcattggcattccgatcgttggacactcgacatttttcatgacggcatgtggcacttggacaaaataggaggcggcggaactgtgcagttggccccctttgggcgtttgttgttggaacagacaaagttggtcatggcaattcttgggacagtaagcgaaaacgagagagtcgtgaagacgcccatcgaacaattgctgaaaaaatgtgaaaagggtggaccaatgggaacagaaaaaatgattcaaaatagaactaaaacagtaaatccagtttatttggaacaaatcggaacaaaaattgttaattttatgaaaattaaaaattatttattaattaatcaatttttcatactgattagctttaccttccgatatgtgtccggcaaattcgactcggcctcgtgtttgaactgactctgataggaaactcccaaataaagcaacgcagtgaccaacggaggactgatcgcttgtgaagccggcgggggtagcggtggctcaagaatgtcccggtaacggctgaccatcaaaacggacagaaagtaaacgacggccaacgcgaggaattgggcctgtttagtctcctccttgaaaatggaattattgaaatatttatttgttttttccctggattaccatgtccctgtaaatgacacctttcagcctttgcaagtcaacattttgtaacagtcggtcaaagtcggagattggcttcgacgactcgcactaaatgagcaaaagttttaaacccataatctctttaaacggggacgggacaaaacgacgccattaaagaaattttcaaactatcttggaaagtttttttgatttcaagaataattttaagaaaaaacgctagaaaaatttttcattttttcttgaagaatctctacataaaattttaattttttttaagatttcggctagaagttttgccttggcgagattacgggtggtgagattttggggtgcaaccccctaaacttacaaattttcgaattgcaacaaattttggcgaattgtcggtgttgtacagtccatctttgtgcattgaacacgccaaaatgttacgaacggttacagtggaaactgcgtgaaagaaattggagtaaaaaacattaaaaaatcagtaccaagtctcagcgattggcgcaaaatgccacccgatggcatgtttttctcctgctccaactgaaaatggaaaggttttttttgattttgccagtgattaaaagaaaatcaaaatgaatgaaatttggccgcacttcgtttagactgacgcccgaggcgaacacaaaaacatcggaaagttcggcaaaagtggcaataaaacgggcggcgtcctcaatgtccaactcttgctgggtggtgtcgttgatttccaattcgctctgaaacaaacattgctatcagagaaaagagacaccaattgtaattgtaaatattagttaaaaatgaatttcaactttacattcggtgccgttgcggcggccaacagtggaagcagtccaccgcatgccattgtcagactgtcgccgagttggctgagcagatggatggtgttggcgatgaacacctggttgtccgcgttgttcagatggtccgcaatcggtgtgcccgaacttaaagccgattagatttaggcaattataaaatgccactgctttcgaatttgccataattatcccccccctgattaattggaaatcccagtttcggactaatgaatgtattatagaacacaaactcgttccattcctgcaccacactctcaatggactcgagcaggtcggacagcagacggatgtgcaccggtgaccaagtggtcgggcgtccgatacagtgccatcggttgctcaccagcagactcccccgcctggtgctcaaactcagtccgttcggccaacctcttctccttttgcaggactttgcgccgatatttctcccatgagacctaaaattgtcgaattcactttttttgtttaaaaaacaggggaaacggagtgggtcaccatgaaaaaaaggggagggtcaccgaaatttttgcggatatatccagccatgtaaatcaatgacttttttttttaaacttcttttgggtaacagggggcggtccttctgccggccaataggcgcatgaggaaaattttttgaatttgtttcaaattgagaaaaagcagaacaccaccaacctttgagtgcgcaattgccatgctgtcaacctgcaaatcatcatttatttcccgtaaaacaaattttaattcgaaaatgtcttacccaaacgcgccatccgccgtattcgagtcgcatggcatggaacagcagaacggcgaacaactcgtagaccaactcggtgacctgtttctgttggtcgtccgttggggaatgtaagcgagtgaaatgaaccattcctaaaatggcacattttgaaaaaaaaaattgacctaaagcctgagtgtgaattagcatgcccttaggtttacataacaatcctaaacttttgttaaaaaagattactgaataccggaccaaaaaaacaggtttctcttagttattaggacggcaaaataccatggacacacaaaatgtcacgggacgcgtaacagtttttggtagtgttaagtgtgataggacatgtaaaaccaactacctagaacccaatggactttggcgcttatgtggtttacctcgcaaattttttttttgtttgtcttaaaaaaactcagggattctgatgaccgctgaacacgaatccgacttttatttcatcctttcgaactccgaactaatttttggtcccaagttaccgagttatacccatgcgaacattgatttggataattttgtccttttgattttgaatttgcgttttcagattaaatcaggacatatgtatgaacctagacgaatttgggttcggggttcgaaatagggtgaaatggacgccggatttgtattcagcgaccatcaaaacccctgaaagatttttttaaagacaaacaaacaaacaaattttatgggcgataaaccacataagtaccagaagaagtttatttggtttatttacatattgtctttagcttagaactaatttatggactaagaaagttaggaaacaagaaacgtatttatgattactagaatcgtttagatttaaaaacaaaaacaacaaaacaatttgtttgcatgtgtgccctcattgaatgagcttttttgacgatttcgacatcatttattttttggcattttgttttagcattttttaaatttctgattcgtcgtctcaccggacaatttttgtgtggctttgttcttacaatcatgtacaatgaatagacactgccaaatgagtgtaggggggaagtcaaaaaggtattcaaaaaagttgatattttttgtcattttacaagaaagttgttaatattcacantagtacatttgcgccttaaaca

SEQ ID NO: 6343 - DNA, 2927 bp, Heterodera glycines
agcatatactgcaaaaagaagaaaatttaaaaaaaaaagttcggaaaacaaagtttttgagtcccttcaggccattattttttttaaacctaatgcacgggtgtgatctgttcttattactaagatatgttctgatttcttaaacacactcataattttgaagttttatggcataatgtcaatattagtcaagaaattttcaagtttacgcaaaatttggtcatttttgggcaaaaaatcttaaaaaattattcatttaaaaatgcactgcaaaaaatgttaaaaatcaaaaaaataaaaaaaaatctgaaaaaaggttaaaaaccattttgatcacgattacactgaaattattttctgttaatttcctccacaacattgttataaatgatggaggtgaaaaatataatattttgatacttttttgattaaataaattgtaaaaaacagctgattaaagcaatttgcaaaatgttcttatttttggctttatgttcttatttttggctttatgttcttatttttggctttatgttcttatttttggctttatgttcttattttgaaatattaatggcaaaataataataaacatacagagaatattgaacaacaccaagaatgcttaatttgtattgataacggatgagaaaatttgtttttatggaaaaaactttttggaaaagtatggtaatttttaataaaaacaattggtaatttttttgcgcgatccgccacaactttttcggttccgcttctcaccccatggctctcttttctccttgaggaggaaatactttttttgaaaatgccgccaaataaaacgcaacaccaaaaaaatataagtacaattttcatttttttatttaaattttatgtcaaatgattaaggaaaaatggaatatttcagctctttcgttgactcttcagcaatggaaatgcaaattttgagcaaacaaagagagaattatgaagattttttctatttcctggcaaaagttttgagcaaatttggtggaaaattgacaaaaaatgagaatagggaacaaatcgaaattggcatcgatggggccaacaaaatattggaaagtttgaaaaattatgccgagaaaatgttgataaaaaaggctagagaatggcacccgtactacgagtgccaagcgaagaaaaaattggagcagcaaaatttacaaatggcagccgtcgaaattatgtgcccaaattttgtggacagtgccgaaatatttgaaattttaaacgggcaaaatgaattgtttaaatctgtgccaaaaagtgaaggaaatgatgaaaaagttgaccctaaattggtcaacaattcgcaactgttcaatttgttgtattcatttgtgacacgaattgaggcgataatttacggcaaaaatgccgatgggacaattattagagaggaaaaagcggcaaaaaaaagagaaaaaaatggaagcagaaaaacatggtgaaacgcccgtgaagagaatccatgcgtttattgctaccacaaaatgttttcaccttccatatcagcaaagatataagaaacttaggtcaaatatttcatccaattgagcgaatattaatacaatgtttaagctattaagggatgcattgaatttttatattaactcttttattaaagaatgttgattagttattttaattaaaaaattatttatacaatttaaattttagtacgtttgactcttcgattgaaatgcatcaaattaattcaaaaaaattggtagttgcaataaagaaggaacaaaaagatgttaacaacatcaaccaaagtaataatttgtaataaaaaaaagaatcaaattcatttaaatgtatcattttataagttgaaaatcaaattaaaataattcgataaaaaataaattttcatttgaaaatagagaaaattaattttaaacgatgagaattttagatacttttattttgctgaaagagctaaatgcgcaacaattttcaatttatgaatcacaaaaattgatcagaaaactttattgtcgggcccagcagaattgcgcaacaaaatatttcactgatttaaaaatgctttcaattcttcaaaatttattcgaccaaattcacaatgagcacaaaggtctcaaattcaaagtcaatttttgggaatgcttgtttgcacgatttgccaaaagaatttcctcaaaacttgccaaaatgctccacgaaaatgggattaagccggaagagcatttgctatcgaaagctttggagaatcaaaaagaaatatttgaaaatacttttgttgccgaccattgcaaagcattgcaagagttttattttctataaataaatttaaaaataaatattatatttaaaatctgagaattctaagttttgaatttaagaaagaactcagaagacgaaataatcggtcaattgaataccattcgatatgatttggttattaattttgaatacaatgcgcgaaaaggtggttaatgtaaaatattaattgatattttaaacagtgagtaattaaattcgtttatttaattaattacgattaaataagtttttaaaaaatattattttttattaagatttatatgaaagagcagacgatttgttaaaactattgtccgagattaacataaatgaaaatgatgatgagaaaaatgccgatggaacaacaattatttttggaactgttaaacaaattaattcttttggacaacgcaaatggccaaatgctaagggaaagaaaaagcgaattggacaaattgctggtcgttagccggctaattgagaagacgaaaaaggatttaattaaagcgaaaaaagcaatgtttaaaaagctaaatgaaattgccaaattggaaattgaaagacggggagcaagcggagagtgccaagaaaagccatggcaaaattggacc

SEQ ID NO: 6344 - DNA, 4166 bp, Heterodera glycines
tattaaactagcgcaggcgcgctcgcttcgctcgcgcacctcgcgctagccgagctttgaaaaaatttattatcttctctctctctctctcacctctctttctttctccctctcctctttttctctctctctcactcttcctcctcttttctatctctctcctcttctctccctcctctttctttctctctctctctcctcttttctatctctctcctcttctctccctcctcttttctctcccttctctcctctctttctttctctccctcctcttttctatctctcacctcttctctccctcctcttttctttctctctctctctcacctctctttctttctccctctcctctttttctctctctctctcttcctcctcttttctatctctctcctcttttctctttctctctctcttctttctatctctctcctcttcactccctcctcttttctctcccttctctcctctctttctttctctccctcctcttttctatctctctcctcttcactccctcctcttttctttctctctctctctcacctctctttctttctccctcctcctctctttctctctctcttcctctctctctatttctctctctctctctctccctcctctatctctctcctcttctctccctcctcttttctctctctctcctcctctctttctttctctctcctctttctatccctcctctcttcctctctctcctctctctcacctctctctcttcctccctctcctctttttctctctctctctctccctcctcttttctctccctcctcttttctctctctctcctctcttctttctctctctctctcctcttcactccctctctcctcttctctcccttctctcctctctttctttctccccctcctctttttctctctctcctcttcctctctctcctcttttctttctctctctcctcttctccctttctttctctttctccctcttctgtttctctctcctcgattttatgtgctcgctcataacacaaaaaagacgtaaacaacaaacagaaaagaaaagaaaaaaagactgaactattttccaaaaggaattcgtttcgataaattgtttacttttaaatgtattagttacagcgcaaaattaggttcatttctcgtttttagttatacagaaatttaaatttttcttttggcacgataactttaataaatattatactatactctcattcattagttgttcattcgcagtactaaccgaaatatagattcacactttttctttatttatttcgaacatttttgaaatttattagctacatacctaattcgtaataattttcttttcattaggtacttttctgaattctcttcgcttttctttatctgtaaaaatgcgaaacagctatgatcggtacgggtgagagctttgttcaattgtttccattttaaaagttcagaggtgggaacagaagtggcgggggatttggcggaggtggtggagcttatggacgaggtgccagtggtggtggttacggagcgcgcggaggcagcggcggttatggaggaggaggaggagcacctcgtggtggatatggcgccggcgggggaggttttgggcctccgccttctggctacggagcgcctgaaccatattatggaggatatggtgcacctccgccctttggcagcggcgggggagggtacggaggcggaggtcgcggaggaggcgggcctggtaagtgataactgaagtttaccgtttgctgatacaaacaatcatggcgaacttattcttaggtggcagacgtttggacgacgcaggctcaaaattaagacctgtcgactgggcgaggcaaaatctgaacccaatcaagaagagtctataccacgaacatgcttcaatttcgcgtcgaaaccaagccgagattgacatgtggcttactgaaaatgagtgtaccctacagggcaccaatattccgcgtccaattttccatttcaacgagagcggatttccaggtttggaattgcattttctagctttgcctaaccttcattcgctttaagacccgattgtccatcttctttctgtgcattatcacattccgactaccatccaaagcatttcgtggcccgtcgcactcagtggacgcgatttgatctcaattgctaagacaggctcaggcaaaacccttggatttattctacctgccatcgttcacactatggcccagcctccacgtcgaccaaatgatgggcctggagtgcttgtgctgcttcctactcgcgaattggctgtgcaggtggagcaagtggcacgagaatactgcaagctgatgaaattggatgtgacttgttgttacggtggagcaccgaaagcaggacaggcaaacgatttgcgaagaggttttccgaaaaagccatgacaacacccatcgttatctagtttaggcgtcgatatttgcgttgccactccggggcgcattctcgactttatggaggccaataccaccaatatgcgtcgctgcacttttttggttttggacgaagctgaccgtatgctcgatatgggatttgaacctcaaattcgcaagattgttggccaaattcgggttcgtaattttcaatacggcatacaaattgacgttactgaggagtttttagccggatcgtcagtctctgatgttctcggccacttggccaaaggaggtgcgctctctcgctgccgatttccaagtgaatccggtccatttgaacgtcggttcgttagagttggcggccaaccacaacatccaacaacacgtggaagtgattgacgagtactccaaacagggccgtctcttcgagttgcttgatcacattatgcgccaggtaaatggggttaatggttgttgatcggtgaggagacggcgcttttctcttttcttctcactcctaccattggtgagagggtttagcaaagcgcaaaaacaaaagggccaaattgcaaccgttgttagctttttttctgaagctttcacgtacttatttctggccacattctttttatgcaaatggcattttcttaattcctgatgtttagcgcgaatgcaaaacgctgatttttgttgaaacgaagcgtaaagccgatgacataacgcggaatatgcgacgcgatggttggccggcgttatgtatccacggggacaaagaacagaaagagcgcgaatgggtgctcagcggttcggattttttaattggtttatagaaactaaatgtgatttattattgttaactctttaaaaatatgaaagaattaaaaagaatttttgcctaattcagaattcaaagaaagcaaaacgcccattttgcttgcaactgatgtggcggctcgtggcttgggtattattttacggtgtataaaacgaaaattccctttgtaattttatatagtttggaataaaatacaaaaaacaaaatgaaggaactcaaaattagtcggatttgaatttggatttacaatgtttggggggcggggtgttccatcggtggtttcttttggtttgccgttcgtgtggatcggatggtcacgtggatagttccaccccacttccacatttcgcacttccctctaacagaagcatagtggtggtggtggtgcaattacagcagaatcggagaatgaattggtcgtccgcaaaaagggacgtccgggaagagtggcggtggatgtgaggtggtggggcttcggtcggattggcctcggtcggactcgtcgtccttccgtcggctgccccatcgatgtgctctgtttgtggctgcggttcacacgattaatggcaatacatttgtgtgttattcgtcgtcgtgatggcggcggcggagggcacacgcacaaaaatggccaacctcaaagtttccgcaaagctccgttgtgtccgcgattcgttaaaattgtggtacaacacggagtgcggaaaaaggttggtggtatatattttgttgttctcgccttttctggcctcttattctcattggcgagttatattttgttttcttaagatgtcagcgacattaaatacgtgatcaatttcgattatccgaacaacagtgaggattacgtgcaccgcatcggacgcactggacgtcaggataaaacggtcgttaaaggagcacccccacccctaa

SEQ ID NO: 6345 - DNA, 888 bp, Heterodera glycines
  misc_feature (36)..(36): n is a, c, g, or t
tatatagaattcaaaaagcatatttggataagtttntgggcgagattccccccctcctaaataatctcaaaaaaaagaaaatttcccaaaatatgggggctataactcacagtgcatatctatcataaaatgggcatttaagcgttggcgtccggtggatgacgacggaccctccgaaaagcgtggaagaccaagtgactccggcggtttcagtggagggaccaactcgtgggcgagttcgaatggttttcaacaggcccgttggtgaatgggaggaaaaacgaatggagaagaaagagtgtgcaccggaagaaccatattaagagaatttctaaggtgttggagcgaaagtatttttagataaaaccaacttaattttatgattttttgctctaatgccttatttgcttatatattttttcaatttaatgaaatttccacgtatattttctgtcattggttgcgttttttgattaaagtccattcattcgtcgcgacttattctatcgttttctcttctcctcccaattctcgctacgcttctctttcgttcctttaaaggtccaataaattctctgtttggtgttaatgtaactttttcgtgcatttcatttaaaagcgatcgaacttgttgctgctgttttgtgaaaacctttttctgttcgaatttccccttttacgttgggtgttccttcaccccccccccccttttcgtcttattttcctgtttggaaagggagtgaaatgaaatgataaaggaagggacggagaaagggaaggtattgaattccacgaattgacagcgagcgaagggatgtgaataatttgagatttgcggaagacaatgaaatgaacgaagggaggggaaacgaaataagacaatcgatc

SEQ ID NO: 6346 - DNA, 1247 bp, Heterodera glycines
  misc_feature (9)..(10): n is a, c, g, or t
ttgcatgcnnctgcaggtcaaatgtgatttcaatattcaatttcttttttatcattttccttttaatccatatttttattcactaaaattccaaaaaaaacttattaattcgatttaaaaactttttcttataatctatttaataacaccaacctttggtgcatttggccaagtaacaaaaatggtcatcgtcctcacaaaaatccaatttaatgaactcctcccccgcgaagcacaacagcccatcgggcacgcgcggacgtttgaagtgcgtattgccaaagtctttgtccttttccccaaattcggcatggcaatgcacatttggcacactcaaatttttctcataataatcttcgaaccatttttctttgctttctttcatatccattgaggcacaagcccaaaaaattgccgacaaaccgttaagaccggctgaaataattataccaaaattcggtaagacttttgataaaattaacgatagttttttccagccaatgagtgattaattcacgagagaagtcattagaaaaatattcattagcgaaagaagccatcgcaaggattttgaatttttttttcattttgtttgttttaggcttgaaaatttcataaagcactcccaaaatttccgaatttttttgcagcactcataatgaactcccgagcataaattgtatgctatttgttacaataataaaaaaccaatccaaaaatgttaggcaaagttaagttttaattgtaaaataaataattcgacctttggtacagattatagctgcacagtaatcgaccgtatctgggcacgttctatttccaatttggtccctgaatccatagtcattacgaatgaatgagtagccgctcttgcagatcaaaccttgttgaatttgtttaatttaagtaattaaaacgctttaaatttattttaaatattcatgttcataattaataattaccactaaattaccataacagctccaggtcaaaacaggaatggtaagcaaaaagaaaaaaagatcatttttcattgcttatttccgtcaaaatattaattgagggaaaatcttatgggatgaattgattttgagttggattgcttaaatcagaattatgccaattaatttagattacaaaagtccgcactattttaaactgaatttttgtgtggcataatcaactatttatgcacacaaagtaatcaacgaattgtgcagatttcacactaatcaaaagctgatgat

SEQ ID NO: 6347 - DNA, 1496 bp, Heterodera glycines
agaccgataataaaaaacccgggatttttgtctaatgaaattctagaccgagactccccagcatgctaatgctatacgttatgctttaaaatatgatttaaatatttaaataaaaaacacatttgcataaaaaatggttcataattcactaaaaattatgataatttttatcaaaaaataatatggtaaatgaggagttgagaaacaaaaatataaaaaaaatacaaaatcatgaagaaattaaatttggtattttgctcatttacaataatattgaaattattaagtgatgagcgaatatacttagaattaaaaatgattagaagatggagcgtttgtttgtgtgaagcttacaaattagctggcccttttttgaatgttaagatttaaaaacagttagggcttggatttatatggaaattactaggagtacgaacttaaattaataatttaatgaaactttacgaaatttataatcaatttgtgaaaatttatgtccctatttctgcacttaatgtccacattttggggtttttgcttcgttttttttactatatttcacgattttatatgtccatataatctcaaaccctattataaaccacgggaagaaaaagaccggcggatatttcatatctccattggtcgtttacatcatttgccggattttgcaaaaccaccgtggcactcgcactgctttggtgtggactcgaaaccaagttcaaccattttctgggcacagctcagcgtaagatttgaagtgcaaccccactctttaacatttcttttcggatcattgcctgatgctgtgaaaaaataccaaaaactttgaaaattttttaaaaatggaaaaaaaaattattcataaatagaaataatatttttatgcaaatttatattttcttggcggtacgacaactgcgaaccggcaattgcggaccggacatttgcgggcggacgacaattgcggacgacaattgcgcactgtacttttacggacgacaattgcggaccgtacttttacggacgacaattgcggacgacaattgcggaccgtacttttgcggacgacaattgcggacgacaattgcggaccgtacttttgcggacgacaattgcggacgacaattgcgcactgtacttttacggacgacaattgcggaccgtacttttgcggacgacaattgcgcactgtacttttacggacgacaattgcggacgacaattgcggaccgtacttttgcggacgacaattgcggacgacaattgcgcactgtacttttacggacgacaattgcggaccgtacttttgcggacgacaattgcggactatacttttacggacgacaattgcggacgacaattgcggactgtacttttacggacgacaattgcggacgacaattgcggaccgtacttttacggacgacaattgcggacgacaattgcggactgtacttttacggacgacaattgcggacgacaattgcggactg

SEQ ID NO: 6348 - DNA, 1757 bp, Heterodera glycines
aaaagtacggtccgcaattgtcgtccgcaattgtcgtccgtaaaaagtacagtccgcaattgtcgtccgcaattgtcgtccgtaaaaagtatagtccgcaattgtcgtccgtaaaagtacggtccgcaattgtcgtccgtaaaagtacagtccgcaattgtcgtccgtaaaagtatagtccgcaattgtcgtccgtaaaagtacggtccgcaattgtcgtccgtaaaagtacggtccgcaattgtcgtaccgccgttttcttttcttcagagcctaagaatttaatcgttaaaaaagattaaaacctagatgcgatttgtcgtaattttattaaaattcataataaaaatttctatccatttcttacggtcctcgcaagaaatgaagtaacacgcattcgtgtctgggccacattcgccgtttgaagttttgttcccaaacgcaactcgaccaattttgcacttatttggagcggcttaaacacacgaccaaaaaacagttaaagattttaattaatcatatccggacttggtgcaggcattattatgccatcatttgagccatgtacaacagtggaaacgcacaaggaattgttcgggattgtactgatgtaagcaaaatcgcgccctttgccctggataaattcatccgtgtcgtactctctttcagtacagccccattccgtgatgatttcagattgatggctatccttattgactgaaagtcggatcaaaatttagattggacgacaaatattccgaaccgtaaggatttccatgaaaaattgtcaaaactaattctacgaaaaataaaaatataaatcactatgaattatccaattatttaacaatcccctttcatacatttgtatgaatatatcattaaatttctaatattatgtccaaaaacttaaaaaaatgagtcatattttttgtattgttttatttatagagaaatttgtgcctaatttaccataaaaatagagaaagtttttcttgaattcaatcctctccctgaattagaattcacccgaggggggagggggtgaaaaatttagtccaagatggactccaattaattaaaataaaaaaaagtgcgtttaaaagtcatttgcctgtggaacaattcaacatgtagcaaaagtgcttaaattggtcacatttgttgtcgctgctttcattatgaccaagcatctttgaaaagtatgcctttttgcactctttggctaaaacaattcataattataaacaaatttttgtttaaattaatttgcctggaattggcacagccattgcagcgttggacattgacacatccgcttcactataattgtgcgcgcaaaaatggtccatgattttgattgtatcattttggtcgatcaattctttgggatcagtcagaggactttcattggattgtttgtcggtgcagccccatttagtcaacaagccaaattccaaatcgaatgatttatttgcagcttcaaaaccaaaataattgattattttttaataaattcattatatattacattagtgatgctcaagaccgagactcggccccgagacccgagactgagaacgaaacatcgagacctagacccaaaaaagccgagacttttttcgagtgatactcgagaacgagactctcggtaacatttaaataataataccaattttcgacataatgatttcgttaattttcatttttgttttttattatcgcctttttgagtttaaaaagtttacaaatttttt

SEQ ID NO: 6349 - DNA, 3408 bp, Heterodera glycines
ataccaattttcgacataatgatttcgttaattttcaattttttgttttttatttatcgccttttgagtttaaaaaagtttacgaatttttttgtttattttcgatattaaatggaaaaagttagcatatttttgtttaacatttttatctttatcctcaaaacagtgcggccatgataaaataaatcctgaataataaattttatttttaccaagattgtcgtttaaatagataatttttgattgaaaagttcaaattttatgagaatttaaactttatttggctttttaggcataaattttcgcgaattcttattttcaattattattcaaaatatgttaataaaaacccagaacgccttccggaaacaaaatacctgtaagcacaattgtacaattgagcacatagcagtaatgctcgtttggcttacaaaaagtcatgttgtctccataattgtgtgtgttccaaaaatggccacctttgcaccaatgggtggtaattgcttaaaatggcaaaaaaaacttccaacatttcttaacaaatttgttaaaattgtacaggcattgaagattggcacttccttgttaaggtttgacatgtctttgttctttttgccaacaaaataattgcaggtggacttgaaggacgggctttcgagccaattgttccgttttttaaaatcatcataaaatgattccttcttcacactgcatccccactctgttttgaatccgacatagccttgatatgacgaagaaactaaaattttgtaggaaaaacattagcataagtgctgcaagcttgtaatattaaaaaaaaaatttttaatcatgtattaattattaaaatacattattattgtaaaatcctgcaaattttattaacttaaattaccatttttttgaaaagtaaagatcattattttgtaccaaatttttgaataaataaaaccattttttcgaattccaaaaaatattatattttaataaagaactaattatgtattttggtggataatggtcgaaatattttactttcttaagggtgcagtatttttcaattataatgtctttttgtgagaaaatttcacgaaaaaataattaagcataaaaatattcccgatttaagcaaaataaaggaagaaaaacttatgtaatgtttctctagtttggcaaattcaacgaatggcgctaattgtaagggcaaaagcattgacttgtggtgcagttcagcacgtaacagtgccgttcggccacgctgcacgccttgtcctcctgctcattgtaaatgttccccgccgggttcgactcaaacgtcgcttttttgcatcgcagaaattcgtcagtggttgttgtggtgctgatggtcgtagttgtggtggtggtcgtcgtagttgtagaagtggtctacaaagacagatagacatatttgtaaacatatatttaaaaccaggggttggattatatttgaatgtcaatactactaatagacccttttgtgggaaatttgattaatcggaccccctattttcaaagtgtttttttgaaatcgtcccacataaaagtgcacaggcagtataatataatattttaataaaaattatatgtaataataaattaattataattttatttttgtgaaaaaacatttttaaggaaaataaaaataaaaatttattttttgtattttgttttttagcaaaaatttaaacctttactgtatttgagatattgaccataaatttgagtgatttctatcagactaactaaactacagtattgcaactgataaaccgtaccgtaacacaacatttcatttcgtacccaggcccacagcagccggaatacgtcatccatacttccggaattggaatgcatgaatagagaccgccgcactgcttgcagtctcgttccggattgcatccttccttcacttctctattcttgctttgttcatccacaattttgaatgcaccttccacatgtggcaccattttttcggaatttttgtacaattcatatttctaaatatgtttatgttttaaattttttatagtaaacaaaacaaaaattaatttaaatttatttatctaattgtaagaatgacaaatcactattttttttattgaatacaatattgtaccaatttgtattccgggaaacggtcagaaagtatagtatgcacctaaaaattgaaaaaatatatgaaattggaaaaaatcgacaaaattcaaaatagtgcataatgcgattattagaaatttaaattttttataaaattcaacacttacttatcagtaggggggctgtcaaaaatatataaaaagtagtaaaaatatgtacataaatatgtaagaaaaatcacgaaatatgtacaaaaaaatcccaaattgtaaaatatgtaaaaaaaattgaaaatatgtacaaaccgaacggatttgcaaaaatttcgtaaaaaatcctcaaaatatgtaaaaaaaataatatatgaaaaaatccaaaataataccaaatatgtaagaaaatcccaaaatttgtaaaaaaaaaatgtaaaaaaatgtaaataaaagtcccaacttttgttagaaaacacaaaaaagaaagtgttcttcctactatttagagcatggagaattctttaacaaatatgtatttacatacataaaattgacagccctacttatgagggattacaaaaattaaaataataatttagcaatgttttaaattaaacagaaataaattcaaaaacttatagccatataagggttttaaaattaattgatcctaatttttaaagccaaatgaattttaatttggatcatttaaatgaaacaaagagttaaattgtcaagttcttaatggtcgtgtaaatttttatgatcgagaaaagtgtattgagctcaattttccattcctactaattaaaatcttacaaaattgtagttttggtaacatattgtttcatagtttggggaacaacattcatcatctccttcctcttccagtagaacacaaataatttttccaggatgacaatttctaaaattaaataaaaattcattttaaaattaatggctcaattttgtcaaatgattaaattagggttgctctccaacccctcgggggcaaaatgtcgagagccgtggaccatagtccggggaccccgatcgggtagtgagtgatcaacaaaaaatttttaacgaaaaaagccaattttaaccgaaatttttgctaacgagtctggggggagaggggtgatcacagcgccaatttgtgaaggagtatgaacatcgtttgacgaccctttttttgctttttctaaactggttttttgtggcgtgcattttccaaaaatttttggggggaataaaggagcccggcggtgcagataggcgccgccgaaaa

SEQ ID NO: 6350 - DNA, 1582 bp, Heterodera glycines
ttttgctctttaaaataaaaaacatacttcaattttgcaaggcaactttcgtagcgtttatcgctttgcactgctgcatcaacagcccccgcagcaattccaatcacaactccaaaaaaagtgccaacaggtcctgctaatgaaccaattgcgccaccaatcgaagcacccaattctgctccttcaaataacttgccgtcatcatcatttttaaatttgaatgcagctttcacatattcactttcagttttgataatgctgggaatcaaacaagcaaaaagaatgccgaaaatgaaaggcttacattttacaagcatttttgcttaaatttgtccaaattatgcaaagtaaaatttcaaaaatctttttaaatcatcagcagggtgtgtgttgatatgttctgatttatcaagaatattaaataaatattgcccctggcaaaaacattgggattttctgattttcgccaaaaatctgctttttcataactaatttctgtcttttaattttggcaaaaaagacatcctgttttaaatgagctaataataaaaattatttatttcataataaatgtatagtttgccaaatgatttcaatgttaacagaattttttgattctctgtatttattggtgattcaccagtagaatgaacaaactatctaatttcccaaaaaaatgctaataaacagcgaatgtaaattcacataaaaggaatttgatgatgtgtaaaaaatggttttcattaagaaaaattgtctttgatattttcttttttttcaattttataaatcatagttgaaacaagtttttgttttgaattatgaaaaattttggcgttaaaagtgttttttcattattcacaaaatgttttaattataaaaataaaataatttaaactgatagtatccatttcttgaacaaattctccattagcctacaaaaacaaaatttttgtcatgttccaaaaaaatgtgagcaaaaatgtacaaaaaaaaaaattttccttttcattgtttcaaattttttaatgagtaaattttttaaattttgtatgctagagcataagaagctagtgctttttatctattgatatcaacttgataagttttttttttgagtttaagcaaagttatgatagattatttgttcaaacaacgcccatttcgcatttctggtgaaatctgtttaaaaaattgaaaaaaaagtctaaatttggctaaaaagcattcttataaaaaaacttgggacgtttatatattttaaagtcctttaaaattcaaattagccacatcacccaaggtattacgcgattttcctgtaatttttatttgtgattattttttttttattcttttcattcatcattgaaaatcatttgcatttttaatgggaaagcagtaaatggaatttaatgtgatgaataataatggtcaaagaaggaaaaaccaaaaaaaaggagctagttcttatgatattcgattaacaacacaaaaattttacgaattatataatcctattttttcatttttaggaattaaaataaaaaaatgcctgtaatatgcctgctgccttcccatttat
